(12) United States Patent
Corey et al.

(10) Patent No.: US 8,222,221 B2
(45) Date of Patent: Jul. 17, 2012

(54) MODULATION OF GENE EXPRESSION THROUGH ENDOGENOUS SMALL RNA TARGETING OF GENE PROMOTERS

(75) Inventors: David R. Corey, Dallas, TX (US); Scott T. Younger, Dallas, TX (US)

(73) Assignee: The Board of Regents of the University of Texas System, Austin, TX (US)

( * ) Notice: Subject to any disclaimer, the term of this patent is extended or adjusted under 35 U.S.C. 154(b) by 238 days.

(21) Appl. No.: 12/455,588

(22) Filed: Jun. 3, 2009

(65) Prior Publication Data

US 2009/0326051 A1    Dec. 31, 2009

Related U.S. Application Data

(60) Provisional application No. 61/058,909, filed on Jun. 4, 2008, provisional application No. 61/172,556, filed on Apr. 24, 2009.

(51) Int. Cl.
*C12N 15/11* (2006.01)
(52) U.S. Cl. .................................... 514/44 A
(58) Field of Classification Search ................. 514/44 A
See application file for complete search history.

(56) References Cited

U.S. PATENT DOCUMENTS

| | | | |
|---|---|---|---|
| 5,859,221 A | 1/1999 | Cook et al. | 536/23.1 |
| 5,877,160 A | 3/1999 | Harper et al. | 514/44 |
| 6,506,559 B1 | 1/2003 | Fire et al. | 435/6 |
| 6,673,611 B2 | 1/2004 | Thompson et al. | 435/455 |
| 6,867,349 B2 | 3/2005 | Ekker et al. | 800/21 |
| 2003/0143732 A1 | 7/2003 | Fosnaugh et al. | 514/44 |
| 2004/0259247 A1 | 12/2004 | Tuschl et al. | 536/24.5 |
| 2005/0032733 A1 | 2/2005 | McSwiggen et al. | 514/44 |
| 2006/0185027 A1* | 8/2006 | Bartel et al. | 800/14 |
| 2006/0205635 A1 | 9/2006 | Corey et al. | 514/44 |
| 2007/0111963 A1 | 5/2007 | Corey et al. | 514/44 |
| 2009/0298910 A1* | 12/2009 | Griffey et al. | 514/44 A |

FOREIGN PATENT DOCUMENTS

| | | |
|---|---|---|
| WO | WO 01/75164 | 10/2001 |
| WO | WO 01/83793 | 11/2001 |
| WO | WO 03/070918 | 8/2003 |
| WO | WO 2006/113246 | 10/2006 |
| WO | WO 2006/130201 | 12/2006 |
| WO | WO 2007/086990 | 8/2007 |

OTHER PUBLICATIONS

Cheng et al. Nucleic Acid Research 2005, 33, 1290-1297.*
International Search Report and Written Opinion, issued in Application No. PCT/US2009/046127, mail date Nov. 5, 2009.
Hwang et al., "A Hexanucleotide element directs microRNA nuclear import," *Science*, 315:97-100, 2007.
Kim at al., "MicroRNA-directed transcriptional gene silencing in mammalian cells," *PNAS*, 105:16230-16235, 2008.
Rossi at al., "Transcriptional activation by small RNA duplexes," *Nature Chemical Biology*, 3:136-137, 2007.
Affymetrix/Cold Spring Harbor Laboratory ENCODE Transcriptome Project, "Post-transcriptional processing generates a diversity of 5'-modified long and short RNAs," *Nature*, 457:1028-1032, 2009.
Aartsma-Rus and vanOmmen, "Antisense-mediated exon skipping: a versatile tool with therapeutic and research applications," *RNA*, 13:1609-1624, 2007.
Braasch et al., "RNA interference in mammalian cells by chemically-modified RNA," *Biochemistry*, 42:7967-7975, 2003.
Check, "RNA interference: hitting the on switch," *Nature*, 448(7156):855-858, 2007.
Corey, "RNA learns from antisense," *Nat. Chem. Biol.*, 3:8-11, 2007.
Czauderna et al. "Structural variations and stabilising modifications of synthetic siRNAs in mammalian cells," *Nucleic Acids Res.*, 31(11):2705-2716, 2003.
Elmén et al., "Locked nucleic acid (LNA) mediated improvements in siRNA stability and functionality," *Nucleic Acids Res.*, 33(1):439-447, 2005.
Gingeras, "Origin of phenotypes: genes and transcripts," *Genome Res.*, 17:682-690, 2007.
Griffiths-Jones et al., "miRBase: microRNA sequences, targets and gene nomenclature," *Nucleic Acids Res.*, 34:D140-4, 2006.
Griffiths-Jones et al., "miRBase: tools for microRNA genomics," *Nucleic Acids Res.*, 36:D154-8, 2008.
Griffiths-Jones, "The microRNA Registry," *Nucleic Acids Res.*, 32:D109-11, 2004.
Grimson et al., "MicroRNA targeting specificity in mammals: determinants beyond seed pairing," *Mol. Cell.*, 27:91-105, 2007.
Han et al., "Promoter-associated RNA is required for RNA-directed transcriptional gene silencing in human cells," *Proc. Natl. Acad. USA*, 104:12422-12427, 2007.
Janowski et al., "Activating gene expression in mammalian cells with promoter-targeted duplex RNAs," *Nat. Chem. Biol.*, 3:166-73, 2007.
Janowski et al., "Inhibiting gene expression at transcription start sites in chromosomal DNA with antigene RNAs," *Nat. Chem. Biol.*, 1:216-22, 2005.
Janowski et al., "Inhibiting transcription of chromosomal DNA with antigene peptide nucleic acids," *Nat Chem. Biol.*, 1:210-215, 2005.
Janowski et al., "Involvement of AGO1 and AGO2 in mammalian transcriptional silencing," *Nat. Struct. Mol. Biol.*, 13:787-92, 2006.
John et al., "Human MicroRNA targets," *PLoS Biol.*, 2:e363, 2004.
Kaihatsu, "Recognition of chromosomal DNA by PNAs," *Chemistry & Biology*, 11:749-758, 2004.
Kawasaki and Taira, "Induction of DNA methylation and gene silencing by short interfering RNAs in human cells," *Nature*, 431:211-217, 2004.

(Continued)

*Primary Examiner* — Brian Whiteman
(74) *Attorney, Agent, or Firm* — Fulbright & Jaworski

(57) ABSTRACT

Gene expression can be selectively regulated by endogenous miRNAs that target promoters of genes. Altering of the activity of these promoter-targeting miRNAs with single-stranded complementary oligonucleotides that bind the miRNA causes modulation of expression of the target gene. Endogenous miRNAs that modulate expression of target genes can be identified by (a) evaluating an endogenous miRNA for complementarity to a target gene promoter; and (b) determining that the complementary miRNA modulates expression of the target gene.

19 Claims, 15 Drawing Sheets

OTHER PUBLICATIONS

Keen and Davidson, "The biology of breast cancer," *Cancer*, 97(s3):825-833, 2003.

Kim et al., "Argonaute-1 directs siRNA-mediated transcriptional gene silencing in human cells," *Nat. Struct. Mol. Biol.*, 13:793-7, 2006.

Kuwabara et al., "A small modulatory dsRNA specifies the fate of adult neural stem cells," *Cell*, 116:779-793, 2004.

Lagos-Quintana et al., "Identification of novel genes coding for small expressed RNAs," *Science*, 294:853-8, 2001.

Lee et al., "The *C. elegans* heterochronic gene lin-4 encodes small RNAs with antisense complementarity to lin-14," *Cell*, 75:843-54, 1993.

Li et al., "Small dsRNAs induce transcriptional activation in human cells," *Proc. Natl. Acad. Sci. USA*, 103:17337-42, 2006.

Li et al., "Small interfering RNA directed transcriptional activation in human cells," *Proceedings of the Annual Meeting of the American Association for Cancer Research*, New York, New York, 46:1436, 2005.

Liu et al., "Argonaute2 is the catalytic engine of mammalian RNAi," *Science*, 305:1437-1441, 2004.

Meister et al., "Human Argonaute2 mediates RNA cleavage targeted by miRNAs and siRNAs," *Mol. Cell.*, 15:185-197, 2004.

Morris et al., "Small interfering RNA-induced transcriptional gene silencing in human cells," *Science*, 305:1289-1292, 2004.

Office Action issued in U.S. Appl. No. 11/559,566, dated Jul. 9, 2008.

Office Action issued in U.S. Appl. No. 11/559,566, dated Sep. 30, 2008.

Office Action issued in U.S. Appl. No. 11/559,566, dated Feb. 24, 2009.

Office Action issued in U.S. Appl. No. 11/559,566, dated Aug. 5, 2009.

Ota et al., "Complete sequencing and characterization of 21,243 full-length human cDNAs," *Nat. Genet.*, 36:40-5, 2004.

Park et al., "Double-stranded siRNA targeted to the huntingtin gene does not induce DNA methylation," *Biochem. Biophys. Res. Comm.*, 323:275-280, 2004.

Paroo and Corey, "Challenges for RNAi in vivo," *Trends Biotechnol.*, 22:390-394, 2004.

Place et al., "MicroRNA-373 induces expression of genes with complementary promoter sequences," *Proc. Natl. Acad. Sci. USA*, 105:1608-13, 2008.

Pulukuri and Rao, "Small interfering RNA directed reversal of urokinase plasminogen activator demethylation inhibits prostate tumor growth and metastasis," *Cancer Res.*, 67:6637-6646, 2007.

Riken Genome Exploration Research Group and Genome Science Group (Genome Network Project Core Group) and the FANTOM Consortium, "Antisense transcription in the mammalian transcriptome," *Science*, 309(5740):1564-1566, 2005.

Schwartz et al., "Antisense transcripts are targets for activating small RNAs," *Nat. Struct. Mol. Biol.*, 15:842-8, 2008.

Stark et al., "Identification of Drosophila MicroRNA targets," *PLoS Biol.*, 1:397-409, 2003.

Suzuki et al., "Prolonged transcriptional silencing and CpG methylation induced by siRNAs targeted to the HIV-1 promoter region," *J. RNAi Gene Silencing*, 1:66-78, 2005.

Takai and Jones, "Comprehensive analysis of CpG islands in human chromosomes 21 and 22," *Proc Natl Acad Sci USA*, 99:3740-3745, 2002.

Takai and Jones, "The CpG island searcher: a new WWW resource," *In Silico Biol.*, 3:235-240, 2003.

The ENCODE Project Consortium, "Identification and analysis of functional elements in 1% of the human genome by the ENCODE pilot project," *Nature*, 447:799-816, 2007.

The FANTOM Consortium, "The transcriptional landscape of the mammalian genome," *Science*, 309:1559-1563, 2005.

Ting et al., "Short double-stranded RNA induces transcriptional gene silencing in human cancer cells in the absence of DNA methylation," *Nat. Genet.*, 37:906-10, 2005.

Tsuritani et al., "Distinct class of putative "non-conserved" promoters in humans: comparative studies of altrnative promoters of human and mouse genes," *Genome Res.*, 17:1005-14, 2007.

Wahlestedt, "Natural antisense and noncoding RNA transcripts as potential drug targets," *Drug Discovery Today*, 11(11-12):503-508, 2006.

Wakaguri et al., "DBTSS: database of transcription start sites, progress report 2008," *Nucleic Acids Res.*, 36:D97-101, 2008.

Younger et al., "Endogenous small RNA targets gene promoter in mammalian cells," Gordon Research Conference, Salve Regina University, Newport, RI, Jun. 1-6, 2008.

Younger et al., "Predicting potential miRNA target sites within gene promoters." *Bioorg. Med. Chem. Lett.*, 19:3791-4, 2009.

Zhang et al., "Reduction of liver Fas expression by an antisense oligonucleotide protects mice from fulminant hepatitis," *Nature Biotech.*, 18:862-867, 2000.

Zhang et al., "Regulation of endothelial nitric oxide synthase by small RNA," *Proc. Natl. Acad. Sci USA*, 102:16967-16972, 2005.

Beane et al., "Inhibiting gene expression with locked nucleic acids (LNAs) that target chromosomal DNA," *Biochemistry*, 46(25):7572-7580, 2007.

Janowski and Corey, "Inhibiting transcription of chromosomal DNA using antigene RNAs," Nucleic Acids Symposium Series, 49:367-368, 2005.

Katayama et al., "Antisense transcription in the mammalian transcriptome," *Science*, 309(5740):1564-1566, 2005.

Office Communication, issued in European Patent Application No. 08835168.9, dated Nov. 18, 2010.

* cited by examiner

| RNA Hit | Name | NM Accession | Location (Rel. to TSS) | Target RNA (Rel. to Gene) | Chrom. (Target Gene) | Chrom. (miRNA) |
|---|---|---|---|---|---|---|
| hsa-miR-33a* | caveolin 1, caveolae protein, 22kDa (CAV1) | NM_001753 | -356 | sense | 7 | 22 |
| hsa-miR-129-5p | caveolin 1, caveolae protein, 22kDa (CAV1) | NM_001737 | -151 | sense | 5 | 7 |
| hsa-miR-129-5p | caveolin 1, caveolae protein, 22kDa (CAV1) | NM_001343 | -60 | sense | 5 | 7 |
| hsa-miR-130b* | caveolin 1, caveolae protein, 22kDa (CAV1) | NM_032900 | -402 | antisense | 10 | 22 |
| hsa-miR-149* | caveolin 1, caveolae protein, 22kDa (CAV1) | NM_021809 | -84 | sense | 20 | 2 |
| hsa-miR-151-5p | caveolin 1, caveolae protein, 22kDa (CAV1) | NM_006306 | -730 | antisense | X | 8 |
| hsa-miR-185* | caveolin 1, caveolae protein, 22kDa (CAV1) | NM_173468 | -675 | antisense | 4 | 22 |
| hsa-miR-194 | caveolin 1, caveolae protein, 22kDa (CAV1) | NM_020925 | -521 | sense | 1 | 1 |
| hsa-miR-220c | caveolin 1, caveolae protein, 22kDa (CAV1) | NM_198856 | -760 | antisense | 22 | 19 |
| hsa-miR-220c | caveolin 1, caveolae protein, 22kDa (CAV1) | NM_199193 | -884 | sense | 2 | 19 |
| hsa-miR-220c | caveolin 1, caveolae protein, 22kDa (CAV1) | NM_004858 | -185 | sense | 12 | 19 |
| hsa-miR-297 | caveolin 1, caveolae protein, 22kDa (CAV1) | NM_022459 | -874 | antisense | 13 | 4 |
| hsa-miR-297 | caveolin 1, caveolae protein, 22kDa (CAV1) | NM_004759 | -334 | antisense | 1 | 4 |
| hsa-miR-324-3p | caveolin 1, caveolae protein, 22kDa (CAV1) | NM_001025069 | -168 | sense | 3 | 17 |

FIG. 2

| RNA Hit | Name | NM Accession | Location (Rel. to TSS) | Target RNA (Rel. to Gene) | Chrom. (Target Gene) | Chrom. (miRNA) |
|---|---|---|---|---|---|---|
| hsa-miR-326 | caveolin 1, caveolae protein, 22kDa (CAV1) | NM_024919 | -924 | sense | 6 | 11 |
| hsa-miR-339-5p | caveolin 1, caveolae protein, 22kDa (CAV1) | NM_031301 | -928 | antisense | 15 | 7 |
| hsa-miR-345 | caveolin 1, caveolae protein, 22kDa (CAV1) | NM_005491 | -841 | sense | X | 14 |
| hsa-miR-345 | caveolin 1, caveolae protein, 22kDa (CAV1) | NM_173854 | -214 | antisense | 1 | 14 |
| hsa-miR-345 | caveolin 1, caveolae protein, 22kDa (CAV1) | NM_018444 | -864 | antisense | 8 | 14 |
| hsa-miR-34b | caveolin 1, caveolae protein, 22kDa (CAV1) | NM_002053 | -89 | sense | 1 | 11 |
| hsa-miR-378 | caveolin 1, caveolae protein, 22kDa (CAV1) | NM_018444 | -866 | sense | 8 | 5 |
| hsa-miR-513a-3p | caveolin 1, caveolae protein, 22kDa (CAV1) | NM_004389 | -197 | antisense | 2 | X |
| hsa-miR-545 | caveolin 1, caveolae protein, 22kDa (CAV1) | NM_016559 | -735 | antisense | 3 | X |
| hsa-miR-545 | caveolin 1, caveolae protein, 22kDa (CAV1) | NM_006255 | -724 | antisense | 14 | X |
| hsa-miR-545 | caveolin 1, caveolae protein, 22kDa (CAV1) | NM_175866 | -467 | sense | 1 | X |
| hsa-miR-545 | caveolin 1, caveolae protein, 22kDa (CAV1) | NM_152470 | -626 | antisense | 18 | X |
| hsa-miR-545* | caveolin 1, caveolae protein, 22kDa (CAV1) | NM_005896 | -219 | sense | 2 | X |
| hsa-miR-548b-5p | caveolin 1, caveolae protein, 22kDa (CAV1) | NM_000066 | -210 | antisense | 1 | 6 |

FIG. 2 (CONT.)

| RNA Hit | Name | NM Accession | Location (Rel. to TSS) | Target RNA (Rel. to Gene) | Chrom. (Target Gene) | Chrom. (miRNA) |
|---|---|---|---|---|---|---|
| hsa-miR-548b-5p | caveolin 1, caveolae protein, 22kDa (CAV1) | NM_201623 | -541 | sense | 12 | 6 |
| hsa-miR-548b-5p | caveolin 1, caveolae protein, 22kDa (CAV1) | NM_152852 | -449 | sense | 11 | 6 |
| hsa-miR-548b-5p | caveolin 1, caveolae protein, 22kDa (CAV1) | NM_007017 | -908 | sense | 5 | 6 |
| hsa-miR-548c-3p | caveolin 1, caveolae protein, 22kDa (CAV1) | NM_133650 | -526 | antisense | 6 | 12 |
| hsa-miR-548c-5p | caveolin 1, caveolae protein, 22kDa (CAV1) | NM_005139 | -450 | sense | 4 | 12 |
| hsa-miR-548c-5p | caveolin 1, caveolae protein, 22kDa (CAV1) | NM_006151 | -380 | antisense | 17 | 12 |
| hsa-miR-548c-5p | caveolin 1, caveolae protein, 22kDa (CAV1) | NM_024430 | -815 | sense | 18 | 12 |
| hsa-miR-548c-5p | caveolin 1, caveolae protein, 22kDa (CAV1) | NM_133460 | -744 | sense | 19 | 12 |
| hsa-miR-548c-5p | caveolin 1, caveolae protein, 22kDa (CAV1) | NM_014900 | -926 | sense | 2 | 12 |
| hsa-miR-548c-5p | caveolin 1, caveolae protein, 22kDa (CAV1) | NM_002786 | -520 | sense | 11 | 12 |
| hsa-miR-548d-5p | caveolin 1, caveolae protein, 22kDa (CAV1) | NM_001034173 | -934 | sense | 12 | 8 |
| hsa-miR-548d-5p | caveolin 1, caveolae protein, 22kDa (CAV1) | NM_201623 | -541 | sense | 12 | 8 |
| hsa-miR-548d-5p | caveolin 1, caveolae protein, 22kDa (CAV1) | NM_152852 | -449 | sense | 11 | 8 |
| hsa-miR-548d-5p | caveolin 1, caveolae protein, 22kDa (CAV1) | NM_007017 | -908 | sense | 5 | 8 |

FIG. 2 (CONT.)

| RNA Hit | Name | NM Accession | Location (Rel. to TSS) | Target RNA (Rel. to Gene) | Chrom. (Target Gene) | Chrom. (miRNA) |
|---|---|---|---|---|---|---|
| hsa-miR-566 | caveolin 1, caveolae protein, 22kDa (CAV1) | NM_022496 | -625 | sense | 12 | 3 |
| hsa-miR-566 | caveolin 1, caveolae protein, 22kDa (CAV1) | NM_007051 | -717 | sense | 1 | 3 |
| hsa-miR-566 | caveolin 1, caveolae protein, 22kDa (CAV1) | NM_001031720 | -473 | sense | 4 | 3 |
| hsa-miR-566 | caveolin 1, caveolae protein, 22kDa (CAV1) | NM_000411 | -583 | antisense | 21 | 3 |
| hsa-miR-566 | caveolin 1, caveolae protein, 22kDa (CAV1) | NM_017761 | -592 | antisense | 1 | 3 |
| hsa-miR-566 | caveolin 1, caveolae protein, 22kDa (CAV1) | NM_005480 | -471 | sense | 12 | 3 |
| hsa-miR-574-3p | caveolin 1, caveolae protein, 22kDa (CAV1) | NM_031901 | -785 | sense | 1 | 4 |
| hsa-miR-591 | caveolin 1, caveolae protein, 22kDa (CAV1) | NM_024817 | -833 | sense | 15 | 7 |
| hsa-miR-623 | caveolin 1, caveolae protein, 22kDa (CAV1) | NM_212471 | -546 | antisense | 17 | 13 |
| hsa-miR-632 | caveolin 1, caveolae protein, 22kDa (CAV1) | NM_024698 | -263 | sense | 11 | 17 |
| hsa-miR-646 | caveolin 1, caveolae protein, 22kDa (CAV1) | NM_197941 | -55 | sense | 5 | 20 |
| hsa-miR-648 | caveolin 1, caveolae protein, 22kDa (CAV1) | NM_001030059 | -747 | antisense | 10 | 22 |
| hsa-miR-649 | caveolin 1, caveolae protein, 22kDa (CAV1) | NM_006385 | -265 | antisense | 19 | 22 |
| hsa-miR-663 | caveolin 1, caveolae protein, 22kDa (CAV1) | NM_198240 | -185 | antisense | 12 | 20 |

FIG. 2 (CONT.)

| RNA Hit | Name | NM Accession | Location (Rel. to TSS) | Target RNA (Rel. to Gene) | Chrom. (Target Gene) | Chrom. (miRNA) |
|---|---|---|---|---|---|---|
| hsa-miR-663 | caveolin 1, caveolae protein, 22kDa (CAV1) | NM_014463 | -328 | sense | 3 | 20 |
| hsa-miR-663 | caveolin 1, caveolae protein, 22kDa (CAV1) | NM_001010875 | -55 | antisense | 13 | 20 |
| hsa-miR-665 | caveolin 1, caveolae protein, 22kDa (CAV1) | NM_006905 | -335 | antisense | 19 | 14 |
| hsa-miR-877* | caveolin 1, caveolae protein, 22kDa (CAV1) | NM_012182 | -41 | antisense | 15 | 6 |
| hsa-miR-877* | caveolin 1, caveolae protein, 22kDa (CAV1) | NM_003302 | -724 | sense | 7 | 6 |
| hsa-miR-1224-3p | caveolin 1, caveolae protein, 22kDa (CAV1) | NM_033310 | -527 | sense | 11 | 3 |
| hsa-miR-1234 | caveolin 1, caveolae protein, 22kDa (CAV1) | NM_014515 | -151 | antisense | 12 | 8 |

FIG. 2 (CONT.)

```
miR-566:      3' - CAACCCUAGUGUCCGCGGG -5'
                  |||||||| :||||||||:
TROAP:        5' - GTTGGGATTACAGGCGCCT -3' miR-566:      3' - CAACCCUAGUGUCCGCGGG -5'
                  |||||||| :||||||||:
PNRC2:        5' - GTTGGGATTACAGGCGCCT -3' miR-378:      3' - GGAAGACUGAGGUUCAGGUCA -5'
                   : |||||||||||||||||
PPM2C:        5' - TTTCTGACTCCAAGTCCAGT -3' miR-665:      3' - UCCCCGGAGUCGGAGGACCA -5'
                      |||||||||||||||||
PSG1:         5' - CTGGGCCTCAGCCTCCTGGT -3' miR-339-5p:   3' - GCACUCGAGGACCUCCUGUCCCU -5'
                  || ||  |||||||:|||||||
APH1B:        5' - CGCGAACTCCTGGGGACAGGGA -3' miR-545       3' - CGUGUGUUAUUUACAAACGACU -5'
                   |||  ||||||| ||||||||
UHMK1:        5' - TTACTCAATAAACGTTTGCTGA -3' miR-545       3' - CGUGUGUUAUUUACAAACGACU -5'
                   || |||||||| | ||||||||
RNF165:       5' - GCTCACAATAATTATTTGCTGA -3'
```

FIG. 3

RNA – siRNA and miRNA mimics

| Name | Target | Sequence | SEQ ID NO: |
|---|---|---|---|
| siDicer | Dicer mRNA | UGCUUGAAGCAGCUCUGGA dTdT | 40015 |
| siDicer comp | Dicer mRNA | UCCAGAGCUGCUUCAAGCA dTdT | 40016 |
| mir566 | TROAP/PNRC2 promoter | GGGCGCCUGUGAUCCCAAC | 40017 |
| mir566 comp | TROAP/PNRC2 promoter | GUUGGGAUCACAGGCGCCC | 40018 |
| mir566-biotin | TROAP/PNRC2 promoter | GGGCGCCUGUGAUCCCAAC-biotin | 40019 |
| mir566 comp-biotin | TROAP/PNRC2 promoter | GUUGGGAUCACAGGCGCCC-biotin | 40020 |
| miR665 | PSG1 promoter | ACCAGGAGGCUGAGGCCCU | 40021 |
| miR665 comp | PSG1 promoter | AGGGGCCUCAGCCUCCUGGU | 40022 |
| miR339-5p | APH1 B promoter | UCCCUGUCUCCAGGAGCUCACG | 40023 |
| miR339-5p comp | APH1 B promoter | CGUGAGCUCCUGGAGGACAGGGA | 40024 |
| miR545 | UHMK1/RNF165 promoter | UCAGCAAACAUUAUGUGUGC | 40025 |
| miR545 comp | UHMK1/RNF165 promoter | GCACACAUAAAUGUUUGCUGA | 40026 |
| MM | none | UCUCGCGAGUCCACAGC dTdT | 40027 |
| MM comp | none | GCUGUGGACUCGCGAGAGA dTdT | 40028 |

LNA – miRNA Inhibitors

| Name | Target | Sequence | SEQ ID NO: |
|---|---|---|---|
| LNA mir566 | miR566 | GUUGGGAUCACAGGCGCCC | 40029 |
| LNA MM4 | none | GUUcGGAaCACUgGGcCCC | 40030 |
| LNA SCR | none | GAUCAGUUGGGCCCCAGGC | 40031 |
| LNA 339-5- | miR339-5p | CGUGAGCUCCUGGAGGACAGGGA | 40032 |
| LNA 545 | miR545 | GCACACAAUAAAUGUUUGCUGA | 40033 |

FIG. 4

| Name | GENE | Target | Sequence | SEQ ID NO: |
|---|---|---|---|---|
| Dicer qF | DICER | Specific for mRNA | CATGGATATAGTGGATGTCAC | 40034 |
| Dicer qR | DICER | Specific for mRNA | CTACTTCCACAGTGACTCTG | 40035 |
| TROAP qF | TROAP | Specific for mRNA | GCGAGGTTGTCACTCACTCA | 40036 |
| TROAP qR | TROAP | Seecific for mRNA | GATGGACATGGCACCACAT | 40037 |
| PNRC2 qF | PNRC2 | Specific for mRNA | GGGAAGAACAAAATTTTCCAA | 40038 |
| PNRC2 qR | PNRC2 | Specific for mRNA | GTGATGGCGGCTCACTAAAT | 40039 |
| PPM2C qF | PPM2C | Specific for mRNA | CCATTTAGGGCATTTGGAGA | 40040 |
| PPM2C qR | PPM2C | Specific for mRNA | TGGCCTTAATCGGTGGTAAG | 40041 |
| PSG1 qF | PSG1 | Specific for mRNA | GACTCCAGACGCAAGCTACC | 40042 |
| PSG1 qR | PSG1 | Specific for mRNA | GCACTCACTGGGTTCCGTAT | 40043 |
| APH1B qF | APH1B | Specific for mRNA | TTTCGTCCCTTGTTGTTGGTTC | 40044 |
| APH1B qR | APH1B | Specific for mRNA | AGTCGCATAGAGGGTGCTGT | 40045 |
| UHMK1 qF | UHMK1 | Specific for mRNA | TTGCCAGTAAAGCAGTGGTG | 40046 |
| UHMK1 qR | UHMK1 | Specific for mRNA | TATGAGGGGCAAAAGGAATG | 40047 |
| RNF165 qF | RNF165 | Specific for mRNA | CGTCCATGAAATCCGAAACT | 40048 |
| RNF165 qR | RNF165 | Specific for mRNA | TTCTGTACAGCTCCCCGAGT | 40049 |
| TROAP Promoter qF | TROAP | DNA or Promoter RNA | tagagaaacgggtgggagtg | 40050 |
| TROAP Promoter qR | TROAP | DNA or Promoter RNA | CCATTCCAGATGCCCATAGA | 40051 |
| TROAP Gene Chip qF | TROAP | TROAP Gene DNA | TAGAAGATCTCCCTTTCCTCCA | 40052 |
| TROAP Gene Chip qR | TROAP | TROAP Gene DNA | gatgggatctccctgtca | 40053 |
| GAPDH Chip qF | GAPDH | GAPDH Promoter DNA | TACTAGCGGTTTTACGGGCG | 40054 |
| GAPDH Chip qR | GAPDH | GAPDH Promoter DNA | TCGAACAGGAGGAGCAGAGAGCGA | 40055 |
| TROAP -1008 F | TROAP | DNA or Promoter RNA | TCTCAGTCTCACAGCCTTGC | 40056 |
| TROAP -802 R | TROAP | DNA or Promoter RNA | TGAGGTGTCTGATGAGGTGTCT | 40057 |
| TROAP -495 F | TROAP | DNA or Promoter RNA | tagagaaacgggtgggagtg | 40058 |
| TROAP -340 R | TROAP | DNA or Promoter RNA | CCATTCCAGATGCCCATAGA | 40059 |
| TROAP -267 F | TROAP | DNA or Promoter RNA | AGCAATCGGAACGATCAACT | 40060 |
| TROAP -79 R | TROAP | DNA or Promoter RNA | CAATCAGCCAATCCGAGAGT | 40061 |
| TROAP +50 F | TROAP | DNA or Promoter RNA | CCAATCAAGAGCTTGGCGTA | 40062 |
| TROAP +214 R | TROAP | DNA or Promoter RNA | CCTCCCTATGAACCCAGCAG | 40063 |
| TROAP +476 F | TROAP | DNA or Promoter RNA | CTAGCAAGATTCCGGTACGC | 40064 |
| TROAP +643 R | TROAP | DNA or Promoter RNA | GGGGACAAAAGGTGAGGTT | 40065 |
| TROAP +1001 F | TROAP | DNA or Promoter RNA | TAGAAGATCTCCCTTTCCTCCA | 40066 |
| TROAP +1151 R | TROAP | DNA or Promoter RNA | gatgggatctccctgtca | 40067 |

FIG. 5

| Location from TSS | DNA-Primers for RACE Sequence | Direction | SEQ ID NO: |
|---|---|---|---|
| -1099 | GGGGAAAATCCACCAGAGTTCTGTTAAGTG | Forward | 40068 |
| -1039 | cccctcaatcttaagcaggat | Forward | 40069 |
| -1025 | GCAGGATATTCTAGGATCTCTCAGTCTCACA | Forward | 40070 |
| -1016 | TTCTAGGATCTCTCAGTCTCACAGCCTTGC | Forward | 40071 |
| -1015 | GGCAAGGCTGTGAGACTGAGAGATCCTAGA | Reverse | 40072 |
| -1005 | TCTCAGTCTCACAGCCTTGC | Forward | 40073 |
| -1003 | GTTATTGGTGGGCAAGGCTGTGAGACT | Reverse | 40074 |
| -908 | CCCAGCTGTGAGTAGCCATT | Forward | 40075 |
| -896 | TAGCCATTCAATTCTGGTGCTGTGGTAACT | Forward | 40076 |
| -890 | TTCAATTCTGGTGCTGTGGT | Forward | 40077 |
| -885 | TTCTGGTGCTGTGGTAACTGAGTTCAAAAA | Forward | 40078 |
| -836 | CCCGTAAAATGAAAGACACCTCATCAGACA | Forward | 40079 |
| -824 | AAGACACCTCATCAGACACCTCACTGGATT | Forward | 40080 |
| -794 | GTGAGGCTCCAAGGAGCACACATATTGTTA | Forward | 40081 |
| -794 | AATCCAGTGAGGTGTCTGATGAGGTGTCTT | Reverse | 40082 |
| -790 | GGCTCCAAGGAGCACACATA | Forward | 40083 |
| -772 | TATTGTTAGGCTCAGTTCGATTCCCTCCAG | Forward | 40084 |
| -769 | TGTTAGGCTCAGTTCGATTCC | Forward | 40085 |
| -743 | CTGGAGGGAATCGAACTGAGCCTAACAATA | Reverse | 40086 |
| -743 | CTGGAGGGAATCGAACTGAG | Reverse | 40087 |
| -721 | CAGTTCCTTATCCCGGAGAC | Forward | 40088 |
| -710 | CCCGGAGACAACGTACAGAT | Forward | 40089 |
| -699 | GTTGTCTCCGGGATAAGGAA | Reverse | 40090 |
| -502 | tattttgtagagaaacgggtgggagtggtc | Forward | 40091 |
| -493 | tagagaaacgggtgggagtggtctcgctat | Forward | 40092 |
| -473 | ccactcccacccgtttctctacaaaataat | Reverse | 40093 |
| -464 | atagcgagaccactcccacccgtttctcta | Reverse | 40094 |
| -369 | GCAGATATTTTCTATGGGCATCTGGAATGG | Forward | 40095 |
| -359 | TCTATGGGCATCTGGAATGG | Forward | 40096 |
| -341 | CCATTCCAGATGCCCATAGA | Reverse | 40097 |
| -340 | GCCATTCCAGATGCCCATAGAAAATATCTG | Reverse | 40098 |
| -266 | AGCAATCGGAACGATCAACT | Forward | 40099 |
| -264 | CAATCGGAACGATCAACTGTACCCTCAGTA | Forward | 40100 |
| -264 | TACTGAGGGTACAGTTGATCGTTCCGATTG | Reverse | 40101 |
| -247 | AGTTGATCGTTCCGATTGCT | Reverse | 40102 |
| -230 | CGCGGTACTGAGGGTACAGT | Reverse | 40103 |
| -98 | ACTCTCGGATTGGCTGATTG | Forward | 40104 |
| -83 | AAAAACTGACTCGGATCAATCAGCCAATC | Reverse | 40105 |
| -79 | CAATCAGCCAATCCGAGAGT | Reverse | 40106 |
| -71 | ACTCGGATCAATCAGCCAAT | Reverse | 40107 |
| -34 | CAATTGTCGAACCGCTTTCT | Reverse | 40108 |
| -24 | AAAGAAGGACCAATTGTCGAACCGCTTTCT | Reverse | 40109 |
| -20 | GGCCAAAAGAAGGACCAATTGTCGAAC | Reverse | 40110 |
| 239 | accggaatcttgctaggggtaggagataca | Reverse | 40111 |
| 253 | accggaatcttgctaggggtaggagataca | Reverse | 401112 |
| 317 | catctccttggatcttggttctcctggtc | Reverse | 401113 |

FIG. 6

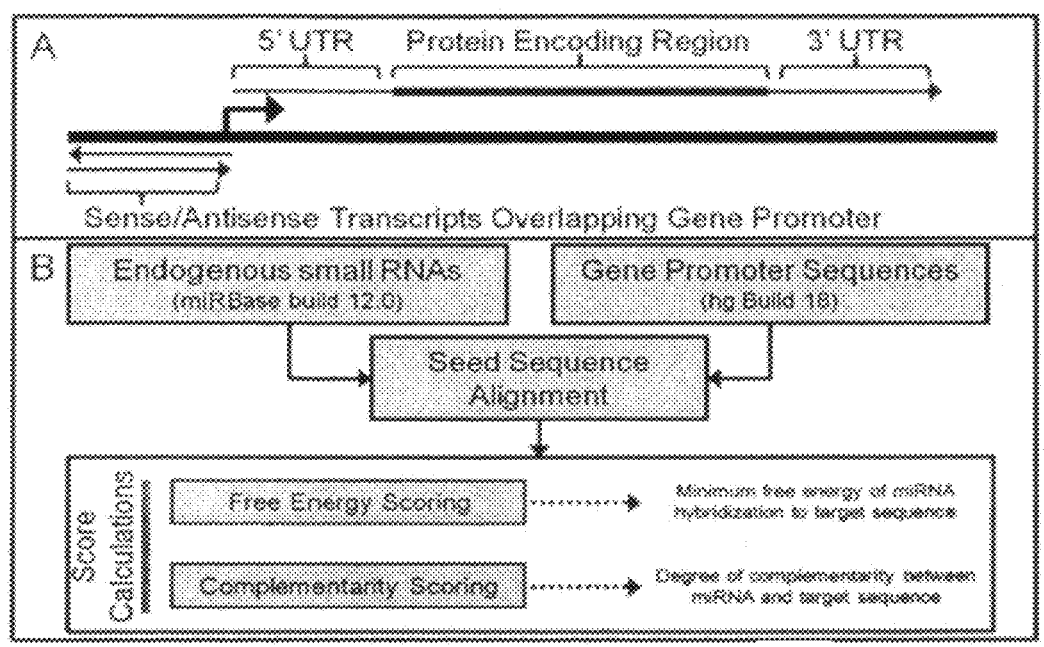
FIG. 7A-B

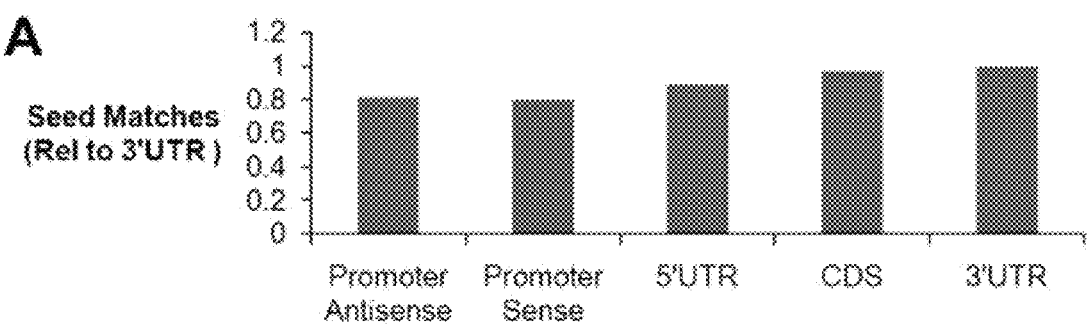
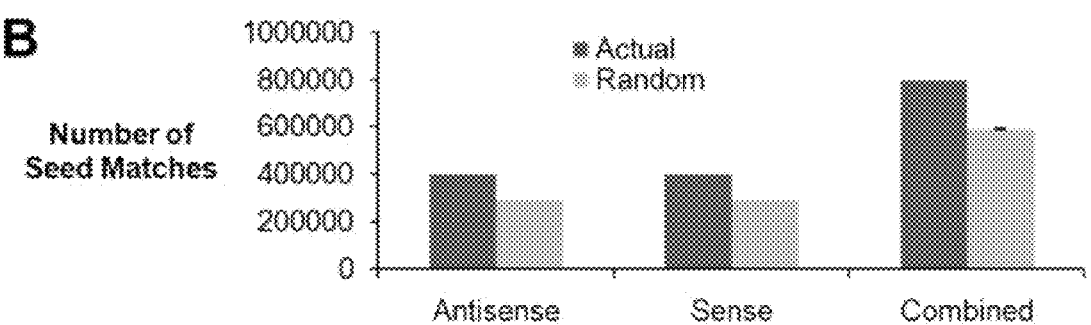
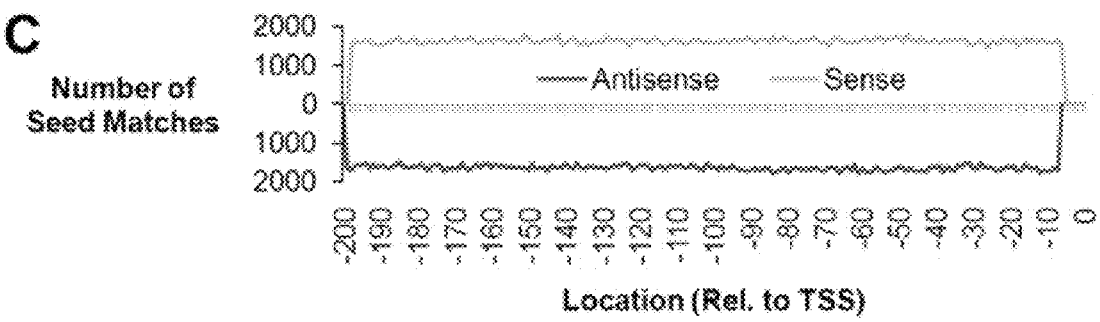
FIG. 8A-C

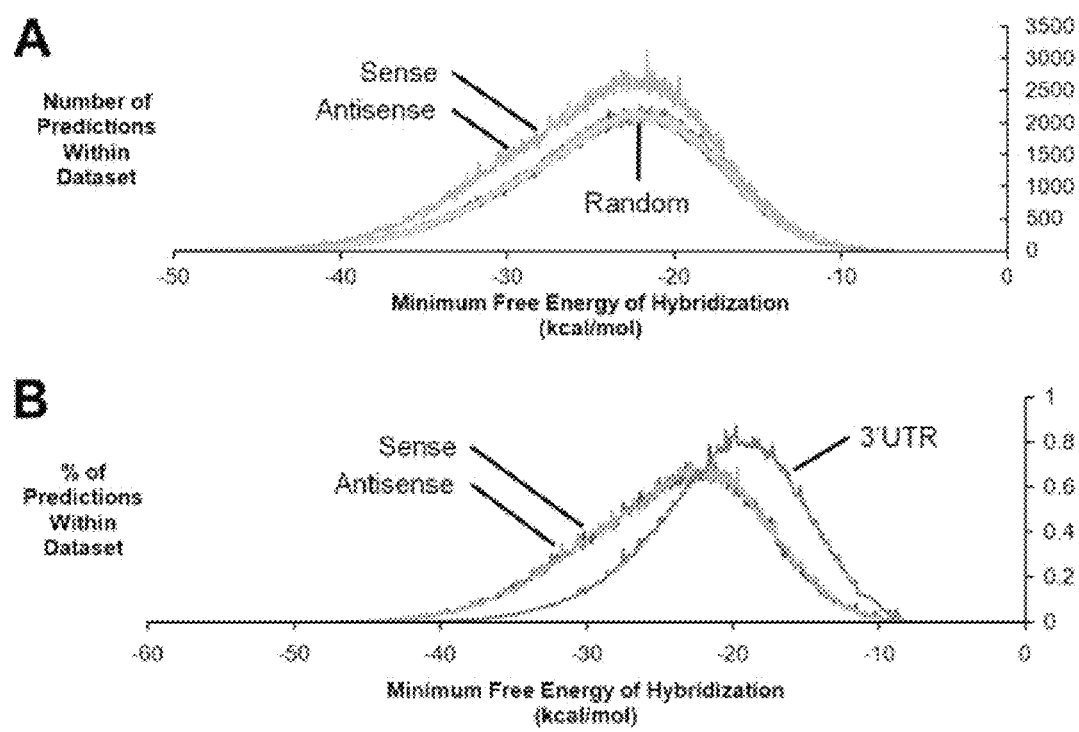
FIG. 9A-B

```
COMT         5' U      C             C            3'
                GGGA AGAGUCUUGCU UGUCGCCC
                UUCU UCUCAGAACGA ACAGCGGG
miR-638      3'        U             A            5'
```

NM_001135162 (AS)    catechol-O-methyltransferase
Seed hit: -145       MFE: -42.7 kcal/mol

```
TYRO3        5' C     C      C                    G 3'
                GCGG  CCCG   CGGCGCCCGCC
                CGCC  GGGC   GCCGCGGGGCGG
miR-663      3'       A                           A 5'
```

NM_006293 (AS)       TYRO3 protein tyrosine kinase
Seed hit: -184       MFE: -54.2 kcal/mol

```
GABRA2       5' G     G                           3'
                GGGGAG GGGGGCCCUGCCUU
                CCCCUC CCCCCGGGACGGAA
miR-940      3'        G                          5'
```

NM_000807 (S)        gamma-aminobutyric acid (GABA) A receptor, alpha 2
Seed hit: -143       MFE: -53.6 kcal/mol

```
CAMK2N1      5' C     GC                          3'
                AGGAA  UAGCGGCAGCCCGGGCCG
                UCCUU  GUCGUCGUCGGGCCGGC
miR-1538     3'                                   5'
```

NM_018584 (S)        calcium/calmodulin-dependent protein kinase II inhibitor 1
Seed hit: -102       MFE: -51.9 kcal/mol

FIG. 10

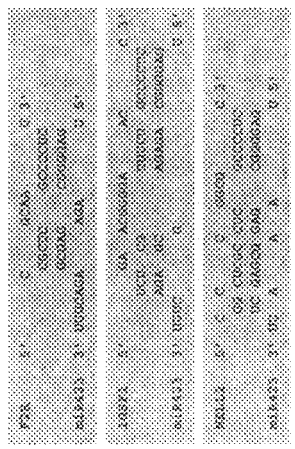
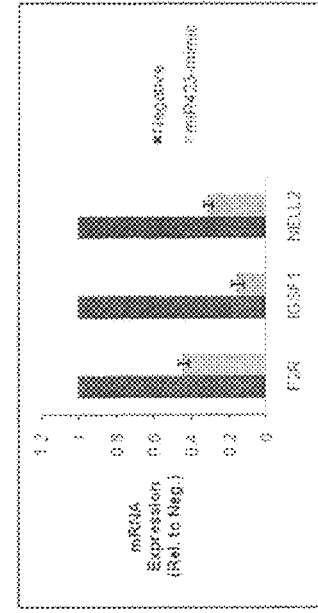
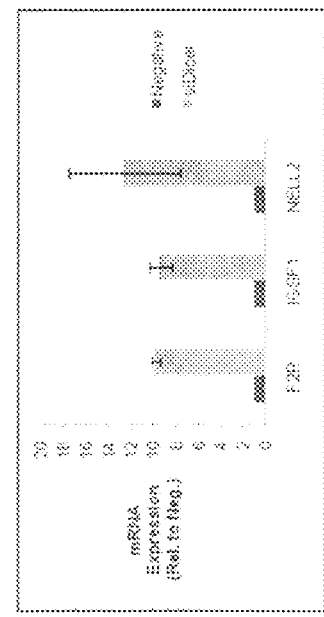
Subset of predicted miR-423-5p targets within gene promoters
Alignments of promoters with predictions listed above
miR-423-5p mimic decreases expression of predicted target genes
Dicer knockdown increases expression of predicted targets
FIG. 11

MODULATION OF GENE EXPRESSION THROUGH ENDOGENOUS SMALL RNA TARGETING OF GENE PROMOTERS

CROSS-REFERENCE TO RELATED APPLICATIONS

This application claims benefit of priority to U.S. Provisional Application Ser. No. 61/058,909, filed Jun. 4, 2008, and U.S. Provisional Application Ser. No. 61/172,556, filed Apr. 24, 2009, the entire contents of each application being hereby incorporated by reference.

STATEMENT REGARDING FEDERALLY SPONSORED RESEARCH

This work was made with government support under grants NIGMS 60642, 77253, and 73042, R01CA 129632 and GM07062 from the National Institutes of Health. The government has certain rights in this invention.

INCORPORATION BY REFERENCE OF SEQUENCE LISTING SUBMITTED ON COMPACT DISC PURSUANT TO 37 C.F.R 1.52(e)

The Sequence Listing is submitted on one compact disc (Copy 1), together with a duplicate thereof (Copy 2), each created on Jun. 3, 2009, and each containing one 5,721 KB file entitled "UTSD:2088US.TXT." The material contained on the compact disc is specifically incorporated herein by reference.

INCORPORATION BY REFERENCE OF TABLE EXCEEDING 50 PAGES SUBMITTED ON COMPACT DISC PURSUANT TO 37 C.F.R. 1.52(e)

Table 1 is submitted on one compact disc (Copy 1), together with a duplicate thereof (Copy 2), each created on Jun. 3, 2009, and each containing one 3,964 KB file entitled "UTSD2088US_TABLE1." The material contained on the compact disc is specifically incorporated herein by reference.

called antigene RNAs (agRNAs) to distinguish them from small duplex RNAs that target mRNA. agRNAs recruit members of the argonaute (AGO) protein family to RNA transcripts that originate from the target gene promoter (Janowski et al., 2006; Kim et al., 2006; Han et al., 2007; Schwartz et al., 2008). Recognition of the target RNA occurs in close proximity to the chromosome, resulting in transcriptional modulation of the target gene.

One remarkable feature of the synthetic agRNAs that the inventors have examined is the potency and robustness of their activity when they are introduced into cells. This potency, coupled with the presence of protein machinery that facilitates their function, suggests that endogenous small RNAs may possess the ability to recognize gene promoters. If RNA could direct proteins to specific gene promoters, such RNA-mediated modulation of transcription might have evolutionary advantages relative to the development of gene-specific protein transcription factors.

Synthetic duplex RNAs that are complementary to mRNA (small interfering RNAs or siRNAs) are also potent and robust agents for modulating gene expression (Fire et al., 1998). siRNAs are known to have endogenous analogs that regulate gene expression called microRNAs (miRNAs) (Lagos-Quintana et al., 2001). miRNAs are processed inside the cell from RNA precursors that contain stem-loop structures. These stem-loop structures are processed by the double-stranded nucleases Drosha and Dicer to produce mature miRNAs.

As of the current release of the miRNA repository (miRBase v12.0), 866 human miRNAs have been annotated, but this number continues to increase. Several miRNAs that recognize sequences within the 3'-untranslated regions (3'UTR) of mRNA transcripts have been characterized. Many miRNAs, however, have no known targets (Lee et al., 1993; John et al., 2004) while some can recognize multiple mRNAs, suggesting that the determinants of miRNA interactions are complex and poorly understood.

Two reports based on computational analyses have suggested that miRNAs can modulate gene expression through promoter recognition. Dahiya and co-workers used publicly available software (RegRNA) to search for potential miRNA

LENGTHY TABLES

The patent contains a lengthy table section. A copy of the table is available in electronic form from the USPTO web site (http://seqdata.uspto.gov/?pageRequest=docDetail&DocID=US08222221B2). An electronic copy of the table will also be available from the USPTO upon request and payment of the fee set forth in 37 CFR 1.19(b)(3).

FIELD OF THE INVENTION

The invention relates to modulating of gene expression using single-stranded oligonucleotides complementary to endogenous miRNAs complementary to promoter regions of target genes.

BACKGROUND OF THE INVENTION

Synthetic small duplex RNAs complementary to gene promoters within chromosomal DNA are potent inhibitors or activators of target gene expression in mammalian cells (Morris et al., 2004; Ting et al., 2005; Janowski et al., 2005; Li et al., 2006; Janowski et al., 2007). These synthetic RNAs are target sites within the promoter of the E-cadherin gene (Place et al., 2008). They identified one potential binding site for miR-373 within the E-cadherin promoter and reported that introduction of a synthetic miR-373 mimic increased expression of the gene by 6-fold at the level of the mRNA. Rossi and co-workers searched for perfect complementarity between miRNAs and gene promoters (Kim et al., 2008). Their analysis suggested that miR-320 targets the genomic location from which it is transcribed and showed that expression of miR-320 and the adjacent gene, POLR3D, are anti-correlated.

The above-mentioned studies either analyzed a single gene promoter or used highly stringent sequence comparison criteria. These approaches were not intended to assess the broader potential for miRNAs to recognize gene promoters, warranting a more thorough evaluation of the relationship between miRNAs and promoter sequences.

A practical justification for more comprehensive studies is that validating natural gene targets of miRNAs is a complex and difficult process. The development of systematic and efficient methods for identifying promoter sequences that may be miRNA targets is essential for prioritizing predictions and efficiently allocating experimental resources towards validating the most promising targets.

SUMMARY OF THE INVENTION

Thus, in accordance with the present invention, there is provided a method of modulating expression of a target gene in a cell comprising contacting an endogenous miRNA complementary to a portion of a promoter of the target gene with a single-stranded complementary oligonucleotide that hybridizes to the miRNA, thereby modulating expression of the target gene. The miRNA may target a non-coding RNA (ncRNA) transcribed from the promoter. The single-stranded complementary oligonucleotide may comprise at least one locked nucleic acid (LNA) base or at least one 2'-O-methyl (2'-O-me) base. The miRNA may be 80%, 85%, 90%, 95% or 100% complementary to the portion of the promoter. The single-stranded complementary oligonucleotide may be the same length as the miRNA or shorter than the miRNA. The complementary oligonucleotide may comprise of or consist of a sequence selected from SEQ ID NOS:20001-40000.

The target gene may be trophinin-associated protein (TROAP), proline-rich nuclear receptor coactivator 2 (PNRC2), protein phosphatase 2C, Mg-dependent catalytic subunit (PPM2C), pregnancy specific beta-1-glycoprotein 1 (PSG1), anterior pharynx defective 1 homolog B (C. elegans) (APH1B), U2AF homology motif (UHM) kinase 1 (UHMK1), ring finger protein 165 (RNF165), catechol O-methyltransferase (COMT), tyrosine protein kinse O3 (TYRO3), γ-aminobutyric acid A receptor α2 (GABRA2) or calcium/calmodulin-dependent protein kinase II inhibitor 1 (CAMK2N1). The target gene also may be brain and reproductive organ-expressed (TNFRSF1A modulator) (BRE); caveolin 1 (caveolae protein, 22 kDa, CAV1); inhibin, alpha (INHA); ribonuclease/angiogenin inhibitor 1 (RNH1); Sp1 transcription factor (SP1); DEK oncogene (DNA binding) (DEK); hepatic leukemia factor (HLF); opioid receptor, kappa 1 (OPRK1); or glyceraldehyde-3-phosphate dehydrogenase, spermatogenic (GAPDHS). The target gene may also be any of the genes set for the Table 1, and the target sequence may be selected from SEQ ID NOS:1-20000.

The target gene may be a native gene, and in a particular, embodiment, the cell may be located in situ in a host, and the contacting step is effected by administering to the host an effective amount of the complementary oligonucleotide. In a particular embodiment, the target gene is Caveolin-1 in a metastatic cell, the contacting step is effected by contacting the cell an effective amount of the complementary oligonucleotide comprising locked nucleic acid (LNA) or 2'-O-methyl (2'-O-me) bases. In another particular embodiment, the target gene is MAPKAPK2 in situ in a host, the contacting step is effected by administering to the host an effective amount of the complementary oligonucleotide comprising locked nucleic acid (LNA) or 2'-O-methyl (2'-O-me) bases.

In various embodiments, the expression of the target gene may be increased or decreased. The method may further comprise detecting a change in the expression of the target gene, for example, by inferring a change in the expression of the target gene from a physiologic change in the cell, or by detecting comprises one or more of Northern blot, PCR, immunohistochemistry, Western blot or ELISA. The cell may be located in situ in a host and the detecting may comprise inferring a change in the expression of the target gene from a physiologic change in the host.

The portion may lie between −200 and −1 relative to a transcriptional start site of the target gene, between −500 and −201 relative to a transcriptional start site of the target gene, or between −2000 and −501 relative to a transcriptional start site of the target gene. The method may further comprise the step of identifying the endogenous miRNA, such as by identifying an miRNA seed region is the promoter, by calculating a minimum free energy for said seed region.

In another embodiment, there is provided method for identifying an endogenous miRNA that modulates expression of a target gene (a) identifying an endogenous miRNA exhibiting complementarity to a portion of a promoter of the target gene; and (b) assessing the ability of the complementary miRNA to modulate expression of the target gene.

The invention provides compositions such as reagents and formulations tailored to the subject methods. It is contemplated that any method or composition described herein can be implemented with respect to any other method or composition described herein.

The use of the word "a" or "an" when used in conjunction with the term "comprising" in the claims and/or the specification may mean "one," but it is also consistent with the meaning of "one or more," "at least one," and "one or more than one."

These and other embodiments of the invention will be better understood when considered in conjunction with the following description and the accompanying drawings. It should be understood that the following description, while indicating various embodiments of the invention and numerous specific details thereof, is given by way of illustration and not of limitation. Many substitutions, modifications, additions and/or rearrangements may be made within the scope of the invention without departing from the spirit thereof, and the invention includes all such substitutions, modifications, additions and/or rearrangements.

BRIEF DESCRIPTION OF THE FIGURES

The following drawings form part of the present specification and are included to further demonstrate certain aspects of the present invention. The invention may be better understood by reference to one or more of these drawings in combination with the detailed description of specific embodiments presented herein FIG. 1—Sequence comparison process.

FIG. 2—miRNAs and target gene promoters.

FIG. 3—Alignment of miRNAs and target gene promoters (miR-566/TROAP (SEQ ID NO:40001 and SEQ ID NO:40002; miR-566/PNRC2 (SEQ ID NO:40003 and SEQ ID NO:40004; miR-378/PPM2C (SEQ ID NO:40005 and SEQ ID NO:40006; miR-665/PSg1 (SEQ ID NO:40007 and SEQ ID NO:40008; miR-339-5p/APH1B (SEQ ID NO:40009 and SEQ ID NO:40010; miR-545/UHMK1 (SEQ ID NO:40011 and SEQ ID NO:40012; miR-545/RNF165 (SEQ ID NO:40013 and SEQ ID NO:40014).

FIG. 4—siRNA, miRNA mimics and LNA-miRNA inhibitors.

FIG. 5—Primers for qPCR.

FIG. 6—Primers for RACE.

FIGS. 7A-B—(FIG. 7A) Diagram of sequences that are potential miRNA targets. (FIG. 7B) Schematic of algorithm used to predict miRNA targets within gene promoters.

FIGS. 8A-C—Gene promoters contain predicted miRNA target sites. (FIG. 8A) The frequency of seed sequence matches in promoter regions, 5'UTRs, coding sequences, and 3'UTRs. (FIG. 8B) Comparison of seed matches within promoter-overlapping transcripts vs. randomized promoter sequences. (FIG. 8C) Distribution of seed match locations within sense and antisense transcripts that overlap gene promoters from −1 to −200 relative to the +1 transcription start site.

FIGS. 9A-B—MFE properties of miRNA target predictions. (FIG. 9A) Distribution of MFE values for predictions within promoter-overlapping transcripts as compared to randomized promoter sequences. (FIG. 9B) Distribution of MFE values for predictions within promoter-overlapping transcripts as compared to 3'UTRs.

FIG. 10—Examples of predicted miRNA targets within sequences of promoter-overlapping transcripts (COMT (SEQ ID NO:40114 and SEQ ID NO:40115); TYRO3 (SEQ ID NO:40116 and SEQ ID NO:40117); GABRA2 (SEQ ID NO:40118 and SEQ ID NO:40119); CAMK2N1 (SEQ ID NO:40120 and SEQ ID NO:40121)).

FIG. 11—miR-423-5p mimic decreases expression of predicted target genes (F2R (SEQ ID NO:40122 and SEQ ID NO:40123); 1GSF1 (SEQ ID NO:40124 and 40125); NELL2 (SEQ ID NO:40126 and 40127)).

DETAILED DESCRIPTION OF SPECIFIC EMBODIMENTS OF THE INVENTION

Figure 1:
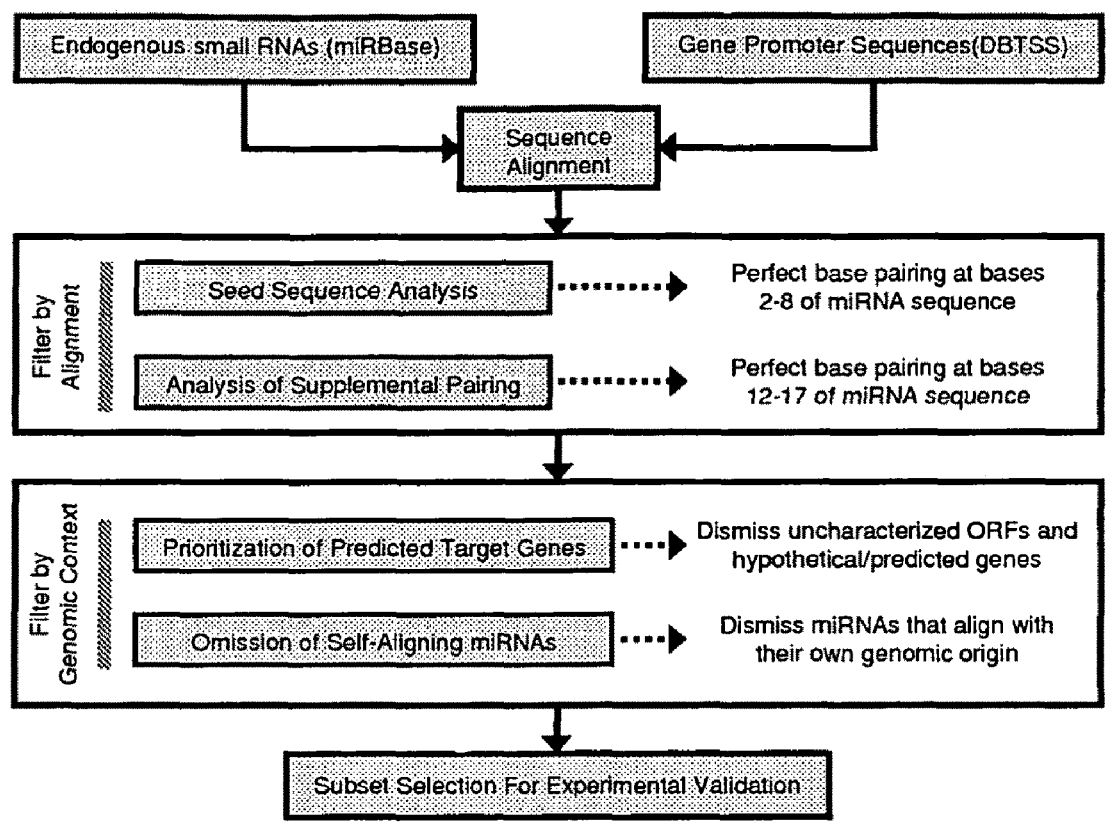

The invention provides a general method of selectively modulating (increasing or decreasing) expression (i.e., transcription) of a target gene by (a) identifying an endogenous miRNA complementary to a promoter of the target gene; (b) contacting the miRNA with a single-stranded complementary oligonucleotide that hybridizes to the miRNA, thereby modulating expression of the target gene. In a particular embodiment, the target gene is a native gene, may be located in a cell, which may be in situ in a host, the contacting step is effected by administering to the host an effective amount of the oligonucleotide, and/or the modulated expression is inferred from a correlated physiologic change in the host.

As disclosed and exemplified herein, by exploiting this hitherto unappreciated endogenous mechanism for selective regulation of gene expression, these methods are generally applicable across a wide variety of target genes, promoter regions, oligonucleotides, cell types and delivery conditions. While conditions whereby a given oligonucleotide selectively modulates expression of a given target gene may be confirmed empirically (e.g., pursuant to the protocols described herein), these data indicate that mammalian cells are generally amenable to target gene selective modulation of target gene expression using these methods.

Various aspects of the invention, as set forth above, are described in greater detail in the following paragraphs.

I. miRNA and Oligonucleotide Antagonists Thereof

A. miRNAs microRNAs (miRNA) are single-stranded RNA molecules of 21-23 nucleotides in length, which regulate gene expression. miRNAs are encoded by genes from whose DNA they are transcribed but miRNAs are not translated into protein (non-coding RNA); instead each primary transcript (a pri-miRNA) is processed into a short stem-loop structure called a pre-miRNA and finally into a functional miRNA. Mature miRNA molecules are partially complementary to one or more messenger RNA (mRNA) molecules, and their main function is to down-regulate gene expression.

The genes encoding miRNAs are much longer than the processed mature miRNA molecule; miRNAs are first transcribed as primary transcripts or pri-miRNA (up to about 100 bases in length) with a cap and poly-A tail, and then processed to short, 70-nucleotide stem-loop structures known as pre-miRNA in the cell nucleus. This processing is performed in animals by a protein complex known as the Microprocessor complex, consisting of the nuclease Drosha and the double-stranded RNA binding protein Pasha. These pre-miRNAs are then processed to mature miRNAs in the cytoplasm by interaction with the endonuclease Dicer, which also initiates the formation of the RNA-induced silencing complex (RISC). This complex is responsible for the gene silencing observed due to miRNA expression and RNA interference.

In general, perfect complementarity between the target sequences and bases 2-8 of the mature miRNA sequence is required for miRNA function. Although not necessarily a prerequisite for miRNA function, the minimum free energy (MFE) of hybridization between miRNAs and their predicted target sites have been successfully used to predict miRNA target sites within 3'UTRs (Stark et al., 2003). Another criterion used in miRNA target prediction is sequence complementarity. Sequence complementarity alone has been used successfully to predict miRNA target sites within 3'UTRs (Lai, 2002).

B. Antagonists

Oligonucleotides of the present invention are single-stranded nucleic acid segments of 12-30 bases in length that are designed to target miRNAs that bind to promoter encoded sequences in target cells. In particular, ranges of 12-23, 15-30, 15-23, 18-23, 19-23, 20-23 and 21-23 bases are contemplated, as are specific lengths of 12, 13, 14, 15, 16, 17, 18, 19, 20, 21, 22, 23, 24 and 25 bases. Such sequences have been termed "antagomirs" to indicate their ability to antagonize miRNAs.

In general, antagomirs are defined as single-stranded, double-stranded, partially double-stranded and hairpin structured oligonucleotides that target an miRNA. An antagomir generally is at least 12 or more contiguous nucleotides completely or substantially complementary to an endogenous miRNA or pre-miRNA nucleotide sequence. In particular, an antagomir includes a nucleotide sequence sufficiently complementary to hybridize to 12-23 nucleotides from an miRNA target sequence. Exemplary target sequences are provided in Table 1 and as SEQ ID NOS:1-20000, while corresponding antagomirs are listed there and as SEQ ID NOS: 20001-40000.

Oligonucleotides are chemically synthesized using nucleoside phosphoramidites. A phosphoramidite is a derivative of natural or synthetic nucleoside with protection groups added to its reactive exocyclic amine and hydroxy groups. The naturally occurring nucleotides (nucleoside-3'-phosphates) are insufficiently reactive to afford the synthetic preparation of oligonucleotides. A dramatically more reactive (2-cyanoethyl) N,N-diisopropyl phosphoramidite group is therefore attached to the 3'-hydroxy group of a nucleoside to form nucleoside phosphoramidite. The protection groups prevent unwanted side reactions or facilitate the formation of the desired product during synthesis. The 5'-hydroxyl group is protected by DMT (dimethoxytrityl) group, the phosphite group by a diisopropylamino (iPr2N) group and a 2-cyanoethyl (OCH$_2$CH$_2$CN) group. The nucleic bases also have protecting groups on the exocyclic amine groups (benzoyl, acetyl, isobutyryl, or many other groups). In RNA synthesis, the 2' group is protected with a TBDMS (t-butyldimethylsilyl) group or with a TOM (t-butyldimethylsilyloxymethyl) group. With the completion of the synthesis process, all the protection groups are removed.

Whereas enzymes synthesize DNA in a 5' to 3' direction, chemical DNA synthesis is done backwards in a 3' to 5' reaction. Based on the desired nucleotide sequence of the product, the phosphoramidites of nucleosides A, C, G, and T are added sequentially to react with the growing chain in a repeating cycle until the sequence is complete. In each cycle, the product's 5'-hydroxy group is deprotected and a new base is added for extension. In solid-phase synthesis, the oligonucleotide being assembled is bound, via its 3'-terminal hydroxy group, to a solid support material on which all reactions take place. The 3' group of the first base is immobilized via a linker onto a solid support (most often, controlled pore glass particles or macroporouspolystyrene beads). This allows for easy addition and removal of reactants. In each cycle, several solutions containing reagents required for the elongation of the oligonucleotide chain by one nucleotide residue are sequentially pumped through the column from an attached reagent delivery system and removed by washing with an inert solvent.

Antagomirs can be synthesized to include a modification that imparts a desired characteristic. For example, the modification can improve stability, hybridization thermodynamics with a target nucleic acid, targeting to a particular tissue or cell-type, or cell permeability, e.g., by an endocytosis-dependent or -independent mechanism. Modifications can also increase sequence specificity, and consequently decrease off-site targeting. In one embodiment, the antagomir includes a non-nucleotide moiety, e.g., a cholesterol moiety. The non-nucleotide moiety can be attached to the 3' or 5' end of the oligonucleotide agent.

A wide variety of well-known, alternative oligonucleotide chemistries may be used (see, e.g., U.S. Patent Publications 2007/0213292, 2008/0032945, 2007/0287831, etc.), particularly single-stranded complementary oligonucleotides comprising 2' methoxyethyl, 2'-fluoro, and morpholino bases (see e.g., Summerton and Weller, 1997). The oligonucleotide may include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O—NMA). Also contemplated are locked nucleic acid (LNA) and peptide nucleic acids (PNA).

Peptide nucleic acids (PNAs) are nonionic DNA mimics that have outstanding potential for recognizing duplex DNA (Kaihatsu et al., 2004; Nielsen et al., 1991). PNAs can be readily synthesized and bind to complementary sequences by standard Watson-Crick base-pairing (Egholm et al., 1993), allowing them to target any sequence within the genome without the need for complex synthetic protocols or design considerations. Strand invasion of duplex DNA by PNAs is not hindered by phosphate-phosphate repulsion and is both rapid and stable (Kaihatsu et al., 2004; Nielsen et al., 1991). Applications for strand invasion by PNAs include creation of artificial primosomes (Demidov et al., 2001), inhibition of transcription (Larsen and Nielsen, 1996), activation of transcription (Mollegaard et al., 1994), and directed mutagenesis (Faruqi et al., 1998). PNAs would provide a general and potent strategy for probing the structure and function of chromosomal DNA in living systems if their remarkable strand invasion abilities could be efficiently applied inside cells.

Strand invasion by PNAs in cell-free systems is most potent at sequences that are partially single-stranded (Bentin and Nielsen, 1996; Zhang et al., 2000). Assembly of RNA polymerase and transcription factors into the pre-initiation complex on DNA induces the formation of a structure known as the open complex that contains several bases of single-stranded DNA (Holstege et al., 1997; Kahl et al., 2000). The exceptional ability of PNAs to recognize duplex DNA allows them to intercept the open complex of an actively transcribed gene without a requirement for preincubation. The open complex is formed during transcription of all genes and PNAs can be synthesized to target any transcription initiation site. Therefore, antigene PNAs that target an open complex at a promoter region within chromosomal DNA would have the potential to be general tools for controlling transcription initiation inside cells.

A locked nucleic acid (LNA), often referred to as inaccessible RNA, is a modified RNA nucleotide (Elmén et al., 2008). The ribose moiety of an LNA nucleotide is modified with an extra bridge connecting the 2' and 4' carbons. The bridge "locks" the ribose in the 3'-endo structural conformation, which is often found in the A-form of DNA or RNA. LNA nucleotides can be mixed with DNA or RNA bases in the oligonucleotide whenever desired. Such oligomers are commercially available. The locked ribose conformation enhances base stacking and backbone pre-organization. This significantly increases the thermal stability (melting temperature) of oligonucleotides (Kaur et al., 2006). LNA bases may be included in a DNA backbone, by they can also be in a backbone of LNA, 2'-O-methyl RNA, 2'-methoxyethyl RNA, or 2'-fluoro RNA. These molecules may utilize either a phosphodiester or phosphorothioate backbone.

Other oligonucleotide modifications can be made to produce oligonucleotides. For example, stability against nuclease degradation has been achieved by introducing a phosphorothioate (P=S) backbone linkage at the 3' end for exonuclease resistance and 2' modifications (2'-OMe, 2'-F and related) for endonuclease resistance (WO 2005115481; Li et al., 2005; Choung et al., 2006). A motif having entirely of 2'-O-methyl and 2'-fluoro nucleotides has shown enhanced plasma stability and increased in vitro potency (Allerson et al., 2005). The incorporation of 2'-O-Me and 2'-O-MOE does not have a notable effect on activity (Prakash et al., 2005).

Sequences containing a 4'-thioribose modification have been shown to have a stability 600 times greater than that of natural RNA (Hoshika et al, 2004). Crystal structure studies reveal that 4'-thioriboses adopt conformations very similar to the C3'-endo pucker observed for unmodified sugars in the native duplex (Haeberli et al., 2005). Stretches of 4'-thio-RNA were well tolerated in both the guide and nonguide strands. However, optimization of both the number and the placement of 4'-thioribonucleosides is necessary for maximal potency.

In the boranophosphate linkage, a non-bridging phosphodiester oxygen is replaced by an isoelectronic borane (BH3-) moiety. Boranophosphate siRNAs have been synthesized by enzymatic routes using T7 RNA polymerase and a boranophosphate ribonucleoside triphosphate in the transcription reaction. Boranophosphate siRNAs are more active than native siRNAs if the center of the guide strand is not modified, and they may be at least ten times more nuclease resistant than unmodified siRNAs (Hall et al., 2004; Hall et al., 2006).

Certain terminal conjugates have been reported to improve or direct cellular uptake. For example, NAAs conjugated with cholesterol improve in vitro and in vivo cell permeation in liver cells (Rand et al., 2005). Soutschek et al. (2004) have reported on the use of chemically-stabilized and cholesterol-conjugated siRNAs have markedly improved pharmacological properties in vitro and in vivo. Chemically-stabilized siRNAs with partial phosphorothioate backbone and 2'-O-methyl sugar modifications on the sense and antisense strands (discussed above) showed significantly enhanced resistance towards degradation by exo- and endonucleases in serum and in tissue homogenates, and the conjugation of cholesterol to the 3' end of the sense strand of an oligonucleotides by means of a pyrrolidine linker does not result in a significant loss of gene-silencing activity in cell culture. These study demonstrates that cholesterol conjugation significantly improves in vivo pharmacological properties of oligonucleotides.

U.S. Patent Publication 2008/0015162, incorporated herein by reference, provide additional examples of nucleic acid analogs useful in the present invention. The following excerpts are derived from that document and are exemplary in nature only.

In certain embodiments, oligomeric compounds comprise one or more modified monomers, including 2'-modified sugars, such as BNA's and monomers (e.g., nucleosides and nucleotides) with 2'-substituents such as allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—N$(R_m)(R_n)$, or O—$CH_2$—C(=O)—N$(R_m)(R_n)$, where each $R_m$ and $R_n$ is, independently, H or substituted or unsubstituted $C_1$-$C_{10}$ alkyl.

In certain embodiments, the oligomeric compounds including, but no limited to short oligomers of the present invention, comprise one or more high affinity monomers provided that the oligomeric compound does not comprise a nucleotide comprising a 2'-O$(CH_2)_n$H, wherein n is one to six. In certain embodiments, the oligomeric compounds including, but no limited to short oligomers of the present invention, comprise one or more high affinity monomer provided that the oligomeric compound does not comprise a nucleotide comprising a 2'-$OCH_3$ or a 2'-O$(CH_2)_2OCH_3$. In certain embodiments, the oligomeric compounds comprise one or more high affinity monomers provided that the oligomeric compound does not comprise a α-L-methyleneoxy (4'-$CH_2$—0-2') BNA and/or a β-D-methyleneoxy (4'-$CH_2$—0-2') BNA.

Certain BNA's have been prepared and disclosed in the patent literature as well as in scientific literature (Singh et al., 1998; Koshkin et al., 1998; Wahlestedt et al., 2000; Kumar et al., 1998; WO 94/14226; WO 2005/021570; Singh et al, 1998; examples of issued US patents and published applications that disclose BNA s include, for example, U.S. Pat. Nos. 7,053,207; 6,268,490; 6,770,748; 6,794,499; 7,034,133; and 6,525,191; and U.S. Patent Publication Nos. 2004/0171570; 2004/0219565; 2004/0014959; 2003/0207841; 2004/0143114; and 2003/0082807.

Also provided herein are BNAs in which the 2'-hydroxyl group of the ribosyl sugar ring is linked to the 4' carbon atom of the sugar ring thereby forming a methyleneoxy (4'-$CH_2$—0-2') linkage to form the bicyclic sugar moiety (reviewed in Elayadi et al., 2001; Braasch et al., 2001; see also U.S. Pat. Nos. 6,268,490 and 6,670,461). The linkage can be a methylene (—$CH_2$—) group bridging the 2' oxygen atom and the 4' carbon atom, for which the term methyleneoxy (4'-$CH_2$—O-2') BNA is used for the bicyclic moiety; in the case of an ethylene group in this position, the term ethyleneoxy (4'-$CH_2CH_2$—0-2') BNA is used (Singh et al., 1998; Morita et al., 2003). Methyleneoxy (4'-$CH_2$—O-2') BNA and other bicyclic sugar analogs display very high duplex thermal stabilities with complementary DNA and RNA (Tm=+3 to +10° C.), stability towards 3'-exonucleolytic degradation and good solubility properties. Potent and nontoxic antisense oligonucleotides comprising BNAs have been described (Wahlestedt et al., 2000).

An isomer of methyleneoxy (4'-$CH_2$—O-2') BNA that has also been discussed is α-L-methyleneoxy (4'-$CH_2$—O-2') BNA which has been shown to have superior stability against a 3'-exonuclease. The α-L-methyleneoxy (4'-$CH_2$—O-2') BNA's were incorporated into antisense gapmers and chimeras that showed potent antisense activity (Frieden et al., 2003).

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., 1998). BNAs and preparation thereof are also described in WO 98/39352 and WO 99/14226.

Analogs of methyleneoxy (4'-$CH_2$—O-2') BNA, phosphorothioate-methyleneoxy (4'-$CH_2$—O-2') BNA and 2'-thio-BNAs, have also been prepared (Kumar et al., 1998). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel comformationally restricted high-affinity oligonucleotide analog has been described in the art (Singh et al., 1998). In addition, 2'-amino- and 2'-methylamino-BNA's have been prepared and the thermal stability of their duplexes with complementary RNA and DNA strands has been previously reported.

Modified sugar moieties are well known and can be used to alter, typically increase, the affinity of oligomers for targets and/or increase nuclease resistance. A representative list of modified sugars includes, but is not limited to, bicyclic modified sugars (BNA's), including methyleneoxy (4'-$CH_2$—O-2') BNA and ethyleneoxy (4'-$(CH_2)_2$—O-2' bridge) BNA; substituted sugars, especially 2'-substituted sugars having a 2'-F, 2'-$OCH_3$ or a 2'-O$(CH_2)_2$—$OCH_3$ substituent group; and 4'-thio modified sugars. Sugars can also be replaced with sugar mimetic groups among others. Methods for the preparations of modified sugars are well known to those skilled in the art. Some representative patents and publications that teach the preparation of such modified sugars include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; 5,700,920; 6,531,584; and 6,600,032; and WO 2005/121371.

The naturally-occurring base portion of a nucleoside is typically a heterocyclic base. The two most common classes of such heterocyclic bases are the purines and the pyrimidines. For those nucleosides that include a pentofuranosyl sugar, a phosphate group can be linked to the 2', 3' or 5' hydroxyl moiety of the sugar. In forming oligonucleotides, those phosphate groups covalently link adjacent nucleosides to one another to form a linear polymeric compound. Within oligonucleotides, the phosphate groups are commonly referred to as forming the internucleotide backbone of the oligonucleotide. The naturally occurring linkage or backbone of RNA and of DNA is a 3' to 5' phosphodiester linkage.

In addition to "unmodified" or "natural" nucleobases such as the purine nucleobases adenine (A) and guanine (G), and the pyrimidine nucleobases thymine (T), cytosine (C) and uracil (U), many modified nucleobases or nucleobase mimetics known to those skilled in the art are amenable with the compounds described herein. In certain embodiments, a modified nucleobase is a nucleobase that is fairly similar in structure to the parent nucleobase, such as for example a 7-deaza purine, a 5-methyl cytosine, or a G-clamp. In certain embodiments, nucleobase mimetic include more complicated structures, such as for example a tricyclic phenoxazine nucleobase mimetic. Methods for preparation of the above noted modified nucleobases are well known to those skilled in the art.

Described herein are linking groups that link monomers (including, but not limited to, modified and unmodified nucleosides and nucleotides) together, thereby forming an oligomeric compound. The two main classes of linking groups are defined by the presence or absence of a phosphorus atom. Representative phosphorus containing linkages include, but are not limited to, phosphodiesters (P=O), phosphotriesters, methylphosphonates, phosphoramidate, and phosphorothioates (P=S). Representative non-phosphorus containing linking groups include, but are not limited to, methylenemethylimino (—CH$_2$—N(CH$_3$)—O—CH$_2$—), thiodiester (—O—C(O)—S—), thionocarbamate (—O—C(O)(NH)—S—); siloxane (—O—Si(H)$_2$—O—); and N,N'-dimethylhydrazine (—CH$_2$—N(CH$_3$)—N(CH$_3$)—). Oligomeric compounds having non-phosphorus linking groups are referred to as oligonucleosides. Modified linkages, compared to natural phosphodiester linkages, can be used to alter, typically increase, nuclease resistance of the oligomeric compound. In certain embodiments, linkages having a chiral atom can be prepared a racemic mixtures, as separate enantiomers. Representative chiral linkages include, but are not limited to, alkylphosphonates and phosphorothioates. Methods of preparation of phosphorous-containing and non-phosphorous-containing linkages are well known to those skilled in the art.

II. Predicting Promoter Target Sites

In one aspect of the invention, there is provided an in silico a process for identifying a previously unknown miRNA-promoter pair (e.g., FIG. 1), or to select an established miRNA correlate/cognate. The inventors have demonstrated the ability of this process to identify a wide range of target gene promoters subject to endogenous miRNA regulation (e.g., FIGS. 2-4).

MFE values were calculated for miRNA hybridization to predicted target sites (based on seed sequence matches, hereafter simply referred to as predictions) within putative promoter-overlapping transcripts and within 10 randomizations of promoter sequences. The inventors found that predictions with lower MFE values occurred more frequently in actual promoter sequences than in randomized sequences. The difference between the distributions of MFE values demonstrates that predictions with low MFE values occur more often than would be expected at random, implying that these predictions are more likely to be biologically significant and that MFE values will be useful criteria for prioritizing target predictions.

The inventors used the Needleman-Wunsch algorithm (1970) to evaluate the degree of sequence complementarity between miRNAs and predicted target sites within gene promoters. They identified over 200 individual miRNAs with near perfect complementarity to their predicted target sites within gene promoters. The high degree of complementarity between miRNAs and gene promoters further demonstrates that gene promoters are promising candidates for miRNA targets. Table 1 illustrates 20,000 target sites (SEQ ID NOS: 1-20000) and corresponding antagomirs (SEQ ID NOS: 20001-40000)

III. Target Genes/Cells/Hosts, Formulations and Delivery of Oligonucleotides

A. Targets

A target gene is generally native to a cell, such as a mammalian or human cell, and which may be in vitro (e.g., a cultured cell), or in situ in a host. Examples of cultured cells include primary cells, cancer cells (e.g., from cell lines), adult or embryonic stem cells, neural cells, fibroblasts, myocytes, etc. Cultured human cells commonly used to test putative therapeutics for human diseases or disorders can be used to screen subject oligonucleotides (complementary to endogenous miRNAs complementary to promoters of target genes) activity, especially therapeutic affect (e.g., induction of apoptosis, cessation of proliferation in cancer cells, etc.). When the cell is in situ, the host may be any mammal, such as a human, or an animal model used in the study of human diseases or disorders (e.g., rodent, canine, porcine, etc., animal models).

The mammalian cell may be determined to be in need of modulated expression of the target gene using routine methods. For example, reduced or increased levels of a target gene expression and/or protein relative to desired levels may be directly measured (see below). Alternatively, increased or decreased expression of a target gene may be inferred from a phenotype or physiologic status associated with reduced or increased levels of a target gene product.

The following is a list of exemplary genes with promoter targets according the present invention:

myelin oligodendrocyte glycoprotein, major histocompatibility complex, class II, DO αγ-aminobutyric acid (GABA) B receptor, lactase, tumor necrosis factor (TNF superfamily, member 2), complement factor B, paraoxonase 1, bradykinin receptor B1, apolipoprotein A-I, leptin receptor, glutamate receptor, metabotropic 2, myosin X cholesteryl ester transfer protein, plasma retinoid X receptor, β single-stranded DNA binding protein, ryanodine receptor, lens epithelial protein, Bone morphogenetic protein (osteogenic protein 1), perforin (pore forming protein), tubulin, β interleukin, arachidonate 5-lipoxygenase, apolipoprotein L, phospholipase C, β2 NAD(P)H dehydrogenase, quinone 2, tumor necrosis factor receptor superfamily, member 13C, lymphocyte-specific protein tyrosine kinase, apolipoprotein L, cystathionine-β-synthase ceruloplasmin (ferroxidase), vitamin D (1,25-dihydroxy vitamin D3) receptor angiotensin I converting enzyme (peptidyl-dipeptidase A) 2 immediate early response 3 lymphotoxin α (TNF superfamily, member 1), cholinergic receptor, nicotinic α5 angiotensin II receptor, type 1 fibroblast growth factor, lactoperoxidase, histone deacetylase 5, hyaluronoglucosaminidase, interferon regulatory factor, ADP-ribosyltransferase, thyroglobulin, orosomucoid, cyclin-dependent kinase inhibitor 1A (p21, Cip1), furin (paired basic amino acid cleaving enzyme), progesterone receptor, and gastrin brain-derived neurotrophic factor.

Additional targets are described in Table 1.

B. Cell Delivery

A variety of methods may be used to deliver oligonucleotides, including antagomirs, into a target cell. For cells in vitro embodiments, delivery can often be accomplished by direct injection into cells, and delivery can often be enhanced using hydrophobic or cationic carriers. Alternatively, the cells can be permeabilized with a permeabilization and then contacted with the oligonucleotide. The antagomir can be administered to the subject either as a naked oligonucleotide agent, in conjunction with a delivery reagent, or as a recombinant plasmid or viral vector which expresses the oligonucleotide agent.

For cells in situ, several applicable delivery methods are well-established, e.g., Elmen et al. (2008), Akinc et al. (2008); Esau et al. (2006), Krützfeldt et al. (2005). In particular, cationic lipids (see e.g., Hassani et al., 2004) and polymers such as polyethylenimine (see e.g., Urban-Klein, 2005) have been used to facilitate oligonucleotide delivery. Compositions consisting essentially of the oligomer (i.e., the oligomer in a carrier solution without any other active ingredients) can be directly injected into the host (see e.g., Tyler et al., 1999; McMahon et al., 2002). In vivo applications of duplex RNAs are reviewed in Paroo and Corey (2004).

When microinjection is not an option, delivery can be enhanced in some cases by using Lipofectamine™ (Invitrogen, Carlsbad, Calif.). PNA oligomers can be introduced into cells in vitro by complexing them with partially complementary DNA oligonucleotides and cationic lipid. The lipid promotes internalization of the DNA, while the PNA enters as cargo and is subsequently released. Peptides such as penetratin, transportan, Tat peptide, nuclear localization signal (NLS), and others, can be attached to the oligomer to promote cellular uptake (see e.g., Nielsen, 2004; Kaihatsu et al., 2003; Kaihatsu et al., 2004). Alternatively, the cells can be permeabilized with a permeabilization agent such as lysolecithin, and then contacted with the oligomer.

Alternatively, certain single-stranded oligonucleotide agents featured in the instant invention can be expressed within cells from eukaryotic promoters (e.g., Izant and Weintraub, 1985; McGarry and Lindquist, 1986; Scanlon et al., 1991; Kashani-Sabet et al, 1992; Propulic et al., 1992; Weerasinghe et al., 1991; Ojwang et al., 1992; Chen et al., 1992; Sarver et al., 1990; Thompson et al., 1995; Good et al., 1997). Those skilled in the art realize that any nucleic acid can be expressed in eukaryotic cells from the appropriate DNA/RNA vector. The activity of such nucleic acids can be augmented by their release from the primary transcript by a enzymatic nucleic acid (PCT WO 93/23569; PCT WO 94/02595; Ohkawa et al., 1992; Taira et al., 1991; Ventura et al., 1993; Chowrira et al., 1994).

The recombinant vectors can be DNA plasmids or viral vectors. Oligonucleotide agent-expressing viral vectors can be constructed based on, but not limited to, adeno-associated virus, retrovirus, adenovirus, or alphavirus. In another embodiment, pol III based constructs are used to express nucleic acid molecules of the invention (see for example Morris et al., 2004; U.S. Pat. Nos. 5,902,880 and 6,146,886). The recombinant vectors capable of expressing the oligonucleotide agents can be delivered as described above, and can persist in target cells. Alternatively, viral vectors can be used that provide for transient expression of nucleic acid molecules. Such vectors can be repeatedly administered as necessary. Once expressed, the antagomir interacts with the target RNA (e.g., miRNA or pre-miRNA) and inhibits miRNA activity. In a particular embodiment, the antagomir forms a duplex with the target miRNA, which prevents the miRNA from binding to its target mRNA, which results in increased translation of the target mRNA. Delivery of oligonucleotide agent-expressing vectors can be systemic, such as by intravenous or intra-muscular administration, by administration to target cells ex-planted from a subject followed by reintroduction into the subject, or by any other means that would allow for introduction into the desired target cell (see Couture et al., 1996).

Methods for the delivery of nucleic acid molecules are also described in Akhtar et al. (1992), Akhtar (1995), Maurer et al. (1999), Hofland and Huang (1999), Lee et al. (2000), all of which are incorporated herein by reference. U.S. Pat. No. 6,395,713 and PCT WO 94/02595 and WO 00/53722 further describe general methods for delivery of nucleic acid molecules.

C. Routes of Administration

A composition that includes an oligomer/antagomir can be delivered to a subject by a variety of routes. Exemplary routes include inhalation, parenchymal, subcutaneous, nasal, buccal and oral delivery. Also contemplated are delivery is through local administration directly to a disease site, or by systemic administration, e.g., parental administration. Parenteral administration includes intravenous (drip), subcutaneous, intraperitoneal or intramuscular injection, or intrathecal or intraventricular administration.

An antagomir featured in the invention can be administered to the subject by any means suitable for delivering the agent to the cells of the tissue at or near the area of unwanted target nucleic acid expression (e.g., target miRNA or pre-miRNA expression). Exemplary delivery methods include administration by gene gun, electroporation, or other suitable parenteral administration route.

Suitable parenteral administration routes include intravascular administration (e.g., intravenous bolus injection, intravenous infusion, intra-arterial bolus injection, intra-arterial infusion and catheter instillation into the vasculature); peri- and intra-tissue injection (e.g., intraocular injection); subcutaneous injection or deposition including subcutaneous infusion (such as by osmotic pumps); direct application to the area at or near the site of disease, for example by a catheter or other placement device.

D. Formulations

An antagomir can be incorporated into pharmaceutical compositions suitable for administration. For example, compositions can include one or more oligonucleotide agents and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

Formulations for direct injection and parenteral administration are well known in the art. Such formulations may include sterile aqueous solutions which may also contain buffers, diluents and other suitable additives. For intravenous use, the total concentration of solutes should be controlled to render the preparation isotonic. An antagomir featured in the invention may be provided in sustained release compositions, such as those described in, for example, U.S. Pat. Nos. 5,672,659 and 5,595,760. The use of immediate or sustained release compositions depends on the nature of the condition being treated. If the condition consists of an acute or over-acute disorder, treatment with an immediate release form will be utilized versus a prolonged release composition. Alternatively, for certain preventative or long-term treatments, a sustained release composition may be appropriate. An antagomir can include a delivery vehicle, such as liposomes, for administration to a subject, carriers and diluents and their salts, and/or can be present in pharmaceutically acceptable formulations.

The oligonucleotide agents featured by the invention may be formulated as pharmaceutical compositions prior to administering to a subject, according to techniques known in the art. Pharmaceutical compositions featured in the present invention are characterized as being at least sterile and pyrogen-free. As used herein, "pharmaceutical formulations" include formulations for human and veterinary use. Methods for preparing pharmaceutical compositions are within the skill in the art, for example as described in Remington's Pharmaceutical Science, 18th ed., Mack Publishing Company, Easton, Pa. (1990), and The Science and Practice of Pharmacy, 2003, Gennaro et al., the entire disclosures of which are herein incorporated by reference.

The present pharmaceutical formulations include an antagomir featured in the invention (e.g., 0.1 to 90% by weight), or a physiologically acceptable salt thereof, mixed with a physiologically acceptable carrier medium. Particular physiologically acceptable carrier media are water, buffered water, normal saline, 0.4% saline, 0.3% glycine, hyaluronic acid and the like.

Pharmaceutical compositions featured in the invention can also include conventional pharmaceutical excipients and/or additives. Suitable pharmaceutical excipients include stabilizers, antioxidants, osmolality adjusting agents, buffers, and pH adjusting agents. Suitable additives include physiologically biocompatible buffers (e.g., tromethamine hydrochloride), additions of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). Pharmaceutical compositions can be packaged for use in liquid form, or can be lyophilized.

For solid compositions, conventional non-toxic solid carriers can be used; for example, pharmaceutical grades of mannitol, lactose, starch, magnesium stearate, sodium saccharin, talcum, cellulose, glucose, sucrose, magnesium carbonate, and the like.

For example, a solid pharmaceutical composition for oral administration can include any of the carriers and excipients listed above and 10-95%, in particular 25%-75%, of one or more single-stranded oligonucleotide agents featured in the invention.

Non-limiting examples of agents suitable for formulation with the nucleic acid molecules of the instant invention include: P-glycoprotein inhibitors (such as PluronicP85), which can enhance entry of drugs into the CNS (Jolliet-Riant and Tillement, 1999); biodegradable polymers, such as poly (DL-lactide-coglycolide) microspheres for sustained release delivery. Other non-limiting examples of delivery strategies for the nucleic acid molecules featured in the instant invention include material described in Boado et al. (1998), Tyler et al. (1999a;b); Pardridge et al. (1995); Boado (1995); Aldrian-Herrada et al. (1998).

The invention also features the use of a composition that includes surface-modified liposomes containing poly(ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al., 1995; Ishiwata et al., 1995).

Such liposomes have been shown to accumulate selectively in tumors, presumably by extravasation and capture in the neovascularized target tissues (Lasic et al., 1995; Oku et al., 1995). The long-circulating liposomes enhance the pharmacokinetics and pharmacodynamics of DNA and RNA, particularly compared to conventional cationic liposomes which are known to accumulate in tissues of the MPS (Liu et al., 1995; PCT Publication No. WO 96/10391; PCT Publication No. WO 96/10390; PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

The present invention also features compositions prepared for storage or administration that include a pharmaceutically effective amount of the desired oligonucleotides in a pharmaceutically acceptable carrier or diluent. Acceptable carriers or diluents for therapeutic use are well known in the pharmaceutical art, and are described, for example, in Remington's Pharmaceutical Sciences, Mack Publishing Co. (1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Bulking agents that are particularly valuable include compatible carbohydrates, polypeptides, amino acids or combinations thereof. Suitable carbohydrates include monosaccharides such as galactose, D-mannose, sorbose, and the like; disaccharides, such as lactose, trehalose, and the like; cyclodextrins, such as 2-hydroxypropyl-β-cyclodextrin; and polysaccharides, such as raffinose, maltodextrins, dextrans, and the like; alditols, such as mannitol, xylitol, and the like. A particular group of carbohydrates includes lactose, threhalose, raffinose maltodextrins, and mannitol. Suitable polypeptides include aspartame. Amino acids include alanine and glycine, with glycine being specifically contemplated.

Suitable pH adjusters or buffers include organic salts prepared from organic acids and bases, such as sodium citrate, sodium ascorbate, and the like.

E. Dosage

An antagomir can be administered at a unit dose less than about 75 mg per kg of bodyweight, or less than about 70, 60, 50, 40, 30, 20, 10, 5, 2, 1, 0.5, 0.1, 0.05, 0.01, 0.005, 0.001, or 0.0005 mg per kg of bodyweight, and less than 200 nmol of antagomir (e.g., about $4.4 \times 10^{16}$ copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmol of antagomir per kg of bodyweight. The unit dose, for example, can be administered by injection (e.g., intravenous or intramuscular, intrathecally, or directly into an organ), inhalation, or a topical application.

Delivery of an antagomir directly to an organ can be at a dosage on the order of about 0.00001 mg to about 3 mg per organ, or particularly about 0.0001-0.001 mg per organ, about 0.03-3.0 mg per organ, about 0.1-3.0 mg per organ or about 0.3-3.0 mg per organ.

Significant modulation of target gene expression may be achieved using nanomolar/submicromolar or picomolar/subnamomolar concentrations of the oligonucleotide, and it is typical to use the lowest concentration possible to achieve the desired resultant increased synthesis, e.g., oligonucleotide concentrations in the 1-100 nM range are contemplated; more particularly, the concentration is in the 1-50 nM, 1-25 nM, 1-10 nM, or picomolar range. In particular embodiments, the contacting step is implemented by contacting the cell with a composition consisting essentially of the oligonucleotide.

In one embodiment, the unit dose is administered once a day, e.g., or less frequently less than or at about every 2, 4, 8 or 30 days. In another embodiment, the unit dose is not administered with a frequency (e.g., not a regular frequency). For example, the unit dose may be administered a single time. Because oligonucleotide agent can persist for several days after administering, in many instances, it is possible to administer the composition with a frequency of less than once per day, or, for some instances, only once for the entire therapeutic regimen.

An antagomir featured in the invention can be administered in a single dose or in multiple doses. Where the administration of the antagomir is by infusion, the infusion can be a single sustained dose or can be delivered by multiple infusions. Injection of the agent can be directly into the tissue at or near the site of aberrant or unwanted target gene expression (e.g., aberrant or unwanted miRNA or pre-miRNA expression). Multiple injections of the agent can be made into the tissue at or near the site.

In a particular dosage regimen, the antagomir is injected at or near a site of unwanted target nucleic acid expression once a day for seven days. Where a dosage regimen comprises multiple administrations, it is understood that the effective amount of antagomir administered to the subject can include the total amount of antagomir administered over the entire dosage regimen. One skilled in the art will appreciate that the exact individual dosages may be adjusted somewhat depending on a variety of factors, including the specific antagomir being administered, the time of administration, the route of administration, the nature of the formulation, the rate of excretion, the particular disorder being treated, the severity of the disorder, the pharmacodynamics of the oligonucleotide agent, and the age, sex, weight, and general health of the patient. Wide variations in the necessary dosage level are to be expected in view of the differing efficiencies of the various routes of administration. Variations in these dosage levels can be adjusted using standard empirical routines of optimization, which are well-known in the art. The precise therapeutically effective dosage levels and patterns can be determined by the attending physician in consideration of the above-identified factors.

In one embodiment, a subject is administered an initial dose, and one or more maintenance doses of an antagomir. The maintenance dose or doses are generally lower than the initial dose, e.g., one-half less of the initial dose. The maintenance doses are generally administered no more than once every 5, 10, or 30 days. Further, the treatment regimen may last for a period of time which will vary depending upon the nature of the particular disease, its severity and the overall condition of the patient. Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered two or more doses, as desired or considered appropriate under the specific circumstances. If desired to facilitate repeated or frequent infusions, implantation of a delivery device, e.g., a pump, semipermanent stent (e.g., intravenous, intraperitoneal, intracisternal or intracapsular), or reservoir may be advisable.

Certain factors may influence the dosage required to effectively treat a subject, including but not limited to the severity of the disease or disorder, previous treatments, the general health and/or age of the subject, and other diseases present. It will also be appreciated that the effective dosage of the antagomir used for treatment may increase or decrease over the course of a particular treatment. Changes in dosage may result and become apparent from the results of diagnostic assays. For example, the subject can be monitored after administering an antagomir composition. Based on information from the monitoring, an additional amount of the antagomir composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual compounds, and can generally be estimated based on $EC_{50}$'s found to be effective in in vitro and in vivo animal models.

IV. Detecting Expression

The detecting step is implemented by detecting a significant change in the expression of the target gene, for example, by detecting at least a 10%, 25%, 50%, 200% or 500% increase in expression of the target gene, or at least a 10%, 25%, 50%, 75%, or 90% decrease in expression of the target gene, relative to a negative control, such as basal expression levels.

Detection may be effected by a variety of routine methods, such as directly measuring a change in the level of the target gene mRNA transcript, or indirectly detecting increased or decreased levels of the corresponding encoded protein compared to a negative control. Alternatively, resultant selective modulation of target gene expression may be inferred from phenotypic or physiologic changes that are indicative of increased or decreased expression of the target gene.

A. Nucleic Acid Detection

Assessing expression may involve quantitating mRNA. Northern blotting techniques are well known to those of skill in the art. Northern blotting involves the use of RNA as a target. Briefly, a probe is used to target an RNA species that has been immobilized on a suitable matrix, often a filter of nitrocellulose. The different species should be spatially separated to facilitate analysis. This often is accomplished by gel electrophoresis of nucleic acid species followed by "blotting" on to the filter.

Subsequently, the blotted target is incubated with a probe (usually labeled) under conditions that promote denaturation and rehybridization. Because the probe is designed to base pair with the target, the probe will binding a portion of the target sequence under renaturing conditions. Unbound probe is then removed, and detection is accomplished.

Nucleic acids may be quantitated following gel separation and staining with ethidium bromide and visualization under UV light. Alternatively, if the nucleic acid results from a synthesis or amplification using integral radio- or fluorometrically-labeled nucleotides, the products can then be exposed to x-ray film or visualized under the appropriate stimulating spectra, following separation.

In one embodiment, visualization is achieved indirectly. Following separation of nucleic acids, a labeled nucleic acid is brought into contact with the target sequence. The probe is conjugated to a chromophore or a radiolabel. In another embodiment, the probe is conjugated to a binding partner, such as an antibody or biotin, and the other member of the binding pair carries a detectable moiety.

One example of the foregoing is described in U.S. Pat. No. 5,279,721, incorporated by reference herein, which discloses an apparatus and method for the automated electrophoresis and transfer of nucleic acids. The apparatus permits electrophoresis and blotting without external manipulation of the gel and is ideally suited to carrying out methods according to the present invention.

In addition, the amplification products described above may be subjected to sequence analysis to identify specific kinds of variations using standard sequence analysis techniques. Within certain methods, exhaustive analysis of genes is carried out by sequence analysis using primer sets designed for optimal sequencing (Pignon et al, 1994). The present invention provides methods by which any or all of these types of analyses may be used. Using the sequences disclosed herein, oligonucleotide primers may be designed to permit the amplification of sequences throughout the Killin gene that may then be analyzed by direct sequencing.

Reverse transcription (RT) of RNA to cDNA followed by relative quantitative PCR™ (RT-PCR™) can be used to determine the relative concentrations of specific mRNA species isolated from patients. By determining that the concentration of a specific mRNA species varies, it is shown that the gene encoding the specific mRNA species is differentially expressed.

In PCR™, the number of molecules of the amplified target DNA increase by a factor approaching two with every cycle of the reaction until some reagent becomes limiting. Thereafter, the rate of amplification becomes increasingly diminished until there is no increase in the amplified target between cycles. If a graph is plotted in which the cycle number is on the X axis and the log of the concentration of the amplified target DNA is on the Y axis, a curved line of characteristic shape is formed by connecting the plotted points. Beginning with the first cycle, the slope of the line is positive and constant. This is said to be the linear portion of the curve. After a reagent becomes limiting, the slope of the line begins to decrease and eventually becomes zero. At this point the concentration of the amplified target DNA becomes asymptotic to some fixed value. This is said to be the plateau portion of the curve.

The concentration of the target DNA in the linear portion of the PCR™ amplification is directly proportional to the starting concentration of the target before the reaction began. By determining the concentration of the amplified products of the target DNA in PCR™ reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundances of the specific mRNA from which the target sequence was derived can be determined for the respective tissues or cells. This direct proportionality between the concentration of the PCR™ products and the relative mRNA abundances is only true in the linear range of the PCR™ reaction.

The final concentration of the target DNA in the plateau portion of the curve is determined by the availability of reagents in the reaction mix and is independent of the original concentration of target DNA. Therefore, the first condition that must be met before the relative abundances of a mRNA species can be determined by RT-PCR™ for a collection of RNA populations is that the concentrations of the amplified PCR™ products must be sampled when the PCR™ reactions are in the linear portion of their curves.

The second condition that must be met for an RT-PCR™ experiment to successfully determine the relative abundances of a particular mRNA species is that relative concentrations of the amplifiable cDNAs must be normalized to some independent standard. The goal of an RT-PCR™ experiment is to determine the abundance of a particular mRNA species relative to the average abundance of all mRNA species in the sample. In the experiments described below, mRNAs for β-actin, asparagine synthetase and lipocortin II were used as external and internal standards to which the relative abundance of other mRNAs are compared.

Most protocols for competitive PCR™ utilize internal PCR™ standards that are approximately as abundant as the target. These strategies are effective if the products of the PCR™ amplifications are sampled during their linear phases. If the products are sampled when the reactions are approaching the plateau phase, then the less abundant product becomes relatively over represented. Comparisons of relative abundances made for many different RNA samples, such as is the case when examining RNA samples for differential expression, become distorted in such a way as to make differences in relative abundances of RNAs appear less than they actually are. This is not a significant problem if the internal standard is much more abundant than the target. If the internal standard is more abundant than the target, then direct linear comparisons can be made between RNA samples.

B. Protein Detection

Immunodetection. Antibodies can be used in characterizing protein expression in cells through techniques such as ELISAs and Western blotting. For example, antibodies may be immobilized onto a selected surface, such as a surface exhibiting a protein affinity such as the wells of a polystyrene microtiter plate. After washing to remove incompletely adsorbed material, it is desirable to bind or coat the assay plate wells with a non-specific protein that is known to be antigenically neutral with regard to the test antisera such as bovine serum albumin (BSA), casein or solutions of powdered milk. This allows for blocking of non-specific adsorption sites on the immobilizing surface and thus reduces the background caused by non-specific binding of antigen onto the surface.

After binding of antibody to the well, coating with a non-reactive material to reduce background, and washing to remove unbound material, the immobilizing surface is contacted with the sample to be tested in a manner conducive to immune complex (antigen/antibody) formation.

Following formation of specific immunocomplexes between the test sample and the bound antibody, and subsequent washing, the occurrence and even amount of immunocomplex formation may be determined by subjecting same to a second antibody having specificity for the target that differs the first antibody. Appropriate conditions include diluting the sample with diluents such as BSA, bovine gamma globulin (BGG) and phosphate buffered saline (PBS)/Tween®. These added agents also tend to assist in the reduction of nonspecific background. The layered antisera is then allowed to incubate for from about 2-4 hrs, at temperatures on the order of about 25°-27° C. Following incubation, the antisera-contacted surface is washed so as to remove non-immunocomplexed material. A particular washing procedure includes washing with a solution such as PBS/Tween®, or borate buffer.

To provide a detecting means, the second antibody may have an associated enzyme that will generate a color development upon incubating with an appropriate chromogenic substrate. Thus, for example, one will desire to contact and incubate the second antibody-bound surface with a urease or peroxidase-conjugated anti-human IgG for a period of time and under conditions which favor the development of immunocomplex formation (e.g., incubation for 2 hr at room temperature in a PBS-containing solution such as PBS/Tween®).

After incubation with the second enzyme-tagged antibody, and subsequent to washing to remove unbound material, the amount of label is quantified by incubation with a chromogenic substrate such as urea and bromocresol purple or 2,2'-azino-di-(3-ethyl-benzthiazoline)-6-sulfonic acid (ABTS) and $H_2O_2$, in the case of peroxidase as the enzyme label. Quantitation is then achieved by measuring the degree of color generation, e.g., using a visible spectrum spectrophotometer.

The preceding format may be altered by first binding the sample to the assay plate. Then, primary antibody is incubated with the assay plate, followed by detecting of bound primary antibody using a labeled second antibody with specificity for the primary antibody.

The antibody compositions of the present invention will also find use in immunoblot or Western blot analysis. The antibodies may be used as high-affinity primary reagents for the identification of proteins immobilized onto a solid support matrix, such as nitrocellulose, nylon or combinations thereof. In conjunction with immunoprecipitation, followed by gel electrophoresis, these may be used as a single step reagent for use in detecting antigens against which secondary reagents used in the detection of the antigen cause an adverse background. Immunologically-based detection methods for use in conjunction with Western blotting include enzymatically-, radiolabel- or fluorescently-tagged secondary antibodies against the toxin moiety are considered to be of particular use in this regard.

Mass Spectrometry. By exploiting the intrinsic properties of mass and charge, mass spectrometry (MS) can resolve and confidently identify a wide variety of complex compounds, including nucleic acids and proteins. Traditional quantitative MS has used electrospray ionization (ESI) followed by tandem MS (MS/MS) (Chen et al., 2001; Zhong et al., 2001; Wu et al., 2000) while newer quantitative methods are being developed using matrix assisted laser desorption/ionization (MALDI) followed by time of flight (TOF) MS (Bucknall et al., 2002; Mirgorodskaya et al., 2000; Gobom et al., 2000).

ESI is a convenient ionization technique developed by Fenn and colleagues (Fenn et al., 1989) that is used to produce gaseous ions from highly polar, mostly nonvolatile biomolecules, including lipids. The sample is injected as a liquid at low flow rates (1-10 μL/min) through a capillary tube to which a strong electric field is applied. The field generates additional charges to the liquid at the end of the capillary and produces a fine spray of highly charged droplets that are electrostatically attracted to the mass spectrometer inlet. The evaporation of the solvent from the surface of a droplet as it travels through the desolvation chamber increases its charge density substantially. When this increase exceeds the Rayleigh stability limit, ions are ejected and ready for MS analysis.

A typical conventional ESI source consists of a metal capillary of typically 0.1-0.3 mm in diameter, with a tip held approximately 0.5 to 5 cm (but more usually 1 to 3 cm) away from an electrically grounded circular interface having at its center the sampling orifice, such as described by Kabarle et al. (1993). A potential difference of between 1 to 5 kV (but more typically 2 to 3 kV) is applied to the capillary by power supply to generate a high electrostatic field ($10^6$ to $10^7$ V/m) at the capillary tip. A sample liquid carrying the analyte to be analyzed by the mass spectrometer, is delivered to the tip through an internal passage from a suitable source (such as from a chromatograph or directly from a sample solution via a liquid flow controller). By applying pressure to the sample in the capillary, the liquid leaves the capillary tip as small highly electrically charged droplets and further undergoes desolvation and breakdown to form single or multicharged gas phase ions in the form of an ion beam. The ions are then collected by the grounded (or negatively charged) interface plate and led through an the orifice into an analyzer of the mass spectrometer. During this operation, the voltage applied to the capillary is held constant. Aspects of construction of ESI sources are described, for example, in U.S. Pat. Nos. 5,838,002; 5,788,166; 5,757,994; RE 35,413; and U.S. Pat. No. 5,986,258.

In ESI tandem mass spectroscopy (ESI/MS/MS), one is able to simultaneously analyze both precursor ions and product ions, thereby monitoring a single precursor product reaction and producing (through selective reaction monitoring (SRM)) a signal only when the desired precursor ion is present. When the internal standard is a stable isotope-labeled version of the analyte, this is known as quantification by the stable isotope dilution method. This approach has been used to accurately measure pharmaceuticals (Zweigenbaum et al., 2000; Zweigenbaum et al., 1999) and bioactive peptides (Desiderio et al., 1996; Lovelace et al., 1991). Newer methods are performed on widely available MALDI-TOF instruments, which can resolve a wider mass range and have been used to quantify metabolites, peptides, and proteins. Larger molecules such as peptides can be quantified using unlabeled homologous peptides as long as their chemistry is similar to the analyte peptide (Duncan et al., 1993; Bucknall et al., 2002). Protein quantification has been achieved by quantifying tryptic peptides (Mirgorodskaya et al., 2000). Complex mixtures such as crude extracts can be analyzed, but in some instances, sample clean up is required (Nelson et al., 1994; Gobom et al., 2000).

Secondary ion mass spectroscopy, or SIMS, is an analytical method that uses ionized particles emitted from a surface for mass spectroscopy at a sensitivity of detection of a few parts per billion. The sample surface is bombarded by primary energetic particles, such as electrons, ions (e.g., O, Cs), neutrals or even photons, forcing atomic and molecular particles to be ejected from the surface, a process called sputtering. Since some of these sputtered particles carry a charge, a mass spectrometer can be used to measure their mass and charge. Continued sputtering permits measuring of the exposed elements as material is removed. This in turn permits one to construct elemental depth profiles. Although the majority of secondary ionized particles are electrons, it is the secondary ions which are detected and analyzed by the mass spectrometer in this method.

Laser desorption mass spectroscopy (LD-MS) involves the use of a pulsed laser, which induces desorption of sample material from a sample site—effectively, this means vaporization of sample off of the sample substrate. This method is usually only used in conjunction with a mass spectrometer, and can be performed simultaneously with ionization if one uses the right laser radiation wavelength.

When coupled with Time-of-Flight (TOF) measurement, LD-MS is referred to as LDLPMS (Laser Desorption Laser Photoionization Mass Spectroscopy). The LDLPMS method of analysis gives instantaneous volatilization of the sample, and this form of sample fragmentation permits rapid analysis without any wet extraction chemistry. The LDLPMS instrumentation provides a profile of the species present while the retention time is low and the sample size is small. In LDLPMS, an impactor strip is loaded into a vacuum chamber. The pulsed laser is fired upon a certain spot of the sample site, and species present are desorbed and ionized by the laser radiation. This ionization also causes the molecules to break up into smaller fragment-ions. The positive or negative ions made are then accelerated into the flight tube, being detected at the end by a microchannel plate detector. Signal intensity, or peak height, is measured as a function of travel time. The applied voltage and charge of the particular ion determines the kinetic energy, and separation of fragments are due to different size causing different velocity. Each ion mass will thus have a different flight-time to the detector.

One can either form positive ions or negative ions for analysis. Positive ions are made from regular direct photoionization, but negative ion formation requires a higher powered laser and a secondary process to gain electrons. Most of the molecules that come off the sample site are neutrals, and thus can attract electrons based on their electron affinity. The negative ion formation process is less efficient than forming just positive ions. The sample constituents will also affect the outlook of a negative ion spectra.

Other advantages with the LDLPMS method include the possibility of constructing the system to give a quiet baseline of the spectra because one can prevent coevolved neutrals from entering the flight tube by operating the instrument in a linear mode.

Since its inception and commercial availability, the versatility of MALDI-TOF-MS has been demonstrated convincingly by its extensive use for qualitative analysis. For example, MALDI-TOF-MS has been employed for the characterization of synthetic polymers (Marie et al., 2000; Wu et al., 1998). peptide and protein analysis (Roepstorff, 2000; Nguyen et al, 1995), DNA and oligonucleotide sequencing (Miketova et al., 1997; Faulstich et al., 1997; Bentzley et al., 1996), and the characterization of recombinant proteins (Kanazawa et al, 1999; Villanueva et al., 1999). Recently, applications of MALDI-TOF-MS have been extended to include the direct analysis of biological tissues and single cell organisms with the aim of characterizing endogenous peptide and protein constituents (Lynn et al., 1999; Stoeckli et al., 2001; Caprioli et al., 1997; Chaurand et al., 1999; Jespersen et al., 1999).

The properties that make MALDI-TOF-MS a popular qualitative tool—its ability to analyze molecules across an extensive mass range, high sensitivity, minimal sample preparation and rapid analysis times—also make it a potentially useful quantitative tool. MALDI-TOF-MS also enables non-volatile and thermally labile molecules to be analyzed with relative ease. It is therefore prudent to explore the potential of MALDI-TOF-MS for quantitative analysis in clinical settings. While there have been reports of quantitative MALDI-TOF-MS applications, there are many problems inherent to the MALDI ionization process that have restricted its widespread use (Kazmaier et al., 1998; Horak et al., 2001; Gobom et al., 2000; Desiderio et al., 2000). These limitations primarily stem from factors such as the sample/matrix heterogeneity, which are believed to contribute to the large variability in observed signal intensities for analytes, the limited dynamic range due to detector saturation, and difficulties associated with coupling MALDI-TOF-MS to on-line separation techniques such as liquid chromatography. Combined, these factors are thought to compromise the accuracy, precision, and utility with which quantitative determinations can be made.

Because of these difficulties, practical examples of quantitative applications of MALDI-TOF-MS have been limited. Most of the studies to date have focused on the quantification of low mass analytes, in particular, alkaloids or active ingredients in agricultural or food products (Jiang et al., 2000; Yang et al., 2000; Wittmann et al., 2001), whereas other studies have demonstrated the potential of MALDI-TOF-MS for the quantification of biologically relevant analytes such as neuropeptides, proteins, antibiotics, or various metabolites in biological tissue or fluid (Muddiman et al., 1996; Nelson et al., 1994; Duncan et al., 1993; Gobom et al., 2000; Wu et al., 1997; Mirgorodskaya et al., 2000). In earlier work it was shown that linear calibration curves could be generated by MALDI-TOF-MS provided that an appropriate internal standard was employed (Duncan et al., 1993). This standard can "correct" for both sample-to-sample and shot-to-shot variability. Stable isotope labeled internal standards (isotopomers) give the best result.

With the marked improvement in resolution available on modern commercial instruments, primarily because of delayed extraction (Bahr et al., 1997; Takach et al., 1997), the opportunity to extend quantitative work to other examples is now possible; not only of low mass analytes, but also biopolymers.

V. Examples

The following examples are included to further illustrate various aspects of the invention. It should be appreciated by those of skill in the art that the techniques disclosed in the examples that follow represent techniques and/or compositions discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

Example 1

Methods

Dataset acquisition. Promoter sequences were downloaded from the DBTSS (dbtss.hgcjp) (Wakaguri et al., 2008; Tsuritani et al., 2007; Ota et al, 2004; Suzuki and Sugano, 2003). miRNA sequences were downloaded from miRBase (microrna.sanger.ac.uk) (Griffiths-Jones, 2004; Griffiths-Jones et al., 2006).

Comparative Sequence Analysis. Gene promoters and miRNA sequences were compared using BLASTN with word size=7 and gap penalty=−1. miRNAs with perfect complementarity to gene promoters at bases 2-7 and 12-17 of the miRNA sequence were characterized as promoter-targeting miRNAs (FIG. 2). Alignments were also required to span from bases 2 through (n−2) of the miRNA sequence, where n=the total length of the miRNA sequence. Promoters corresponding to uncharacterized open reading frames or hypothetical genes were omitted from subsequent experiments. miRNAs that aligned with their own genomic origin were also dismissed.

Cell culture. T47D cells (America Type Cell Culture Collection, ATCC) were maintained in RPMI-1640 medium (ATCC) supplemented with 10% fetal bovine serum (FBS), 0.5% nonessential amino acids (NEAA), 1 mM sodium pyruvate, 10 mM HEPES, and 0.4 units/ml bovine insulin. Cells were cultured at 37° C. and 5% $CO_2$.

Lipid-mediated transfection. Cells were plated at 200,000 cells per well in six-well plates (Costar) two days before transfection. Transfection of oligonucleotides was performed with RNAi-max (Invitrogen) according to the manufacturer's instructions. Duplex RNAs were prepared as described (Janowski et al., 2005). All duplex RNAs and single stranded LNAs were introduced at 100 nM concentrations (FIG. 4). miR-mimics, LNAs, and siRNAs were harvested at 1, 3, and 5 days prior to transfection, respectively.

RNA analysis. Total RNA from treated T47D cells was extracted with TRIzol (Invitrogen). RNA was treated with DNase I to remove contaminating DNA and subsequently reverse-transcribed by random primers with a High Capacity cDNA Archive Kit (Applied Biosystems).

Quantitative PCR (qPCR). qPCR was performed on an ABI7900 real-time PCR (Applied Biosystems) using iTaq SYBR Green Supermix w/ROX (BIO-RAD). Primers were designed using primer3 software with the exception of primers for GAPDH which were supplied as a control (Applied Biosystems) (FIG. 5). Only those primer sets that show linear amplification over several orders of magnitude were used. RNA was treated with DNase prior to reverse transcription. Taqman miRNA assay kit for miR566 (Applied Biosystems) was used according to manufacturer's instructions to detect miR566 in T47D cells.

5'-Rapid amplification of cDNA ends (5'-RACE). 5'-RACE and 3'-RACE was performed according to the manufacturer's protocol using the GeneRacer kit (Invitrogen). The inventors chose this kit because it includes purification steps designed to obtain full length RNA with intact 5' caps rather than truncated products. 3'-RACE protocol selected for polyadenylated transcripts. Forty-six primers were used, blanketing the promoter from −20 to −1099 to maximize detection of transcripts and reduce the likelihood of bias from any one primer set (FIG. 6). Each primer was screened for either 5' or 3' products or both. PCR products were cloned into a PCR-4 Topo vector and sequenced. The inventors used the Platinum Taq High Fidelity kit (Invitrogen) to produce product for cloning. They sequenced multiple clones from at least two independent experiments to confirm results.

Biotin pulldown of small RNA:transcript complexes. T47D were grown in six-well dishes and transfected with biotinylated RNA heteroduplexes (a 3'-biotin on either the sense or antisense strand, supplied by Sigma-Proligo) at a concentration of 100 nM for 24 hours. Avidin-coated beads were prepared by pre-blocking with yeast tRNA and salmon sperm DNA. Cells were harvested at 24 hours to obtain nuclei. The nuclei were lysed and mixed with avidin-coated beads at 4° C. for two hours. The inventors washed the beads exhaustively prior to elution of RNA using buffer (1.5% Biotin, 4 M guanidine thiocyanate, 25 mM sodium citrate, 0.5% sodium N-lauroyl sarcosinate) for 2 hours at 45° C. with periodic gentle agitation. Samples were treated with DNase to remove any contaminating DNA and then amplified by PCR using a primer set capable of amplifying the target ncRNA transcript (FIG. 5).

RNA immunoprecipitation (RIP). RIP was performed essentially as described (Schwartz et al., 2008). The inventors grew T47D cells in 150 cm$^2$ dishes and transfected duplex RNAs using RNAiMax (Invitrogen). Cells were crosslinked using 1% formaldehyde solution and harvested. Cells were lysed and nuclei obtained. Antibody capable of binding to all 4 human isoforms of AGO was incubated with nuclei overnight (Nelson et al., 2007). The antibody-treated material was then mixed with Protein A/G agarose Plus (Santa Cruz) and washed five times as described (Schwartz et al., 2008). Complex was eluted and crosslinking reversed by adding 200 nM NaCl and heating to 65° C. for two hours. Samples were amplified using a primer set capable of amplifying the target ncRNA transcript (FIG. 5).

Chromatin immunoprecipitation (ChIP). ChIP was performed as described (Schwartz et al., 2008). Inhibition of TROAP was confirmed using qPCR. Anti-RNA Pol II and anti-H3K9me2 antibodies were supplied by Upstate. Primer sets targeting the TROAP gene and TROAP promoter were used for the Pol II and H3K9me2 ChIPs, respectively (FIG. 5).

Example 2

Modulating Expression of Target Genes with Antisense Oligonucleotides of Endogenous miRNA Complementary to Promoters of the Target Genes To identify endogenous promoter-targeting RNAs, the inventors constructed a comparative database comprised of sequences from publicly available datasets. Promoter sequences were acquired from the database of Transcriptional Start Sites (dbTSS), which houses experimentally determined transcription start sites and the flanking sequences for over 15,000 human genes (Wakaguri et al., 2008; Tsuritani et al., 2007; Ota et al, 2004; Suzuki and Sugano, 2003. Small RNA sequences were obtained from miRBase which contains sequences of computationally predicted and experimentally determined endogenous small RNAs (Griffiths-Jones, 2004; Griffiths-Jones et al., 2006).

To compare these data sets, the inventors derived a sequence comparison algorithm (FIG. 1) based on current guidelines for identifying potential mRNA targets for miRNAs (Grimson et al., 2007). Briefly, miRNAs with perfect complementarity to promoter sequences at bases 2-8 and 12-17 of the miRNA sequence were classified as predicted promoter-targeting miRNAs. The inventors dismissed alignments corresponding to uncharacterized open reading frames or hypothetical genes and those between miRNAs and their own genomic origin. Using these criteria in an initial screen, the inventors identified 63 alignments involving 35 unique miRNAs and 58 unique gene promoters (FIG. 2).

To identify candidate target genes that might be under control of miRNAs, the inventors inhibited expression of DICER, an enzyme required for miRNA biogenesis. Quantitative PCR (qPCR) revealed that mRNA expression of 6 out of 7 candidate target genes were significantly increased following siRNA knockdown of DICER in T47D breast cancer cells.

The inventors next examined the ability of specific miRNA-mimics to modulate the expression of their predicted target genes. The miRNA mimics used were synthetic duplex RNAs consisting of the miRNA sequence and a fully complementary carrier strand. In exemplary experiments, introduction of a miR566 mimic reduced expression of both TROAP and PNRC2, and the miR339-5p and miR545 mimics decreased expression of APHIB and UHMK1, respectively.

To determine if endogenous miRNAs were regulating the remaining candidate genes, the inventors used single-stranded antisense oligonucleotides containing 2'-O-methyl (2'-O-me) bases that were complementary to the predicted miRNAs. 2'-O-me oligomers are known to be able to bind to miRNAs and block their activity (25, 17, 18). For example, 2'-O-methyl RNA targeting miR566 increased TROAP by almost 3-fold.

To further elucidate the link between miRNA and target gene expression, the inventors targeted miRNA with complementary single-stranded antisense oligonucleotides containing locked nucleic acid (LNA) (Elmén et al., 2008; Ørom et al., 2006) bases and examined the effect on target gene expression. For example, LNA complementary to miR-566 increased TROAP mRNA expression by 5-fold as compared to an LNA that contained 4 mismatched bases or a scrambled sequence. The complementary antisense LNA also increased TROAP protein levels as compared to the same negative controls.

To further document the protocols, the inventors developed a panel of inhibitor oligonucleotides that target miRNAs with complementarity to promoters of additional therapeutically-relevant target genes. For example, in cell based experiments (supra), both 2'-O-me and LNA-modified versions of the inhibitor sequences shown in Tables 1-2 demonstrate significant transcriptional regulation for the targeted gene expression.

miRNAs have been understood to regulate gene expression at the post-transcriptional level through recognition of 3'-UTRs within mRNA transcripts. These studies extend miRNA function to recognition of gene promoters, particularly non-coding RNA transcripts at gene promoters, and reveal a novel mechanism for regulation of gene transcription. The inventors have demonstrated with diverse examples that they can with reasonable predictability modulate expression of a target gene by (a) identifying an endogenous miRNA complementary to a promoter of a target gene; and (b) contacting the miRNA with a single-stranded complementary oligonucleotide effective to bind the miRNA and thereby modulate expression of the target gene.

Example 3

Activating Caveolin-1 Expression Potently Inhibits Matrigel Invasion by Metastatic Mammary Tumor Cells The inventors designed complementary single-stranded antisense oligonucleotides containing (i) 2'-O-methyl or (ii) LNA bases, and targeting hsa-miR-33a* (Table 2) to target caveolin-1 gene expression in metastatic mammary tumor cells, and demonstrate that increased expression of Cav-1 in Met-1 cells reduces their invasive potential. Invasion through Matrigel®-coated membranes is a widely accepted method for assessing the metastatic potential of virtually all types of tumor cells. In this example, Matrigel® invasion assays are used to measure the invasiveness of cells in response to chemoattractants (0.5 or 10% FBS in DMEM) over a 24 h incubation period. In pilot experiments, oligonucleotide-treated cells (2'-O-methyl and LNA base-containing) show a ~5-fold reduction in Matrigel® invasion in response to 10% FBS.

Example 4

Activating Map Kinase_Activated Protein Kinase 2 Expression by Systemic Delivery of Specific Anti-miRNA Oligonucleotides Reduces Atherosclerosis in Hypercholesterolemic Mice The inventors identified an endogenous miRNA (hsa-miR-297) complementary to the promoter of the therapeutically important target gene mitogen-activated protein kinase-activated protein kinase 2 (MAPKAPK2); see FIG. 2. The inventors then designed single-stranded oligonucleotide complements to hsa-miR-297 (antisense hsa-miR-297) incorporating (i) LNA- or (ii) 2'-O-methyl-modified bases to confirm their ability to bind the endogenous miRNA and thereby modulate MAPKAPK2 expression.

In a murine atherosclerosis model both LNA- and 2'-O-methyl-modified antisense hsa-miR-297 oligonucleotides markedly reduce indicia of atherosclerosis in LDLR-deficient mice fed an atherogenic diet for 8 or 16 weeks as indicated by a significantly reduced lipid-positive area (oil red O) in the aorta descendens (en face) and the aortic arch (longitudinal sections); see detailed methods below.

LDLR-deficient mice (C57Bl/6, Jackson Laboratories, Bar Harbor, Me.) are fed a high-cholesterol diet (product #D12108, Research Diets; 1.25% Cholesterol without added cholate) for 8 and 16 weeks. Subsequently, mice are euthanized and the aortas removed and analyzed as described below. Aortic arches are frozen in OCT compound (Tissue-Tek) and the thoracic and abdominal parts of the aortas fixed in 10% buffered formalin (see, Jagavelu et al., 2007, Circ. Res.101; 1104-1112).

Saline-formulated compounds were administered into normal and hypercholesterolaemic C57BL/6J mice by intraperitoneal injections (two weekly intraperitoneal doses of 5 mg/kg LNA- or 2'-O-methyl modified anti-miR for six weeks). LNA-modified and 2'-O-methyl oligonucleotides are synthesized as described herein.

Immunohistochemistry/Immunofluorescence. Serial cryostat sections (6 μm) of mouse aortic arches are fixed in acetone (−20° C., 5 minutes), air dried, and stained by the avidinbiotin-peroxidase method. For immunfluorescence serial cryosections (6 μm) of mouse aortic arches are fixed in paraformaldehyde (4° C., 15 minutes) and permeabilized with 0.1% Triton X-100 for minutes. Sections are incubated with primary antibodies overnight at 4° C. followed by incubation with a fluorescence dye-conjugated secondary antibody (Molecular Probes/Invitrogen). Nuclei are stained with 4'-6-diamidino-2-phenyl indole-2HCl (DAPI, Santa Cruz Biotechnologies).

Oil Red 0 Staining for Lipids. Deposition of lipids in en face preparations of the aorta descendens (fixed with 10% formalin) and cryosections of the aortic arch is determined by oil red O staining.

Tissue Analysis. To quantify the extent and composition of the aortic lesions longitudinal sections of the aortic arch were analyzed microscopically in all mice. In the aortic arch, a 2-mm proximal segment of the inner curvature, starting at a perpendicular dropped from the left side of the left subclavian artery origin, is analyzed for the total wall area. The respective areas positively stains for lipids (oil red O), macrophages (MOMA-2), VCAM-1, and ICAM-1 are determined via computer-assisted image quantification (Leica Microscope DM 4000B, Leica Qwin software, Leica). En face analysis of lipid depositions of the pinned Aorta descendens use measurement of percentage of surface area (20 mm from the iliac bifurcation to the thoracic section of the aorta) stained by oil red O using computer-assisted image analysis (Axiovertmicroscope & Axioversion Rel. 4.4 software, Zeiss).

Example 5

Mechanistic Studies Using TROAP—miR-566

For detailed mechanistic studies, the inventors selected an exemplary target gene—miRNA regulatory pair. TROAP has been implicated to function in cell adhesion (Fukuda et al., 1995), is involved in mitotic spindle assembly (Yang et al., 2008), and has been identified as a prostate cancer biomarker (Dhanasekaran et al., 2001). Sequence analysis revealed that miR-566 is complementary to the TROAP gene promoter at bases −405 to −386 relative to the RefSeq transcription start site. To verify the transcription start site (TSS) of TROAP in T47D cells the inventors used 5'-RACE. The inventors identified the TROAP TSS to be 57 bases downstream of the RefSeq start site and 443 bases downstream of the predicted miR-566 target sequence.

To verify that miR-566 is expressed in T47D cells, the inventors used quantitative RT-PCR. They detected miR-566 in whole cell RNA preparations. To verify that miR-566 is present in the nucleus of T47D cells, the inventors repeated the experiment on nuclear isolates. They also detected miR-566 in the nucleus.

The inventors have previously shown that noncoding RNAs (ncRNAs) transcribed from gene promoters are the molecular targets for synthetic agRNAs that inhibit or activate the progesterone receptor gene (Schwartz et al., 2008). The inventors reasoned that at least some miRNAs might also target ncRNAs originating from gene promoters. miR-566 would be a near perfect complement to a ncRNA transcribed in the sense direction relative to the TROAP gene. Using Reverse-Transcription PCR(RT-PCR), the inventors detected RNA species produced from the TROAP promoter both surrounding and overlapping the predicted miR-566 target sequence. Using RACE, they also identified a ncRNA transcript which initiates 1047 bases upstream of the RefSeq start. The ncRNA transcript is spliced, resulting in excision of the predicted miR-566 target sequence from the mature RNA. The transcript contains 5 exons, 3 of which overlap TROAP mRNA, but has no obvious protein coding potential. Mechanistically, miR-566 may bind to this ncRNA prior to RNA splicing, consistent with the miRNA binding to the target RNA in close proximity to the chromosome. Pre-mRNA transcripts are established targets for synthetic antisense oligonucleotides (Aartsma-Rus and van Ommun, 2007).

To investigate the potential for miR-566 to bind to an RNA originating from the TROAP promoter, the inventors synthesized a miR-566 mimic with a 3'-biotin label. Labeling of the miR-566 mimics did not affect their ability to repress TROAP expression after transfection into cells. Nuclei from cells transfected with labeled miR-566 mimic were isolated and biotinylated material was recovered using avidin beads. RT-PCR amplification and sequencing of purified material detected an RNA product that originated from the TROAP promoter and contained the recognition sequence for miR-566. The RNA product was not detected when the complementary strand (− strand) of the miR-566 mimic duplex was biotinylated, when cells were treated with unlabeled miR-566 mimic or mismatch duplexes, or under conditions that would only amplify DNA. These data indicate a physical association of miR-566 mimic with an RNA species produced from the TROAP promoter.

The inventors have previously observed that activating and inhibitory synthetic agRNAs recruit AGO proteins to target RNA transcripts at gene promoters (Schwartz et al., 2008). They reasoned that endogenous miR-566 might be recruiting AGO to an RNA transcript originating from the TROAP promoter. To test this hypothesis, the inventors used RNA immunoprecipitation (RIP) with a well-characterized anti-argonaute antibody that recognizes all 4 human AGO isoforms (Nelson et al., 2007). RT-PCR amplification and sequencing of purified material detected an RNA product that originated from the TROAP promoter. The association between AGO and the TROAP promoter RNA species is absent in cells treated with an siRNA targeting DICER. These results indicate that AGO association with TROAP promoter RNA is dependent on endogenous miR-566.

Synthetic agRNAs can silence gene expression by blocking transcription (Ting et al., 2005; Morris et al., 2004; Janowski et al., 2006). To determine the affects of miR-566 on TROAP gene transcription, the inventors performed ChIP using an anti-RNA Polymerase II (Pol II) antibody. Addition of the miR-566 mimic decreased Pol II occupancy on the TROAP gene by 77% as compared to mismatch duplex treated cells. This decrease in Pol II occupancy indicates that miR-566 silences TROAP expression at the level of transcription. To further examine changes at the level of the chromosome in response to miR-566, the inventors analyzed histone modifications. Specifically, dimethylation of histone 3 lysine 9 (H3K9me2) has been implicated in gene silencing by synthetic agRNAs (Ting et al., 2005; Kim et al., 2006). Consistent with these findings, addition of miR-566 mimic increased H3K9me2 occupancy at the TROAP promoter by nearly 7 fold as compared to mismatch duplex treated cells.

These studies demonstrate that miRNAs can recognize gene promoter sequences inside mammalian cells by binding non-coding RNA transcripts produced from the target promoter. The inventors identify i) multiple miRNAs with significant complementarity to gene promoters, ii) that inhibiting endogenous miRNA by complementary oligonucleotides results in increased target gene expression, iii) miRNAs bind to noncoding RNA species that originate from gene promoters. Recently, Place et al. reported that a miRNA mimic with complementarity to the promoters of E-cadherin and CSDC2 could activate gene expression when transiently introduced (Place et al., 2008). In this report, however, DICER knockdown had no effect on the predicted target genes and oligomers targeting the putative miRNA had no effect on gene expression. These data do not support the existence of an endogenous miRNA that regulates expression of either E-cadherin or CSDC2 9 Place et al., 2008).

Example 6

Predicting Potential miRNA Targets Sites within Gene Promoters

Sequence Acquisition. To identify putative promoter-targeting miRNAs the inventors constructed a database comprised of miRNA and gene promoter sequences from public sequence repositories. Promoter sequences were acquired from the UCSC genome browser (hg 18) and consisted of the 200 nucleotides immediately 5' to the annotated transcription start site for each gene (Intl Human Genome Sequencing Consortium, 2001; Kent et al., 2002). The inventors chose 200 base sequences (−200 to −1) for initial evaluations, but larger promoter regions can also be examined. Mature miRNA sequences were obtained from miRBase (Build 12.0), which contains sequences of experimentally determined precursor and mature miRNAs (Grffiths-Jones et al., 2008; Griffiths-Jones et al., 2006; Griffiths-Jones, 2004).

Analysis of Seed Matches. Synthetic agRNAs target non-coding (ncRNA) transcripts that overlap gene promoters. The inventors used promoter DNA sequences to construct datasets representing potential ncRNA transcripts in both the sense and antisense direction for each gene promoter. For comparison, they also obtained the sequences of the 5'UTR, coding sequence (CDS), and 3'UTR for each gene (FIG. 7A).

A basic requirement for target recognition by miRNAs is perfect complementarity between the target sequences and bases 2-8 of the mature miRNA sequence, called the seed sequence. The inventors determined the number of seed matches within potential sense and antisense transcripts that overlap gene promoters and compared them to seed matches within the 3'UTR region of mRNAs (FIG. 7B). They found that seed matches within promoter-overlapping transcripts occur 80% as frequently as seed matches within 3'UTRs, indicating that gene promoter sequences have the potential to be miRNA targets (FIG. 8A).

To evaluate the statistical significance of seed matches within gene promoter sequences, the inventors tabulated the frequency of occurrences of seed matches in 100 randomizations of each promoter sequence. They found that seed matches occur 75% as frequently within randomized as opposed to actual promoter sequences (FIG. 8B). The excess of observed to expected seed sequence matches within promoter sequences was similar for both putative sense and antisense transcripts. This result implies that promoter sequences are enriched for potential targets for recognition by miRNAs. Matches are equally distributed throughout the 200 base gene promoter segments surveyed, suggesting that no particular region of a gene promoter is more likely than another to contain a predicted miRNA target site (FIG. 8C).

Ranking Matches. The inventors' analysis identified nearly 800,000 miRNA seed matches within 27,345 gene promoter sequences (FIG. 8B). This large number required investigation of additional factors to prioritize target predictions. Although not necessarily a prerequisite for miRNA function, the minimum free energy (MFE) of hybridization between miRNAs and their predicted target sites have been successfully used to predict miRNA target sites within 3'UTRs (Stark et al., 2003). The inventors reasoned that MFE values may also be useful for prioritizing miRNA target predictions within gene promoters.

The MFE values were calculated for miRNA hybridization to predicted target sites (based on seed sequence matches, hereafter simply referred to as predictions) within putative promoter-overlapping transcripts and within 10 randomizations of promoter sequences. The inventors found that predictions with lower MFE values occurred more frequently in actual promoter sequences than in randomized sequences (FIG. 9A). The difference between the distributions of MFE values demonstrates that predictions with low MFE values occur more often than would be expected at random, implying that these predictions are more likely to be biologically significant and that MFE values will be useful criteria for prioritizing target predictions.

During the course of the MFE analysis, the inventors identified several miRNA target predictions within gene promoters that had notably low MFE values. These observations prompted the inventors to compare the MFE values for target predictions within gene promoters to target predictions within 3'UTRs (FIG. 9B). The inventors calculated the mean MFE value for all predictions within gene promoters to be −24.27 kcal/mol and −24.32 kcal/mol for putative sense and antisense promoter-overlapping transcripts, respectively. The mean MFE for all predictions within 3'UTRs was −20.57 kcal/mol, more than 3.5 kcal/mol higher than predictions within promoters. The difference in mean MFE values suggests that, on average, miRNA recognition of sequences at gene promoters would be more energetically favorable than recognition of 3'UTR sequences.

To further evaluate the differences between target predictions within gene promoters and 3'UTRs, the inventors examined the distribution of MFE values for all predictions within the different sequence datasets. As previously indicated by the mean MFE values, roughly 50% of target predictions within gene promoters had MFE values below −24.3 kcal/mol. Interestingly, only 22% of predictions within 3'UTRs had MFE values below −24.3 kcal/mol (FIG. 9B). The difference in MFE value distributions demonstrates that gene promoters are enriched relative to 3'UTRs for predicted target sites with low free energies of hybridization and may actually represent more favorable miRNA targets than 3'UTRs.

Another criterion used in miRNA target prediction is sequence complementarity. Sequence complementarity alone has been used successfully to predict miRNA target sites within 3'UTRs (Lai, 2002). The inventors used the Needleman-Wunsch algorithm (Neddleman and Wunsch, 1970) to evaluate the degree of sequence complementarity between miRNAs and predicted target sites within gene promoters (FIG. 7B). They identified over 200 individual miRNAs with near perfect complementarity to their predicted target sites within gene promoters. A selected subset of these predictions is listed in FIG. 10. The high degree of complementarity between miRNAs and gene promoters further demonstrates that gene promoters contain promising candidates for miRNA target sequences.

Summary. Strong evidence that gene expression can be modulated using synthetic duplex RNAs that are complementary to gene promoters suggests that natural gene regulation may include recognition of gene promoters by miRNAs. Such recognition would have evolutionary advantages, given the large difference between protein transcription factors and miRNAs in their efficiency of generating new selectivity for gene promoters through mutation.

Here, the inventors describe a computational algorithm that can be used to identify promising miRNA target sites within gene promoters. They identified many seed sequence matches within promoters and demonstrate that they are almost as common as those within 3'UTRs. They also identified many miRNA/promoter pairs that have unusually strong complementarity. These results can be used to rank order miRNA/promoter pairs for the demanding studies necessary to validate whether the potential for these interactions is biologically significant. Recognition of gene promoters by miRNAs would have important implications for the development of synthetic agents that regulate gene expression.

The foregoing description and examples are offered by way of illustration and not by way of limitation. All publications and patent applications cited in this specification are herein incorporated by reference as if each individual publication or patent application were specifically and individually indicated to be incorporated by reference. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

VI. References

The following references, to the extent that they provide exemplary procedural or other details supplementary to those set forth herein, are specifically incorporated herein by reference:

U.S. Pat. No. 4,981,957
U.S. Pat. No. 5,118,800
U.S. Pat. No. 5,279,721
U.S. Pat. No. 5,319,080
U.S. Pat. No. 5,359,044
U.S. Pat. No. 5,393,878
U.S. Pat. No. 5,446,137
U.S. Pat. No. 5,466,786
U.S. Pat. No. 5,514,785
U.S. Pat. No. 5,519,134
U.S. Pat. No. 5,567,811

U.S. Pat. No. 5,576,427
U.S. Pat. No. 5,591,722
U.S. Pat. No. 5,595,760
U.S. Pat. No. 5,597,909
U.S. Pat. No. 5,610,300
U.S. Pat. No. 5,627,053
U.S. Pat. No. 5,639,873
U.S. Pat. No. 5,646,265
U.S. Pat. No. 5,658,873
U.S. Pat. No. 5,670,633
U.S. Pat. No. 5,672,659
U.S. Pat. No. 5,700,920
U.S. Pat. No. 5,792,747
U.S. Pat. No. 5,902,880
U.S. Pat. No. 6,146,886
U.S. Pat. No. 6,268,490
U.S. Pat. No. 6,268,490
U.S. Pat. No. 6,395,713
U.S. Pat. No. 6,525,191
U.S. Pat. No. 6,531,584
U.S. Pat. No. 6,600,032
U.S. Pat. No. 6,670,461
U.S. Pat. No. 6,770,748
U.S. Pat. No. 6,794,499
U.S. Pat. No. 7,034,133
U.S. Pat. No. 7,053,207
U.S. Patent Publn. 2003/0082807
U.S. Patent Publn. 2003/0207841
U.S. Patent Publn. 2004/0014959
U.S. Patent Publn. 2004/0143114
U.S. Patent Publn. 2004/0171570
U.S. Patent Publn. 2004/0219565
U.S. Patent Publn. 2007/0213292
U.S. Patent Publn. 2007/0287831
U.S. Patent Publn. 2008/0015162
U.S. Patent Publn. 2008/0032945
Aartsma-Rus and vanOmmen, *RNA*, 13:1609, 2007.
Akhtar et al., *Trends in Cell Bio.*, 2:139, 1992.
Akhtar In: *Delivery Strategies for Antisense Oligonucleotide Therapeutics*, 1995.
Akinc et al., *Nat. Biotechnol.*, 26(5):561-9, 2008.
Aldrian-Herrada et al., *Nucleic Acids Res.*, 26:4910, 1998.
Allerson et al., *J. Med. Chem.*, 48:901-904, 2005.
Bentin and Nielsen, *Biochemistry*, 35:8863-8869, 1996.
Boado et al., *J. Pharm. Sci.*, 87:1308, 1998.
Boado, *Adv. Drug Delivery Rev.*, 15:73, 1995.
Braasch et al., *Methods*, 23(2):97-107, 2001.
Chen et al., *Nucleic Acids Res.*, 20:4581, 1992.
Choung et al., *Biochem. Biophys. Res. Commun.*, 342:919-927, 2006.
Chowrira et al., *J. Biol. Chem.*, 269:25856, 1994.
Couture et al., *Trends in Genetics*, 12:510, 1996.
Demidov et al., *ChemBiochem.*, 2:133-139, 2001.
Dhanasekaran et al., *Nature*, 412:822, 2001.
Egholm et al., *Nature*, 365(6446):566-568, 1993.
Elayadi et al., *Nucleic Acids Res.*, 29(8): 1683-9, 2001.
Elmen et al., *Nature*, 452(7189):896-9, 2008.
Esau et al. *Cell Metab.*, 3(2):87-98, 2006.
Faruqi et al., *Proc. Natl. Acad. Sci. USA*, 95:1398-1403, 1998.
Fire et al., *Nature*, 391(6669):806-811, 1998.
Frieden et al., *Nucle. Nucleo. Nucleic Acids*, 22(5-8):1041-3, 2003.
Fukuda et al., *Genes Dev.*, 15:1199, 1995.
Good et al., *Gene Therapy*, 4:45, 1997.
Griffiths-Jones et al., *Nucleic Acids Res.*, 34:D140, 2006.
Griffiths-Jones et al., *Nucleic Acids Res.*, 36:D154, 2008.
Griffiths-Jones, *Nucleic Acids Res.*, 32:D109, 2004.
Grimson et al., *Mol. Cell.*, 27:91, 2007.
Haeberli et al., *Nucleic Acids Res.*, 33:3965-3975, 2005.
Hall et al., *Clin. Cancer Res.*, 10(23):7852-7859, 2004.
Hall et al., *Nucleic Acids Res.*, 34:2773-2781, 2006.
Hassani et al., *J. Gene Med.*, 7:198-207, 2004.
Hofland and Huang, *Handb. Exp. Pharmacol.*, 137:165, 1999.
Holstege et al, *EMBO J.*, 16:7468-7480, 1997.
Hoshika et al., *Nucleic Acids Res.*, 32:3815-3825, 2004.
International Human Genome Sequencing Consortium, *Nature*, 409:860, 2001.
Ishiwata et al., *Chem. Phare. Bull.*, 43:1005, 1995.
Izant and Weintraub, *Science*, 229:345, 1985.
Janowski et al., *Nat. Chem. Biol.*, 1:216, 2005.
Janowski et al., *Nat. Chem. Biol.*, 3:166, 2007.
Janowski et al., *Nat. Struct. Mol. Biol.*, 13:787, 2006.
John et al., *PLoS Biol.*, 2:e363, 2004.
Jolliet-Riant and Tillement, *Fundam. Clin. Pharmacol.*, 13:16, 1999.
Kahl et al., *J. Mol. Biol.*, 299:75-89, 2000.
Kaihatsu et al, *Chem. Biol.*, 11:749-758, 2004.
Kaihatsu et al, *Biochem.*, 42(47):13996-4003, 2003.
Kashani-Sabet et al., *Antisense Res. Dev.*, 2:3, 1992.
Kaur et al., *Biochemistry*, 45(23):7347-7355, 2006.
Kent et al., *Genome Res.*, 12:996, 2002.
Kim et al., *Nat. Struct. Mol. Biol.*, 13:793, 2006.
Kim et al., *Proc. Natl. Acad. Sci. USA*, 105:16230, 2008.
Koshkin et al., *Tetrahedron*, 54:3607-3630, 1998
Krützfeldt et al., *Nature*, 438:685-689, 2005.
Kumar et al, *Bioorg. Med. Chem. Lett.*, 8:2219-2222, 1998
Lagos-Quintana et al., *Science*, 294:853-8, 2001.
Lai, *Nat. Genet.*, 30:363, 2002.
Larsen and Nielsen, *Nucl. Acids Res.*, 24:458-463, 1996.
Lasic et al., *Chem. Rev.* 95:2601, 1995.
Lasic et al., *Science*, 267:1275, 1995.
Lee et al., *ACS Symp. Ser.*, 752:184, 2000.
Lee et al., *Cell*, 75:843, 1993.
Li et al., *Proc. Natl. Acad. Sci. USA*, 102:19231-19236, 2005.
Li et al., *Proc. Natl. Acad. Sci. USA*, 103:17337, 2006.
Liu et al., *J. Biol. Chem.*, 42:24864, 1995.
Maurer et al., *Mol. Membr. Biol.*, 16:129, 1999.
McGarry and Lindquist, *Proc. Natl. Acad. Sci. USA*, 83:399, 1986.
McMahon et al., *Life Sci.*, 71(3):325-3, 2002.
Mollegaard et al., *Proc. Natl. Acad. Sci. USA*, 91:3892-3895, 1994.
Morita et al., *Nucleic Acids Res. Suppl.*, (2):99-100, 2002
Morris et al., *Science*, 305:1289-1292, 2004.
Needleman and Wunsch, *J. Mol. Biol.*, 48:443, 1970.
Nelson et al., *RNA*, 13:1787, 2007.
Nielsen et al, *Science*, 254:1497-1500, 1991.
Ohkawa et al., *Nucleic Acids Symp. Ser.*, 27:156, 1992.
Ojwang et al., *Proc. Natl. Acad. Sci. USA*, 89:10802, 1992.
Oku et al., *Biochim. Biophys. Acta*, 1238:86, 1995.
Ørom et al., *Gene*, 372:137, 2006.
Ota et al., *Nat. Genet.*, 36:40, 2004.
Pardridge et al., *Proc. Natl. Acad. Sci. USA*, 92:5592, 1995.
Paroo and Corey, *Trends Biotechnol.*, 22(8):390-4, 2004.
PCT Appln. WO 2000/53722
PCT Appln. WO 2005/021570
PCT Appln. WO 2005/121371
PCT Appln. WO 2005115481
PCT Appln. WO 93/23569
PCT Appln. WO 94/02595
PCT Appln. WO 94/02595
PCT Appln. WO 94/14226
PCT Appln. WO 96/10390

PCT Appln. WO 96/10391
PCT Appln. WO 96/10392
PCT Appln. WO 98/39352
PCT Appln. WO 99/14226
Pignon et al., *Hum. Mutat.*, 3: 126-132, 1994.
Place et al., *Proc. Natl. Acad. Sci. USA*, 105:1608, 2008.
Prakash et al., *J. Med. Chem.*, 48:4247-4253, 2005.
Propulic et al., *J. Virol.*, 66:1432, 1992.
Rand et al., *Cell*, 123:621-629, 2005.
Remington's Pharmaceutical Science, 18th ed., Mack Publishing Company, Easton, Pa. 1990.
Remington's Pharmaceutical Sciences, Mack Publishing Co., 1985.
Sarver et al., *Science*, 247:1222, 1990.
Scanlon et al., *Proc. Natl. Acad. Sci. USA*, 88:10591, 1991.
Schwartz et al., *Nat. Struct. Mol. Biol.*, 15:842, 2008.
Singh et al., *Chem. Commun.*, 4:455-456, 1998
Singh et al., *J. Org. Chem.*, 63:10035-10039, 1998
Soutschek et al., *Nature*, 432(7014):173-178, 2004.
Stark et al., *PLoS Biol.*, 1: 1, 2003.
Summerton and Weller, *Antisense Nucleic Acid Drug Dev.*; 7(3):187-95, 1997.
Suzuki and Sugano, *Methods Mol. Biol.*, 221:73, 2003.
Taira et al., *Nucleic Acids Res.*, 19:5125, 1991.
The Science and Practice of Pharmacy, 2003.
Thompson et al., *Nucleic Acids Res.*, 23:2259, 1995.
Ting et al., *Nat. Genet.*, 37:906, 2005.
Tsuritani et al., *Genome Res.*, 17:1005, 2007.
Tyler et al., *FEBS Lett.*, 421:280, 1999.
Tyler et al., *Proc. Natl. Acad. Sci. USA*, 96:7053-7058, 1999.
Urban-Klein, *Gene Ther.*, 12:461-6, 2005.
Ventura et al., *Nucleic Acids Res.*, 21:3249, 1993.
Wahlestedt et al., *Proc. Natl. Acad. Sci. USA*, 97:5633-5638, 2000
Wakaguri et al., *Nucleic Acids Res.*, 36:D97, 2008.
Weerasinghe et al., *J. Virol.*, 65:5531, 1991.
Yang et al., *FASEB J.*, 22(6):1960-72, 2008.
Zhang et al., *J. Biol. Chem.*, 275:24436-24443, 2000.

SEQUENCE LISTING (40127 sequences)

SEQ ID NO: 1 - RNA, 22 nt, Homo sapiens
uucuggaauucugugugaggga

SEQ ID NO: 2 - RNA, 22 nt, Homo sapiens
uuuagagacggggucuugcucu

SEQ ID NO: 3 - RNA, 22 nt, Homo sapiens
ugagaacugaauuccauggguu

SEQ ID NO: 4 - RNA, 20 nt, Homo sapiens
guguguggaaaugcuucugc

SEQ ID NO: 5 - RNA, 22 nt, Homo sapiens
uagcagcacauaaugguuugug

SEQ ID NO: 6 - RNA, 22 nt, Homo sapiens
aauugcacgguauccaucugua

SEQ ID NO: 7 - RNA, 23 nt, Homo sapiens
caaagcgcuucucuuuagagugu

SEQ ID NO: 8 - RNA, 21 nt, Homo sapiens
cuccagagggaaguacuuucu

SEQ ID NO: 9 - RNA, 21 nt, Homo sapiens
cuccagagggaugcacuuucu

SEQ ID NO: 10 - RNA, 22 nt, Homo sapiens
aaacauucgcggugcacuucuu

SEQ ID NO: 11 - RNA, 21 nt, Homo sapiens
ucuuguguucucuagaucagu

SEQ ID NO: 12 - RNA, 19 nt, Homo sapiens
ugucucugcugggguuucu

SEQ ID NO: 13 - RNA, 22 nt, Homo sapiens
agucauuggaggguuugagcag

SEQ ID NO: 14 - RNA, 22 nt, Homo sapiens
ugagaccucuggguucugagcu

SEQ ID NO: 15 - RNA, 21 nt, Homo sapiens
ccuggaaacacugagguugug

SEQ ID NO: 16 - RNA, 21 nt, Homo sapiens
aguuaggauuaggucguggaa

SEQ ID NO: 17 - RNA, 24 nt, Homo sapiens
ucccugagacccuuuaaccuguga

SEQ ID NO: 18 - RNA, 22 nt, Homo sapiens
ucccugagacccuaacuuguga

SEQ ID NO: 19 - RNA, 23 nt, Homo sapiens
ccucagggcuguagaacagggcu

SEQ ID NO: 20 - RNA, 24 nt, Homo sapiens
uggcccugacugaagaccagcagu

SEQ ID NO: 21 - RNA, 22 nt, Homo sapiens
aaaucucugcaggcaaauguga

SEQ ID NO: 22 - RNA, 20 nt, Homo sapiens
ccucugggcccuuccuccag

SEQ ID NO: 23 - RNA, 22 nt, Homo sapiens
ucucugggccugugucuuaggc

SEQ ID NO: 24 - RNA, 22 nt, Homo sapiens
uuuaggauaagcuugacuuuug

SEQ ID NO: 25 - RNA, 23 nt, Homo sapiens
aaggagcuuacaaucuagcuggg

SEQ ID NO: 26 - RNA, 22 nt, Homo sapiens
acccgucccguucguccccgga

SEQ ID NO: 27 - RNA, 23 nt, Homo sapiens
cuggagauauggaagagcugugu

SEQ ID NO: 28 - RNA, 17 nt, Homo sapiens
gugggggagaggcuguc

SEQ ID NO: 29 - RNA, 24 nt, Homo sapiens
uggcccugacugaagaccagcagu

SEQ ID NO: 30 - RNA, 23 nt, Homo sapiens
ucuuggaguaggucauugggugg

SEQ ID NO: 31 - RNA, 24 nt, Homo sapiens
uucuccaaaagaaagcacuuucug

SEQ ID NO: 32 - RNA, 22 nt, Homo sapiens
aagugccuccuuuuagaguguu

SEQ ID NO: 33 - RNA, 21 nt, Homo sapiens
gcuaguccugacucagccagu

SEQ ID NO: 34 - RNA, 20 nt, Homo sapiens
auggagauagauauagaaau

SEQ ID NO: 35 - RNA, 21 nt, Homo sapiens
cccggagccaggaugcagcuc

SEQ ID NO: 36 - RNA, 22 nt, Homo sapiens
ugagccccugugccgcccccag

SEQ ID NO: 37 - RNA, 22 nt, Homo sapiens
ucggccugaccacccaccccac

SEQ ID NO: 38 - RNA, 24 nt, Homo sapiens
agccuggaagcuggagccugcagu

SEQ ID NO: 39 - RNA, 17 nt, Homo sapiens
ucgccuccuccucuccc

SEQ ID NO: 40 - RNA, 25 nt, Homo sapiens
ugggaacggguuccggcagacgcug

SEQ ID NO: 41 - RNA, 21 nt, Homo sapiens
cggcggggacggcgauugguc

SEQ ID NO: 42 - RNA, 21 nt, Homo sapiens
agggcccccccucaauccugu

SEQ ID NO: 43 - RNA, 21 nt, Homo sapiens
agggcccccccucaauccugu

SEQ ID NO: 44 - RNA, 22 nt, Homo sapiens
aggcggggcgccgcgggaccgc

SEQ ID NO: 45 - RNA, 22 nt, Homo sapiens
ugcggggcuagggcuaacagca

SEQ ID NO: 46 - RNA, 22 nt, Homo sapiens
uauggcacugguagaauucacu

SEQ ID NO: 47 - RNA, 23 nt, Homo sapiens
uaaggugcaucuagugcagauag

SEQ ID NO: 48 - RNA, 22 nt, Homo sapiens
ugauauguuugauauauuaggu

SEQ ID NO: 49 - RNA, 20 nt, Homo sapiens
gugcauugcuguugcauugc

SEQ ID NO: 50 - RNA, 21 nt, Homo sapiens
ucacuccucuccucccgucuu

SEQ ID NO: 51 - RNA, 22 nt, Homo sapiens
gagugccuucuuuuggagcguu

SEQ ID NO: 52 - RNA, 22 nt, Homo sapiens
aagugccuccuuuuagaguguu

SEQ ID NO: 53 - RNA, 21 nt, Homo sapiens
uggaggagaaggaaggugaug

SEQ ID NO: 54 - RNA, 22 nt, Homo sapiens
ucugcccccuccgcugcugcca

SEQ ID NO: 55 - RNA, 22 nt, Homo sapiens
aagcugccaguugaagaacugu

SEQ ID NO: 56 - RNA, 22 nt, Homo sapiens
aagcugccaguugaagaacugu

SEQ ID NO: 57 - RNA, 20 nt, Homo sapiens
acugccccaggugcugcugg

SEQ ID NO: 58 - RNA, 23 nt, Homo sapiens
cgcauccccuagggcauuggugu

SEQ ID NO: 59 - RNA, 23 nt, Homo sapiens
ugaggggcagagagcgagacuuu

SEQ ID NO: 60 - RNA, 21 nt, Homo sapiens
cggggcagcucaguacaggau

SEQ ID NO: 61 - RNA, 22 nt, Homo sapiens
aguggggaacccuuccaugagg

SEQ ID NO: 62 - RNA, 24 nt, Homo sapiens
uucuccaaaagaaagcacuuucug

SEQ ID NO: 63 - RNA, 23 nt, Homo sapiens
caaagcgcuucucuuuagagugu

SEQ ID NO: 64 - RNA, 22 nt, Homo sapiens
aagugccuccuuuuagaguguu

SEQ ID NO: 65 - RNA, 21 nt, Homo sapiens
cuccagagggaaguacuuucu

SEQ ID NO: 66 - RNA, 21 nt, Homo sapiens
cuccagagggaugcacuuucu

SEQ ID NO: 67 - RNA, 21 nt, Homo sapiens
agggggaaaguucuauagucc

SEQ ID NO: 68 - RNA, 22 nt, Homo sapiens
ugagccccugugccgcccccag

SEQ ID NO: 69 - RNA, 22 nt, Homo sapiens
uggagugugacaaugguguuug

SEQ ID NO: 70 - RNA, 24 nt, Homo sapiens
agccuggaagcuggagccugcagu

SEQ ID NO: 71 - RNA, 18 nt, Homo sapiens
cgggcguggugguggggg

SEQ ID NO: 72 - RNA, 21 nt, Homo sapiens
cggcggggacggcgauugguc

SEQ ID NO: 73 - RNA, 22 nt, Homo sapiens
ucaggccaggcacaguggcuca

SEQ ID NO: 74 - RNA, 22 nt, Homo sapiens
aacacaccugguuaaccucuuu

SEQ ID NO: 75 - RNA, 23 nt, Homo sapiens
ucccccaggugugauucugauuu

SEQ ID NO: 76 - RNA, 22 nt, Homo sapiens
aacacaccuauucaaggauuca

SEQ ID NO: 77 - RNA, 20 nt, Homo sapiens
guccgcucggcgguggccca

SEQ ID NO: 78 - RNA, 24 nt, Homo sapiens
acugggggcuuucgggcucugcgu

SEQ ID NO: 79 - RNA, 25 nt, Homo sapiens
ggcggagggaaguagguccguuggu

SEQ ID NO: 80 - RNA, 22 nt, Homo sapiens
aggcggggcgccgcgggaccgc

SEQ ID NO: 81 - RNA, 22 nt, Homo sapiens
ugcggggcuagggcuaacagca

SEQ ID NO: 82 - RNA, 21 nt, Homo sapiens
uggaggagaaggaaggugaug

SEQ ID NO: 83 - RNA, 22 nt, Homo sapiens
acuccagccccacagccucagc

SEQ ID NO: 84 - RNA, 22 nt, Homo sapiens
ugcaacgaaccugagccacuga

SEQ ID NO: 85 - RNA, 22 nt, Homo sapiens
uggagugugacaaugguguuug

SEQ ID NO: 86 - RNA, 21 nt, Homo sapiens
cggcggggacggcgauugguc

SEQ ID NO: 87 - RNA, 22 nt, Homo sapiens
uagguaguuucauguuguuggg

SEQ ID NO: 88 - RNA, 23 nt, Homo sapiens
cgcauccccuagggcauuggugu

SEQ ID NO: 89 - RNA, 21 nt, Homo sapiens
gaacggcuucauacaggaguu

SEQ ID NO: 90 - RNA, 22 nt, Homo sapiens
aauugcacuuuagcaaugguga

SEQ ID NO: 91 - RNA, 22 nt, Homo sapiens
aggcggggcgccgcgggaccgc

SEQ ID NO: 92 - RNA, 22 nt, Homo sapiens
ugcggggcuagggcuaacagca

SEQ ID NO: 93 - RNA, 22 nt, Homo sapiens
ugcggggcuagggcuaacagca

SEQ ID NO: 94 - RNA, 26 nt, Homo sapiens
gaugaugauggcagcaaauucugaaa

SEQ ID NO: 95 - RNA, 18 nt, Homo sapiens
uugagaaggaggcugcug

SEQ ID NO: 96 - RNA, 18 nt, Homo sapiens
cagggaggugaaugugau

SEQ ID NO: 97 - RNA, 23 nt, Homo sapiens
ucuggcuccgugucuucacuccc

SEQ ID NO: 98 - RNA, 22 nt, Homo sapiens
aacuguuugcagaggaaacuga

SEQ ID NO: 99 - RNA, 21 nt, Homo sapiens
cugaccuaugaauugacagcc

SEQ ID NO: 100 - RNA, 21 nt, Homo sapiens
uagcagcacagaaauauuggc

SEQ ID NO: 101 - RNA, 21 nt, Homo sapiens
augaccuaugaauugacagac

SEQ ID NO: 102 - RNA, 23 nt, Homo sapiens
ccuaguagguguccaguaagugu

SEQ ID NO: 103 - RNA, 23 nt, Homo sapiens
ucuuugguuaucuagcuguauga

SEQ ID NO: 104 - RNA, 23 nt, Homo sapiens
uuuggcacuagcacauuuuugcu

SEQ ID NO: 105 - RNA, 21 nt, Homo sapiens
uugcucacuguucuucccuag

SEQ ID NO: 106 - RNA, 23 nt, Homo sapiens
gagggucuugggagggaugugac

SEQ ID NO: 107 - RNA, 23 nt, Homo sapiens
ccugcagcgacuugauggcuucc

SEQ ID NO: 108 - RNA, 17 nt, Homo sapiens
ucccuguucgggcgcca

SEQ ID NO: 109 - RNA, 24 nt, Homo sapiens
uggcccugacugaagaccagcagu

SEQ ID NO: 110 - RNA, 24 nt, Homo sapiens
uggcccugacugaagaccagcagu

SEQ ID NO: 111 - RNA, 22 nt, Homo sapiens
ugcccuguggacucaguucugg

SEQ ID NO: 112 - RNA, 22 nt, Homo sapiens
uagcagcacauaaugguuugug

SEQ ID NO: 113 - RNA, 22 nt, Homo sapiens
uagcagcacaucaugguuuaca

SEQ ID NO: 114 - RNA, 22 nt, Homo sapiens
uagcagcacguaaauauuggcg

SEQ ID NO: 115 - RNA, 22 nt, Homo sapiens
uggagagaaaggcaguuccuga

SEQ ID NO: 116 - RNA, 21 nt, Homo sapiens
uagcagcacagaaauauuggc

SEQ ID NO: 117 - RNA, 23 nt, Homo sapiens
agcuacauugucugcuggguuuc

SEQ ID NO: 118 - RNA, 21 nt, Homo sapiens
uucacaguggcuaaguuccgc

SEQ ID NO: 119 - RNA, 22 nt, Homo sapiens
uguaaacauccuacacucagcu

SEQ ID NO: 120 - RNA, 23 nt, Homo sapiens
ucaagagcaauaacgaaaaaugu

SEQ ID NO: 121 - RNA, 22 nt, Homo sapiens
aauugcacuuuagcaaugguga

SEQ ID NO: 122 - RNA, 22 nt, Homo sapiens
uuauaauacaaccugauaagug

SEQ ID NO: 123 - RNA, 22 nt, Homo sapiens
cagcagcaauucauguuuugaa

SEQ ID NO: 124 - RNA, 22 nt, Homo sapiens
agaggcuggccgugaugaauuc

SEQ ID NO: 125 - RNA, 21 nt, Homo sapiens
cagcagcacacugugguuugu

SEQ ID NO: 126 - RNA, 22 nt, Homo sapiens
agacccuggucugcacucuauc

SEQ ID NO: 127 - RNA, 19 nt, Homo sapiens
gugucugcuuccuguggga

SEQ ID NO: 128 - RNA, 21 nt, Homo sapiens
guggcugcacucacuuccuuc

SEQ ID NO: 129 - RNA, 22 nt, Homo sapiens
uaugucugcugaccaucaccuu

SEQ ID NO: 130 - RNA, 23 nt, Homo sapiens
ucugcucauaccccaugguuucu

SEQ ID NO: 131 - RNA, 19 nt, Homo sapiens
gugaggacucgggaggugg

SEQ ID NO: 132 - RNA, 22 nt, Homo sapiens
uggagugugacaaugguguuug

SEQ ID NO: 133 - RNA, 22 nt, Homo sapiens
acaggugagguucuugggagcc

SEQ ID NO: 134 - RNA, 23 nt, Homo sapiens
cuggagauauggaagagcugugu

SEQ ID NO: 135 - RNA, 23 nt, Homo sapiens
cuggagauauggaagagcugugu

SEQ ID NO: 136 - RNA, 22 nt, Homo sapiens
ucugggcaacaaagugagaccu

SEQ ID NO: 137 - RNA, 21 nt, Homo sapiens
ugagaugaagcacuguagcuc

SEQ ID NO: 138 - RNA, 21 nt, Homo sapiens
ugagaugaagcacuguagcuc

SEQ ID NO: 139 - RNA, 23 nt, Homo sapiens
uaaggugcaucuagugcagauag

SEQ ID NO: 140 - RNA, 20 nt, Homo sapiens
ccccagggcgacgcggcggg

SEQ ID NO: 141 - RNA, 20 nt, Homo sapiens
ccuccugcccuccuugcugu

SEQ ID NO: 142 - RNA, 22 nt, Homo sapiens
acagcaggcacagacaggcagu

SEQ ID NO: 143 - RNA, 22 nt, Homo sapiens
acagcaggcacagacaggcagu

SEQ ID NO: 144 - RNA, 20 nt, Homo sapiens
gugcauugcuguugcauugc

SEQ ID NO: 145 - RNA, 22 nt, Homo sapiens
gccugcugggguggaaccuggu

SEQ ID NO: 146 - RNA, 22 nt, Homo sapiens
gccugcugggguggaaccuggu

SEQ ID NO: 147 - RNA, 22 nt, Homo sapiens
gagugccuucuuuuggagcguu

SEQ ID NO: 148 - RNA, 22 nt, Homo sapiens
aagugccuccuuuuagaguguu

SEQ ID NO: 149 - RNA, 23 nt, Homo sapiens
agugccugagggaguaagagccc

SEQ ID NO: 150 - RNA, 25 nt, Homo sapiens
gcugggcagggcuucugagcuccuu

SEQ ID NO: 151 - RNA, 20 nt, Homo sapiens
auggagauagauauagaaau

SEQ ID NO: 152 - RNA, 20 nt, Homo sapiens
auggagauagauauagaaau

SEQ ID NO: 153 - RNA, 22 nt, Homo sapiens
augcugacauauuuacuagagg

SEQ ID NO: 154 - RNA, 22 nt, Homo sapiens
cugcccuggcccgagggaccga

SEQ ID NO: 155 - RNA, 22 nt, Homo sapiens
ugugcgcagggagaccucuccc

SEQ ID NO: 156 - RNA, 20 nt, Homo sapiens
ugagcccuguccucccgcag

SEQ ID NO: 157 - RNA, 17 nt, Homo sapiens
gugggggagaggcuguc

SEQ ID NO: 158 - RNA, 22 nt, Homo sapiens
ugugacugguugaccagagggg

SEQ ID NO: 159 - RNA, 23 nt, Homo sapiens
ucuggcuccgugucuucacuccc

SEQ ID NO: 160 - RNA, 22 nt, Homo sapiens
uggagagaaaggcaguuccuga

SEQ ID NO: 161 - RNA, 22 nt, Homo sapiens
ucugcccccuccgcugcugcca

SEQ ID NO: 162 - RNA, 20 nt, Homo sapiens
ccccagggcgacgcggcggg

SEQ ID NO: 163 - RNA, 21 nt, Homo sapiens
uucaaguaauucaggauaggu

SEQ ID NO: 164 - RNA, 20 nt, Homo sapiens
acugccccaggugcugcugg

SEQ ID NO: 165 - RNA, 23 nt, Homo sapiens
ucccuguccuccaggagcucacg

SEQ ID NO: 166 - RNA, 23 nt, Homo sapiens
ucccccaggugugauucugauuu

SEQ ID NO: 167 - RNA, 23 nt, Homo sapiens
uagugcaauauugcuuauagggu

SEQ ID NO: 168 - RNA, 22 nt, Homo sapiens
uggugggcacagaaucuggacu

SEQ ID NO: 169 - RNA, 21 nt, Homo sapiens
uggguuuacguugggagaacu

SEQ ID NO: 170 - RNA, 24 nt, Homo sapiens
acugggggcuuucgggcucugcgu

SEQ ID NO: 171 - RNA, 22 nt, Homo sapiens
uggugggccgcagaacaugugc

SEQ ID NO: 172 - RNA, 24 nt, Homo sapiens
uggggagcugaggcucugggggug

SEQ ID NO: 173 - RNA, 21 nt, Homo sapiens
cauaaaguagaaagcacuacu

SEQ ID NO: 174 - RNA, 21 nt, Homo sapiens
caagucacuagugguuccguu

SEQ ID NO: 175 - RNA, 23 nt, Homo sapiens
uaagugcuuccauguuuugguga

SEQ ID NO: 176 - RNA, 21 nt, Homo sapiens
gugcauuguaguugcauugca

SEQ ID NO: 177 - RNA, 22 nt, Homo sapiens
aucaugaugggcuccucggugu

SEQ ID NO: 178 - RNA, 22 nt, Homo sapiens
aucaugaugggcuccucggugu

SEQ ID NO: 179 - RNA, 22 nt, Homo sapiens
gaaagcgcuucccuuugcugga

SEQ ID NO: 180 - RNA, 22 nt, Homo sapiens
caaagcgcuccccuuuagaggu

SEQ ID NO: 181 - RNA, 23 nt, Homo sapiens
caaagcgcuucucuuuagagugu

SEQ ID NO: 182 - RNA, 21 nt, Homo sapiens
caaagcgcuucccuuuggagc

SEQ ID NO: 183 - RNA, 21 nt, Homo sapiens
aaagcgcuucccuucagagug

SEQ ID NO: 184 - RNA, 21 nt, Homo sapiens
aaagcgcuucccuucagagug

SEQ ID NO: 185 - RNA, 21 nt, Homo sapiens
gaaagcgcuucucuuuagagg

SEQ ID NO: 186 - RNA, 20 nt, Homo sapiens
cuacaaagggaagcccuuuc

SEQ ID NO: 187 - RNA, 22 nt, Homo sapiens
aaaaugguucccuuuagagugu

SEQ ID NO: 188 - RNA, 22 nt, Homo sapiens
cuacaaagggaagcacuuucuc

SEQ ID NO: 189 - RNA, 22 nt, Homo sapiens
aaaaguacuugcggauuuugcu

SEQ ID NO: 190 - RNA, 22 nt, Homo sapiens
aaaaguauuugcggguuuuguc

SEQ ID NO: 191 - RNA, 22 nt, Homo sapiens
caaaaguaauuguggauuuugu

SEQ ID NO: 192 - RNA, 21 nt, Homo sapiens
aguuaaugaauccuggaaagu

SEQ ID NO: 193 - RNA, 21 nt, Homo sapiens
uagauaaaauauugguaccug

SEQ ID NO: 194 - RNA, 21 nt, Homo sapiens
uagauaaaauauugguaccug

SEQ ID NO: 195 - RNA, 21 nt, Homo sapiens
guucaaauccagaucuauaac

SEQ ID NO: 196 - RNA, 18 nt, Homo sapiens
ucagcuggcccucauuuc

SEQ ID NO: 197 - RNA, 19 nt, Homo sapiens
gugaggacucgggaggugg

SEQ ID NO: 198 - RNA, 22 nt, Homo sapiens
uaacagucuacagccauggucg

SEQ ID NO: 199 - RNA, 23 nt, Homo sapiens
ucuggcuccgugucuucacuccc

SEQ ID NO: 200 - RNA, 22 nt, Homo sapiens
caaagaauucuccuuuugggcu

SEQ ID NO: 201 - RNA, 21 nt, Homo sapiens
uaacagucuccagucacggcc

SEQ ID NO: 202 - RNA, 22 nt, Homo sapiens
aauugcacgguauccaucugua

SEQ ID NO: 203 - RNA, 23 nt, Homo sapiens
aucaacagacauuaauugggcgc

SEQ ID NO: 204 - RNA, 22 nt, Homo sapiens
cgucaacacuugcugguuuccu

SEQ ID NO: 205 - RNA, 22 nt, Homo sapiens
cgucaacacuugcugguuuccu

SEQ ID NO: 206 - RNA, 21 nt, Homo sapiens
uagauaaaauauugguaccug

SEQ ID NO: 207 - RNA, 23 nt, Homo sapiens
ucuuugguuaucuagcuguauga

SEQ ID NO: 208 - RNA, 22 nt, Homo sapiens
ugagaacugaauuccauggguu

SEQ ID NO: 209 - RNA, 22 nt, Homo sapiens
uagcagcacauaaugguuugug

SEQ ID NO: 210 - RNA, 22 nt, Homo sapiens
uagcagcacaucaugguuuaca

SEQ ID NO: 211 - RNA, 22 nt, Homo sapiens
uagcagcacguaaauauuggcg

SEQ ID NO: 212 - RNA, 21 nt, Homo sapiens
uagcagcacagaaauauuggc

SEQ ID NO: 213 - RNA, 23 nt, Homo sapiens
cuguaauauaaauuuaauuuauu

SEQ ID NO: 214 - RNA, 22 nt, Homo sapiens
caaucacuaacuccacugccau

SEQ ID NO: 215 - RNA, 22 nt, Homo sapiens
aaucacuaaccacacggccagg

SEQ ID NO: 216 - RNA, 22 nt, Homo sapiens
cagcagcaauucauguuuugaa

SEQ ID NO: 217 - RNA, 21 nt, Homo sapiens
cagcagcacacugugguuugu

SEQ ID NO: 218 - RNA, 21 nt, Homo sapiens
ugaguuggccaucugagugag

SEQ ID NO: 219 - RNA, 23 nt, Homo sapiens
uauucauuuauccccagccuaca

SEQ ID NO: 220 - RNA, 22 nt, Homo sapiens
ugcaacuuaccugagucauuga

SEQ ID NO: 221 - RNA, 22 nt, Homo sapiens
aacccguagauccgaucuugug

SEQ ID NO: 222 - RNA, 22 nt, Homo sapiens
cacccguagaaccgaccuugcg

SEQ ID NO: 223 - RNA, 22 nt, Homo sapiens
aacccguagauccgaacuugug

SEQ ID NO: 224 - RNA, 20 nt, Homo sapiens
uacaguauagaugauguacu

SEQ ID NO: 225 - RNA, 22 nt, Homo sapiens
aucgugcauccuuuuagagugu

SEQ ID NO: 226 - RNA, 21 nt, Homo sapiens
cggcggggacggcgauugguc

SEQ ID NO: 227 - RNA, 22 nt, Homo sapiens
uaauacugccugguaaugauga

SEQ ID NO: 228 - RNA, 23 nt, Homo sapiens
uaauacugccggguaaugaugga

SEQ ID NO: 229 - RNA, 22 nt, Homo sapiens
uuggggaaacggccgcugagug

SEQ ID NO: 230 - RNA, 22 nt, Homo sapiens
uaauacugucugguaaaaccgu

SEQ ID NO: 231 - RNA, 18 nt, Homo sapiens
ugcuuccuuucagagggu

SEQ ID NO: 232 - RNA, 22 nt, Homo sapiens
aucuggagguaagaagcacuuu

SEQ ID NO: 233 - RNA, 21 nt, Homo sapiens
guggcugcacucacuuccuuc

SEQ ID NO: 234 - RNA, 22 nt, Homo sapiens
aggcggggcgccgcgggaccgc

SEQ ID NO: 235 - RNA, 23 nt, Homo sapiens
aggaagcccuggaggggcuggag

SEQ ID NO: 236 - RNA, 21 nt, Homo sapiens
ucguggccuggucuccauuau

SEQ ID NO: 237 - RNA, 22 nt, Homo sapiens
uggguggucuggagauuugugc

SEQ ID NO: 238 - RNA, 21 nt, Homo sapiens
ccaccaccgugucugacacuu

SEQ ID NO: 239 - RNA, 22 nt, Homo sapiens
ggagaaauuauccuuggugugu

SEQ ID NO: 240 - RNA, 22 nt, Homo sapiens
uggugggcacagaaucuggacu

SEQ ID NO: 241 - RNA, 21 nt, Homo sapiens
uuggccacaauggguuagaac

SEQ ID NO: 242 - RNA, 22 nt, Homo sapiens
agacuucccauuugaagguggc

SEQ ID NO: 243 - RNA, 19 nt, Homo sapiens
aguguggcuuucuuagagc

SEQ ID NO: 244 - RNA, 22 nt, Homo sapiens
uggugggccgcagaacaugugc

SEQ ID NO: 245 - RNA, 24 nt, Homo sapiens
ugccugggucucuggccugcgcgu

SEQ ID NO: 246 - RNA, 21 nt, Homo sapiens
uugcucacuguucuucccuag

SEQ ID NO: 247 - RNA, 18 nt, Homo sapiens
gcaugggugguucagugg

SEQ ID NO: 248 - RNA, 22 nt, Homo sapiens
aauugcacgguauccaucugua

SEQ ID NO: 249 - RNA, 23 nt, Homo sapiens
uaauccuugcuaccugggugaga

SEQ ID NO: 250 - RNA, 22 nt, Homo sapiens
aaugcacccgggcaaggauucu

SEQ ID NO: 251 - RNA, 22 nt, Homo sapiens
aaugcaccugggcaaggauuca

SEQ ID NO: 252 - RNA, 23 nt, Homo sapiens
ugcaccaugguugucugagcaug

SEQ ID NO: 253 - RNA, 22 nt, Homo sapiens
uggagagaaaggcaguuccuga

SEQ ID NO: 254 - RNA, 22 nt, Homo sapiens
uucuggaauucugugugaggga

SEQ ID NO: 255 - RNA, 22 nt, Homo sapiens
uacccagagcaugcagugugaa

SEQ ID NO: 256 - RNA, 22 nt, Homo sapiens
acaguagucugcacauugguua

SEQ ID NO: 257 - RNA, 22 nt, Homo sapiens
acaguagucugcacauugguua

SEQ ID NO: 258 - RNA, 21 nt, Homo sapiens
agcuacaucuggcuacugggu

SEQ ID NO: 259 - RNA, 22 nt, Homo sapiens
uguaaacauccucgacuggaag

SEQ ID NO: 260 - RNA, 22 nt, Homo sapiens
uguaaacauccccgacuggaag

SEQ ID NO: 261 - RNA, 22 nt, Homo sapiens
uguaaacauccuugacuggaag

SEQ ID NO: 262 - RNA, 20 nt, Homo sapiens
ccucugggcccuuccuccag

SEQ ID NO: 263 - RNA, 22 nt, Homo sapiens
ucucugggccugugucuuaggc

SEQ ID NO: 264 - RNA, 22 nt, Homo sapiens
uuuugcaauauguuccugaaua

SEQ ID NO: 265 - RNA, 22 nt, Homo sapiens
uuuugcaauauguuccugaaua

SEQ ID NO: 266 - RNA, 22 nt, Homo sapiens
ugauugguacgucuguggguag

SEQ ID NO: 267 - RNA, 20 nt, Homo sapiens
cugcaaagggaagcccuuuc

SEQ ID NO: 268 - RNA, 23 nt, Homo sapiens
caaagcgcuucucuuuagagugu

SEQ ID NO: 269 - RNA, 20 nt, Homo sapiens
cugcaaagggaagcccuuuc

SEQ ID NO: 270 - RNA, 23 nt, Homo sapiens
uucauuugguauaaaccgcgauu

SEQ ID NO: 271 - RNA, 20 nt, Homo sapiens
aggguguuucucucaucucu

SEQ ID NO: 272 - RNA, 21 nt, Homo sapiens
cggcggggacggcgauugguc

SEQ ID NO: 273 - RNA, 22 nt, Homo sapiens
cauugcacuugucucggucuga

SEQ ID NO: 274 - RNA, 25 nt, Homo sapiens
ggcggagggaaguagguccguuggu

SEQ ID NO: 275 - RNA, 22 nt, Homo sapiens
aggcggggcgccgcgggaccgc

SEQ ID NO: 276 - RNA, 22 nt, Homo sapiens
ugcggggcuagggcuaacagca

SEQ ID NO: 277 - RNA, 22 nt, Homo sapiens
ucggccugaccacccaccccac

SEQ ID NO: 278 - RNA, 21 nt, Homo sapiens
gcccuccgcccgugcaccccg

SEQ ID NO: 279 - RNA, 23 nt, Homo sapiens
cggcccgggcugcugcuguuccu

SEQ ID NO: 280 - RNA, 22 nt, Homo sapiens
uggagagaaaggcaguuccuga

SEQ ID NO: 281 - RNA, 22 nt, Homo sapiens
uuggggaaacggccgcugagug

SEQ ID NO: 282 - RNA, 21 nt, Homo sapiens
agggcccccccucaauccugu

SEQ ID NO: 283 - RNA, 23 nt, Homo sapiens
ucccccaggugugauucugauuu

SEQ ID NO: 284 - RNA, 22 nt, Homo sapiens
aauugcacgguauccaucugua

SEQ ID NO: 285 - RNA, 23 nt, Homo sapiens
ugaggggcagagagcgagacuuu

SEQ ID NO: 286 - RNA, 22 nt, Homo sapiens
aguggggaacccuuccaugagg

SEQ ID NO: 287 - RNA, 19 nt, Homo sapiens
aggcugcggaauucaggac

SEQ ID NO: 288 - RNA, 24 nt, Homo sapiens
acugggggcuuucgggcucugcgu

SEQ ID NO: 289 - RNA, 24 nt, Homo sapiens
ugccugggucucuggccugcgcgu

SEQ ID NO: 290 - RNA, 21 nt, Homo sapiens
uggaggagaaggaaggugaug

SEQ ID NO: 291 - RNA, 21 nt, Homo sapiens
cgcgggugcuuacugacccuu

SEQ ID NO: 292 - RNA, 20 nt, Homo sapiens
ggggagcuguggaagcagua

SEQ ID NO: 293 - RNA, 22 nt, Homo sapiens
ucugggcaacaaagugagaccu

SEQ ID NO: 294 - RNA, 18 nt, Homo sapiens
gcaugggugguucagugg

SEQ ID NO: 295 - RNA, 22 nt, Homo sapiens
cauugcacuugucucggucuga

SEQ ID NO: 296 - RNA, 22 nt, Homo sapiens
uguaaacauccuacacucagcu

SEQ ID NO: 297 - RNA, 23 nt, Homo sapiens
ugaggggcagagagcgagacuuu

SEQ ID NO: 298 - RNA, 25 nt, Homo sapiens
gcugggcagggcuucugagcuccuu

SEQ ID NO: 299 - RNA, 25 nt, Homo sapiens
ggcggagggaaguagguccguuggu

SEQ ID NO: 300 - RNA, 21 nt, Homo sapiens
uggaggagaaggaaggugaug

SEQ ID NO: 301 - RNA, 23 nt, Homo sapiens
gagggucuugggagggaugugac

SEQ ID NO: 302 - RNA, 22 nt, Homo sapiens
uggagugugacaaugguguuug

SEQ ID NO: 303 - RNA, 22 nt, Homo sapiens
ccucuuccccuugucucuccag

SEQ ID NO: 304 - RNA, 22 nt, Homo sapiens
ucugggcaacaaagugagaccu

SEQ ID NO: 305 - RNA, 22 nt, Homo sapiens
uggagagaaaggcaguuccuga

SEQ ID NO: 306 - RNA, 22 nt, Homo sapiens
cgcaggggccgggugcucaccg

SEQ ID NO: 307 - RNA, 22 nt, Homo sapiens
ugggucuuugcgggcgagauga

SEQ ID NO: 308 - RNA, 22 nt, Homo sapiens
acagcaggcacagacaggcagu

SEQ ID NO: 309 - RNA, 22 nt, Homo sapiens
aaaucucugcaggcaaauguga

SEQ ID NO: 310 - RNA, 20 nt, Homo sapiens
ccucugggcccuuccuccag

SEQ ID NO: 311 - RNA, 22 nt, Homo sapiens
ucucugggccugugucuuaggc

SEQ ID NO: 312 - RNA, 22 nt, Homo sapiens
gccugcugggguggaaccuggu

SEQ ID NO: 313 - RNA, 22 nt, Homo sapiens
agacccuggucugcacucuauc

SEQ ID NO: 314 - RNA, 20 nt, Homo sapiens
uaaggcacgcggugaaugcc

SEQ ID NO: 315 - RNA, 25 nt, Homo sapiens
gcugggcagggcuucugagcuccuu

SEQ ID NO: 316 - RNA, 23 nt, Homo sapiens
uggaagacuagugauuuuguugu

SEQ ID NO: 317 - RNA, 21 nt, Homo sapiens
uggcagggaggcugggagggg

SEQ ID NO: 318 - RNA, 18 nt, Homo sapiens
cagggaggugaaugugau

SEQ ID NO: 319 - RNA, 20 nt, Homo sapiens
uacaguauagaugauguacu

SEQ ID NO: 320 - RNA, 23 nt, Homo sapiens
cggcccgggcugcugcuguuccu

SEQ ID NO: 321 - RNA, 23 nt, Homo sapiens
cggcccgggcugcugcuguuccu

SEQ ID NO: 322 - RNA, 22 nt, Homo sapiens
ucugcccccuccgcugcugcca

SEQ ID NO: 323 - RNA, 22 nt, Homo sapiens
aagcugccaguugaagaacugu

SEQ ID NO: 324 - RNA, 21 nt, Homo sapiens
aucacauugccagggauuucc

SEQ ID NO: 325 - RNA, 21 nt, Homo sapiens
aucacauugccagggauuacc

SEQ ID NO: 326 - RNA, 21 nt, Homo sapiens
agggcccccccucaauccugu

SEQ ID NO: 327 - RNA, 20 nt, Homo sapiens
acugccccaggugcugcugg

SEQ ID NO: 328 - RNA, 23 nt, Homo sapiens
ugaggggcagagagcgagacuuu

SEQ ID NO: 329 - RNA, 21 nt, Homo sapiens
cggggcagcucaguacaggau

SEQ ID NO: 330 - RNA, 19 nt, Homo sapiens
ugagcugcuguaccaaaau

SEQ ID NO: 331 - RNA, 19 nt, Homo sapiens
aggcacggugucagcaggc

SEQ ID NO: 332 - RNA, 24 nt, Homo sapiens
uggggagcugaggcucugggggug

SEQ ID NO: 333 - RNA, 23 nt, Homo sapiens
ccugcagcgacuugauggcuucc

SEQ ID NO: 334 - RNA, 22 nt, Homo sapiens
acaggugagguucuugggagcc

SEQ ID NO: 335 - RNA, 22 nt, Homo sapiens
ugcccuguggacucaguucugg

SEQ ID NO: 336 - RNA, 22 nt, Homo sapiens
uggagagaaaggcaguuccuga

SEQ ID NO: 337 - RNA, 22 nt, Homo sapiens
cccugugcccggcccacuucug

SEQ ID NO: 338 - RNA, 20 nt, Homo sapiens
ccuccugcccuccuugcugu

SEQ ID NO: 339 - RNA, 22 nt, Homo sapiens
aaggagcucacagucuauugag

SEQ ID NO: 340 - RNA, 23 nt, Homo sapiens
gcaaagcacacggccugcagaga

SEQ ID NO: 341 - RNA, 21 nt, Homo sapiens
aacaggugacugguuagacaa

SEQ ID NO: 342 - RNA, 23 nt, Homo sapiens
aaggagcuuacaaucuagcuggg

SEQ ID NO: 343 - RNA, 22 nt, Homo sapiens
cugcccuggcccgagggaccga

SEQ ID NO: 344 - RNA, 22 nt, Homo sapiens
ugagguaguagguuguaugguu

SEQ ID NO: 345 - RNA, 20 nt, Homo sapiens
uaaggcacgcggugaaugcc

SEQ ID NO: 346 - RNA, 17 nt, Homo sapiens
ucauauugcuucuuucu

SEQ ID NO: 347 - RNA, 21 nt, Homo sapiens
ucacagugaaccggucucuuu

SEQ ID NO: 348 - RNA, 22 nt, Homo sapiens
ucgugucuuguguugcagccgg

SEQ ID NO: 349 - RNA, 23 nt, Homo sapiens
uaaggugcaucuagugcagauag

SEQ ID NO: 350 - RNA, 22 nt, Homo sapiens
uucccuuugucauccuaugccu

SEQ ID NO: 351 - RNA, 22 nt, Homo sapiens
uucccuuugucauccuucgccu

SEQ ID NO: 352 - RNA, 22 nt, Homo sapiens
aacaauauccuggugcugagug

SEQ ID NO: 353 - RNA, 21 nt, Homo sapiens
uaaggcacccuucugaguaga

SEQ ID NO: 354 - RNA, 23 nt, Homo sapiens
uauucauuuauccccagccuaca

SEQ ID NO: 355 - RNA, 20 nt, Homo sapiens
accaggaggcugaggccccu

SEQ ID NO: 356 - RNA, 23 nt, Homo sapiens
ucaaaugcucagacuccuguggu

SEQ ID NO: 357 - RNA, 21 nt, Homo sapiens
ucacagugaaccggucucuuu

SEQ ID NO: 358 - RNA, 22 nt, Homo sapiens
ucagugcacuacagaacuuugu

SEQ ID NO: 359 - RNA, 22 nt, Homo sapiens
ucagugcaucacagaacuuugu

SEQ ID NO: 360 - RNA, 21 nt, Homo sapiens
ucagugcaugacagaacuugg

SEQ ID NO: 361 - RNA, 22 nt, Homo sapiens
uagcaccaucugaaaucgguua

SEQ ID NO: 362 - RNA, 23 nt, Homo sapiens
uagcaccauuugaaaucaguguu

SEQ ID NO: 363 - RNA, 22 nt, Homo sapiens
uagcaccauuugaaaucgguua

SEQ ID NO: 364 - RNA, 22 nt, Homo sapiens
cuuaugcaagauucccuucuac

SEQ ID NO: 365 - RNA, 22 nt, Homo sapiens
ugaaggucuacugugugccagg

SEQ ID NO: 366 - RNA, 22 nt, Homo sapiens
ucagcaaacauuuauugugugc

SEQ ID NO: 367 - RNA, 21 nt, Homo sapiens
aaaacggugagauuuuguuuu

SEQ ID NO: 368 - RNA, 22 nt, Homo sapiens
agucauuggaggguuugagcag

SEQ ID NO: 369 - RNA, 23 nt, Homo sapiens
ugcaccaugguugucugagcaug

SEQ ID NO: 370 - RNA, 23 nt, Homo sapiens
caguaacaaagauucauccuugu

SEQ ID NO: 371 - RNA, 23 nt, Homo sapiens
uacccuguagauccgaauuugug

SEQ ID NO: 372 - RNA, 23 nt, Homo sapiens
uacccuguagaaccgaauuugug

SEQ ID NO: 373 - RNA, 23 nt, Homo sapiens
cuggagauauggaagagcugugu

SEQ ID NO: 374 - RNA, 22 nt, Homo sapiens
cagugcaauguuaaaagggcau

SEQ ID NO: 375 - RNA, 22 nt, Homo sapiens
uagguuauccguguugccuucg

SEQ ID NO: 376 - RNA, 22 nt, Homo sapiens
caaagaauucuccuuuugggcu

SEQ ID NO: 377 - RNA, 22 nt, Homo sapiens
uaaucucagcuggcaacuguga

SEQ ID NO: 378 - RNA, 21 nt, Homo sapiens
aucacauugccagggauuucc

SEQ ID NO: 379 - RNA, 21 nt, Homo sapiens
aucacauugccagggauuacc

SEQ ID NO: 380 - RNA, 23 nt, Homo sapiens
ucccuguccuccaggagcucacg

SEQ ID NO: 381 - RNA, 22 nt, Homo sapiens
aaucauacagggacauccaguu

SEQ ID NO: 382 - RNA, 23 nt, Homo sapiens
uucauuugguauaaaccgcgauu

SEQ ID NO: 383 - RNA, 20 nt, Homo sapiens
auggagauagauauagaaau

SEQ ID NO: 384 - RNA, 20 nt, Homo sapiens
agaccauggguucucauugu

SEQ ID NO: 385 - RNA, 22 nt, Homo sapiens
uggagugugacaaugguguuug

SEQ ID NO: 386 - RNA, 22 nt, Homo sapiens
acucggcguggcgucggucgug

SEQ ID NO: 387 - RNA, 21 nt, Homo sapiens
uccugcgcgucccagaugccc

SEQ ID NO: 388 - RNA, 24 nt, Homo sapiens
uuuggcaaugguagaacucacacu

SEQ ID NO: 389 - RNA, 23 nt, Homo sapiens
ugaguaccgccaugucuguuggg

SEQ ID NO: 390 - RNA, 22 nt, Homo sapiens
uagguaguuuccuguuguuggg

SEQ ID NO: 391 - RNA, 22 nt, Homo sapiens
ucaggcucaguccccucccgau

SEQ ID NO: 392 - RNA, 23 nt, Homo sapiens
uagcagcgggaacaguucugcag

SEQ ID NO: 393 - RNA, 23 nt, Homo sapiens
gaacgccuguucuugccaggugg

SEQ ID NO: 394 - RNA, 22 nt, Homo sapiens
uccgagccugggucucccucuu

SEQ ID NO: 395 - RNA, 21 nt, Homo sapiens
gcaggaacuugugagucuccu

SEQ ID NO: 396 - RNA, 21 nt, Homo sapiens
ugcaggaccaagaugagcccu

SEQ ID NO: 397 - RNA, 22 nt, Homo sapiens
uggagagaaaggcaguuccuga

SEQ ID NO: 398 - RNA, 21 nt, Homo sapiens
cggcggggacggcgauugguc

SEQ ID NO: 399 - RNA, 23 nt, Homo sapiens
ugaguaccgccaugucuguuggg

SEQ ID NO: 400 - RNA, 23 nt, Homo sapiens
agugccugagggaguaagagccc

SEQ ID NO: 401 - RNA, 19 nt, Homo sapiens
aggcacggugucagcaggc

SEQ ID NO: 402 - RNA, 19 nt, Homo sapiens
aggcugcggaauucaggac

SEQ ID NO: 403 - RNA, 19 nt, Homo sapiens
aggcugcggaauucaggac

SEQ ID NO: 404 - RNA, 22 nt, Homo sapiens
aggcggggcgccgcgggaccgc

SEQ ID NO: 405 - RNA, 22 nt, Homo sapiens
ugcggggcuagggcuaacagca

SEQ ID NO: 406 - RNA, 21 nt, Homo sapiens
gugccagcugcagugggggag

SEQ ID NO: 407 - RNA, 18 nt, Homo sapiens
ucagcuggcccucauuuc

SEQ ID NO: 408 - RNA, 21 nt, Homo sapiens
cggcggggacggcgauugguc

SEQ ID NO: 409 - RNA, 22 nt, Homo sapiens
aagcugccaguugaagaacugu

SEQ ID NO: 410 - RNA, 23 nt, Homo sapiens
ugaggggcagagagcgagacuuu

SEQ ID NO: 411 - RNA, 25 nt, Homo sapiens
aggggugguguugggacagcuccgu

SEQ ID NO: 412 - RNA, 22 nt, Homo sapiens
aggcggggcgccgcgggaccgc

SEQ ID NO: 413 - RNA, 17 nt, Homo sapiens
ucucgcuggggccucca

SEQ ID NO: 414 - RNA, 20 nt, Homo sapiens
ggggagcuguggaagcagua

SEQ ID NO: 415 - RNA, 21 nt, Homo sapiens
ugcaggaccaagaugagcccu

SEQ ID NO: 416 - RNA, 22 nt, Homo sapiens
ugugagguuggcauuguugucu

SEQ ID NO: 417 - RNA, 22 nt, Homo sapiens
ugcccuguggacucaguucugg

SEQ ID NO: 418 - RNA, 18 nt, Homo sapiens
ugaggcaguagauugaau

SEQ ID NO: 419 - RNA, 23 nt, Homo sapiens
uaaggugcaucuagugcagauag

SEQ ID NO: 420 - RNA, 21 nt, Homo sapiens
ugacaacuauggaugagcucu

SEQ ID NO: 421 - RNA, 22 nt, Homo sapiens
aagcugccaguugaagaacugu

SEQ ID NO: 422 - RNA, 22 nt, Homo sapiens
acacagggcuguugugaagacu

SEQ ID NO: 423 - RNA, 23 nt, Homo sapiens
agcuacauugucugcuggguuuc

SEQ ID NO: 424 - RNA, 21 nt, Homo sapiens
agcuacaucuggcuacugggu

SEQ ID NO: 425 - RNA, 21 nt, Homo sapiens
caagucacuagugguuccguu

SEQ ID NO: 426 - RNA, 22 nt, Homo sapiens
aaggagcucacagucuauugag

SEQ ID NO: 427 - RNA, 23 nt, Homo sapiens
ucuuggaguaggucauugggugg

SEQ ID NO: 428 - RNA, 22 nt, Homo sapiens
ugauugguacgucuguggguag

SEQ ID NO: 429 - RNA, 19 nt, Homo sapiens
ugagcugcuguaccaaaau

SEQ ID NO: 430 - RNA, 21 nt, Homo sapiens
aagccugcccggcuccucggg

SEQ ID NO: 431 - RNA, 23 nt, Homo sapiens
aaggagcuuacaaucuagcuggg

SEQ ID NO: 432 - RNA, 22 nt, Homo sapiens
cugcccuggcccgagggaccga

SEQ ID NO: 433 - RNA, 21 nt, Homo sapiens
uggcagggaggcugggagggg

SEQ ID NO: 434 - RNA, 18 nt, Homo sapiens
ugaggcaguagauugaau

SEQ ID NO: 435 - RNA, 21 nt, Homo sapiens
cggcggggacggcgauugguc

SEQ ID NO: 436 - RNA, 22 nt, Homo sapiens
cgcaggggccgggugcucaccg

SEQ ID NO: 437 - RNA, 21 nt, Homo sapiens
agggcccccccucaauccugu

SEQ ID NO: 438 - RNA, 20 nt, Homo sapiens
ccucugggcccuuccuccag

SEQ ID NO: 439 - RNA, 22 nt, Homo sapiens
ucucugggccugugucuuaggc

SEQ ID NO: 440 - RNA, 20 nt, Homo sapiens
gugcauugcuguugcauugc

SEQ ID NO: 441 - RNA, 23 nt, Homo sapiens
aaugacacgaucacucccguuga

SEQ ID NO: 442 - RNA, 21 nt, Homo sapiens
cggggcagcucaguacaggau

SEQ ID NO: 443 - RNA, 22 nt, Homo sapiens
aagugcugucauagcugagguc

SEQ ID NO: 444 - RNA, 23 nt, Homo sapiens
cacucagccuugagggcacuuuc

SEQ ID NO: 445 - RNA, 22 nt, Homo sapiens
gagugccuucuuuuggagcguu

SEQ ID NO: 446 - RNA, 22 nt, Homo sapiens
aagugccuccuuuuagaguguu

SEQ ID NO: 447 - RNA, 23 nt, Homo sapiens
ucggggaucaucaugucacgaga

SEQ ID NO: 448 - RNA, 23 nt, Homo sapiens
agugccugagggaguaagagccc

SEQ ID NO: 449 - RNA, 22 nt, Homo sapiens
uccgagccugggucucccucuu

SEQ ID NO: 450 - RNA, 21 nt, Homo sapiens
aggaggcagcgcucucaggac

SEQ ID NO: 451 - RNA, 24 nt, Homo sapiens
ugccugggucucuggccugcgcgu

SEQ ID NO: 452 - RNA, 22 nt, Homo sapiens
aggcggggcgccgcgggaccgc

SEQ ID NO: 453 - RNA, 22 nt, Homo sapiens
ugcggggcuagggcuaacagca

SEQ ID NO: 454 - RNA, 21 nt, Homo sapiens
uggaggagaaggaaggugaug

SEQ ID NO: 455 - RNA, 21 nt, Homo sapiens
aaggcagggcccccgcucccc

SEQ ID NO: 456 - RNA, 22 nt, Homo sapiens
uaguacugugcauaucaucuau

SEQ ID NO: 457 - RNA, 22 nt, Homo sapiens
uaacagucuacagccauggucg

SEQ ID NO: 458 - RNA, 23 nt, Homo sapiens
cggcccgggcugcugcuguuccu

SEQ ID NO: 459 - RNA, 23 nt, Homo sapiens
uaaggugcaucuagugcagauag

SEQ ID NO: 460 - RNA, 23 nt, Homo sapiens
uaaggugcaucuagugcaguuag

SEQ ID NO: 461 - RNA, 23 nt, Homo sapiens
caacggaaucccaaaagcagcug

SEQ ID NO: 462 - RNA, 22 nt, Homo sapiens
uagguaguuucauguuguuggg

SEQ ID NO: 463 - RNA, 21 nt, Homo sapiens
uaacagucuccagucacggcc

SEQ ID NO: 464 - RNA, 22 nt, Homo sapiens
aauugcacuuuagcaaugguga

SEQ ID NO: 465 - RNA, 22 nt, Homo sapiens
uugcauauguaggaugucccau

SEQ ID NO: 466 - RNA, 20 nt, Homo sapiens
cuacaaagggaagcccuuuc

SEQ ID NO: 467 - RNA, 22 nt, Homo sapiens
cuacaaagggaagcacuuucuc

SEQ ID NO: 468 - RNA, 22 nt, Homo sapiens
gaugagcucauuguaauaugag

SEQ ID NO: 469 - RNA, 22 nt, Homo sapiens
uaugcauuguauuuuuaggucc

SEQ ID NO: 470 - RNA, 22 nt, Homo sapiens
ugcggggcuagggcuaacagca

SEQ ID NO: 471 - RNA, 22 nt, Homo sapiens
acuccagccccacagccucagc

SEQ ID NO: 472 - RNA, 23 nt, Homo sapiens
uccaguaccacgugucagggcca

SEQ ID NO: 473 - RNA, 22 nt, Homo sapiens
cugcccuggcccgagggaccga

SEQ ID NO: 474 - RNA, 22 nt, Homo sapiens
acaggugagguucuugggagcc

SEQ ID NO: 475 - RNA, 24 nt, Homo sapiens
uugcagcugccugggagugacuuc

SEQ ID NO: 476 - RNA, 23 nt, Homo sapiens
uaaagugcuuauagugcagguag

SEQ ID NO: 477 - RNA, 22 nt, Homo sapiens
uaaucucagcuggcaacuguga

SEQ ID NO: 478 - RNA, 22 nt, Homo sapiens
aaaagcuggguugagagggcga

SEQ ID NO: 479 - RNA, 22 nt, Homo sapiens
aaaagcuggguugagagggcaa

SEQ ID NO: 480 - RNA, 20 nt, Homo sapiens
aaaagcuggguugagagggu

SEQ ID NO: 481 - RNA, 19 nt, Homo sapiens
aaaagcuggguugagagga

SEQ ID NO: 482 - RNA, 21 nt, Homo sapiens
aacaggugacugguuagacaa

SEQ ID NO: 483 - RNA, 22 nt, Homo sapiens
cgaaaacagcaauuaccuuugc

SEQ ID NO: 484 - RNA, 21 nt, Homo sapiens
gaagugugccguggugugucu

SEQ ID NO: 485 - RNA, 21 nt, Homo sapiens
uggcagggaggcugggagggg

SEQ ID NO: 486 - RNA, 23 nt, Homo sapiens
cucucaccacugcccucccacag

SEQ ID NO: 487 - RNA, 21 nt, Homo sapiens
gcccuccgcccgugcaccccg

SEQ ID NO: 488 - RNA, 23 nt, Homo sapiens
ucuggcuccgugucuucacuccc

SEQ ID NO: 489 - RNA, 22 nt, Homo sapiens
uagcagcacauaaugguuugug

SEQ ID NO: 490 - RNA, 22 nt, Homo sapiens
uagcagcacaucaugguuuaca

SEQ ID NO: 491 - RNA, 22 nt, Homo sapiens
uagcagcacguaaauauuggcg

SEQ ID NO: 492 - RNA, 22 nt, Homo sapiens
cgcaggggccgggugcucaccg

SEQ ID NO: 493 - RNA, 22 nt, Homo sapiens
aacuggcccucaaagucccgcu

SEQ ID NO: 494 - RNA, 21 nt, Homo sapiens
uagcagcacagaaauauuggc

SEQ ID NO: 495 - RNA, 22 nt, Homo sapiens
gauuagggugcuuagcuguuaa

SEQ ID NO: 496 - RNA, 21 nt, Homo sapiens
gguuugguccuagccuuucua

SEQ ID NO: 497 - RNA, 20 nt, Homo sapiens
agagguauagggcaugggaa

SEQ ID NO: 498 - RNA, 23 nt, Homo sapiens
agcuacauugucugcuggguuuc

SEQ ID NO: 499 - RNA, 22 nt, Homo sapiens
cagcagcaauucauguuuugaa

SEQ ID NO: 500 - RNA, 22 nt, Homo sapiens
agaggcuggccgugaugaauuc

SEQ ID NO: 501 - RNA, 21 nt, Homo sapiens
cagcagcacacugugguuugu

SEQ ID NO: 502 - RNA, 25 nt, Homo sapiens
ggcggagggaaguagguccguuggu

SEQ ID NO: 503 - RNA, 20 nt, Homo sapiens
ggggagcuguggaagcagua

SEQ ID NO: 504 - RNA, 21 nt, Homo sapiens
uaggacacauggucuacuucu

SEQ ID NO: 505 - RNA, 26 nt, Homo sapiens
aaguaguugguuuguaugagaugguu

SEQ ID NO: 506 - RNA, 17 nt, Homo sapiens
gugggggagaggcuguc

SEQ ID NO: 507 - RNA, 24 nt, Homo sapiens
uugcagcugccugggagugacuuc

SEQ ID NO: 508 - RNA, 22 nt, Homo sapiens
ugagaacugaauuccauggguu

SEQ ID NO: 509 - RNA, 22 nt, Homo sapiens
ugagaacugaauuccauggguu

SEQ ID NO: 510 - RNA, 22 nt, Homo sapiens
ugagaacugaauuccauaggcu

SEQ ID NO: 511 - RNA, 22 nt, Homo sapiens
ucagugcacuacagaacuuugu

SEQ ID NO: 512 - RNA, 23 nt, Homo sapiens
ucuggcuccgugucuucacuccc

SEQ ID NO: 513 - RNA, 18 nt, Homo sapiens
ugaggcaguagauugaau

SEQ ID NO: 514 - RNA, 23 nt, Homo sapiens
ucuuggaguaggucauugggugg

SEQ ID NO: 515 - RNA, 23 nt, Homo sapiens
uaauccuugcuaccugggugaga

SEQ ID NO: 516 - RNA, 22 nt, Homo sapiens
ugugacagauugauaacugaaa

SEQ ID NO: 517 - RNA, 19 nt, Homo sapiens
ugagcugcuguaccaaaau

SEQ ID NO: 518 - RNA, 20 nt, Homo sapiens
aggguguuucucucaucucu

SEQ ID NO: 519 - RNA, 22 nt, Homo sapiens
gucccucuccaaaugugucuug

SEQ ID NO: 520 - RNA, 21 nt, Homo sapiens
aggaggcagcgcucucaggac

SEQ ID NO: 521 - RNA, 21 nt, Homo sapiens
agugaaugauggguucugacc

SEQ ID NO: 522 - RNA, 18 nt, Homo sapiens
cagggaggugaaugugau

SEQ ID NO: 523 - RNA, 20 nt, Homo sapiens
ggggagcuguggaagcagua

SEQ ID NO: 524 - RNA, 22 nt, Homo sapiens
cucuagagggaagcacuuucug

SEQ ID NO: 525 - RNA, 22 nt, Homo sapiens
uguaacagcaacuccaugugga

SEQ ID NO: 526 - RNA, 22 nt, Homo sapiens
cucccacugcuucacuugacua

SEQ ID NO: 527 - RNA, 22 nt, Homo sapiens
uucccuuugucauccuaugccu

SEQ ID NO: 528 - RNA, 22 nt, Homo sapiens
uucccuuugucauccuucgccu

SEQ ID NO: 529 - RNA, 21 nt, Homo sapiens
agcuacaucuggcuacugggu

SEQ ID NO: 530 - RNA, 22 nt, Homo sapiens
uuauaauacaaccugauaagug

SEQ ID NO: 531 - RNA, 22 nt, Homo sapiens
auauaauacaaccugcuaagug

SEQ ID NO: 532 - RNA, 22 nt, Homo sapiens
aggcaguguauuguuagcuggc

SEQ ID NO: 533 - RNA, 22 nt, Homo sapiens
agaggcuggccgugaugaauuc

SEQ ID NO: 534 - RNA, 18 nt, Homo sapiens
ugcuuccuuucagagggu

SEQ ID NO: 535 - RNA, 22 nt, Homo sapiens
aucuggagguaagaagcacuuu

SEQ ID NO: 536 - RNA, 22 nt, Homo sapiens
uagcaaaaacugcaguuacuuu

SEQ ID NO: 537 - RNA, 20 nt, Homo sapiens
aaaguagcuguaccauuugc

SEQ ID NO: 538 - RNA, 21 nt, Homo sapiens
guggcugcacucacuuccuuc

SEQ ID NO: 539 - RNA, 22 nt, Homo sapiens
uacccauugcauaucggaguug

SEQ ID NO: 540 - RNA, 21 nt, Homo sapiens
ccccaccuccucucuccucag

SEQ ID NO: 541 - RNA, 17 nt, Homo sapiens
uucaaguaauucaggug

SEQ ID NO: 542 - RNA, 22 nt, Homo sapiens
uggagagaaaggcaguuccuga

SEQ ID NO: 543 - RNA, 22 nt, Homo sapiens
uuggggaaacggccgcugagug

SEQ ID NO: 544 - RNA, 21 nt, Homo sapiens
uucaaguaauucaggauaggu

SEQ ID NO: 545 - RNA, 23 nt, Homo sapiens
aaugacacgaucacucccguuga

SEQ ID NO: 546 - RNA, 22 nt, Homo sapiens
aguggggaacccuuccaugagg

SEQ ID NO: 547 - RNA, 22 nt, Homo sapiens
ggagaaauuauccuuggugugu

SEQ ID NO: 548 - RNA, 22 nt, Homo sapiens
aaaaguauuugcggguuuuguc

SEQ ID NO: 549 - RNA, 22 nt, Homo sapiens
caaaaguaauuguggauuuugu

SEQ ID NO: 550 - RNA, 20 nt, Homo sapiens
guagaggagauggcgcaggg

SEQ ID NO: 551 - RNA, 22 nt, Homo sapiens
auccgcgcucugacucucugcc

SEQ ID NO: 552 - RNA, 21 nt, Homo sapiens
ucguggccuggucuccauuau

SEQ ID NO: 553 - RNA, 21 nt, Homo sapiens
ccccaccuccucucuccucag

SEQ ID NO: 554 - RNA, 22 nt, Homo sapiens
uggagugugacaaugguguuug

SEQ ID NO: 555 - RNA, 19 nt, Homo sapiens
auggauaaggcuuuggcuu

SEQ ID NO: 556 - RNA, 21 nt, Homo sapiens
ccuguugaaguguaaucccca

SEQ ID NO: 557 - RNA, 17 nt, Homo sapiens
ucccaccgcugccaccc

SEQ ID NO: 558 - RNA, 17 nt, Homo sapiens
ucgccuccuccucuccc

SEQ ID NO: 559 - RNA, 21 nt, Homo sapiens
ugcaggaccaagaugagcccu

SEQ ID NO: 560 - RNA, 22 nt, Homo sapiens
aaaaccgucuaguuacaguugu

SEQ ID NO: 561 - RNA, 22 nt, Homo sapiens
ucugcccccuccgcugcugcca

SEQ ID NO: 562 - RNA, 21 nt, Homo sapiens
ccacaccguaucugacacuuu

SEQ ID NO: 563 - RNA, 20 nt, Homo sapiens
acugccccaggugcugcugg

SEQ ID NO: 564 - RNA, 23 nt, Homo sapiens
ucucacacagaaaucgcacccgu

SEQ ID NO: 565 - RNA, 23 nt, Homo sapiens
aucaacagacauuaauugggcgc

SEQ ID NO: 566 - RNA, 22 nt, Homo sapiens
aaaccguuaccauuacugaguu

SEQ ID NO: 567 - RNA, 23 nt, Homo sapiens
agguuguccguggugaguucgca

SEQ ID NO: 568 - RNA, 22 nt, Homo sapiens
agaggcuggccgugaugaauuc

SEQ ID NO: 569 - RNA, 21 nt, Homo sapiens
cggggcagcucaguacaggau

SEQ ID NO: 570 - RNA, 22 nt, Homo sapiens
uggugggcacagaaucuggacu

SEQ ID NO: 571 - RNA, 21 nt, Homo sapiens
aacaggugacugguuagacaa

SEQ ID NO: 572 - RNA, 20 nt, Homo sapiens
guccgcucggcgguggccca

SEQ ID NO: 573 - RNA, 21 nt, Homo sapiens
uuggccacaauggguuagaac

SEQ ID NO: 574 - RNA, 21 nt, Homo sapiens
uuggccacaauggguuagaac

SEQ ID NO: 575 - RNA, 22 nt, Homo sapiens
uggugggccgcagaacaugugc

SEQ ID NO: 576 - RNA, 25 nt, Homo sapiens
ggcggagggaaguagguccguuggu

SEQ ID NO: 577 - RNA, 20 nt, Homo sapiens
ggggagcuguggaagcagua

SEQ ID NO: 578 - RNA, 21 nt, Homo sapiens
agagaagaagaucagccugca

SEQ ID NO: 579 - RNA, 24 nt, Homo sapiens
agccuggaagcuggagccugcagu

SEQ ID NO: 580 - RNA, 18 nt, Homo sapiens
uugagaaggaggcugcug

SEQ ID NO: 581 - RNA, 22 nt, Homo sapiens
ugagaacugaauuccauggguu

SEQ ID NO: 582 - RNA, 22 nt, Homo sapiens
ugagaacugaauuccauaggcu

SEQ ID NO: 583 - RNA, 21 nt, Homo sapiens
caucccuugcaugguggaggg

SEQ ID NO: 584 - RNA, 21 nt, Homo sapiens
aggcaagaugcuggcauagcu

SEQ ID NO: 585 - RNA, 23 nt, Homo sapiens
cgcauccccuagggcauuggugu

SEQ ID NO: 586 - RNA, 22 nt, Homo sapiens
uucucaaggaggugucguuuau

SEQ ID NO: 587 - RNA, 22 nt, Homo sapiens
uaacugguugaacaacugaacc

SEQ ID NO: 588 - RNA, 23 nt, Homo sapiens
aucccuugcaggggcuguugggu

SEQ ID NO: 589 - RNA, 23 nt, Homo sapiens
caguaacaaagauucauccuugu

SEQ ID NO: 590 - RNA, 22 nt, Homo sapiens
ugcccuuaaaggugaacccagu

SEQ ID NO: 591 - RNA, 22 nt, Homo sapiens
uuuccggcucgcgugggugugu

SEQ ID NO: 592 - RNA, 18 nt, Homo sapiens
aucccaccucugccacca

SEQ ID NO: 593 - RNA, 23 nt, Homo sapiens
ugugcaaaucuaugcaaaacuga

SEQ ID NO: 594 - RNA, 23 nt, Homo sapiens
ugugcaaauccaugcaaaacuga

SEQ ID NO: 595 - RNA, 21 nt, Homo sapiens
uuuugcaccuuuuggagugaa

SEQ ID NO: 596 - RNA, 22 nt, Homo sapiens
ccucccacacccaaggcuugca

SEQ ID NO: 597 - RNA, 23 nt, Homo sapiens
guuugcacgggugggccuugucu

SEQ ID NO: 598 - RNA, 22 nt, Homo sapiens
caaaguuuaagauccuugaagu

SEQ ID NO: 599 - RNA, 25 nt, Homo sapiens
aggggugguguugggacagcuccgu

SEQ ID NO: 600 - RNA, 22 nt, Homo sapiens
uccgagccugggucucccucuu

SEQ ID NO: 601 - RNA, 22 nt, Homo sapiens
ugcggggcuagggcuaacagca

SEQ ID NO: 602 - RNA, 21 nt, Homo sapiens
ucguggccuggucuccauuau

SEQ ID NO: 603 - RNA, 22 nt, Homo sapiens
gcccgcguguggagccaggugu

SEQ ID NO: 604 - RNA, 22 nt, Homo sapiens
uagcagcacauaaugguuugug

SEQ ID NO: 605 - RNA, 22 nt, Homo sapiens
uagcagcacaucaugguuuaca

SEQ ID NO: 606 - RNA, 22 nt, Homo sapiens
uagcagcacguaaauauuggcg

SEQ ID NO: 607 - RNA, 21 nt, Homo sapiens
cggcggggacggcgauugguc

SEQ ID NO: 608 - RNA, 23 nt, Homo sapiens
ugaguaccgccaugucuguuggg

SEQ ID NO: 609 - RNA, 21 nt, Homo sapiens
uagcagcacagaaauauuggc

SEQ ID NO: 610 - RNA, 22 nt, Homo sapiens
uggcucaguucagcaggaacag

SEQ ID NO: 611 - RNA, 22 nt, Homo sapiens
cagcagcaauucauguuuugaa

SEQ ID NO: 612 - RNA, 21 nt, Homo sapiens
cagcagcacacugugguuugu

SEQ ID NO: 613 - RNA, 19 nt, Homo sapiens
ugucucugcugggguuucu

SEQ ID NO: 614 - RNA, 22 nt, Homo sapiens
ggggguccccggugcucggauc

SEQ ID NO: 615 - RNA, 22 nt, Homo sapiens
aggcggggcgccgcgggaccgc

SEQ ID NO: 616 - RNA, 22 nt, Homo sapiens
gguggcccggccgugccugagg

SEQ ID NO: 617 - RNA, 23 nt, Homo sapiens
ugcaccaugguugucugagcaug

SEQ ID NO: 618 - RNA, 22 nt, Homo sapiens
ugugcgcagggagaccucuccc

SEQ ID NO: 619 - RNA, 22 nt, Homo sapiens
acaggugagguucuugggagcc

SEQ ID NO: 620 - RNA, 18 nt, Homo sapiens
cgggcguggugguggggg

SEQ ID NO: 621 - RNA, 20 nt, Homo sapiens
uaaagagcccuguggagaca

SEQ ID NO: 622 - RNA, 17 nt, Homo sapiens
ucccaccgcugccaccc

SEQ ID NO: 623 - RNA, 20 nt, Homo sapiens
ucguuugccuuuuucugcuu

SEQ ID NO: 624 - RNA, 21 nt, Homo sapiens
cggcggggacggcgauugguc

SEQ ID NO: 625 - RNA, 21 nt, Homo sapiens
gccccugggccuauccuagaa

SEQ ID NO: 626 - RNA, 22 nt, Homo sapiens
uggcagugucuuagcugguugu

SEQ ID NO: 627 - RNA, 22 nt, Homo sapiens
uggugggcacagaaucuggacu

SEQ ID NO: 628 - RNA, 22 nt, Homo sapiens
ugugacagauugauaacugaaa

SEQ ID NO: 629 - RNA, 22 nt, Homo sapiens
ucagcaaacauuuauugugugc

SEQ ID NO: 630 - RNA, 25 nt, Homo sapiens
aggggugguguugggacagcuccgu

SEQ ID NO: 631 - RNA, 22 nt, Homo sapiens
uggugggccgcagaacaugugc

SEQ ID NO: 632 - RNA, 22 nt, Homo sapiens
aggcggggcgccgcgggaccgc

SEQ ID NO: 633 - RNA, 22 nt, Homo sapiens
ugcggggcuagggcuaacagca

SEQ ID NO: 634 - RNA, 20 nt, Homo sapiens
ggggagcuguggaagcagua

SEQ ID NO: 635 - RNA, 20 nt, Homo sapiens
ggggagcuguggaagcagua

SEQ ID NO: 636 - RNA, 22 nt, Homo sapiens
ugagguaguagguuguauaguu

SEQ ID NO: 637 - RNA, 22 nt, Homo sapiens
ugagguaguagguugugugguu

SEQ ID NO: 638 - RNA, 22 nt, Homo sapiens
ugagguaguagguuguaugguu

SEQ ID NO: 639 - RNA, 22 nt, Homo sapiens
agagguaguagguugcauaguu

SEQ ID NO: 640 - RNA, 22 nt, Homo sapiens
ugagguaggagguuguauaguu

SEQ ID NO: 641 - RNA, 22 nt, Homo sapiens
ugagguaguagauuguauaguu

SEQ ID NO: 642 - RNA, 22 nt, Homo sapiens
ugagguaguaguuuguacaguu

SEQ ID NO: 643 - RNA, 22 nt, Homo sapiens
ugagguaguaguuugugcuguu

SEQ ID NO: 644 - RNA, 22 nt, Homo sapiens
ccucuuccccuugucucuccag

SEQ ID NO: 645 - RNA, 22 nt, Homo sapiens
ugugacugguugaccagagggg

SEQ ID NO: 646 - RNA, 23 nt, Homo sapiens
uaauacugccggguaaugaugga

SEQ ID NO: 647 - RNA, 22 nt, Homo sapiens
auaagacgagcaaaaagcuugu

SEQ ID NO: 648 - RNA, 22 nt, Homo sapiens
auaagacgaacaaaagguuugu

SEQ ID NO: 649 - RNA, 20 nt, Homo sapiens
ccucugggcccuuccuccag

SEQ ID NO: 650 - RNA, 22 nt, Homo sapiens
ucucugggccugugucuuaggc

SEQ ID NO: 651 - RNA, 21 nt, Homo sapiens
ugguagacuauggaacguagg

SEQ ID NO: 652 - RNA, 22 nt, Homo sapiens
ugauugguacgucuguggguag

SEQ ID NO: 653 - RNA, 23 nt, Homo sapiens
agugccugagggaguaagagccc

SEQ ID NO: 654 - RNA, 20 nt, Homo sapiens
guagaggagauggcgcaggg

SEQ ID NO: 655 - RNA, 22 nt, Homo sapiens
uauugcacucgucccggccucc

SEQ ID NO: 656 - RNA, 22 nt, Homo sapiens
ugagguaguaaguuguauuguu

SEQ ID NO: 657 - RNA, 22 nt, Homo sapiens
agaaggaaauugaauucauuua

SEQ ID NO: 658 - RNA, 22 nt, Homo sapiens
ucagugcacuacagaacuuugu

SEQ ID NO: 659 - RNA, 22 nt, Homo sapiens
ucagugcaucacagaacuuugu

SEQ ID NO: 660 - RNA, 21 nt, Homo sapiens
ucagugcaugacagaacuugg

SEQ ID NO: 661 - RNA, 18 nt, Homo sapiens
uccagugcccuccucucc

SEQ ID NO: 662 - RNA, 23 nt, Homo sapiens
ucaagagcaauaacgaaaaaugu

SEQ ID NO: 663 - RNA, 23 nt, Homo sapiens
ucccccaggugugauucugauuu

SEQ ID NO: 664 - RNA, 23 nt, Homo sapiens
aaacucuacuuguccuucugagu

SEQ ID NO: 665 - RNA, 24 nt, Homo sapiens
acugggggcuuucgggcucugcgu

SEQ ID NO: 666 - RNA, 24 nt, Homo sapiens
ugccugggucucuggccugcgcgu

SEQ ID NO: 667 - RNA, 22 nt, Homo sapiens
ugagccccugugccgcccccag

SEQ ID NO: 668 - RNA, 22 nt, Homo sapiens
ucggccugaccacccaccccac

SEQ ID NO: 669 - RNA, 24 nt, Homo sapiens
ucccugagacccuuuaaccuguga

SEQ ID NO: 670 - RNA, 22 nt, Homo sapiens
ucccugagacccuaacuuguga

SEQ ID NO: 671 - RNA, 23 nt, Homo sapiens
ccucagggcuguagaacagggcu

SEQ ID NO: 672 - RNA, 23 nt, Homo sapiens
cggcccgggcugcugcuguuccu

SEQ ID NO: 673 - RNA, 21 nt, Homo sapiens
cggcggggacggcgauugguc

SEQ ID NO: 674 - RNA, 23 nt, Homo sapiens
caacggaaucccaaaagcagcug

SEQ ID NO: 675 - RNA, 22 nt, Homo sapiens
uggcucaguucagcaggaacag

SEQ ID NO: 676 - RNA, 19 nt, Homo sapiens
gggcgccugugaucccaac

SEQ ID NO: 677 - RNA, 25 nt, Homo sapiens
aggggugguguugggacagcuccgu

SEQ ID NO: 678 - RNA, 24 nt, Homo sapiens
ugccugggucucuggccugcgcgu

SEQ ID NO: 679 - RNA, 22 nt, Homo sapiens
aggcggggcgccgcgggaccgc

SEQ ID NO: 680 - RNA, 22 nt, Homo sapiens
ugcggggcuagggcuaacagca

SEQ ID NO: 681 - RNA, 23 nt, Homo sapiens
cgggucggaguuagcucaagcgg

SEQ ID NO: 682 - RNA, 20 nt, Homo sapiens
ggggagcuguggaagcagua

SEQ ID NO: 683 - RNA, 23 nt, Homo sapiens
cacccggcugugugcacaugugc

SEQ ID NO: 684 - RNA, 21 nt, Homo sapiens
uaaagugcugacagugcagau

SEQ ID NO: 685 - RNA, 20 nt, Homo sapiens
uaaagagcccuguggagaca

SEQ ID NO: 686 - RNA, 18 nt, Homo sapiens
uccagugcccuccucucc

SEQ ID NO: 687 - RNA, 21 nt, Homo sapiens
cggcggggacggcgauugguc

SEQ ID NO: 688 - RNA, 22 nt, Homo sapiens
ucugcccccuccgcugcugcca

SEQ ID NO: 689 - RNA, 20 nt, Homo sapiens
acugccccaggugcugcugg

SEQ ID NO: 690 - RNA, 21 nt, Homo sapiens
cggggcagcucaguacaggau

SEQ ID NO: 691 - RNA, 23 nt, Homo sapiens
cacucagccuugagggcacuuuc

SEQ ID NO: 692 - RNA, 21 nt, Homo sapiens
caaagguauuugugguuuuug

SEQ ID NO: 693 - RNA, 21 nt, Homo sapiens
gcgacccacucuugguuucca

SEQ ID NO: 694 - RNA, 21 nt, Homo sapiens
gcgacccauacuugguuucag

SEQ ID NO: 695 - RNA, 19 nt, Homo sapiens
ugucucugcugggguuucu

SEQ ID NO: 696 - RNA, 19 nt, Homo sapiens
ucuaggcugguacugcuga

SEQ ID NO: 697 - RNA, 22 nt, Homo sapiens
ugcggggcuagggcuaacagca

SEQ ID NO: 698 - RNA, 19 nt, Homo sapiens
gugaggacucgggaggugg

SEQ ID NO: 699 - RNA, 24 nt, Homo sapiens
agccuggaagcuggagccugcagu

SEQ ID NO: 700 - RNA, 23 nt, Homo sapiens
uauggcuuuuuauuccuauguga

SEQ ID NO: 701 - RNA, 23 nt, Homo sapiens
uauggcuuuucauuccuauguga

SEQ ID NO: 702 - RNA, 21 nt, Homo sapiens
cggcggggacggcgauugguc

SEQ ID NO: 703 - RNA, 22 nt, Homo sapiens
ugauauguuugauauauuaggu

SEQ ID NO: 704 - RNA, 23 nt, Homo sapiens
agcuacauugucugcuggguuuc

SEQ ID NO: 705 - RNA, 23 nt, Homo sapiens
ugaggggcagagagcgagacuuu

SEQ ID NO: 706 - RNA, 21 nt, Homo sapiens
aauggcgccacuaggguugug

SEQ ID NO: 707 - RNA, 22 nt, Homo sapiens
aggcggggcgccgcgggaccgc

SEQ ID NO: 708 - RNA, 22 nt, Homo sapiens
ugcggggcuagggcuaacagca

SEQ ID NO: 709 - RNA, 22 nt, Homo sapiens
aggcagcgggguguaguggaua

SEQ ID NO: 710 - RNA, 22 nt, Homo sapiens
auccgcgcucugacucucugcc

SEQ ID NO: 711 - RNA, 22 nt, Homo sapiens
acccgucccguucguccccgga

SEQ ID NO: 712 - RNA, 25 nt, Homo sapiens
gggcgacaaagcaagacucuuucuu

SEQ ID NO: 713 - RNA, 23 nt, Homo sapiens
cggcccgggcugcugcuguuccu

SEQ ID NO: 714 - RNA, 22 nt, Homo sapiens
uagguaguuuccuguuguuggg

SEQ ID NO: 715 - RNA, 21 nt, Homo sapiens
gccccugggccuauccuagaa

SEQ ID NO: 716 - RNA, 22 nt, Homo sapiens
ugugacagauugauaacugaaa

SEQ ID NO: 717 - RNA, 22 nt, Homo sapiens
uauugcacucgucccggccucc

SEQ ID NO: 718 - RNA, 22 nt, Homo sapiens
auccgcgcucugacucucugcc

SEQ ID NO: 719 - RNA, 22 nt, Homo sapiens
ucugggcaacaaagugagaccu

SEQ ID NO: 720 - RNA, 21 nt, Homo sapiens
uggacugcccugaucuggaga

SEQ ID NO: 721 - RNA, 22 nt, Homo sapiens
ugauauguuugauauauuaggu

SEQ ID NO: 722 - RNA, 21 nt, Homo sapiens
ugauauguuugauauuggguu

SEQ ID NO: 723 - RNA, 21 nt, Homo sapiens
ccaguccugugccugccgccu

SEQ ID NO: 724 - RNA, 22 nt, Homo sapiens
uagguaguuucauguuguuggg

SEQ ID NO: 725 - RNA, 22 nt, Homo sapiens
cucccacugcuucacuugacua

SEQ ID NO: 726 - RNA, 22 nt, Homo sapiens
ccucccacacccaaggcuugca

SEQ ID NO: 727 - RNA, 22 nt, Homo sapiens
ccaaaacugcaguuacuuuugc

SEQ ID NO: 728 - RNA, 25 nt, Homo sapiens
gcugggcagggcuucugagcuccuu

SEQ ID NO: 729 - RNA, 24 nt, Homo sapiens
ugccugggucucuggccugcgcgu

SEQ ID NO: 730 - RNA, 20 nt, Homo sapiens
accaggaggcugaggccccu

SEQ ID NO: 731 - RNA, 22 nt, Homo sapiens
ugcggggcuagggcuaacagca

SEQ ID NO: 732 - RNA, 18 nt, Homo sapiens
ucagcuggcccucauuuc

SEQ ID NO: 733 - RNA, 22 nt, Homo sapiens
uggagugugacaaugguguuug

SEQ ID NO: 734 - RNA, 22 nt, Homo sapiens
uggguggucuggagauuugugc

SEQ ID NO: 735 - RNA, 18 nt, Homo sapiens
cagggaggugaaugugau

SEQ ID NO: 736 - RNA, 23 nt, Homo sapiens
ucuggcuccgugucuucacuccc

SEQ ID NO: 737 - RNA, 22 nt, Homo sapiens
uuggggaaacggccgcugagug

SEQ ID NO: 738 - RNA, 22 nt, Homo sapiens
aggugguccguggcgcguucgc

SEQ ID NO: 739 - RNA, 20 nt, Homo sapiens
ccucugggcccuuccuccag

SEQ ID NO: 740 - RNA, 22 nt, Homo sapiens
ucucugggccugugucuuaggc

SEQ ID NO: 741 - RNA, 25 nt, Homo sapiens
aggggugguguugggacagcuccgu

SEQ ID NO: 742 - RNA, 22 nt, Homo sapiens
gucccucuccaaaugugucuug

SEQ ID NO: 743 - RNA, 22 nt, Homo sapiens
ugagccccugugccgcccccag

SEQ ID NO: 744 - RNA, 23 nt, Homo sapiens
ucuggcuccgugucuucacuccc

SEQ ID NO: 745 - RNA, 21 nt, Homo sapiens
cggcggggacggcgauugguc

SEQ ID NO: 746 - RNA, 22 nt, Homo sapiens
uagcuuaucagacugauguuga

SEQ ID NO: 747 - RNA, 21 nt, Homo sapiens
uucacaguggcuaaguucugc

SEQ ID NO: 748 - RNA, 23 nt, Homo sapiens
ugaggggcagagagcgagacuuu

SEQ ID NO: 749 - RNA, 22 nt, Homo sapiens
gagcuuauucauaaaagugcag

SEQ ID NO: 750 - RNA, 22 nt, Homo sapiens
aggcggggcgccgcgggaccgc

SEQ ID NO: 751 - RNA, 22 nt, Homo sapiens
ugcggggcuagggcuaacagca

SEQ ID NO: 752 - RNA, 24 nt, Homo sapiens
uggggagcugaggcucugggggug

SEQ ID NO: 753 - RNA, 22 nt, Homo sapiens
aacccguagauccgaucuugug

SEQ ID NO: 754 - RNA, 22 nt, Homo sapiens
cacccguagaaccgaccuugcg

SEQ ID NO: 755 - RNA, 23 nt, Homo sapiens
uagcagcgggaacaguucugcag

SEQ ID NO: 756 - RNA, 22 nt, Homo sapiens
aucuggagguaagaagcacuuu

SEQ ID NO: 757 - RNA, 22 nt, Homo sapiens
aucuggagguaagaagcacuuu

SEQ ID NO: 758 - RNA, 23 nt, Homo sapiens
caaagcgcuucucuuuagagugu

SEQ ID NO: 759 - RNA, 21 nt, Homo sapiens
cuccagagggaaguacuuucu

SEQ ID NO: 760 - RNA, 21 nt, Homo sapiens
cuccagagggaugcacuuucu

SEQ ID NO: 761 - RNA, 22 nt, Homo sapiens
aaaaguaauugcgaguuuuacc

SEQ ID NO: 762 - RNA, 22 nt, Homo sapiens
aaaaguaauugcgguuuuugcc

SEQ ID NO: 763 - RNA, 22 nt, Homo sapiens
aaaaguaauugugguuuuugcc

SEQ ID NO: 764 - RNA, 22 nt, Homo sapiens
aaaaguaaucgcgguuuuuguc

SEQ ID NO: 765 - RNA, 22 nt, Homo sapiens
aaaaguaauugcggauuuugcc

SEQ ID NO: 766 - RNA, 22 nt, Homo sapiens
aaaaguaauugcggucuuuggu

SEQ ID NO: 767 - RNA, 21 nt, Homo sapiens
uaaaguaaauaugcaccaaaa

SEQ ID NO: 768 - RNA, 20 nt, Homo sapiens
accaggaggcugaggccccu

SEQ ID NO: 769 - RNA, 20 nt, Homo sapiens
accaggaggcugaggccccu

SEQ ID NO: 770 - RNA, 22 nt, Homo sapiens
ugagaccucuggguucugagcu

SEQ ID NO: 771 - RNA, 22 nt, Homo sapiens
ugagguaguagguuguauaguu

SEQ ID NO: 772 - RNA, 22 nt, Homo sapiens
ugagguaguagguugugugguu

SEQ ID NO: 773 - RNA, 22 nt, Homo sapiens
ugagguaguagguuguaugguu

SEQ ID NO: 774 - RNA, 22 nt, Homo sapiens
agagguaguagguugcauaguu

SEQ ID NO: 775 - RNA, 22 nt, Homo sapiens
ugagguaggagguuguauaguu

SEQ ID NO: 776 - RNA, 22 nt, Homo sapiens
ugagguaguagauuguauaguu

SEQ ID NO: 777 - RNA, 22 nt, Homo sapiens
ugagguaguaguuuguacaguu

SEQ ID NO: 778 - RNA, 22 nt, Homo sapiens
ugagguaguaguuugugcuguu

SEQ ID NO: 779 - RNA, 21 nt, Homo sapiens
uggcagggaggcugggagggg

SEQ ID NO: 780 - RNA, 22 nt, Homo sapiens
uuagggcccuggcuccaucucc

SEQ ID NO: 781 - RNA, 23 nt, Homo sapiens
uaaggugcaucuagugcaguuag

SEQ ID NO: 782 - RNA, 22 nt, Homo sapiens
cgcaggggccgggugcucaccg

SEQ ID NO: 783 - RNA, 22 nt, Homo sapiens
gauuagggugcuuagcuguuaa

SEQ ID NO: 784 - RNA, 21 nt, Homo sapiens
agggcccccccucaauccugu

SEQ ID NO: 785 - RNA, 22 nt, Homo sapiens
uuauaaagcaaugagacugauu

SEQ ID NO: 786 - RNA, 25 nt, Homo sapiens
aggggugguguugggacagcuccgu

SEQ ID NO: 787 - RNA, 24 nt, Homo sapiens
ugccugggucucuggccugcgcgu

SEQ ID NO: 788 - RNA, 20 nt, Homo sapiens
cggcucugggucugugggga

SEQ ID NO: 789 - RNA, 23 nt, Homo sapiens
cgggucggaguuagcucaagcgg

SEQ ID NO: 790 - RNA, 20 nt, Homo sapiens
ggggagcuguggaagcagua

SEQ ID NO: 791 - RNA, 22 nt, Homo sapiens
ugagguaguaaguuguauuguu

SEQ ID NO: 792 - RNA, 21 nt, Homo sapiens
uggcagggaggcugggagggg

SEQ ID NO: 793 - RNA, 22 nt, Homo sapiens
acgcccuucccccccuucuuca

SEQ ID NO: 794 - RNA, 18 nt, Homo sapiens
cgggcguggugguggggg

SEQ ID NO: 795 - RNA, 22 nt, Homo sapiens
ucuacaaaggaaagcgcuuucu

SEQ ID NO: 796 - RNA, 23 nt, Homo sapiens
ucuggcuccgugucuucacuccc

SEQ ID NO: 797 - RNA, 22 nt, Homo sapiens
aucgugcauccuuuuagagugu

SEQ ID NO: 798 - RNA, 18 nt, Homo sapiens
ugaggcaguagauugaau

SEQ ID NO: 799 - RNA, 22 nt, Homo sapiens
uggagagaaaggcaguuccuga

SEQ ID NO: 800 - RNA, 22 nt, Homo sapiens
ucgugucuuguguugcagccgg

SEQ ID NO: 801 - RNA, 22 nt, Homo sapiens
cgcaggggccgggugcucaccg

SEQ ID NO: 802 - RNA, 22 nt, Homo sapiens
uaauacugccugguaaugauga

SEQ ID NO: 803 - RNA, 23 nt, Homo sapiens
uaauacugccggguaaugaugga

SEQ ID NO: 804 - RNA, 20 nt, Homo sapiens
ccucugggcccuuccuccag

SEQ ID NO: 805 - RNA, 22 nt, Homo sapiens
ucucugggccugugucuuaggc

SEQ ID NO: 806 - RNA, 22 nt, Homo sapiens
uaauacugucugguaaaaccgu

SEQ ID NO: 807 - RNA, 19 nt, Homo sapiens
aggcugcggaauucaggac

SEQ ID NO: 808 - RNA, 25 nt, Homo sapiens
ggcggagggaaguagguccguuggu

SEQ ID NO: 809 - RNA, 23 nt, Homo sapiens
ucuggcuccgugucuucacuccc

SEQ ID NO: 810 - RNA, 23 nt, Homo sapiens
cggcccgggcugcugcuguuccu

SEQ ID NO: 811 - RNA, 21 nt, Homo sapiens
cggcggggacggcgauugguc

SEQ ID NO: 812 - RNA, 23 nt, Homo sapiens
ugaggggcagagagcgagacuuu

SEQ ID NO: 813 - RNA, 22 nt, Homo sapiens
aguggggaacccuuccaugagg

SEQ ID NO: 814 - RNA, 21 nt, Homo sapiens
auccuugcuaucugggugcua

SEQ ID NO: 815 - RNA, 22 nt, Homo sapiens
aucuggagguaagaagcacuuu

SEQ ID NO: 816 - RNA, 23 nt, Homo sapiens
caaagcgcuucucuuuagagugu

SEQ ID NO: 817 - RNA, 21 nt, Homo sapiens
cuccagagggaaguacuuucu

SEQ ID NO: 818 - RNA, 21 nt, Homo sapiens
cuccagagggaugcacuuucu

SEQ ID NO: 819 - RNA, 23 nt, Homo sapiens
gcgaggaccccucggggucugac

SEQ ID NO: 820 - RNA, 23 nt, Homo sapiens
gaacgccuguucuugccaggugg

SEQ ID NO: 821 - RNA, 22 nt, Homo sapiens
aggcggggcgccgcgggaccgc

SEQ ID NO: 822 - RNA, 22 nt, Homo sapiens
ugcggggcuagggcuaacagca

SEQ ID NO: 823 - RNA, 20 nt, Homo sapiens
ggggagcuguggaagcagua

SEQ ID NO: 824 - RNA, 22 nt, Homo sapiens
ucaccagcccuguguucccuag

SEQ ID NO: 825 - RNA, 22 nt, Homo sapiens
agaaggaaauugaauucauuua

SEQ ID NO: 826 - RNA, 17 nt, Homo sapiens
ucgccuccuccucuccc

SEQ ID NO: 827 - RNA, 23 nt, Homo sapiens
agcugguguugugaaucaggccg

SEQ ID NO: 828 - RNA, 21 nt, Homo sapiens
uccugcgcgucccagaugccc

SEQ ID NO: 829 - RNA, 22 nt, Homo sapiens
ucugcccccuccgcugcugcca

SEQ ID NO: 830 - RNA, 20 nt, Homo sapiens
ccuccugcccuccuugcugu

SEQ ID NO: 831 - RNA, 23 nt, Homo sapiens
uaaagugcuuauagugcagguag

SEQ ID NO: 832 - RNA, 22 nt, Homo sapiens
aaggagcucacagucuauugag

SEQ ID NO: 833 - RNA, 20 nt, Homo sapiens
acugccccaggugcugcugg

SEQ ID NO: 834 - RNA, 22 nt, Homo sapiens
gcugacuccuaguccagggcuc

SEQ ID NO: 835 - RNA, 21 nt, Homo sapiens
cggggcagcucaguacaggau

SEQ ID NO: 836 - RNA, 21 nt, Homo sapiens
aacaggugacugguuagacaa

SEQ ID NO: 837 - RNA, 23 nt, Homo sapiens
aaggagcuuacaaucuagcuggg

SEQ ID NO: 838 - RNA, 21 nt, Homo sapiens
uggcagggaggcugggagggg

SEQ ID NO: 839 - RNA, 21 nt, Homo sapiens
ccccaccuccucucuccucag

SEQ ID NO: 840 - RNA, 22 nt, Homo sapiens
ccucuuccccuugucucuccag

SEQ ID NO: 841 - RNA, 22 nt, Homo sapiens
acaggugagguucuugggagcc

SEQ ID NO: 842 - RNA, 24 nt, Homo sapiens
ccagacagaauucuaugcacuuuc

SEQ ID NO: 843 - RNA, 23 nt, Homo sapiens
cggcccgggcugcugcuguuccu

SEQ ID NO: 844 - RNA, 18 nt, Homo sapiens
ugaggcaguagauugaau

SEQ ID NO: 845 - RNA, 23 nt, Homo sapiens
uaaggugcaucuagugcagauag

SEQ ID NO: 846 - RNA, 22 nt, Homo sapiens
cgcaggggccgggugcucaccg

SEQ ID NO: 847 - RNA, 21 nt, Homo sapiens
agggcccccccucaauccugu

SEQ ID NO: 848 - RNA, 21 nt, Homo sapiens
agggcccccccucaauccugu

SEQ ID NO: 849 - RNA, 22 nt, Homo sapiens
gcugacuccuaguccagggcuc

SEQ ID NO: 850 - RNA, 22 nt, Homo sapiens
uacucaggagaguggcaaucac

SEQ ID NO: 851 - RNA, 19 nt, Homo sapiens
agcugucugaaaaugucuu

SEQ ID NO: 852 - RNA, 19 nt, Homo sapiens
gugucugcuuccuguggga

SEQ ID NO: 853 - RNA, 23 nt, Homo sapiens
ucugcucauaccccaugguuucu

SEQ ID NO: 854 - RNA, 21 nt, Homo sapiens
gcaggaacuugugagucuccu

SEQ ID NO: 855 - RNA, 20 nt, Homo sapiens
guagaggagauggcgcaggg

SEQ ID NO: 856 - RNA, 21 nt, Homo sapiens
aaggcagggcccccgcucccc

SEQ ID NO: 857 - RNA, 23 nt, Homo sapiens
uacccuguagaaccgaauuugug

SEQ ID NO: 858 - RNA, 22 nt, Homo sapiens
cuccugagccauucugagccuc

SEQ ID NO: 859 - RNA, 21 nt, Homo sapiens
ccccaccuccucucuccucag

SEQ ID NO: 860 - RNA, 17 nt, Homo sapiens
ucccaccgcugccaccc

SEQ ID NO: 861 - RNA, 21 nt, Homo sapiens
ugagaugaagcacuguagcuc

SEQ ID NO: 862 - RNA, 23 nt, Homo sapiens
guccaguuuucccaggaaucccu

SEQ ID NO: 863 - RNA, 22 nt, Homo sapiens
uguaaacauccuacacucagcu

SEQ ID NO: 864 - RNA, 21 nt, Homo sapiens
aggggugcuaucugugauuga

SEQ ID NO: 865 - RNA, 20 nt, Homo sapiens
ggggagcuguggaagcagua

SEQ ID NO: 866 - RNA, 22 nt, Homo sapiens
ucggccugaccacccaccccac

SEQ ID NO: 867 - RNA, 22 nt, Homo sapiens
uuagggcccuggcuccaucucc

SEQ ID NO: 868 - RNA, 22 nt, Homo sapiens
uuagggcccuggcuccaucucc

SEQ ID NO: 869 - RNA, 23 nt, Homo sapiens
ucuggcuccgugucuucacuccc

SEQ ID NO: 870 - RNA, 18 nt, Homo sapiens
uccagugcccuccucucc

SEQ ID NO: 871 - RNA, 21 nt, Homo sapiens
cucccacaugcaggguuugca

SEQ ID NO: 872 - RNA, 22 nt, Homo sapiens
aacuggccuacaaagucccagu

SEQ ID NO: 873 - RNA, 22 nt, Homo sapiens
aacuggcccucaaagucccgcu

SEQ ID NO: 874 - RNA, 22 nt, Homo sapiens
uguaacagcaacuccaugugga

SEQ ID NO: 875 - RNA, 22 nt, Homo sapiens
cucccacugcuucacuugacua

SEQ ID NO: 876 - RNA, 21 nt, Homo sapiens
ccacaccguaucugacacuuu

SEQ ID NO: 877 - RNA, 23 nt, Homo sapiens
aucaacagacauuaauugggcgc

SEQ ID NO: 878 - RNA, 21 nt, Homo sapiens
agggcccccccucaauccugu

SEQ ID NO: 879 - RNA, 22 nt, Homo sapiens
uguaaacauccuacacucagcu

SEQ ID NO: 880 - RNA, 22 nt, Homo sapiens
cuggcccucucugcccuuccgu

SEQ ID NO: 881 - RNA, 23 nt, Homo sapiens
aagugccgccaucuuuugagugu

SEQ ID NO: 882 - RNA, 23 nt, Homo sapiens
ugaggggcagagagcgagacuuu

SEQ ID NO: 883 - RNA, 21 nt, Homo sapiens
uugaaaggcuauuucuugguc

SEQ ID NO: 884 - RNA, 22 nt, Homo sapiens
ccucccacacccaaggcuugca

SEQ ID NO: 885 - RNA, 22 nt, Homo sapiens
uauugcacucgucccggccucc

SEQ ID NO: 886 - RNA, 21 nt, Homo sapiens
uggcagggaggcugggagggg

SEQ ID NO: 887 - RNA, 20 nt, Homo sapiens
guguguggaaaugcuucugc

SEQ ID NO: 888 - RNA, 23 nt, Homo sapiens
ucuggcuccgugucuucacuccc

SEQ ID NO: 889 - RNA, 23 nt, Homo sapiens
uaaggugcaucuagugcagauag

SEQ ID NO: 890 - RNA, 22 nt, Homo sapiens
cgcaggggccgggugcucaccg

SEQ ID NO: 891 - RNA, 22 nt, Homo sapiens
aacacaccugguuaaccucuuu

SEQ ID NO: 892 - RNA, 21 nt, Homo sapiens
aggggugcuaucugugauuga

SEQ ID NO: 893 - RNA, 22 nt, Homo sapiens
aacacaccuauucaaggauuca

SEQ ID NO: 894 - RNA, 23 nt, Homo sapiens
cacucagccuugagggcacuuuc

SEQ ID NO: 895 - RNA, 22 nt, Homo sapiens
gugagucucuaagaaaagagga

SEQ ID NO: 896 - RNA, 21 nt, Homo sapiens
guggcugcacucacuuccuuc

SEQ ID NO: 897 - RNA, 23 nt, Homo sapiens
gagggucuugggagggaugugac

SEQ ID NO: 898 - RNA, 20 nt, Homo sapiens
ucacuguucagacaggcgga

SEQ ID NO: 899 - RNA, 22 nt, Homo sapiens
aggcauugacuucucacuagcu

SEQ ID NO: 900 - RNA, 22 nt, Homo sapiens
ucguaccgugaguaauaaugcg

SEQ ID NO: 901 - RNA, 19 nt, Homo sapiens
auggauaaggcuuuggcuu

SEQ ID NO: 902 - RNA, 22 nt, Homo sapiens
ucugcccccuccgcugcugcca

SEQ ID NO: 903 - RNA, 20 nt, Homo sapiens
acugccccaggugcugcugg

SEQ ID NO: 904 - RNA, 21 nt, Homo sapiens
cggggcagcucaguacaggau

SEQ ID NO: 905 - RNA, 22 nt, Homo sapiens
ucagcaaacauuuauugugugc

SEQ ID NO: 906 - RNA, 22 nt, Homo sapiens
aaaaguauuugcggguuuuguc

SEQ ID NO: 907 - RNA, 23 nt, Homo sapiens
uggaagacuagugauuuuguugu

SEQ ID NO: 908 - RNA, 22 nt, Homo sapiens
aaauuauuguacaucggaugag

SEQ ID NO: 909 - RNA, 21 nt, Homo sapiens
gguuugguccuagccuuucua

SEQ ID NO: 910 - RNA, 21 nt, Homo sapiens
aucacauugccagggauuucc

SEQ ID NO: 911 - RNA, 21 nt, Homo sapiens
aucacauugccagggauuacc

SEQ ID NO: 912 - RNA, 21 nt, Homo sapiens
agggcccccccucaauccugu

SEQ ID NO: 913 - RNA, 21 nt, Homo sapiens
agggcccccccucaauccugu

SEQ ID NO: 914 - RNA, 22 nt, Homo sapiens
ugguuuaccgucccacauacau

SEQ ID NO: 915 - RNA, 22 nt, Homo sapiens
uagcaccaucugaaaucgguua

SEQ ID NO: 916 - RNA, 23 nt, Homo sapiens
uagcaccauuugaaaucaguguu

SEQ ID NO: 917 - RNA, 22 nt, Homo sapiens
uagcaccauuugaaaucgguua

SEQ ID NO: 918 - RNA, 23 nt, Homo sapiens
ucccuguccuccaggagcucacg

SEQ ID NO: 919 - RNA, 22 nt, Homo sapiens
aaaccuguguuguucaagaguc

SEQ ID NO: 920 - RNA, 22 nt, Homo sapiens
ugagguaguagguuguaugguu

SEQ ID NO: 921 - RNA, 22 nt, Homo sapiens
ucugggcaacaaagugagaccu

SEQ ID NO: 922 - RNA, 22 nt, Homo sapiens
acucggcguggcgucggucgug

SEQ ID NO: 923 - RNA, 22 nt, Homo sapiens
cauugcacuugucucggucuga

SEQ ID NO: 924 - RNA, 22 nt, Homo sapiens
ugaaacauacacgggaaaccuc

SEQ ID NO: 925 - RNA, 25 nt, Homo sapiens
gcugggcagggcuucugagcuccuu

SEQ ID NO: 926 - RNA, 22 nt, Homo sapiens
ugcggggcuagggcuaacagca

SEQ ID NO: 927 - RNA, 21 nt, Homo sapiens
uacucaaaaagcugucaguca

SEQ ID NO: 928 - RNA, 20 nt, Homo sapiens
ggggagcuguggaagcagua

SEQ ID NO: 929 - RNA, 24 nt, Homo sapiens
uggggagcugaggcucugggggug

SEQ ID NO: 930 - RNA, 26 nt, Homo sapiens
gaugaugauggcagcaaauucugaaa

SEQ ID NO: 931 - RNA, 21 nt, Homo sapiens
uugcucacuguucuucccuag

SEQ ID NO: 932 - RNA, 20 nt, Homo sapiens
uaaggcacgcggugaaugcc

SEQ ID NO: 933 - RNA, 18 nt, Homo sapiens
aucccaccucugccacca

SEQ ID NO: 934 - RNA, 21 nt, Homo sapiens
aagugaucuaaaggccuacau

SEQ ID NO: 935 - RNA, 22 nt, Homo sapiens
cccugugcccggcccacuucug

SEQ ID NO: 936 - RNA, 21 nt, Homo sapiens
uaaggcacccuucugaguaga

SEQ ID NO: 937 - RNA, 23 nt, Homo sapiens
ggcagguucucacccucucuagg

SEQ ID NO: 938 - RNA, 21 nt, Homo sapiens
aaggcagggcccccgcucccc

SEQ ID NO: 939 - RNA, 22 nt, Homo sapiens
ucggccugaccacccaccccac

SEQ ID NO: 940 - RNA, 21 nt, Homo sapiens
uccuucugcuccgucccccag

SEQ ID NO: 941 - RNA, 20 nt, Homo sapiens
uaaggcacgcggugaaugcc

SEQ ID NO: 942 - RNA, 24 nt, Homo sapiens
ucccugagacccuuuaaccuguga

SEQ ID NO: 943 - RNA, 22 nt, Homo sapiens
ucccugagacccuaacuuguga

SEQ ID NO: 944 - RNA, 23 nt, Homo sapiens
ccucagggcuguagaacagggcu

SEQ ID NO: 945 - RNA, 22 nt, Homo sapiens
uucuggaauucugugugaggga

SEQ ID NO: 946 - RNA, 23 nt, Homo sapiens
ugaguaccgccaugucuguuggg

SEQ ID NO: 947 - RNA, 22 nt, Homo sapiens
cuggcccucucugcccuuccgu

SEQ ID NO: 948 - RNA, 20 nt, Homo sapiens
gugcauugcuguugcauugc

SEQ ID NO: 949 - RNA, 23 nt, Homo sapiens
aaugacacgaucacucccguuga

SEQ ID NO: 950 - RNA, 21 nt, Homo sapiens
uaaggcacccuucugaguaga

SEQ ID NO: 951 - RNA, 22 nt, Homo sapiens
uacucaggagaguggcaaucac

SEQ ID NO: 952 - RNA, 22 nt, Homo sapiens
gagugccuucuuuuggagcguu

SEQ ID NO: 953 - RNA, 18 nt, Homo sapiens
ugcuuccuuucagagggu

SEQ ID NO: 954 - RNA, 22 nt, Homo sapiens
aucuggagguaagaagcacuuu

SEQ ID NO: 955 - RNA, 22 nt, Homo sapiens
aagugccuccuuuuagaguguu

SEQ ID NO: 956 - RNA, 21 nt, Homo sapiens
ccuggaaacacugagguugug

SEQ ID NO: 957 - RNA, 21 nt, Homo sapiens
aaggcagggcccccgcucccc

SEQ ID NO: 958 - RNA, 21 nt, Homo sapiens
uggcagggaggcugggagggg

SEQ ID NO: 959 - RNA, 22 nt, Homo sapiens
acaggugagguucuugggagcc

SEQ ID NO: 960 - RNA, 21 nt, Homo sapiens
gcccuccgcccgugcaccccg

SEQ ID NO: 961 - RNA, 21 nt, Homo sapiens
cucccacaugcaggguuugca

SEQ ID NO: 962 - RNA, 23 nt, Homo sapiens
uaaggugcaucuagugcagauag

SEQ ID NO: 963 - RNA, 21 nt, Homo sapiens
cggcggggacggcgauugguc

SEQ ID NO: 964 - RNA, 22 nt, Homo sapiens
uggcucaguucagcaggaacag

SEQ ID NO: 965 - RNA, 22 nt, Homo sapiens
cauugcacuugucucggucuga

SEQ ID NO: 966 - RNA, 23 nt, Homo sapiens
cacucagccuugagggcacuuuc

SEQ ID NO: 967 - RNA, 25 nt, Homo sapiens
ggcggagggaaguagguccguuggu

SEQ ID NO: 968 - RNA, 22 nt, Homo sapiens
aggcggggcgccgcgggaccgc

SEQ ID NO: 969 - RNA, 22 nt, Homo sapiens
ugcggggcuagggcuaacagca

SEQ ID NO: 970 - RNA, 22 nt, Homo sapiens
cugcccuggcccgagggaccga

SEQ ID NO: 971 - RNA, 22 nt, Homo sapiens
aggcagcgggguguaguggaua

SEQ ID NO: 972 - RNA, 22 nt, Homo sapiens
ugagguaguagguuguauaguu

SEQ ID NO: 973 - RNA, 22 nt, Homo sapiens
ugagguaguagguugugugguu

SEQ ID NO: 974 - RNA, 22 nt, Homo sapiens
ugagguaguagguuguaugguu

SEQ ID NO: 975 - RNA, 22 nt, Homo sapiens
agagguaguagguugcauaguu

SEQ ID NO: 976 - RNA, 22 nt, Homo sapiens
ugagguaggagguuguauaguu

SEQ ID NO: 977 - RNA, 22 nt, Homo sapiens
ugagguaguagauuguauaguu

SEQ ID NO: 978 - RNA, 22 nt, Homo sapiens
ugagguaguaguuuguacaguu

SEQ ID NO: 979 - RNA, 22 nt, Homo sapiens
ugagguaguaguuugugcuguu

SEQ ID NO: 980 - RNA, 22 nt, Homo sapiens
ugugagguuggcauuguugucu

SEQ ID NO: 981 - RNA, 22 nt, Homo sapiens
cagugcaaugaugaaagggcau

SEQ ID NO: 982 - RNA, 23 nt, Homo sapiens
ugaguaccgccaugucuguuggg

SEQ ID NO: 983 - RNA, 23 nt, Homo sapiens
ucccccaggugugauucugauuu

SEQ ID NO: 984 - RNA, 22 nt, Homo sapiens
agaucagaaggugauuguggcu

SEQ ID NO: 985 - RNA, 22 nt, Homo sapiens
ugaaggucuacugugugccagg

SEQ ID NO: 986 - RNA, 22 nt, Homo sapiens
gaaagcgcuucccuuugcugga

SEQ ID NO: 987 - RNA, 22 nt, Homo sapiens
caaagcgcuccccuuuagaggu

SEQ ID NO: 988 - RNA, 23 nt, Homo sapiens
caaagcgcuucucuuuagagugu

SEQ ID NO: 989 - RNA, 21 nt, Homo sapiens
caaagcgcuucccuuuggagc

SEQ ID NO: 990 - RNA, 21 nt, Homo sapiens
gaaagcgcuucucuuuagagg

SEQ ID NO: 991 - RNA, 25 nt, Homo sapiens
aggggugguguugggacagcuccgu

SEQ ID NO: 992 - RNA, 21 nt, Homo sapiens
ugagcuaaaugugugcuggga

SEQ ID NO: 993 - RNA, 24 nt, Homo sapiens
acugggggcuuucgggcucugcgu

SEQ ID NO: 994 - RNA, 21 nt, Homo sapiens
uggaggagaaggaaggugaug

SEQ ID NO: 995 - RNA, 20 nt, Homo sapiens
guagaggagauggcgcaggg

SEQ ID NO: 996 - RNA, 20 nt, Homo sapiens
guagaggagauggcgcaggg

SEQ ID NO: 997 - RNA, 20 nt, Homo sapiens
ggggagcuguggaagcagua

SEQ ID NO: 998 - RNA, 22 nt, Homo sapiens
ugagguaguaaguuguauuguu

SEQ ID NO: 999 - RNA, 22 nt, Homo sapiens
uuuccggcucgcgugggugugu

SEQ ID NO: 1000 - RNA, 22 nt, Homo sapiens
ucggccugaccacccaccccac

SEQ ID NO: 1001 - RNA, 22 nt, Homo sapiens
acaggugagguucuugggagcc

SEQ ID NO: 1002 - RNA, 22 nt, Homo sapiens
acucggcguggcgucggucgug

SEQ ID NO: 1003 - RNA, 21 nt, Homo sapiens
ucgaggagcucacagucuagu

SEQ ID NO: 1004 - RNA, 22 nt, Homo sapiens
acagcaggcacagacaggcagu

SEQ ID NO: 1005 - RNA, 22 nt, Homo sapiens
aaggagcucacagucuauugag

SEQ ID NO: 1006 - RNA, 22 nt, Homo sapiens
uguaaacauccuacacucagcu

SEQ ID NO: 1007 - RNA, 23 nt, Homo sapiens
ugucugcccgcaugccugccucu

SEQ ID NO: 1008 - RNA, 22 nt, Homo sapiens
gccugcugggguggaaccuggu

SEQ ID NO: 1009 - RNA, 22 nt, Homo sapiens
ugauugguacgucuguggguag

SEQ ID NO: 1010 - RNA, 22 nt, Homo sapiens
ugauugguacgucuguggguag

SEQ ID NO: 1011 - RNA, 18 nt, Homo sapiens
uucacagggaggugucau

SEQ ID NO: 1012 - RNA, 22 nt, Homo sapiens
ccucccacacccaaggcuugca

SEQ ID NO: 1013 - RNA, 19 nt, Homo sapiens
aggcugcggaauucaggac

SEQ ID NO: 1014 - RNA, 23 nt, Homo sapiens
aaggagcuuacaaucuagcuggg

SEQ ID NO: 1015 - RNA, 23 nt, Homo sapiens
uggaguccaggaaucugcauuuu

SEQ ID NO: 1016 - RNA, 24 nt, Homo sapiens
uggcccugacugaagaccagcagu

SEQ ID NO: 1017 - RNA, 22 nt, Homo sapiens
ugcccuguggacucaguucugg

SEQ ID NO: 1018 - RNA, 22 nt, Homo sapiens
gcccgcguguggagccaggugu

SEQ ID NO: 1019 - RNA, 22 nt, Homo sapiens
uauggcacugguagaauucacu

SEQ ID NO: 1020 - RNA, 21 nt, Homo sapiens
caucccuugcaugguggaggg

SEQ ID NO: 1021 - RNA, 23 nt, Homo sapiens
caacggaaucccaaaagcagcug

SEQ ID NO: 1022 - RNA, 22 nt, Homo sapiens
gauuagggugcuuagcuguuaa

SEQ ID NO: 1023 - RNA, 22 nt, Homo sapiens
aacacaccugguuaaccucuuu

SEQ ID NO: 1024 - RNA, 23 nt, Homo sapiens
ucccuguccuccaggagcucacg

SEQ ID NO: 1025 - RNA, 22 nt, Homo sapiens
aacacaccuauucaaggauuca

SEQ ID NO: 1026 - RNA, 22 nt, Homo sapiens
caaccuggaggacuccaugcug

SEQ ID NO: 1027 - RNA, 23 nt, Homo sapiens
uacuccagagggcgucacucaug

SEQ ID NO: 1028 - RNA, 22 nt, Homo sapiens
uugugucaauaugcgaugaugu

SEQ ID NO: 1029 - RNA, 22 nt, Homo sapiens
ugugucacucgaugaccacugu

SEQ ID NO: 1030 - RNA, 23 nt, Homo sapiens
aucccuugcaggggcuguugggu

SEQ ID NO: 1031 - RNA, 22 nt, Homo sapiens
cugcccuggcccgagggaccga

SEQ ID NO: 1032 - RNA, 21 nt, Homo sapiens
uccuucugcuccgucccccag

SEQ ID NO: 1033 - RNA, 22 nt, Homo sapiens
uaacagucuacagccauggucg

SEQ ID NO: 1034 - RNA, 21 nt, Homo sapiens
uaacagucuccagucacggcc

SEQ ID NO: 1035 - RNA, 21 nt, Homo sapiens
uugugcuugaucuaaccaugu

SEQ ID NO: 1036 - RNA, 22 nt, Homo sapiens
uggcagugucuuagcugguugu

SEQ ID NO: 1037 - RNA, 22 nt, Homo sapiens
caaucacuaacuccacugccau

SEQ ID NO: 1038 - RNA, 23 nt, Homo sapiens
aggcaguguaguuagcugauugc

SEQ ID NO: 1039 - RNA, 21 nt, Homo sapiens
acuggacuuggagucagaagg

SEQ ID NO: 1040 - RNA, 22 nt, Homo sapiens
uggcaguguauuguuagcuggu

SEQ ID NO: 1041 - RNA, 22 nt, Homo sapiens
aggcaguguauuguuagcuggc

SEQ ID NO: 1042 - RNA, 22 nt, Homo sapiens
caaaaaucucaauuacuuuugc

SEQ ID NO: 1043 - RNA, 22 nt, Homo sapiens
cgaaaacagcaauuaccuuugc

SEQ ID NO: 1044 - RNA, 22 nt, Homo sapiens
uugagaaugaugaaucauuagg

SEQ ID NO: 1045 - RNA, 19 nt, Homo sapiens
aagugugcagggcacuggu

SEQ ID NO: 1046 - RNA, 21 nt, Homo sapiens
cugacuguugccguccuccag

SEQ ID NO: 1047 - RNA, 21 nt, Homo sapiens
gugccagcugcagugggggag

SEQ ID NO: 1048 - RNA, 21 nt, Homo sapiens
ccccaccuccucucuccucag

SEQ ID NO: 1049 - RNA, 18 nt, Homo sapiens
cagggaggugaaugugau

SEQ ID NO: 1050 - RNA, 23 nt, Homo sapiens
ucuggcuccgugucuucacuccc

SEQ ID NO: 1051 - RNA, 22 nt, Homo sapiens
aagcugccaguugaagaacugu

SEQ ID NO: 1052 - RNA, 20 nt, Homo sapiens
ccucugggcccuuccuccag

SEQ ID NO: 1053 - RNA, 22 nt, Homo sapiens
ucucugggccugugucuuaggc

SEQ ID NO: 1054 - RNA, 19 nt, Homo sapiens
ugagcugcuguaccaaaau

SEQ ID NO: 1055 - RNA, 21 nt, Homo sapiens
aaggcagggcccccgcucccc

SEQ ID NO: 1056 - RNA, 22 nt, Homo sapiens
ccucuuccccuugucucuccag

SEQ ID NO: 1057 - RNA, 22 nt, Homo sapiens
agaaggaaauugaauucauuua

SEQ ID NO: 1058 - RNA, 17 nt, Homo sapiens
ucgccuccuccucuccc

SEQ ID NO: 1059 - RNA, 20 nt, Homo sapiens
ccuccugcccuccuugcugu

SEQ ID NO: 1060 - RNA, 22 nt, Homo sapiens
cauugcacuugucucggucuga

SEQ ID NO: 1061 - RNA, 20 nt, Homo sapiens
ccucugggcccuuccuccag

SEQ ID NO: 1062 - RNA, 22 nt, Homo sapiens
ucucugggccugugucuuaggc

SEQ ID NO: 1063 - RNA, 23 nt, Homo sapiens
cacucagccuugagggcacuuuc

SEQ ID NO: 1064 - RNA, 21 nt, Homo sapiens
uggaggagaaggaaggugaug

SEQ ID NO: 1065 - RNA, 20 nt, Homo sapiens
guagaggagauggcgcaggg

SEQ ID NO: 1066 - RNA, 22 nt, Homo sapiens
aggcagcgggguguaguggaua

SEQ ID NO: 1067 - RNA, 22 nt, Homo sapiens
cucggcgcggggcgcgggcucc

SEQ ID NO: 1068 - RNA, 22 nt, Homo sapiens
acagcaggcacagacaggcagu

SEQ ID NO: 1069 - RNA, 22 nt, Homo sapiens
gccugcugggguggaaccuggu

SEQ ID NO: 1070 - RNA, 21 nt, Homo sapiens
uuggccacaauggguuagaac

SEQ ID NO: 1071 - RNA, 23 nt, Homo sapiens
ucugcucauaccccaugguuucu

SEQ ID NO: 1072 - RNA, 22 nt, Homo sapiens
aggcagcgggguguaguggaua

SEQ ID NO: 1073 - RNA, 25 nt, Homo sapiens
cuagugagggacagaaccaggauuc

SEQ ID NO: 1074 - RNA, 22 nt, Homo sapiens
ugugcgcagggagaccucuccc

SEQ ID NO: 1075 - RNA, 22 nt, Homo sapiens
acccgucccguucguccccgga

SEQ ID NO: 1076 - RNA, 21 nt, Homo sapiens
cggcggggacggcgauugguc

SEQ ID NO: 1077 - RNA, 21 nt, Homo sapiens
cggcggggacggcgauugguc

SEQ ID NO: 1078 - RNA, 22 nt, Homo sapiens
cauugcacuugucucggucuga

SEQ ID NO: 1079 - RNA, 21 nt, Homo sapiens
agggcccccccucaauccugu

SEQ ID NO: 1080 - RNA, 22 nt, Homo sapiens
ucaggcucaguccccucccgau

SEQ ID NO: 1081 - RNA, 21 nt, Homo sapiens
aagccugcccggcuccucggg

SEQ ID NO: 1082 - RNA, 22 nt, Homo sapiens
aggcggggcgccgcgggaccgc

SEQ ID NO: 1083 - RNA, 22 nt, Homo sapiens
aggcggggcgccgcgggaccgc

SEQ ID NO: 1084 - RNA, 22 nt, Homo sapiens
ugcggggcuagggcuaacagca

SEQ ID NO: 1085 - RNA, 22 nt, Homo sapiens
ugcggggcuagggcuaacagca

SEQ ID NO: 1086 - RNA, 21 nt, Homo sapiens
uggaggagaaggaaggugaug

SEQ ID NO: 1087 - RNA, 21 nt, Homo sapiens
cgcgggugcuuacugacccuu

SEQ ID NO: 1088 - RNA, 17 nt, Homo sapiens
ucgccuccuccucuccc

SEQ ID NO: 1089 - RNA, 18 nt, Homo sapiens
cagggaggugaaugugau

SEQ ID NO: 1090 - RNA, 22 nt, Homo sapiens
gcccgcguguggagccaggugu

SEQ ID NO: 1091 - RNA, 21 nt, Homo sapiens
cggcggggacggcgauugguc

SEQ ID NO: 1092 - RNA, 22 nt, Homo sapiens
gucccucuccaaaugugucuug

SEQ ID NO: 1093 - RNA, 24 nt, Homo sapiens
uggggagcugaggcucugggggug

SEQ ID NO: 1094 - RNA, 18 nt, Homo sapiens
gcaugggugguucagugg

SEQ ID NO: 1095 - RNA, 23 nt, Homo sapiens
ucuggcuccgugucuucacuccc

SEQ ID NO: 1096 - RNA, 22 nt, Homo sapiens
uagcagcacaucaugguuuaca

SEQ ID NO: 1097 - RNA, 22 nt, Homo sapiens
acagcaggcacagacaggcagu

SEQ ID NO: 1098 - RNA, 22 nt, Homo sapiens
uggcucaguucagcaggaacag

SEQ ID NO: 1099 - RNA, 22 nt, Homo sapiens
uggcaguguauuguuagcuggu

SEQ ID NO: 1100 - RNA, 21 nt, Homo sapiens
cacauuacacggucgaccucu

SEQ ID NO: 1101 - RNA, 21 nt, Homo sapiens
gugcauuguaguugcauugca

SEQ ID NO: 1102 - RNA, 22 nt, Homo sapiens
gccugcugggguggaaccuggu

SEQ ID NO: 1103 - RNA, 21 nt, Homo sapiens
uugaaaggcuauuucuugguc

SEQ ID NO: 1104 - RNA, 21 nt, Homo sapiens
aguuaaugaauccuggaaagu

SEQ ID NO: 1105 - RNA, 19 nt, Homo sapiens
gagccaguuggacaggagc

SEQ ID NO: 1106 - RNA, 19 nt, Homo sapiens
ugucucugcugggguuucu

SEQ ID NO: 1107 - RNA, 22 nt, Homo sapiens
cacuggcuccuuucuggguaga

SEQ ID NO: 1108 - RNA, 22 nt, Homo sapiens
ugugcgcagggagaccucuccc

SEQ ID NO: 1109 - RNA, 19 nt, Homo sapiens
gugaggacucgggaggugg

SEQ ID NO: 1110 - RNA, 24 nt, Homo sapiens
uggcccugacugaagaccagcagu

SEQ ID NO: 1111 - RNA, 21 nt, Homo sapiens
aagugaucuaaaggccuacau

SEQ ID NO: 1112 - RNA, 23 nt, Homo sapiens
cggcccgggcugcugcuguuccu

SEQ ID NO: 1113 - RNA, 20 nt, Homo sapiens
ccccagggcgacgcggcggg

SEQ ID NO: 1114 - RNA, 22 nt, Homo sapiens
uuggggaaacggccgcugagug

SEQ ID NO: 1115 - RNA, 22 nt, Homo sapiens
cauugcacuugucucggucuga

SEQ ID NO: 1116 - RNA, 22 nt, Homo sapiens
cuggcccucucugcccuuccgu

SEQ ID NO: 1117 - RNA, 21 nt, Homo sapiens
uugaaaggcuauuucuugguc

SEQ ID NO: 1118 - RNA, 25 nt, Homo sapiens
ggcggagggaaguagguccguuggu

SEQ ID NO: 1119 - RNA, 22 nt, Homo sapiens
uauugcacucgucccggccucc

SEQ ID NO: 1120 - RNA, 20 nt, Homo sapiens
ucacuguucagacaggcgga

SEQ ID NO: 1121 - RNA, 25 nt, Homo sapiens
ugggaacggguuccggcagacgcug

SEQ ID NO: 1122 - RNA, 22 nt, Homo sapiens
ugagaacugaauuccauggguu

SEQ ID NO: 1123 - RNA, 22 nt, Homo sapiens
ugagaacugaauuccauaggcu

SEQ ID NO: 1124 - RNA, 22 nt, Homo sapiens
uuggggaaacggccgcugagug

SEQ ID NO: 1125 - RNA, 22 nt, Homo sapiens
gaaguuguucgugguggauucg

SEQ ID NO: 1126 - RNA, 22 nt, Homo sapiens
aacuguuugcagaggaaacuga

SEQ ID NO: 1127 - RNA, 22 nt, Homo sapiens
aguggggaacccuuccaugagg

SEQ ID NO: 1128 - RNA, 21 nt, Homo sapiens
ugacaacuauggaugagcucu

SEQ ID NO: 1129 - RNA, 25 nt, Homo sapiens
aggggugguguugggacagcuccgu

SEQ ID NO: 1130 - RNA, 20 nt, Homo sapiens
ggggagcuguggaagcagua

SEQ ID NO: 1131 - RNA, 20 nt, Homo sapiens
uaaagagcccuguggagaca

SEQ ID NO: 1132 - RNA, 22 nt, Homo sapiens
ucucccaacccuuguaccagug

SEQ ID NO: 1133 - RNA, 22 nt, Homo sapiens
uagcagcacauaaugguuugug

SEQ ID NO: 1134 - RNA, 22 nt, Homo sapiens
uagcagcacaucaugguuuaca

SEQ ID NO: 1135 - RNA, 22 nt, Homo sapiens
uagcagcacguaaauauuggcg

SEQ ID NO: 1136 - RNA, 21 nt, Homo sapiens
uagcagcacagaaauauuggc

SEQ ID NO: 1137 - RNA, 24 nt, Homo sapiens
agcagaagcagggagguucuccca

SEQ ID NO: 1138 - RNA, 23 nt, Homo sapiens
gcaaagcacacggccugcagaga

SEQ ID NO: 1139 - RNA, 22 nt, Homo sapiens
cagcagcaauucauguuuugaa

SEQ ID NO: 1140 - RNA, 22 nt, Homo sapiens
aacuguuugcagaggaaacuga

SEQ ID NO: 1141 - RNA, 22 nt, Homo sapiens
gugacaucacauauacggcagc

SEQ ID NO: 1142 - RNA, 21 nt, Homo sapiens
cagcagcacacugugguuugu

SEQ ID NO: 1143 - RNA, 23 nt, Homo sapiens
caaagcgcuucucuuuagagugu

SEQ ID NO: 1144 - RNA, 21 nt, Homo sapiens
cuccagagggaaguacuuucu

SEQ ID NO: 1145 - RNA, 21 nt, Homo sapiens
cuccagagggaugcacuuucu

SEQ ID NO: 1146 - RNA, 21 nt, Homo sapiens
agggggaaaguucuauagucc

SEQ ID NO: 1147 - RNA, 23 nt, Homo sapiens
ugucacucggcucggcccacuac

SEQ ID NO: 1148 - RNA, 21 nt, Homo sapiens
uggcagggaggcugggagggg

SEQ ID NO: 1149 - RNA, 20 nt, Homo sapiens
cgugccacccuuuuccccag

SEQ ID NO: 1150 - RNA, 24 nt, Homo sapiens
uggcccugacugaagaccagcagu

SEQ ID NO: 1151 - RNA, 23 nt, Homo sapiens
cggcccgggcugcugcuguuccu

SEQ ID NO: 1152 - RNA, 22 nt, Homo sapiens
aucuggagguaagaagcacuuu

SEQ ID NO: 1153 - RNA, 25 nt, Homo sapiens
aggggugguguugggacagcuccgu

SEQ ID NO: 1154 - RNA, 20 nt, Homo sapiens
ggggagcuguggaagcagua

SEQ ID NO: 1155 - RNA, 24 nt, Homo sapiens
uggcccugacugaagaccagcagu

SEQ ID NO: 1156 - RNA, 18 nt, Homo sapiens
cagggaggugaaugugau

SEQ ID NO: 1157 - RNA, 22 nt, Homo sapiens
ugcccuguggacucaguucugg

SEQ ID NO: 1158 - RNA, 23 nt, Homo sapiens
ucuggcuccgugucuucacuccc

SEQ ID NO: 1159 - RNA, 22 nt, Homo sapiens
uggagagaaaggcaguuccuga

SEQ ID NO: 1160 - RNA, 21 nt, Homo sapiens
cggcggggacggcgauugguc

SEQ ID NO: 1161 - RNA, 22 nt, Homo sapiens
cgcaggggccgggugcucaccg

SEQ ID NO: 1162 - RNA, 25 nt, Homo sapiens
cccccacaaccgcgcuugacuagcu

SEQ ID NO: 1163 - RNA, 22 nt, Homo sapiens
cuggcccucucugcccuuccgu

SEQ ID NO: 1164 - RNA, 23 nt, Homo sapiens
ucccuguccuccaggagcucacg

SEQ ID NO: 1165 - RNA, 21 nt, Homo sapiens
cggggcagcucaguacaggau

SEQ ID NO: 1166 - RNA, 22 nt, Homo sapiens
aguggggaacccuuccaugagg

SEQ ID NO: 1167 - RNA, 22 nt, Homo sapiens
aggcggggcgccgcgggaccgc

SEQ ID NO: 1168 - RNA, 20 nt, Homo sapiens
ggggagcuguggaagcagua

SEQ ID NO: 1169 - RNA, 24 nt, Homo sapiens
uggggagcugaggcucugggggug

SEQ ID NO: 1170 - RNA, 22 nt, Homo sapiens
ucuucucuguuuuggccaugug

SEQ ID NO: 1171 - RNA, 21 nt, Homo sapiens
aguuaggauuaggucguggaa

SEQ ID NO: 1172 - RNA, 21 nt, Homo sapiens
aagugaucuaaaggccuacau

SEQ ID NO: 1173 - RNA, 22 nt, Homo sapiens
uccuucauuccaccggagucug

SEQ ID NO: 1174 - RNA, 23 nt, Homo sapiens
uuucaagccagggggcguuuuuc

SEQ ID NO: 1175 - RNA, 23 nt, Homo sapiens
cacucagccuugagggcacuuuc

SEQ ID NO: 1176 - RNA, 21 nt, Homo sapiens
ugacaacuauggaugagcucu

SEQ ID NO: 1177 - RNA, 22 nt, Homo sapiens
caaaguuuaagauccuugaagu

SEQ ID NO: 1178 - RNA, 21 nt, Homo sapiens
guggcugcacucacuuccuuc

SEQ ID NO: 1179 - RNA, 22 nt, Homo sapiens
uuuaggauaagcuugacuuuug

SEQ ID NO: 1180 - RNA, 22 nt, Homo sapiens
ugugcgcagggagaccucuccc

SEQ ID NO: 1181 - RNA, 21 nt, Homo sapiens
ccccaccuccucucuccucag

SEQ ID NO: 1182 - RNA, 17 nt, Homo sapiens
gugggggagaggcuguc

SEQ ID NO: 1183 - RNA, 22 nt, Homo sapiens
uacccagagcaugcagugugaa

SEQ ID NO: 1184 - RNA, 22 nt, Homo sapiens
uagcuuaucagacugauguuga

SEQ ID NO: 1185 - RNA, 20 nt, Homo sapiens
ccucugggcccuuccuccag

SEQ ID NO: 1186 - RNA, 22 nt, Homo sapiens
ucucugggccugugucuuaggc

SEQ ID NO: 1187 - RNA, 22 nt, Homo sapiens
uuauaaagcaaugagacugauu

SEQ ID NO: 1188 - RNA, 22 nt, Homo sapiens
agaggcuggccgugaugaauuc

SEQ ID NO: 1189 - RNA, 22 nt, Homo sapiens
gagcuuauucauaaaagugcag

SEQ ID NO: 1190 - RNA, 20 nt, Homo sapiens
ugagcccuguccucccgcag

SEQ ID NO: 1191 - RNA, 22 nt, Homo sapiens
agaaggaaauugaauucauuua

SEQ ID NO: 1192 - RNA, 18 nt, Homo sapiens
aucccaccucugccacca

SEQ ID NO: 1193 - RNA, 22 nt, Homo sapiens
uucuggaauucugugugaggga

SEQ ID NO: 1194 - RNA, 22 nt, Homo sapiens
aagcccuuaccccaaaaagcau

SEQ ID NO: 1195 - RNA, 18 nt, Homo sapiens
cagggaggugaaugugau

SEQ ID NO: 1196 - RNA, 23 nt, Homo sapiens
ucuggcuccgugucuucacuccc

SEQ ID NO: 1197 - RNA, 23 nt, Homo sapiens
ugaguaccgccaugucuguuggg

SEQ ID NO: 1198 - RNA, 20 nt, Homo sapiens
gugcauugcuguugcauugc

SEQ ID NO: 1199 - RNA, 23 nt, Homo sapiens
aaugacacgaucacucccguuga

SEQ ID NO: 1200 - RNA, 22 nt, Homo sapiens
gagugccuucuuuuggagcguu

SEQ ID NO: 1201 - RNA, 22 nt, Homo sapiens
aagugccuccuuuuagaguguu

SEQ ID NO: 1202 - RNA, 23 nt, Homo sapiens
agugccugagggaguaagagccc

SEQ ID NO: 1203 - RNA, 21 nt, Homo sapiens
cccggagccaggaugcagcuc

SEQ ID NO: 1204 - RNA, 22 nt, Homo sapiens
uggagugugacaaugguguuug

SEQ ID NO: 1205 - RNA, 20 nt, Homo sapiens
ugagcccuguccucccgcag

SEQ ID NO: 1206 - RNA, 17 nt, Homo sapiens
ucgccuccuccucuccc

SEQ ID NO: 1207 - RNA, 21 nt, Homo sapiens
ucgaggagcucacagucuagu

SEQ ID NO: 1208 - RNA, 22 nt, Homo sapiens
ucugcccccuccgcugcugcca

SEQ ID NO: 1209 - RNA, 22 nt, Homo sapiens
cauugcacuugucucggucuga

SEQ ID NO: 1210 - RNA, 20 nt, Homo sapiens
acugccccaggugcugcugg

SEQ ID NO: 1211 - RNA, 23 nt, Homo sapiens
ugagcgccucgacgacagagccg

SEQ ID NO: 1212 - RNA, 22 nt, Homo sapiens
uggcagugucuuagcugguugu

SEQ ID NO: 1213 - RNA, 23 nt, Homo sapiens
aggcaguguaguuagcugauugc

SEQ ID NO: 1214 - RNA, 22 nt, Homo sapiens
uggcaguguauuguuagcuggu

SEQ ID NO: 1215 - RNA, 22 nt, Homo sapiens
aggcaguguauuguuagcuggc

SEQ ID NO: 1216 - RNA, 25 nt, Homo sapiens
ggcggagggaaguagguccguuggu

SEQ ID NO: 1217 - RNA, 17 nt, Homo sapiens
ucgccuccuccucuccc

SEQ ID NO: 1218 - RNA, 22 nt, Homo sapiens
cagugcaaugaugaaagggcau

SEQ ID NO: 1219 - RNA, 21 nt, Homo sapiens
cggcggggacggcgauugguc

SEQ ID NO: 1220 - RNA, 22 nt, Homo sapiens
cauugcacuugucucggucuga

SEQ ID NO: 1221 - RNA, 21 nt, Homo sapiens
caaagaggaaggucccauuac

SEQ ID NO: 1222 - RNA, 25 nt, Homo sapiens
ggcggagggaaguagguccguuggu

SEQ ID NO: 1223 - RNA, 22 nt, Homo sapiens
aggcggggcgccgcgggaccgc

SEQ ID NO: 1224 - RNA, 21 nt, Homo sapiens
gcccuccgcccgugcaccccg

SEQ ID NO: 1225 - RNA, 22 nt, Homo sapiens
cauugcacuugucucggucuga

SEQ ID NO: 1226 - RNA, 22 nt, Homo sapiens
cuggcccucucugcccuuccgu

SEQ ID NO: 1227 - RNA, 25 nt, Homo sapiens
ggcggagggaaguagguccguuggu

SEQ ID NO: 1228 - RNA, 23 nt, Homo sapiens
uaagugcuuccauguuuugguga

SEQ ID NO: 1229 - RNA, 23 nt, Homo sapiens
uaagugcuuccauguuuuaguag

SEQ ID NO: 1230 - RNA, 23 nt, Homo sapiens
uaagugcuuccauguuucagugg

SEQ ID NO: 1231 - RNA, 23 nt, Homo sapiens
uaagugcuuccauguuugagugu

SEQ ID NO: 1232 - RNA, 17 nt, Homo sapiens
uaagugcuuccaugcuu

SEQ ID NO: 1233 - RNA, 20 nt, Homo sapiens
gugcauugcuguugcauugc

SEQ ID NO: 1234 - RNA, 23 nt, Homo sapiens
aaagugcugcgacauuugagcgu

SEQ ID NO: 1235 - RNA, 23 nt, Homo sapiens
gaagugcuucgauuuuggggugu

SEQ ID NO: 1236 - RNA, 22 nt, Homo sapiens
gagugccuucuuuuggagcguu

SEQ ID NO: 1237 - RNA, 22 nt, Homo sapiens
aagugccuccuuuuagaguguu

SEQ ID NO: 1238 - RNA, 22 nt, Homo sapiens
aaagugcuucccuuuggacugu

SEQ ID NO: 1239 - RNA, 21 nt, Homo sapiens
aaagugcuuccuuuuagaggg

SEQ ID NO: 1240 - RNA, 22 nt, Homo sapiens
aaagugcuuccuuuuagagggu

SEQ ID NO: 1241 - RNA, 22 nt, Homo sapiens
aaagugcuucucuuuggugggu

SEQ ID NO: 1242 - RNA, 21 nt, Homo sapiens
aaagugcuuccuuuuugaggg

SEQ ID NO: 1243 - RNA, 21 nt, Homo sapiens
caaagaggaaggucccauuac

SEQ ID NO: 1244 - RNA, 22 nt, Homo sapiens
uggagugugacaaugguguuug

SEQ ID NO: 1245 - RNA, 21 nt, Homo sapiens
gcccuccgcccgugcaccccg

SEQ ID NO: 1246 - RNA, 21 nt, Homo sapiens
cggcggggacggcgauugguc

SEQ ID NO: 1247 - RNA, 21 nt, Homo sapiens
ccaguccugugccugccgccu

SEQ ID NO: 1248 - RNA, 23 nt, Homo sapiens
agcuacauugucugcuggguuuc

SEQ ID NO: 1249 - RNA, 22 nt, Homo sapiens
cauugcacuugucucggucuga

SEQ ID NO: 1250 - RNA, 22 nt, Homo sapiens
aaggagcucacagucuauugag

SEQ ID NO: 1251 - RNA, 21 nt, Homo sapiens
aggcaagaugcuggcauagcu

SEQ ID NO: 1252 - RNA, 23 nt, Homo sapiens
ugaggggcagagagcgagacuuu

SEQ ID NO: 1253 - RNA, 23 nt, Homo sapiens
aggaccugcgggacaagauucuu

SEQ ID NO: 1254 - RNA, 25 nt, Homo sapiens
ggcggagggaaguagguccguuggu

SEQ ID NO: 1255 - RNA, 22 nt, Homo sapiens
aggcggggcgccgcgggaccgc

SEQ ID NO: 1256 - RNA, 20 nt, Homo sapiens
accaggaggcugaggccccu

SEQ ID NO: 1257 - RNA, 23 nt, Homo sapiens
aaggagcuuacaaucuagcuggg

SEQ ID NO: 1258 - RNA, 22 nt, Homo sapiens
ugcggggcuagggcuaacagca

SEQ ID NO: 1259 - RNA, 22 nt, Homo sapiens
uggagugugacaaugguguuug

SEQ ID NO: 1260 - RNA, 22 nt, Homo sapiens
ccucuuccccuugucucuccag

SEQ ID NO: 1261 - RNA, 21 nt, Homo sapiens
agugaaugauggguucugacc

SEQ ID NO: 1262 - RNA, 23 nt, Homo sapiens
acuccauuuguuuugaugaugga

SEQ ID NO: 1263 - RNA, 23 nt, Homo sapiens
ucuggcuccgugucuucacuccc

SEQ ID NO: 1264 - RNA, 22 nt, Homo sapiens
caaagaauucuccuuuugggcu

SEQ ID NO: 1265 - RNA, 23 nt, Homo sapiens
uaaggugcaucuagugcagauag

SEQ ID NO: 1266 - RNA, 23 nt, Homo sapiens
ugaggggcagagagcgagacuuu

SEQ ID NO: 1267 - RNA, 22 nt, Homo sapiens
cgucaacacuugcugguuuccu

SEQ ID NO: 1268 - RNA, 23 nt, Homo sapiens
cacucagccuugagggcacuuuc

SEQ ID NO: 1269 - RNA, 22 nt, Homo sapiens
uccgagccugggucucccucuu

SEQ ID NO: 1270 - RNA, 23 nt, Homo sapiens
acuugggcacugaaacaaugucc

SEQ ID NO: 1271 - RNA, 20 nt, Homo sapiens
accaggaggcugaggccccu

SEQ ID NO: 1272 - RNA, 21 nt, Homo sapiens
uggaggagaaggaaggugaug

SEQ ID NO: 1273 - RNA, 20 nt, Homo sapiens
guagaggagauggcgcaggg

SEQ ID NO: 1274 - RNA, 22 nt, Homo sapiens
ugugcgcagggagaccucuccc

SEQ ID NO: 1275 - RNA, 22 nt, Homo sapiens
cugaagcucagagggcucugau

SEQ ID NO: 1276 - RNA, 17 nt, Homo sapiens
ucgccuccuccucuccc

SEQ ID NO: 1277 - RNA, 23 nt, Homo sapiens
ucuggcuccgugucuucacuccc

SEQ ID NO: 1278 - RNA, 22 nt, Homo sapiens
ucucccaacccuuguaccagug

SEQ ID NO: 1279 - RNA, 24 nt, Homo sapiens
uuuggcaaugguagaacucacacu

SEQ ID NO: 1280 - RNA, 21 nt, Homo sapiens
ugacaacuauggaugagcucu

SEQ ID NO: 1281 - RNA, 22 nt, Homo sapiens
ugguuuaccgucccacauacau

SEQ ID NO: 1282 - RNA, 22 nt, Homo sapiens
uggcaguguauuguuagcuggu

SEQ ID NO: 1283 - RNA, 22 nt, Homo sapiens
uguaaacauccuacacucagcu

SEQ ID NO: 1284 - RNA, 22 nt, Homo sapiens
uguaaacauccuacacucagcu

SEQ ID NO: 1285 - RNA, 22 nt, Homo sapiens
cugcccuggcccgagggaccga

SEQ ID NO: 1286 - RNA, 17 nt, Homo sapiens
ucccaccgcugccaccc

SEQ ID NO: 1287 - RNA, 17 nt, Homo sapiens
ucgccuccuccucuccc

SEQ ID NO: 1288 - RNA, 22 nt, Homo sapiens
uuugaggcuacagugagaugug

SEQ ID NO: 1289 - RNA, 23 nt, Homo sapiens
ucuggcuccgugucuucacuccc

SEQ ID NO: 1290 - RNA, 23 nt, Homo sapiens
cggcccgggcugcugcuguuccu

SEQ ID NO: 1291 - RNA, 21 nt, Homo sapiens
cggcggggacggcgauugguc

SEQ ID NO: 1292 - RNA, 21 nt, Homo sapiens
agggcccccccucaauccugu

SEQ ID NO: 1293 - RNA, 22 nt, Homo sapiens
ucaggcucaguccccucccgau

SEQ ID NO: 1294 - RNA, 22 nt, Homo sapiens
uggugggcacagaaucuggacu

SEQ ID NO: 1295 - RNA, 21 nt, Homo sapiens
guggcugcacucacuuccuuc

SEQ ID NO: 1296 - RNA, 22 nt, Homo sapiens
uggugggccgcagaacaugugc

SEQ ID NO: 1297 - RNA, 24 nt, Homo sapiens
ugccugggucucuggccugcgcgu

SEQ ID NO: 1298 - RNA, 22 nt, Homo sapiens
aggcggggcgccgcgggaccgc

SEQ ID NO: 1299 - RNA, 20 nt, Homo sapiens
accaggaggcugaggccccu

SEQ ID NO: 1300 - RNA, 22 nt, Homo sapiens
ugcggggcuagggcuaacagca

SEQ ID NO: 1301 - RNA, 22 nt, Homo sapiens
ucaccagcccuguguucccuag

SEQ ID NO: 1302 - RNA, 20 nt, Homo sapiens
ugagcccuguccucccgcag

SEQ ID NO: 1303 - RNA, 27 nt, Homo sapiens
accuucuuguauaagcacugugcuaaa

SEQ ID NO: 1304 - RNA, 22 nt, Homo sapiens
uucuggaauucugugugaggga

SEQ ID NO: 1305 - RNA, 18 nt, Homo sapiens
cagggaggugaaugugau

SEQ ID NO: 1306 - RNA, 23 nt, Homo sapiens
uauggcuuuuuauuccuauguga

SEQ ID NO: 1307 - RNA, 23 nt, Homo sapiens
acuccauuuguuuugaugaugga

SEQ ID NO: 1308 - RNA, 23 nt, Homo sapiens
agcugguguugugaaucaggccg

SEQ ID NO: 1309 - RNA, 23 nt, Homo sapiens
ucuggcuccgugucuucacuccc

SEQ ID NO: 1310 - RNA, 21 nt, Homo sapiens
caucccuugcaugguggaggg

SEQ ID NO: 1311 - RNA, 22 nt, Homo sapiens
cgucaacacuugcugguuuccu

SEQ ID NO: 1312 - RNA, 23 nt, Homo sapiens
caaagcgcuucucuuuagagugu

SEQ ID NO: 1313 - RNA, 21 nt, Homo sapiens
cuccagagggaaguacuuucu

SEQ ID NO: 1314 - RNA, 21 nt, Homo sapiens
cuccagagggaugcacuuucu

SEQ ID NO: 1315 - RNA, 22 nt, Homo sapiens
ggagaaauuauccuuggugugu

SEQ ID NO: 1316 - RNA, 22 nt, Homo sapiens
gaugagcucauuguaauaugag

SEQ ID NO: 1317 - RNA, 23 nt, Homo sapiens
uaaaucccauggugccuucuccu

SEQ ID NO: 1318 - RNA, 22 nt, Homo sapiens
uccgagccugggucucccucuu

SEQ ID NO: 1319 - RNA, 22 nt, Homo sapiens
aaccagcaccccaacuuuggac

SEQ ID NO: 1320 - RNA, 21 nt, Homo sapiens
aggaggcagcgcucucaggac

SEQ ID NO: 1321 - RNA, 23 nt, Homo sapiens
ucugcucauaccccaugguuucu

SEQ ID NO: 1322 - RNA, 21 nt, Homo sapiens
ccuggaaacacugagguugug

SEQ ID NO: 1323 - RNA, 22 nt, Homo sapiens
uggauuucuuugugaaucacca

SEQ ID NO: 1324 - RNA, 23 nt, Homo sapiens
gcagcagagaauaggacuacguc

SEQ ID NO: 1325 - RNA, 23 nt, Homo sapiens
agcagcauuguacagggcuauga

SEQ ID NO: 1326 - RNA, 23 nt, Homo sapiens
agcagcauuguacagggcuauca

SEQ ID NO: 1327 - RNA, 22 nt, Homo sapiens
agaaggaaauugaauucauuua

SEQ ID NO: 1328 - RNA, 17 nt, Homo sapiens
ucgccuccuccucuccc

SEQ ID NO: 1329 - RNA, 18 nt, Homo sapiens
cagggaggugaaugugau

SEQ ID NO: 1330 - RNA, 22 nt, Homo sapiens
uaacacugucugguaaagaugg

SEQ ID NO: 1331 - RNA, 18 nt, Homo sapiens
ugaggcaguagauugaau

SEQ ID NO: 1332 - RNA, 21 nt, Homo sapiens
cggcggggacggcgauugguc

SEQ ID NO: 1333 - RNA, 22 nt, Homo sapiens
uaacacugucugguaacgaugu

SEQ ID NO: 1334 - RNA, 22 nt, Homo sapiens
uggcagugucuuagcugguugu

SEQ ID NO: 1335 - RNA, 22 nt, Homo sapiens
caaucacuaacuccacugccau

SEQ ID NO: 1336 - RNA, 23 nt, Homo sapiens
aggcaguguaguuagcugauugc

SEQ ID NO: 1337 - RNA, 22 nt, Homo sapiens
uggcaguguauuguuagcuggu

SEQ ID NO: 1338 - RNA, 22 nt, Homo sapiens
aggcaguguauuguuagcuggc

SEQ ID NO: 1339 - RNA, 23 nt, Homo sapiens
ucggggaucaucaugucacgaga

SEQ ID NO: 1340 - RNA, 21 nt, Homo sapiens
aggguaagcugaaccucugau

SEQ ID NO: 1341 - RNA, 21 nt, Homo sapiens
aggaggcagcgcucucaggac

SEQ ID NO: 1342 - RNA, 22 nt, Homo sapiens
aggcggggcgccgcgggaccgc

SEQ ID NO: 1343 - RNA, 23 nt, Homo sapiens
uggugcggagagggcccacagug

SEQ ID NO: 1344 - RNA, 21 nt, Homo sapiens
uggaggagaaggaaggugaug

SEQ ID NO: 1345 - RNA, 22 nt, Homo sapiens
ucuucucuguuuuggccaugug

SEQ ID NO: 1346 - RNA, 21 nt, Homo sapiens
cggcggggacggcgauugguc

SEQ ID NO: 1347 - RNA, 22 nt, Homo sapiens
cauugcacuugucucggucuga

SEQ ID NO: 1348 - RNA, 24 nt, Homo sapiens
agcagaagcagggagguucuccca

SEQ ID NO: 1349 - RNA, 23 nt, Homo sapiens
ugaggggcagagagcgagacuuu

SEQ ID NO: 1350 - RNA, 23 nt, Homo sapiens
ucggggaucaucaugucacgaga

SEQ ID NO: 1351 - RNA, 22 nt, Homo sapiens
aggcggggcgccgcgggaccgc

SEQ ID NO: 1352 - RNA, 22 nt, Homo sapiens
ugcggggcuagggcuaacagca

SEQ ID NO: 1353 - RNA, 22 nt, Homo sapiens
uuuccggcucgcgugggugugu

SEQ ID NO: 1354 - RNA, 24 nt, Homo sapiens
uugcagcugccugggagugacuuc

SEQ ID NO: 1355 - RNA, 21 nt, Homo sapiens
uccugcgcgucccagaugccc

SEQ ID NO: 1356 - RNA, 23 nt, Homo sapiens
ugaguaccgccaugucuguuggg

SEQ ID NO: 1357 - RNA, 23 nt, Homo sapiens
cgcauccccuagggcauuggugu

SEQ ID NO: 1358 - RNA, 23 nt, Homo sapiens
uagcagcgggaacaguucugcag

SEQ ID NO: 1359 - RNA, 19 nt, Homo sapiens
ugagcugcuguaccaaaau

SEQ ID NO: 1360 - RNA, 19 nt, Homo sapiens
aggcacggugucagcaggc

SEQ ID NO: 1361 - RNA, 22 nt, Homo sapiens
acuccagccccacagccucagc

SEQ ID NO: 1362 - RNA, 22 nt, Homo sapiens
aggcagcgggguguaguggaua

SEQ ID NO: 1363 - RNA, 22 nt, Homo sapiens
uggagagaaaggcaguuccuga

SEQ ID NO: 1364 - RNA, 21 nt, Homo sapiens
cggcggggacggcgauugguc

SEQ ID NO: 1365 - RNA, 23 nt, Homo sapiens
ugugcaaaucuaugcaaaacuga

SEQ ID NO: 1366 - RNA, 22 nt, Homo sapiens
aacaauauccuggugcugagug

SEQ ID NO: 1367 - RNA, 22 nt, Homo sapiens
agagguaguagguugcauaguu

SEQ ID NO: 1368 - RNA, 22 nt, Homo sapiens
agaggcuggccgugaugaauuc

SEQ ID NO: 1369 - RNA, 21 nt, Homo sapiens
uugaaaggcuauuucuugguc

SEQ ID NO: 1370 - RNA, 23 nt, Homo sapiens
uacuccagagggcgucacucaug

SEQ ID NO: 1371 - RNA, 19 nt, Homo sapiens
aggcugcggaauucaggac

SEQ ID NO: 1372 - RNA, 22 nt, Homo sapiens
uccgagccugggucucccucuu

SEQ ID NO: 1373 - RNA, 22 nt, Homo sapiens
aggcggggcgccgcgggaccgc

SEQ ID NO: 1374 - RNA, 22 nt, Homo sapiens
ugcggggcuagggcuaacagca

SEQ ID NO: 1375 - RNA, 21 nt, Homo sapiens
cgcgggugcuuacugacccuu

SEQ ID NO: 1376 - RNA, 20 nt, Homo sapiens
ggggagcuguggaagcagua

SEQ ID NO: 1377 - RNA, 20 nt, Homo sapiens
uaaagagcccuguggagaca

SEQ ID NO: 1378 - RNA, 19 nt, Homo sapiens
uggauuuuuggaucaggga

SEQ ID NO: 1379 - RNA, 22 nt, Homo sapiens
caaaaaucucaauuacuuuugc

SEQ ID NO: 1380 - RNA, 22 nt, Homo sapiens
uagcaaaaacugcaguuacuuu

SEQ ID NO: 1381 - RNA, 21 nt, Homo sapiens
uaauuuuauguauaagcuagu

SEQ ID NO: 1382 - RNA, 23 nt, Homo sapiens
uauucauuuauccccagccuaca

SEQ ID NO: 1383 - RNA, 21 nt, Homo sapiens
uccuucugcuccgucccccag

SEQ ID NO: 1384 - RNA, 22 nt, Homo sapiens
aacuggaucaauuauaggagug

SEQ ID NO: 1385 - RNA, 23 nt, Homo sapiens
uuaaugcuaaucgugauaggggu

SEQ ID NO: 1386 - RNA, 22 nt, Homo sapiens
uggagagaaaggcaguuccuga

SEQ ID NO: 1387 - RNA, 23 nt, Homo sapiens
cccaguguucagacuaccuguuc

SEQ ID NO: 1388 - RNA, 23 nt, Homo sapiens
cccaguguuuagacuaucuguuc

SEQ ID NO: 1389 - RNA, 22 nt, Homo sapiens
uuggggaaacggccgcugagug

SEQ ID NO: 1390 - RNA, 24 nt, Homo sapiens
agcagaagcagggagguucuccca

SEQ ID NO: 1391 - RNA, 22 nt, Homo sapiens
uucacaaggaggugucauuuau

SEQ ID NO: 1392 - RNA, 22 nt, Homo sapiens
caaaaaccacaguuucuuuugc

SEQ ID NO: 1393 - RNA, 20 nt, Homo sapiens
aaaguagcuguaccauuugc

SEQ ID NO: 1394 - RNA, 20 nt, Homo sapiens
aggguguuucucucaucucu

SEQ ID NO: 1395 - RNA, 21 nt, Homo sapiens
augauccaggaaccugccucu

SEQ ID NO: 1396 - RNA, 23 nt, Homo sapiens
gcagcagagaauaggacuacguc

SEQ ID NO: 1397 - RNA, 21 nt, Homo sapiens
cuuuuugcggucugggcuugc

SEQ ID NO: 1398 - RNA, 23 nt, Homo sapiens
ugaguaccgccaugucuguuggg

SEQ ID NO: 1399 - RNA, 22 nt, Homo sapiens
uguaacagcaacuccaugugga

SEQ ID NO: 1400 - RNA, 22 nt, Homo sapiens
ucaggccaggcacaguggcuca

SEQ ID NO: 1401 - RNA, 20 nt, Homo sapiens
aaaguagcuguaccauuugc

SEQ ID NO: 1402 - RNA, 19 nt, Homo sapiens
ugucucugcugggguuucu

SEQ ID NO: 1403 - RNA, 20 nt, Homo sapiens
accaggaggcugaggccccu

SEQ ID NO: 1404 - RNA, 24 nt, Homo sapiens
agccugauuaaacacaugcucuga

SEQ ID NO: 1405 - RNA, 20 nt, Homo sapiens
ucacaccugccucgcccccc

SEQ ID NO: 1406 - RNA, 22 nt, Homo sapiens
ugugagguuggcauuguugucu

SEQ ID NO: 1407 - RNA, 23 nt, Homo sapiens
uauggcuuuuuauuccuauguga

SEQ ID NO: 1408 - RNA, 22 nt, Homo sapiens
aagcugccaguugaagaacugu

SEQ ID NO: 1409 - RNA, 24 nt, Homo sapiens
agcagaagcagggagguucuccca

SEQ ID NO: 1410 - RNA, 23 nt, Homo sapiens
ucucacacagaaaucgcacccgu

SEQ ID NO: 1411 - RNA, 22 nt, Homo sapiens
gugacaucacauauacggcagc

SEQ ID NO: 1412 - RNA, 18 nt, Homo sapiens
uucacagggaggugucau

SEQ ID NO: 1413 - RNA, 22 nt, Homo sapiens
aaaaguacuugcggauuuugcu

SEQ ID NO: 1414 - RNA, 19 nt, Homo sapiens
ugagcugcuguaccaaaau

SEQ ID NO: 1415 - RNA, 23 nt, Homo sapiens
gcagcagagaauaggacuacguc

SEQ ID NO: 1416 - RNA, 26 nt, Homo sapiens
aaguaguugguuuguaugagaugguu

SEQ ID NO: 1417 - RNA, 21 nt, Homo sapiens
agagaagaagaucagccugca

SEQ ID NO: 1418 - RNA, 21 nt, Homo sapiens
ugagaugaagcacuguagcuc

SEQ ID NO: 1419 - RNA, 22 nt, Homo sapiens
cuccuauaugaugccuuucuuc

SEQ ID NO: 1420 - RNA, 22 nt, Homo sapiens
gcugacuccuaguccagggcuc

SEQ ID NO: 1421 - RNA, 22 nt, Homo sapiens
caaucacuaacuccacugccau

SEQ ID NO: 1422 - RNA, 21 nt, Homo sapiens
acuggacuuggagucagaagg

SEQ ID NO: 1423 - RNA, 22 nt, Homo sapiens
ucuucucuguuuuggccaugug

SEQ ID NO: 1424 - RNA, 23 nt, Homo sapiens
cggcccgggcugcugcuguuccu

SEQ ID NO: 1425 - RNA, 18 nt, Homo sapiens
ugcuuccuuucagagggu

SEQ ID NO: 1426 - RNA, 22 nt, Homo sapiens
aucuggagguaagaagcacuuu

SEQ ID NO: 1427 - RNA, 22 nt, Homo sapiens
aggcggggcgccgcgggaccgc

SEQ ID NO: 1428 - RNA, 23 nt, Homo sapiens
aggaagcccuggaggggcuggag

SEQ ID NO: 1429 - RNA, 22 nt, Homo sapiens
ugcggggcuagggcuaacagca

SEQ ID NO: 1430 - RNA, 22 nt, Homo sapiens
auccgcgcucugacucucugcc

SEQ ID NO: 1431 - RNA, 24 nt, Homo sapiens
uggggagcugaggcucugggggug

SEQ ID NO: 1432 - RNA, 22 nt, Homo sapiens
ccucuuccccuugucucuccag

SEQ ID NO: 1433 - RNA, 17 nt, Homo sapiens
gugggggagaggcuguc

SEQ ID NO: 1434 - RNA, 23 nt, Homo sapiens
caacggaaucccaaaagcagcug

SEQ ID NO: 1435 - RNA, 22 nt, Homo sapiens
uacccagagcaugcagugugaa

SEQ ID NO: 1436 - RNA, 21 nt, Homo sapiens
uucacaguggcuaaguuccgc

SEQ ID NO: 1437 - RNA, 21 nt, Homo sapiens
uaaagugcugacagugcagau

SEQ ID NO: 1438 - RNA, 23 nt, Homo sapiens
cagugcaaugauauugucaaagc

SEQ ID NO: 1439 - RNA, 23 nt, Homo sapiens
ucaagagcaauaacgaaaaaugu

SEQ ID NO: 1440 - RNA, 21 nt, Homo sapiens
aggguaagcugaaccucugau

SEQ ID NO: 1441 - RNA, 21 nt, Homo sapiens
agggggaaaguucuauagucc

SEQ ID NO: 1442 - RNA, 20 nt, Homo sapiens
ggggagcuguggaagcagua

SEQ ID NO: 1443 - RNA, 21 nt, Homo sapiens
uccuucugcuccgucccccag

SEQ ID NO: 1444 - RNA, 17 nt, Homo sapiens
ucccaccgcugccaccc

SEQ ID NO: 1445 - RNA, 23 nt, Homo sapiens
ucuggcuccgugucuucacuccc

SEQ ID NO: 1446 - RNA, 22 nt, Homo sapiens
uggagagaaaggcaguuccuga

SEQ ID NO: 1447 - RNA, 21 nt, Homo sapiens
cggcggggacggcgauugguc

SEQ ID NO: 1448 - RNA, 22 nt, Homo sapiens
aagcugccaguugaagaacugu

SEQ ID NO: 1449 - RNA, 22 nt, Homo sapiens
aaggagcucacagucuauugag

SEQ ID NO: 1450 - RNA, 23 nt, Homo sapiens
ugaggggcagagagcgagacuuu

SEQ ID NO: 1451 - RNA, 23 nt, Homo sapiens
uaauccuugcuaccugggugaga

SEQ ID NO: 1452 - RNA, 22 nt, Homo sapiens
aggcggggcgccgcgggaccgc

SEQ ID NO: 1453 - RNA, 23 nt, Homo sapiens
aaggagcuuacaaucuagcuggg

SEQ ID NO: 1454 - RNA, 22 nt, Homo sapiens
ugcggggcuagggcuaacagca

SEQ ID NO: 1455 - RNA, 23 nt, Homo sapiens
cgggucggaguuagcucaagcgg

SEQ ID NO: 1456 - RNA, 20 nt, Homo sapiens
ggggagcuguggaagcagua

SEQ ID NO: 1457 - RNA, 23 nt, Homo sapiens
cacccggcugugugcacaugugc

SEQ ID NO: 1458 - RNA, 23 nt, Homo sapiens
agcagcauuguacagggcuauga

SEQ ID NO: 1459 - RNA, 23 nt, Homo sapiens
agcagcauuguacagggcuauca

SEQ ID NO: 1460 - RNA, 17 nt, Homo sapiens
gugggggagaggcuguc

SEQ ID NO: 1461 - RNA, 22 nt, Homo sapiens
uagcagcacauaaugguuugug

SEQ ID NO: 1462 - RNA, 22 nt, Homo sapiens
uagcagcacaucaugguuuaca

SEQ ID NO: 1463 - RNA, 22 nt, Homo sapiens
uagcagcacguaaauauuggcg

SEQ ID NO: 1464 - RNA, 21 nt, Homo sapiens
uagcagcacagaaauauuggc

SEQ ID NO: 1465 - RNA, 22 nt, Homo sapiens
uuauaauacaaccugauaagug

SEQ ID NO: 1466 - RNA, 22 nt, Homo sapiens
cagcagcaauucauguuuugaa

SEQ ID NO: 1467 - RNA, 22 nt, Homo sapiens
agaggcuggccgugaugaauuc

SEQ ID NO: 1468 - RNA, 21 nt, Homo sapiens
cagcagcacacugugguuugu

SEQ ID NO: 1469 - RNA, 23 nt, Homo sapiens
uucauuugguauaaaccgcgauu

SEQ ID NO: 1470 - RNA, 22 nt, Homo sapiens
ugagaaccacgucugcucugag

SEQ ID NO: 1471 - RNA, 21 nt, Homo sapiens
guggcugcacucacuuccuuc

SEQ ID NO: 1472 - RNA, 20 nt, Homo sapiens
ggggagcuguggaagcagua

SEQ ID NO: 1473 - RNA, 22 nt, Homo sapiens
ugugcgcagggagaccucuccc

SEQ ID NO: 1474 - RNA, 20 nt, Homo sapiens
gugucugggcggacagcugc

SEQ ID NO: 1475 - RNA, 17 nt, Homo sapiens
ucccaccgcugccaccc

SEQ ID NO: 1476 - RNA, 22 nt, Homo sapiens
uagcagcacauaaugguuugug

SEQ ID NO: 1477 - RNA, 22 nt, Homo sapiens
uagcagcacaucaugguuuaca

SEQ ID NO: 1478 - RNA, 22 nt, Homo sapiens
uagcagcacguaaauauuggcg

SEQ ID NO: 1479 - RNA, 22 nt, Homo sapiens
uggagagaaaggcaguuccuga

SEQ ID NO: 1480 - RNA, 21 nt, Homo sapiens
uagcagcacagaaauauuggc

SEQ ID NO: 1481 - RNA, 23 nt, Homo sapiens
cccaguguucagacuaccuguuc

SEQ ID NO: 1482 - RNA, 23 nt, Homo sapiens
cccaguguuuagacuaucuguuc

SEQ ID NO: 1483 - RNA, 22 nt, Homo sapiens
acagcaggcacagacaggcagu

SEQ ID NO: 1484 - RNA, 24 nt, Homo sapiens
agcagaagcagggagguucuccca

SEQ ID NO: 1485 - RNA, 22 nt, Homo sapiens
gccugcugggguggaaccuggu

SEQ ID NO: 1486 - RNA, 23 nt, Homo sapiens
ugaggggcagagagcgagacuuu

SEQ ID NO: 1487 - RNA, 22 nt, Homo sapiens
cagcagcaauucauguuuugaa

SEQ ID NO: 1488 - RNA, 21 nt, Homo sapiens
cagcagcacacugugguuugu

SEQ ID NO: 1489 - RNA, 22 nt, Homo sapiens
cgucaacacuugcugguuuccu

SEQ ID NO: 1490 - RNA, 24 nt, Homo sapiens
ugccugggucucuggccugcgcgu

SEQ ID NO: 1491 - RNA, 22 nt, Homo sapiens
gguggcccggccgugccugagg

SEQ ID NO: 1492 - RNA, 20 nt, Homo sapiens
ggggagcuguggaagcagua

SEQ ID NO: 1493 - RNA, 22 nt, Homo sapiens
ucuucucuguuuuggccaugug

SEQ ID NO: 1494 - RNA, 22 nt, Homo sapiens
ucguaccgugaguaauaaugcg

SEQ ID NO: 1495 - RNA, 24 nt, Homo sapiens
uuuggcaaugguagaacucacacu

SEQ ID NO: 1496 - RNA, 23 nt, Homo sapiens
uaagugcuuccauguuuuaguag

SEQ ID NO: 1497 - RNA, 23 nt, Homo sapiens
uaagugcuuccauguuugagugu

SEQ ID NO: 1498 - RNA, 21 nt, Homo sapiens
aggcaagaugcuggcauagcu

SEQ ID NO: 1499 - RNA, 20 nt, Homo sapiens
cuacaaagggaagcccuuuc

SEQ ID NO: 1500 - RNA, 22 nt, Homo sapiens
cuacaaagggaagcacuuucuc

SEQ ID NO: 1501 - RNA, 22 nt, Homo sapiens
gugagucucuaagaaaagagga

SEQ ID NO: 1502 - RNA, 21 nt, Homo sapiens
guggcugcacucacuuccuuc

SEQ ID NO: 1503 - RNA, 21 nt, Homo sapiens
aauauuauacagucaaccucu

SEQ ID NO: 1504 - RNA, 23 nt, Homo sapiens
aaggagcuuacaaucuagcuggg

SEQ ID NO: 1505 - RNA, 22 nt, Homo sapiens
aaauuauuguacaucggaugag

SEQ ID NO: 1506 - RNA, 22 nt, Homo sapiens
uggagugugacaaugguguuug

SEQ ID NO: 1507 - RNA, 21 nt, Homo sapiens
cggcggggacggcgauugguc

SEQ ID NO: 1508 - RNA, 23 nt, Homo sapiens
ugaguaccgccaugucuguuggg

SEQ ID NO: 1509 - RNA, 21 nt, Homo sapiens
gguuugguccuagccuuucua

SEQ ID NO: 1510 - RNA, 22 nt, Homo sapiens
cucccacugcuucacuugacua

SEQ ID NO: 1511 - RNA, 21 nt, Homo sapiens
ugacaacuauggaugagcucu

SEQ ID NO: 1512 - RNA, 21 nt, Homo sapiens
agggcccccccucaauccugu

SEQ ID NO: 1513 - RNA, 22 nt, Homo sapiens
cuggcccucucugcccuuccgu

SEQ ID NO: 1514 - RNA, 23 nt, Homo sapiens
ucccccaggugugauucugauuu

SEQ ID NO: 1515 - RNA, 21 nt, Homo sapiens
ucacuccucuccucccgucuu

SEQ ID NO: 1516 - RNA, 19 nt, Homo sapiens
agcugucugaaaaugucuu

SEQ ID NO: 1517 - RNA, 24 nt, Homo sapiens
acugggggcuuucgggcucugcgu

SEQ ID NO: 1518 - RNA, 22 nt, Homo sapiens
aggcggggcgccgcgggaccgc

SEQ ID NO: 1519 - RNA, 23 nt, Homo sapiens
ugucacucggcucggcccacuac

SEQ ID NO: 1520 - RNA, 23 nt, Homo sapiens
aaggagcuuacaaucuagcuggg

SEQ ID NO: 1521 - RNA, 17 nt, Homo sapiens
gugggggagaggcuguc

SEQ ID NO: 1522 - RNA, 21 nt, Homo sapiens
gcccuccgcccgugcaccccg

SEQ ID NO: 1523 - RNA, 22 nt, Homo sapiens
ucagugcaucacagaacuuugu

SEQ ID NO: 1524 - RNA, 22 nt, Homo sapiens
acacagggcuguugugaagacu

SEQ ID NO: 1525 - RNA, 22 nt, Homo sapiens
aguggggaacccuuccaugagg

SEQ ID NO: 1526 - RNA, 22 nt, Homo sapiens
aauccuuugucccugggugaga

SEQ ID NO: 1527 - RNA, 18 nt, Homo sapiens
uucacagggaggugucau

SEQ ID NO: 1528 - RNA, 22 nt, Homo sapiens
uacgucaucguugucaucguca

SEQ ID NO: 1529 - RNA, 25 nt, Homo sapiens
aggggugguguugggacagcuccgu

SEQ ID NO: 1530 - RNA, 22 nt, Homo sapiens
agucauuggaggguuugagcag

SEQ ID NO: 1531 - RNA, 25 nt, Homo sapiens
ggcggagggaaguagguccguuggu

SEQ ID NO: 1532 - RNA, 20 nt, Homo sapiens
ggggagcuguggaagcagua

SEQ ID NO: 1533 - RNA, 22 nt, Homo sapiens
uuuccggcucgcgugggugugu

SEQ ID NO: 1534 - RNA, 21 nt, Homo sapiens
ccgucgccgccacccgagccg

SEQ ID NO: 1535 - RNA, 22 nt, Homo sapiens
acccgucccguucguccccgga

SEQ ID NO: 1536 - RNA, 22 nt, Homo sapiens
augggugaauuuguagaaggau

SEQ ID NO: 1537 - RNA, 21 nt, Homo sapiens
gcccuccgcccgugcaccccg

SEQ ID NO: 1538 - RNA, 21 nt, Homo sapiens
uccugcgcgucccagaugccc

SEQ ID NO: 1539 - RNA, 21 nt, Homo sapiens
cggcggggacggcgauugguc

SEQ ID NO: 1540 - RNA, 22 nt, Homo sapiens
cccugugcccggcccacuucug

SEQ ID NO: 1541 - RNA, 22 nt, Homo sapiens
cauugcacuugucucggucuga

SEQ ID NO: 1542 - RNA, 23 nt, Homo sapiens
cgcauccccuagggcauuggugu

SEQ ID NO: 1543 - RNA, 23 nt, Homo sapiens
ugaggggcagagagcgagacuuu

SEQ ID NO: 1544 - RNA, 22 nt, Homo sapiens
uccuguacugagcugccccgag

SEQ ID NO: 1545 - RNA, 23 nt, Homo sapiens
ucggggaucaucaugucacgaga

SEQ ID NO: 1546 - RNA, 25 nt, Homo sapiens
aggggugguguugggacagcuccgu

SEQ ID NO: 1547 - RNA, 22 nt, Homo sapiens
aggcggggcgccgcgggaccgc

SEQ ID NO: 1548 - RNA, 23 nt, Homo sapiens
aggaagcccuggaggggcuggag

SEQ ID NO: 1549 - RNA, 22 nt, Homo sapiens
ugcggggcuagggcuaacagca

SEQ ID NO: 1550 - RNA, 20 nt, Homo sapiens
ggggagcuguggaagcagua

SEQ ID NO: 1551 - RNA, 22 nt, Homo sapiens
uauugcacucgucccggccucc

SEQ ID NO: 1552 - RNA, 21 nt, Homo sapiens
cggcggggacggcgauugguc

SEQ ID NO: 1553 - RNA, 23 nt, Homo sapiens
ugaggggcagagagcgagacuuu

SEQ ID NO: 1554 - RNA, 22 nt, Homo sapiens
agaggcuggccgugaugaauuc

SEQ ID NO: 1555 - RNA, 22 nt, Homo sapiens
aggcggggcgccgcgggaccgc

SEQ ID NO: 1556 - RNA, 22 nt, Homo sapiens
ugcggggcuagggcuaacagca

SEQ ID NO: 1557 - RNA, 21 nt, Homo sapiens
agagaagaagaucagccugca

SEQ ID NO: 1558 - RNA, 17 nt, Homo sapiens
gugggggagaggcuguc

SEQ ID NO: 1559 - RNA, 23 nt, Homo sapiens
ucuggcuccgugucuucacuccc

SEQ ID NO: 1560 - RNA, 23 nt, Homo sapiens
uaaggugcaucuagugcagauag

SEQ ID NO: 1561 - RNA, 22 nt, Homo sapiens
gguccagaggggagauagguuc

SEQ ID NO: 1562 - RNA, 22 nt, Homo sapiens
aagcugccaguugaagaacugu

SEQ ID NO: 1563 - RNA, 20 nt, Homo sapiens
ccucugggcccuuccuccag

SEQ ID NO: 1564 - RNA, 22 nt, Homo sapiens
ucucugggccugugucuuaggc

SEQ ID NO: 1565 - RNA, 23 nt, Homo sapiens
ucccccaggugugauucugauuu

SEQ ID NO: 1566 - RNA, 22 nt, Homo sapiens
uaaugccccuaaaaauccuuau

SEQ ID NO: 1567 - RNA, 23 nt, Homo sapiens
caaagcgcuucucuuuagagugu

SEQ ID NO: 1568 - RNA, 21 nt, Homo sapiens
cuccagagggaaguacuuucu

SEQ ID NO: 1569 - RNA, 21 nt, Homo sapiens
cuccagagggaugcacuuucu

SEQ ID NO: 1570 - RNA, 19 nt, Homo sapiens
ugagcugcuguaccaaaau

SEQ ID NO: 1571 - RNA, 24 nt, Homo sapiens
acugggggcuuucgggcucugcgu

SEQ ID NO: 1572 - RNA, 22 nt, Homo sapiens
acuccagccccacagccucagc

SEQ ID NO: 1573 - RNA, 20 nt, Homo sapiens
ggggagcuguggaagcagua

SEQ ID NO: 1574 - RNA, 22 nt, Homo sapiens
ucuucucuguuuuggccaugug

SEQ ID NO: 1575 - RNA, 18 nt, Homo sapiens
ucagcuggcccucauuuc

SEQ ID NO: 1576 - RNA, 18 nt, Homo sapiens
ucagcuggcccucauuuc

SEQ ID NO: 1577 - RNA, 21 nt, Homo sapiens
uggcagggaggcugggagggg

SEQ ID NO: 1578 - RNA, 20 nt, Homo sapiens
gugucugggcggacagcugc

SEQ ID NO: 1579 - RNA, 18 nt, Homo sapiens
ugaggcaguagauugaau

SEQ ID NO: 1580 - RNA, 22 nt, Homo sapiens
cgcaggggccgggugcucaccg

SEQ ID NO: 1581 - RNA, 22 nt, Homo sapiens
acagcaggcacagacaggcagu

SEQ ID NO: 1582 - RNA, 22 nt, Homo sapiens
gccugcugggguggaaccuggu

SEQ ID NO: 1583 - RNA, 21 nt, Homo sapiens
guggcugcacucacuuccuuc

SEQ ID NO: 1584 - RNA, 23 nt, Homo sapiens
ugucacucggcucggcccacuac

SEQ ID NO: 1585 - RNA, 22 nt, Homo sapiens
ugagaccucuggguucugagcu

SEQ ID NO: 1586 - RNA, 21 nt, Homo sapiens
aaggcagggcccccgcucccc

SEQ ID NO: 1587 - RNA, 22 nt, Homo sapiens
cuccugagccauucugagccuc

SEQ ID NO: 1588 - RNA, 21 nt, Homo sapiens
aagugaucuaaaggccuacau

SEQ ID NO: 1589 - RNA, 23 nt, Homo sapiens
uaaggugcaucuagugcagauag

SEQ ID NO: 1590 - RNA, 23 nt, Homo sapiens
ugaguaccgccaugucuguuggg

SEQ ID NO: 1591 - RNA, 22 nt, Homo sapiens
cccugugcccggcccacuucug

SEQ ID NO: 1592 - RNA, 22 nt, Homo sapiens
aacuggccuacaaagucccagu

SEQ ID NO: 1593 - RNA, 22 nt, Homo sapiens
aacuggcccucaaagucccgcu

SEQ ID NO: 1594 - RNA, 22 nt, Homo sapiens
aaaucucugcaggcaaauguga

SEQ ID NO: 1595 - RNA, 22 nt, Homo sapiens
aagcugccaguugaagaacugu

SEQ ID NO: 1596 - RNA, 22 nt, Homo sapiens
uggcucaguucagcaggaacag

SEQ ID NO: 1597 - RNA, 22 nt, Homo sapiens
ucaggcucaguccccucccgau

SEQ ID NO: 1598 - RNA, 22 nt, Homo sapiens
ugauugguacgucuguggguag

SEQ ID NO: 1599 - RNA, 22 nt, Homo sapiens
ugcaacuuaccugagucauuga

SEQ ID NO: 1600 - RNA, 20 nt, Homo sapiens
ggggagcuguggaagcagua

SEQ ID NO: 1601 - RNA, 22 nt, Homo sapiens
acccgucccguucguccccgga

SEQ ID NO: 1602 - RNA, 24 nt, Homo sapiens
uggcccugacugaagaccagcagu

SEQ ID NO: 1603 - RNA, 22 nt, Homo sapiens
ugugagguuggcauuguugucu

SEQ ID NO: 1604 - RNA, 22 nt, Homo sapiens
uacccagagcaugcagugugaa

SEQ ID NO: 1605 - RNA, 22 nt, Homo sapiens
uagcaccaucugaaaucgguua

SEQ ID NO: 1606 - RNA, 20 nt, Homo sapiens
ccucugggcccuuccuccag

SEQ ID NO: 1607 - RNA, 22 nt, Homo sapiens
ucucugggccugugucuuaggc

SEQ ID NO: 1608 - RNA, 22 nt, Homo sapiens
uggcagugucuuagcugguugu

SEQ ID NO: 1609 - RNA, 22 nt, Homo sapiens
gaauguugcucggugaaccccu

SEQ ID NO: 1610 - RNA, 22 nt, Homo sapiens
aguggggaacccuuccaugagg

SEQ ID NO: 1611 - RNA, 21 nt, Homo sapiens
aguuaaugaauccuggaaagu

SEQ ID NO: 1612 - RNA, 21 nt, Homo sapiens
guguugaaacaaucucuacug

SEQ ID NO: 1613 - RNA, 22 nt, Homo sapiens
uauugcacucgucccggccucc

SEQ ID NO: 1614 - RNA, 21 nt, Homo sapiens
uggcagggaggcugggagggg

SEQ ID NO: 1615 - RNA, 25 nt, Homo sapiens
gggcgacaaagcaagacucuuucuu

SEQ ID NO: 1616 - RNA, 18 nt, Homo sapiens
cagggaggugaaugugau

SEQ ID NO: 1617 - RNA, 20 nt, Homo sapiens
guguguggaaaugcuucugc

SEQ ID NO: 1618 - RNA, 21 nt, Homo sapiens
gcccuccgcccgugcaccccg

SEQ ID NO: 1619 - RNA, 22 nt, Homo sapiens
ucucccaacccuuguaccagug

SEQ ID NO: 1620 - RNA, 21 nt, Homo sapiens
cggcggggacggcgauugguc

SEQ ID NO: 1621 - RNA, 22 nt, Homo sapiens
uagguaguuuccuguuguuggg

SEQ ID NO: 1622 - RNA, 25 nt, Homo sapiens
cccccacaaccgcgcuugacuagcu

SEQ ID NO: 1623 - RNA, 21 nt, Homo sapiens
uaaagugcugacagugcagau

SEQ ID NO: 1624 - RNA, 23 nt, Homo sapiens
cagugcaaugauauugucaaagc

SEQ ID NO: 1625 - RNA, 22 nt, Homo sapiens
aacacaccugguuaaccucuuu

SEQ ID NO: 1626 - RNA, 22 nt, Homo sapiens
aacacaccuauucaaggauuca

SEQ ID NO: 1627 - RNA, 23 nt, Homo sapiens
ucggggaucaucaugucacgaga

SEQ ID NO: 1628 - RNA, 21 nt, Homo sapiens
cacaagguauugguauuaccu

SEQ ID NO: 1629 - RNA, 22 nt, Homo sapiens
aggcggggcgccgcgggaccgc

SEQ ID NO: 1630 - RNA, 23 nt, Homo sapiens
uggaagacuagugauuuuguugu

SEQ ID NO: 1631 - RNA, 22 nt, Homo sapiens
caaagugccucccuuuagagug

SEQ ID NO: 1632 - RNA, 22 nt, Homo sapiens
uacguagauauauauguauuuu

SEQ ID NO: 1633 - RNA, 18 nt, Homo sapiens
cagggaggugaaugugau

SEQ ID NO: 1634 - RNA, 23 nt, Homo sapiens
ucuggcuccgugucuucacuccc

SEQ ID NO: 1635 - RNA, 21 nt, Homo sapiens
gguuugguccuagccuuucua

SEQ ID NO: 1636 - RNA, 22 nt, Homo sapiens
gaggguuggguggaggcucucc

SEQ ID NO: 1637 - RNA, 22 nt, Homo sapiens
uauguaauaugguccacaucuu

SEQ ID NO: 1638 - RNA, 21 nt, Homo sapiens
ucacuccucuccucccgucuu

SEQ ID NO: 1639 - RNA, 19 nt, Homo sapiens
agguugacauacguuuccc

SEQ ID NO: 1640 - RNA, 22 nt, Homo sapiens
gucccucuccaaaugugucuug

SEQ ID NO: 1641 - RNA, 21 nt, Homo sapiens
cugacuguugccguccuccag

SEQ ID NO: 1642 - RNA, 22 nt, Homo sapiens
ugagguaguagguuguauaguu

SEQ ID NO: 1643 - RNA, 22 nt, Homo sapiens
ugagguaguagguugugugguu

SEQ ID NO: 1644 - RNA, 19 nt, Homo sapiens
ugucucugcugggguuucu

SEQ ID NO: 1645 - RNA, 22 nt, Homo sapiens
aacccguagauccgaacuugug

SEQ ID NO: 1646 - RNA, 22 nt, Homo sapiens
cugaagcucagagggcucugau

SEQ ID NO: 1647 - RNA, 22 nt, Homo sapiens
uaaucucagcuggcaacuguga

SEQ ID NO: 1648 - RNA, 20 nt, Homo sapiens
auguauaaauguauacacac

SEQ ID NO: 1649 - RNA, 21 nt, Homo sapiens
ggcuagcaacagcgcuuaccu

SEQ ID NO: 1650 - RNA, 21 nt, Homo sapiens
cacaagguauugguauuaccu

SEQ ID NO: 1651 - RNA, 20 nt, Homo sapiens
agaccauggguucucauugu

SEQ ID NO: 1652 - RNA, 22 nt, Homo sapiens
uggagugugacaaugguguuug

SEQ ID NO: 1653 - RNA, 23 nt, Homo sapiens
uuuggcacuagcacauuuuugcu

SEQ ID NO: 1654 - RNA, 17 nt, Homo sapiens
ucccuguucgggcgcca

SEQ ID NO: 1655 - RNA, 23 nt, Homo sapiens
cggcccgggcugcugcuguuccu

SEQ ID NO: 1656 - RNA, 21 nt, Homo sapiens
agggcccccccucaauccugu

SEQ ID NO: 1657 - RNA, 21 nt, Homo sapiens
aggggugcuaucugugauuga

SEQ ID NO: 1658 - RNA, 23 nt, Homo sapiens
ucccccaggugugauucugauuu

SEQ ID NO: 1659 - RNA, 24 nt, Homo sapiens
acugggggcuuucgggcucugcgu

SEQ ID NO: 1660 - RNA, 23 nt, Homo sapiens
uggugcggagagggcccacagug

SEQ ID NO: 1661 - RNA, 20 nt, Homo sapiens
agagucuugugaugucuugc

SEQ ID NO: 1662 - RNA, 20 nt, Homo sapiens
ucacuguucagacaggcgga

SEQ ID NO: 1663 - RNA, 21 nt, Homo sapiens
ccccaccuccucucuccucag

SEQ ID NO: 1664 - RNA, 21 nt, Homo sapiens
ccuguugaaguguaaucccca

SEQ ID NO: 1665 - RNA, 22 nt, Homo sapiens
cucuagagggaagcacuuucug

SEQ ID NO: 1666 - RNA, 22 nt, Homo sapiens
uggagagaaaggcaguuccuga

SEQ ID NO: 1667 - RNA, 22 nt, Homo sapiens
uguaacagcaacuccaugugga

SEQ ID NO: 1668 - RNA, 22 nt, Homo sapiens
cucccacugcuucacuugacua

SEQ ID NO: 1669 - RNA, 21 nt, Homo sapiens
uaaagugcugacagugcagau

SEQ ID NO: 1670 - RNA, 23 nt, Homo sapiens
cagugcaaugauauugucaaagc

SEQ ID NO: 1671 - RNA, 23 nt, Homo sapiens
aucaacagacauuaauugggcgc

SEQ ID NO: 1672 - RNA, 22 nt, Homo sapiens
cuuaugcaagauucccuucuac

SEQ ID NO: 1673 - RNA, 22 nt, Homo sapiens
ugaaggucuacugugugccagg

SEQ ID NO: 1674 - RNA, 22 nt, Homo sapiens
cgucaacacuugcugguuuccu

SEQ ID NO: 1675 - RNA, 22 nt, Homo sapiens
ccucccacacccaaggcuugca

SEQ ID NO: 1676 - RNA, 21 nt, Homo sapiens
aacaggugacugguuagacaa

SEQ ID NO: 1677 - RNA, 22 nt, Homo sapiens
gguggcccggccgugccugagg

SEQ ID NO: 1678 - RNA, 20 nt, Homo sapiens
ggggagcuguggaagcagua

SEQ ID NO: 1679 - RNA, 22 nt, Homo sapiens
ucuucucuguuuuggccaugug

SEQ ID NO: 1680 - RNA, 22 nt, Homo sapiens
ucggccugaccacccaccccac

SEQ ID NO: 1681 - RNA, 24 nt, Homo sapiens
agccuggaagcuggagccugcagu

SEQ ID NO: 1682 - RNA, 18 nt, Homo sapiens
cgggcguggugguggggg

SEQ ID NO: 1683 - RNA, 23 nt, Homo sapiens
uggaguccaggaaucugcauuuu

SEQ ID NO: 1684 - RNA, 21 nt, Homo sapiens
uccugcgcgucccagaugccc

SEQ ID NO: 1685 - RNA, 21 nt, Homo sapiens
cggcggggacggcgauugguc

SEQ ID NO: 1686 - RNA, 22 nt, Homo sapiens
cgcaggggccgggugcucaccg

SEQ ID NO: 1687 - RNA, 23 nt, Homo sapiens
ugagcgccucgacgacagagccg

SEQ ID NO: 1688 - RNA, 22 nt, Homo sapiens
aggcggggcgccgcgggaccgc

SEQ ID NO: 1689 - RNA, 22 nt, Homo sapiens
ugcggggcuagggcuaacagca

SEQ ID NO: 1690 - RNA, 22 nt, Homo sapiens
auccgcgcucugacucucugcc

SEQ ID NO: 1691 - RNA, 22 nt, Homo sapiens
ucugggcaacaaagugagaccu

SEQ ID NO: 1692 - RNA, 23 nt, Homo sapiens
uuauugcuuaagaauacgcguag

SEQ ID NO: 1693 - RNA, 23 nt, Homo sapiens
ucuggcuccgugucuucacuccc

SEQ ID NO: 1694 - RNA, 23 nt, Homo sapiens
ucuggcuccgugucuucacuccc

SEQ ID NO: 1695 - RNA, 23 nt, Homo sapiens
uaaggugcaucuagugcagauag

SEQ ID NO: 1696 - RNA, 20 nt, Homo sapiens
ccuccugcccuccuugcugu

SEQ ID NO: 1697 - RNA, 22 nt, Homo sapiens
acacagggcuguugugaagacu

SEQ ID NO: 1698 - RNA, 22 nt, Homo sapiens
gaggguuggguggaggcucucc

SEQ ID NO: 1699 - RNA, 22 nt, Homo sapiens
aggcaguguauuguuagcuggc

SEQ ID NO: 1700 - RNA, 22 nt, Homo sapiens
cgucaacacuugcugguuuccu

SEQ ID NO: 1701 - RNA, 25 nt, Homo sapiens
gcugggcagggcuucugagcuccuu

SEQ ID NO: 1702 - RNA, 19 nt, Homo sapiens
aguguggcuuucuuagagc

SEQ ID NO: 1703 - RNA, 20 nt, Homo sapiens
accaggaggcugaggccccu

SEQ ID NO: 1704 - RNA, 20 nt, Homo sapiens
cggcucugggucugugggga

SEQ ID NO: 1705 - RNA, 22 nt, Homo sapiens
cugcccuggcccgagggaccga

SEQ ID NO: 1706 - RNA, 23 nt, Homo sapiens
uacccuguagauccgaauuugug

SEQ ID NO: 1707 - RNA, 23 nt, Homo sapiens
uacccuguagaaccgaauuugug

SEQ ID NO: 1708 - RNA, 17 nt, Homo sapiens
ucccuguucgggcgcca

SEQ ID NO: 1709 - RNA, 17 nt, Homo sapiens
ucccaccgcugccaccc

SEQ ID NO: 1710 - RNA, 22 nt, Homo sapiens
cagugcaaugaugaaagggcau

SEQ ID NO: 1711 - RNA, 22 nt, Homo sapiens
ugauauguuugauauauuaggu

SEQ ID NO: 1712 - RNA, 21 nt, Homo sapiens
ugauauguuugauauuggguu

SEQ ID NO: 1713 - RNA, 21 nt, Homo sapiens
uucaaguaauucaggauaggu

SEQ ID NO: 1714 - RNA, 22 nt, Homo sapiens
aguggggaacccuuccaugagg

SEQ ID NO: 1715 - RNA, 22 nt, Homo sapiens
ugagaaccacgucugcucugag

SEQ ID NO: 1716 - RNA, 20 nt, Homo sapiens
guagaggagauggcgcaggg

SEQ ID NO: 1717 - RNA, 20 nt, Homo sapiens
ggggagcuguggaagcagua

SEQ ID NO: 1718 - RNA, 22 nt, Homo sapiens
ugugcgcagggagaccucuccc

SEQ ID NO: 1719 - RNA, 22 nt, Homo sapiens
acgcccuucccccccuucuuca

SEQ ID NO: 1720 - RNA, 23 nt, Homo sapiens
ucuggcuccgugucuucacuccc

SEQ ID NO: 1721 - RNA, 21 nt, Homo sapiens
uccugcgcgucccagaugccc

SEQ ID NO: 1722 - RNA, 20 nt, Homo sapiens
ccccagggcgacgcggcggg

SEQ ID NO: 1723 - RNA, 22 nt, Homo sapiens
ugggucuuugcgggcgagauga

SEQ ID NO: 1724 - RNA, 21 nt, Homo sapiens
gccccugggccuauccuagaa

SEQ ID NO: 1725 - RNA, 23 nt, Homo sapiens
uagcagcgggaacaguucugcag

SEQ ID NO: 1726 - RNA, 20 nt, Homo sapiens
accaggaggcugaggccccu

SEQ ID NO: 1727 - RNA, 23 nt, Homo sapiens
uggaagacuagugauuuuguugu

SEQ ID NO: 1728 - RNA, 22 nt, Homo sapiens
uggaauguaaggaagugugugg

SEQ ID NO: 1729 - RNA, 22 nt, Homo sapiens
cugaagcucagagggcucugau

SEQ ID NO: 1730 - RNA, 22 nt, Homo sapiens
ugugagguuggcauuguugucu

SEQ ID NO: 1731 - RNA, 21 nt, Homo sapiens
ccaguccugugccugccgccu

SEQ ID NO: 1732 - RNA, 22 nt, Homo sapiens
cucccacugcuucacuugacua

SEQ ID NO: 1733 - RNA, 23 nt, Homo sapiens
acuucaccugguccacuagccgu

SEQ ID NO: 1734 - RNA, 22 nt, Homo sapiens
gugacaucacauauacggcagc

SEQ ID NO: 1735 - RNA, 23 nt, Homo sapiens
uacuccagagggcgucacucaug

SEQ ID NO: 1736 - RNA, 21 nt, Homo sapiens
uggaggagaaggaaggugaug

SEQ ID NO: 1737 - RNA, 20 nt, Homo sapiens
uacaguauagaugauguacu

SEQ ID NO: 1738 - RNA, 22 nt, Homo sapiens
ugucaguuugucaaauacccca

SEQ ID NO: 1739 - RNA, 23 nt, Homo sapiens
ucaagagcaauaacgaaaaaugu

SEQ ID NO: 1740 - RNA, 22 nt, Homo sapiens
gcugacuccuaguccagggcuc

SEQ ID NO: 1741 - RNA, 21 nt, Homo sapiens
acuggacuuggagucagaagg

SEQ ID NO: 1742 - RNA, 22 nt, Homo sapiens
ugaaggucuacugugugccagg

SEQ ID NO: 1743 - RNA, 22 nt, Homo sapiens
ugugacagauugauaacugaaa

SEQ ID NO: 1744 - RNA, 21 nt, Homo sapiens
gcgacccauacuugguuucag

SEQ ID NO: 1745 - RNA, 22 nt, Homo sapiens
uggauuucuuugugaaucacca

SEQ ID NO: 1746 - RNA, 23 nt, Homo sapiens
uacccuguagauccgaauuugug

SEQ ID NO: 1747 - RNA, 23 nt, Homo sapiens
uacccuguagaaccgaauuugug

SEQ ID NO: 1748 - RNA, 22 nt, Homo sapiens
cuccugagccauucugagccuc

SEQ ID NO: 1749 - RNA, 26 nt, Homo sapiens
aaguaguugguuuguaugagaugguu

SEQ ID NO: 1750 - RNA, 17 nt, Homo sapiens
ucccuguucgggcgcca

SEQ ID NO: 1751 - RNA, 22 nt, Homo sapiens
cagugcaaugaugaaagggcau

SEQ ID NO: 1752 - RNA, 22 nt, Homo sapiens
uaacacugucugguaaagaugg

SEQ ID NO: 1753 - RNA, 22 nt, Homo sapiens
uaacacugucugguaacgaugu

SEQ ID NO: 1754 - RNA, 22 nt, Homo sapiens
ugucaguuugucaaauacccca

SEQ ID NO: 1755 - RNA, 21 nt, Homo sapiens
uucacaguggcuaaguuccgc

SEQ ID NO: 1756 - RNA, 21 nt, Homo sapiens
uucacaguggcuaaguucugc

SEQ ID NO: 1757 - RNA, 23 nt, Homo sapiens
ccaguuaccgcuuccgcuaccgc

SEQ ID NO: 1758 - RNA, 21 nt, Homo sapiens
cugacuguugccguccuccag

SEQ ID NO: 1759 - RNA, 21 nt, Homo sapiens
uggcagggaggcugggagggg

SEQ ID NO: 1760 - RNA, 22 nt, Homo sapiens
uggagugugacaaugguguuug

SEQ ID NO: 1761 - RNA, 22 nt, Homo sapiens
uucuggaauucugugugaggga

SEQ ID NO: 1762 - RNA, 22 nt, Homo sapiens
aagcccuuaccccaaaaagcau

SEQ ID NO: 1763 - RNA, 23 nt, Homo sapiens
uaaggugcaucuagugcagauag

SEQ ID NO: 1764 - RNA, 20 nt, Homo sapiens
ccccagggcgacgcggcggg

SEQ ID NO: 1765 - RNA, 22 nt, Homo sapiens
uagcaccaucugaaaucgguua

SEQ ID NO: 1766 - RNA, 22 nt, Homo sapiens
cgucaacacuugcugguuuccu

SEQ ID NO: 1767 - RNA, 22 nt, Homo sapiens
auauuaccauuagcucaucuuu

SEQ ID NO: 1768 - RNA, 20 nt, Homo sapiens
auguauaaauguauacacac

SEQ ID NO: 1769 - RNA, 22 nt, Homo sapiens
cugcccuggcccgagggaccga

SEQ ID NO: 1770 - RNA, 22 nt, Homo sapiens
cugcccuggcccgagggaccga

SEQ ID NO: 1771 - RNA, 21 nt, Homo sapiens
cccggagccaggaugcagcuc

SEQ ID NO: 1772 - RNA, 20 nt, Homo sapiens
ugagcccuguccucccgcag

SEQ ID NO: 1773 - RNA, 23 nt, Homo sapiens
uggaguccaggaaucugcauuuu

SEQ ID NO: 1774 - RNA, 21 nt, Homo sapiens
ucgaggagcucacagucuagu

SEQ ID NO: 1775 - RNA, 23 nt, Homo sapiens
cggcccgggcugcugcuguuccu

SEQ ID NO: 1776 - RNA, 21 nt, Homo sapiens
cggcggggacggcgauugguc

SEQ ID NO: 1777 - RNA, 21 nt, Homo sapiens
agggcccccccucaauccugu

SEQ ID NO: 1778 - RNA, 22 nt, Homo sapiens
uguaaacauccuacacucagcu

SEQ ID NO: 1779 - RNA, 22 nt, Homo sapiens
uccagcaucagugauuuuguug

SEQ ID NO: 1780 - RNA, 22 nt, Homo sapiens
uaaugccccuaaaaauccuuau

SEQ ID NO: 1781 - RNA, 22 nt, Homo sapiens
agacuucccauuugaagguggc

SEQ ID NO: 1782 - RNA, 22 nt, Homo sapiens
aggcggggcgccgcgggaccgc

SEQ ID NO: 1783 - RNA, 21 nt, Homo sapiens
ccccaccuccucucuccucag

SEQ ID NO: 1784 - RNA, 21 nt, Homo sapiens
agcuacaucuggcuacugggu

SEQ ID NO: 1785 - RNA, 22 nt, Homo sapiens
ugucaguuugucaaauacccca

SEQ ID NO: 1786 - RNA, 22 nt, Homo sapiens
gcugacuccuaguccagggcuc

SEQ ID NO: 1787 - RNA, 22 nt, Homo sapiens
uaaugccccuaaaaauccuuau

SEQ ID NO: 1788 - RNA, 20 nt, Homo sapiens
auuccuagaaauuguucaua

SEQ ID NO: 1789 - RNA, 23 nt, Homo sapiens
agguuacccgagcaacuuugcau

SEQ ID NO: 1790 - RNA, 22 nt, Homo sapiens
aguggggaacccuuccaugagg

SEQ ID NO: 1791 - RNA, 22 nt, Homo sapiens
agacuucccauuugaagguggc

SEQ ID NO: 1792 - RNA, 19 nt, Homo sapiens
gugucugcuuccuguggga

SEQ ID NO: 1793 - RNA, 22 nt, Homo sapiens
uaugucugcugaccaucaccuu

SEQ ID NO: 1794 - RNA, 22 nt, Homo sapiens
auccgcgcucugacucucugcc

SEQ ID NO: 1795 - RNA, 22 nt, Homo sapiens
aggcauugacuucucacuagcu

SEQ ID NO: 1796 - RNA, 21 nt, Homo sapiens
gcccuccgcccgugcaccccg

SEQ ID NO: 1797 - RNA, 22 nt, Homo sapiens
ucagugcaucacagaacuuugu

SEQ ID NO: 1798 - RNA, 22 nt, Homo sapiens
ucucccaacccuuguaccagug

SEQ ID NO: 1799 - RNA, 25 nt, Homo sapiens
ggcggagggaaguagguccguuggu

SEQ ID NO: 1800 - RNA, 20 nt, Homo sapiens
ggggagcuguggaagcagua

SEQ ID NO: 1801 - RNA, 22 nt, Homo sapiens
auccgcgcucugacucucugcc

SEQ ID NO: 1802 - RNA, 22 nt, Homo sapiens
ugagguaguagguuguauaguu

SEQ ID NO: 1803 - RNA, 22 nt, Homo sapiens
ugagguaguagguugugugguu

SEQ ID NO: 1804 - RNA, 19 nt, Homo sapiens
ugucucugcugggguuucu

SEQ ID NO: 1805 - RNA, 23 nt, Homo sapiens
ucaaaugcucagacuccuguggu

SEQ ID NO: 1806 - RNA, 22 nt, Homo sapiens
agaucagaaggugauuguggcu

SEQ ID NO: 1807 - RNA, 22 nt, Homo sapiens
ucagcaaacauuuauugugugc

SEQ ID NO: 1808 - RNA, 21 nt, Homo sapiens
gcgacccauacuugguuucag

SEQ ID NO: 1809 - RNA, 20 nt, Homo sapiens
auguauaaauguauacacac

SEQ ID NO: 1810 - RNA, 21 nt, Homo sapiens
cuucuugugcucuaggauugu

SEQ ID NO: 1811 - RNA, 22 nt, Homo sapiens
gucccucuccaaaugugucuug

SEQ ID NO: 1812 - RNA, 23 nt, Homo sapiens
uacccuguagauccgaauuugug

SEQ ID NO: 1813 - RNA, 23 nt, Homo sapiens
uacccuguagaaccgaauuugug

SEQ ID NO: 1814 - RNA, 23 nt, Homo sapiens
gagggucuugggagggaugugac

SEQ ID NO: 1815 - RNA, 21 nt, Homo sapiens
gguuugguccuagccuuucua

SEQ ID NO: 1816 - RNA, 22 nt, Homo sapiens
uagcuuaucagacugauguuga

SEQ ID NO: 1817 - RNA, 23 nt, Homo sapiens
ucccuguccuccaggagcucacg

SEQ ID NO: 1818 - RNA, 23 nt, Homo sapiens
gaagugcuucgauuuuggggugu

SEQ ID NO: 1819 - RNA, 23 nt, Homo sapiens
ugaggggcagagagcgagacuuu

SEQ ID NO: 1820 - RNA, 22 nt, Homo sapiens
agacccuggucugcacucuauc

SEQ ID NO: 1821 - RNA, 21 nt, Homo sapiens
ugaguuggccaucugagugag

SEQ ID NO: 1822 - RNA, 21 nt, Homo sapiens
uaauuuuauguauaagcuagu

SEQ ID NO: 1823 - RNA, 22 nt, Homo sapiens
agucauuggaggguuugagcag

SEQ ID NO: 1824 - RNA, 17 nt, Homo sapiens
ucccuguucgggcgcca

SEQ ID NO: 1825 - RNA, 22 nt, Homo sapiens
ucuacaaaggaaagcgcuuucu

SEQ ID NO: 1826 - RNA, 21 nt, Homo sapiens
caagucacuagugguuccguu

SEQ ID NO: 1827 - RNA, 22 nt, Homo sapiens
uuauaauacaaccugauaagug

SEQ ID NO: 1828 - RNA, 23 nt, Homo sapiens
ucuuggaguaggucauugggugg

SEQ ID NO: 1829 - RNA, 21 nt, Homo sapiens
uugaaaggcuauuucuugguc

SEQ ID NO: 1830 - RNA, 20 nt, Homo sapiens
cuacaaagggaagcccuuuc

SEQ ID NO: 1831 - RNA, 22 nt, Homo sapiens
aaaaugguucccuuuagagugu

SEQ ID NO: 1832 - RNA, 22 nt, Homo sapiens
cuacaaagggaagcacuuucuc

SEQ ID NO: 1833 - RNA, 22 nt, Homo sapiens
auucuaauuucuccacgucuuu

SEQ ID NO: 1834 - RNA, 23 nt, Homo sapiens
aaacucuacuuguccuucugagu

SEQ ID NO: 1835 - RNA, 23 nt, Homo sapiens
ucuuugguuaucuagcuguauga

SEQ ID NO: 1836 - RNA, 21 nt, Homo sapiens
uaaagugcugacagugcagau

SEQ ID NO: 1837 - RNA, 23 nt, Homo sapiens
ccugcagcgacuugauggcuucc

SEQ ID NO: 1838 - RNA, 21 nt, Homo sapiens
cccggagccaggaugcagcuc

SEQ ID NO: 1839 - RNA, 21 nt, Homo sapiens
uggcagggaggcugggagggg

SEQ ID NO: 1840 - RNA, 17 nt, Homo sapiens
ucgccuccuccucuccc

SEQ ID NO: 1841 - RNA, 21 nt, Homo sapiens
cggcggggacggcgauugguc

SEQ ID NO: 1842 - RNA, 22 nt, Homo sapiens
cgcaggggccgggugcucaccg

SEQ ID NO: 1843 - RNA, 22 nt, Homo sapiens
ucugcccccuccgcugcugcca

SEQ ID NO: 1844 - RNA, 20 nt, Homo sapiens
acugccccaggugcugcugg

SEQ ID NO: 1845 - RNA, 22 nt, Homo sapiens
uggcagugucuuagcugguugu

SEQ ID NO: 1846 - RNA, 23 nt, Homo sapiens
aggcaguguaguuagcugauugc

SEQ ID NO: 1847 - RNA, 22 nt, Homo sapiens
uggcaguguauuguuagcuggu

SEQ ID NO: 1848 - RNA, 22 nt, Homo sapiens
aggcaguguauuguuagcuggc

SEQ ID NO: 1849 - RNA, 21 nt, Homo sapiens
cggggcagcucaguacaggau

SEQ ID NO: 1850 - RNA, 22 nt, Homo sapiens
uggugggcacagaaucuggacu

SEQ ID NO: 1851 - RNA, 19 nt, Homo sapiens
aggcugcggaauucaggac

SEQ ID NO: 1852 - RNA, 22 nt, Homo sapiens
uggugggccgcagaacaugugc

SEQ ID NO: 1853 - RNA, 22 nt, Homo sapiens
aggcggggcgccgcgggaccgc

SEQ ID NO: 1854 - RNA, 21 nt, Homo sapiens
uggaggagaaggaaggugaug

SEQ ID NO: 1855 - RNA, 23 nt, Homo sapiens
cggcccgggcugcugcuguuccu

SEQ ID NO: 1856 - RNA, 21 nt, Homo sapiens
uggguuuacguugggagaacu

SEQ ID NO: 1857 - RNA, 23 nt, Homo sapiens
cggcccgggcugcugcuguuccu

SEQ ID NO: 1858 - RNA, 22 nt, Homo sapiens
uggagagaaaggcaguuccuga

SEQ ID NO: 1859 - RNA, 21 nt, Homo sapiens
cggcggggacggcgauugguc

SEQ ID NO: 1860 - RNA, 23 nt, Homo sapiens
ugaggggcagagagcgagacuuu

SEQ ID NO: 1861 - RNA, 21 nt, Homo sapiens
uuaagacuugcagugauguuu

SEQ ID NO: 1862 - RNA, 22 nt, Homo sapiens
aucuggagguaagaagcacuuu

SEQ ID NO: 1863 - RNA, 21 nt, Homo sapiens
gaaggcgcuucccuuuggagu

SEQ ID NO: 1864 - RNA, 22 nt, Homo sapiens
gaaggcgcuucccuuuagagcg

SEQ ID NO: 1865 - RNA, 19 nt, Homo sapiens
gggcgccugugaucccaac

SEQ ID NO: 1866 - RNA, 19 nt, Homo sapiens
gggcgccugugaucccaac

SEQ ID NO: 1867 - RNA, 22 nt, Homo sapiens
agacuucccauuugaagguggc

SEQ ID NO: 1868 - RNA, 21 nt, Homo sapiens
aauggcgccacuaggguugug

SEQ ID NO: 1869 - RNA, 24 nt, Homo sapiens
ugccugggucucuggccugcgcgu

SEQ ID NO: 1870 - RNA, 22 nt, Homo sapiens
aggcggggcgccgcgggaccgc

SEQ ID NO: 1871 - RNA, 22 nt, Homo sapiens
aggcggggcgccgcgggaccgc

SEQ ID NO: 1872 - RNA, 20 nt, Homo sapiens
ugagcccuguccucccgcag

SEQ ID NO: 1873 - RNA, 22 nt, Homo sapiens
acgcccuucccccccuucuuca

SEQ ID NO: 1874 - RNA, 21 nt, Homo sapiens
ccuguugaaguguaaucccca

SEQ ID NO: 1875 - RNA, 22 nt, Homo sapiens
uucuggaauucugugugaggga

SEQ ID NO: 1876 - RNA, 22 nt, Homo sapiens
aagcccuuaccccaaaaagcau

SEQ ID NO: 1877 - RNA, 22 nt, Homo sapiens
ucaaaacugaggggcauuuucu

SEQ ID NO: 1878 - RNA, 22 nt, Homo sapiens
uguaacagcaacuccaugugga

SEQ ID NO: 1879 - RNA, 20 nt, Homo sapiens
uguuuugauaacaguaaugu

SEQ ID NO: 1880 - RNA, 22 nt, Homo sapiens
agaucagaaggugauuguggcu

SEQ ID NO: 1881 - RNA, 22 nt, Homo sapiens
uggcagugucuuagcugguugu

SEQ ID NO: 1882 - RNA, 23 nt, Homo sapiens
aggcaguguaguuagcugauugc

SEQ ID NO: 1883 - RNA, 23 nt, Homo sapiens
aucaacagacauuaauugggcgc

SEQ ID NO: 1884 - RNA, 22 nt, Homo sapiens
uggcaguguauuguuagcuggu

SEQ ID NO: 1885 - RNA, 22 nt, Homo sapiens
aggcaguguauuguuagcuggc

SEQ ID NO: 1886 - RNA, 22 nt, Homo sapiens
caaaaaucucaauuacuuuugc

SEQ ID NO: 1887 - RNA, 22 nt, Homo sapiens
ccaaaacugcaguuacuuuugc

SEQ ID NO: 1888 - RNA, 21 nt, Homo sapiens
gcgacccauacuugguuucag

SEQ ID NO: 1889 - RNA, 19 nt, Homo sapiens
ugggcguaucuguaugcua

SEQ ID NO: 1890 - RNA, 21 nt, Homo sapiens
uccgguucucagggcuccacc

SEQ ID NO: 1891 - RNA, 20 nt, Homo sapiens
cggcucugggucugugggga

SEQ ID NO: 1892 - RNA, 22 nt, Homo sapiens
gugaacgggcgccaucccgagg

SEQ ID NO: 1893 - RNA, 20 nt, Homo sapiens
ggggagcuguggaagcagua

SEQ ID NO: 1894 - RNA, 24 nt, Homo sapiens
ucccugagacccuuuaaccuguga

SEQ ID NO: 1895 - RNA, 22 nt, Homo sapiens
ucccugagacccuaacuuguga

SEQ ID NO: 1896 - RNA, 23 nt, Homo sapiens
ccucagggcuguagaacagggcu

SEQ ID NO: 1897 - RNA, 19 nt, Homo sapiens
uggauuuuuggaucaggga

SEQ ID NO: 1898 - RNA, 18 nt, Homo sapiens
cagggaggugaaugugau

SEQ ID NO: 1899 - RNA, 22 nt, Homo sapiens
cccugugcccggcccacuucug

SEQ ID NO: 1900 - RNA, 21 nt, Homo sapiens
uucacaguggcuaaguucugc

SEQ ID NO: 1901 - RNA, 22 nt, Homo sapiens
aacaauauccuggugcugagug

SEQ ID NO: 1902 - RNA, 23 nt, Homo sapiens
acuucaccugguccacuagccgu

SEQ ID NO: 1903 - RNA, 22 nt, Homo sapiens
aggcaguguauuguuagcuggc

SEQ ID NO: 1904 - RNA, 22 nt, Homo sapiens
ugaaggucuacugugugccagg

SEQ ID NO: 1905 - RNA, 22 nt, Homo sapiens
caaaaaucucaauuacuuuugc

SEQ ID NO: 1906 - RNA, 23 nt, Homo sapiens
uauucauuuauccccagccuaca

SEQ ID NO: 1907 - RNA, 20 nt, Homo sapiens
guagaggagauggcgcaggg

SEQ ID NO: 1908 - RNA, 22 nt, Homo sapiens
ucguaccgugaguaauaaugcg

SEQ ID NO: 1909 - RNA, 23 nt, Homo sapiens
aacauucaacgcugucggugagu

SEQ ID NO: 1910 - RNA, 23 nt, Homo sapiens
aacauucauugcugucggugggu

SEQ ID NO: 1911 - RNA, 22 nt, Homo sapiens
aacauucaaccugucggugagu

SEQ ID NO: 1912 - RNA, 23 nt, Homo sapiens
aacauucauuguugucggugggu

SEQ ID NO: 1913 - RNA, 22 nt, Homo sapiens
caaagaauucuccuuuugggcu

SEQ ID NO: 1914 - RNA, 22 nt, Homo sapiens
uagcuuaucagacugauguuga

SEQ ID NO: 1915 - RNA, 21 nt, Homo sapiens
aucacauugccagggauuucc

SEQ ID NO: 1916 - RNA, 21 nt, Homo sapiens
aucacauugccagggauuacc

SEQ ID NO: 1917 - RNA, 22 nt, Homo sapiens
aaaagcuggguugagagggcga

SEQ ID NO: 1918 - RNA, 22 nt, Homo sapiens
aaaagcuggguugagagggcaa

SEQ ID NO: 1919 - RNA, 20 nt, Homo sapiens
aaaagcuggguugagagggu

SEQ ID NO: 1920 - RNA, 19 nt, Homo sapiens
aaaagcuggguugagagga

SEQ ID NO: 1921 - RNA, 21 nt, Homo sapiens
gugcauuguaguugcauugca

SEQ ID NO: 1922 - RNA, 22 nt, Homo sapiens
ggagaaauuauccuuggugugu

SEQ ID NO: 1923 - RNA, 22 nt, Homo sapiens
aaacauucgcggugcacuucuu

SEQ ID NO: 1924 - RNA, 23 nt, Homo sapiens
uucauuugguauaaaccgcgauu

SEQ ID NO: 1925 - RNA, 21 nt, Homo sapiens
uuggccacaauggguuagaac

SEQ ID NO: 1926 - RNA, 23 nt, Homo sapiens
cuaauaguaucuaccacaauaaa

SEQ ID NO: 1927 - RNA, 19 nt, Homo sapiens
ucuaggcugguacugcuga

SEQ ID NO: 1928 - RNA, 23 nt, Homo sapiens
uauucauuuauccccagccuaca

SEQ ID NO: 1929 - RNA, 21 nt, Homo sapiens
ccuguugaaguguaaucccca

SEQ ID NO: 1930 - RNA, 23 nt, Homo sapiens
uauggcuuuuuauuccuauguga

SEQ ID NO: 1931 - RNA, 23 nt, Homo sapiens
uauggcuuuucauuccuauguga

SEQ ID NO: 1932 - RNA, 20 nt, Homo sapiens
ggggagcuguggaagcagua

SEQ ID NO: 1933 - RNA, 24 nt, Homo sapiens
agcagaagcagggagguucuccca

SEQ ID NO: 1934 - RNA, 22 nt, Homo sapiens
uagcaccaucugaaaucgguua

SEQ ID NO: 1935 - RNA, 23 nt, Homo sapiens
aucaacagacauuaauugggcgc

SEQ ID NO: 1936 - RNA, 22 nt, Homo sapiens
agaggcuggccgugaugaauuc

SEQ ID NO: 1937 - RNA, 23 nt, Homo sapiens
uaaauuucaccuuucugagaagg

SEQ ID NO: 1938 - RNA, 23 nt, Homo sapiens
uaaauuucaccuuucugagaagg

SEQ ID NO: 1939 - RNA, 22 nt, Homo sapiens
ggagaaauuauccuuggugugu

SEQ ID NO: 1940 - RNA, 22 nt, Homo sapiens
ggagaaauuauccuuggugugu

SEQ ID NO: 1941 - RNA, 21 nt, Homo sapiens
uggguuuacguugggagaacu

SEQ ID NO: 1942 - RNA, 21 nt, Homo sapiens
guguugaaacaaucucuacug

SEQ ID NO: 1943 - RNA, 17 nt, Homo sapiens
ucucgcuggggccucca

SEQ ID NO: 1944 - RNA, 22 nt, Homo sapiens
uucuggaauucugugugaggga

SEQ ID NO: 1945 - RNA, 20 nt, Homo sapiens
guguguggaaaugcuucugc

SEQ ID NO: 1946 - RNA, 23 nt, Homo sapiens
ucuggcuccgugucuucacuccc

SEQ ID NO: 1947 - RNA, 21 nt, Homo sapiens
cucccacaugcaggguuugca

SEQ ID NO: 1948 - RNA, 22 nt, Homo sapiens
gaggguuggguggaggcucucc

SEQ ID NO: 1949 - RNA, 22 nt, Homo sapiens
uguaaacauccuacacucagcu

SEQ ID NO: 1950 - RNA, 22 nt, Homo sapiens
uccagcaucagugauuuuguug

SEQ ID NO: 1951 - RNA, 22 nt, Homo sapiens
agaggcuggccgugaugaauuc

SEQ ID NO: 1952 - RNA, 23 nt, Homo sapiens
caaagcgcuucucuuuagagugu

SEQ ID NO: 1953 - RNA, 21 nt, Homo sapiens
cuccagagggaaguacuuucu

SEQ ID NO: 1954 - RNA, 21 nt, Homo sapiens
cuccagagggaugcacuuucu

SEQ ID NO: 1955 - RNA, 22 nt, Homo sapiens
ccucccacacccaaggcuugca

SEQ ID NO: 1956 - RNA, 23 nt, Homo sapiens
ugagugugugugugugagugugu

SEQ ID NO: 1957 - RNA, 22 nt, Homo sapiens
cacacacugcaauuacuuuugc

SEQ ID NO: 1958 - RNA, 21 nt, Homo sapiens
uggaggagaaggaaggugaug

SEQ ID NO: 1959 - RNA, 20 nt, Homo sapiens
uaaagagcccuguggagaca

SEQ ID NO: 1960 - RNA, 22 nt, Homo sapiens
cagugcaaugaugaaagggcau

SEQ ID NO: 1961 - RNA, 21 nt, Homo sapiens
gccccugggccuauccuagaa

SEQ ID NO: 1962 - RNA, 23 nt, Homo sapiens
ucccccaggugugauucugauuu

SEQ ID NO: 1963 - RNA, 25 nt, Homo sapiens
aggggugguguugggacagcuccgu

SEQ ID NO: 1964 - RNA, 24 nt, Homo sapiens
acugggggcuuucgggcucugcgu

SEQ ID NO: 1965 - RNA, 21 nt, Homo sapiens
cgcgggugcuuacugacccuu

SEQ ID NO: 1966 - RNA, 20 nt, Homo sapiens
ggggagcuguggaagcagua

SEQ ID NO: 1967 - RNA, 23 nt, Homo sapiens
caagucuuauuugagcaccuguu

SEQ ID NO: 1968 - RNA, 22 nt, Homo sapiens
uucuggaauucugugugaggga

SEQ ID NO: 1969 - RNA, 20 nt, Homo sapiens
uacaguauagaugauguacu

SEQ ID NO: 1970 - RNA, 23 nt, Homo sapiens
guguuaauuaaaccucuauuuac

SEQ ID NO: 1971 - RNA, 23 nt, Homo sapiens
cuguaauauaaauuuaauuuauu

SEQ ID NO: 1972 - RNA, 21 nt, Homo sapiens
gugcauuguaguugcauugca

SEQ ID NO: 1973 - RNA, 21 nt, Homo sapiens
auugacacuucugugaguaga

SEQ ID NO: 1974 - RNA, 21 nt, Homo sapiens
aauauuauacagucaaccucu

SEQ ID NO: 1975 - RNA, 21 nt, Homo sapiens
ccuggaaacacugagguugug

SEQ ID NO: 1976 - RNA, 22 nt, Homo sapiens
cuccugagccauucugagccuc

SEQ ID NO: 1977 - RNA, 21 nt, Homo sapiens
auauaugaugacuuagcuuuu

SEQ ID NO: 1978 - RNA, 22 nt, Homo sapiens
cuuggcaccuagcaagcacuca

SEQ ID NO: 1979 - RNA, 22 nt, Homo sapiens
ugauauguuugauauauuaggu

SEQ ID NO: 1980 - RNA, 22 nt, Homo sapiens
uagguaguuuccuguuguuggg

SEQ ID NO: 1981 - RNA, 22 nt, Homo sapiens
uaaucucagcuggcaacuguga

SEQ ID NO: 1982 - RNA, 22 nt, Homo sapiens
aaggagcucacagucuauugag

SEQ ID NO: 1983 - RNA, 23 nt, Homo sapiens
ucaagagcaauaacgaaaaaugu

SEQ ID NO: 1984 - RNA, 22 nt, Homo sapiens
ucaggcucaguccccucccgau

SEQ ID NO: 1985 - RNA, 24 nt, Homo sapiens
uucuccaaaagaaagcacuuucug

SEQ ID NO: 1986 - RNA, 20 nt, Homo sapiens
uaaggcacgcggugaaugcc

SEQ ID NO: 1987 - RNA, 22 nt, Homo sapiens
cucuagagggaagcacuuucug

SEQ ID NO: 1988 - RNA, 21 nt, Homo sapiens
aaagcgcuucccuucagagug

SEQ ID NO: 1989 - RNA, 21 nt, Homo sapiens
gaaagcgcuucucuuuagagg

SEQ ID NO: 1990 - RNA, 22 nt, Homo sapiens
aaagugcauccuuuuagagugu

SEQ ID NO: 1991 - RNA, 22 nt, Homo sapiens
cucuagagggaagcgcuuucug

SEQ ID NO: 1992 - RNA, 22 nt, Homo sapiens
cucuagagggaagcgcuuucug

SEQ ID NO: 1993 - RNA, 22 nt, Homo sapiens
aagugccuccuuuuagaguguu

SEQ ID NO: 1994 - RNA, 22 nt, Homo sapiens
cucuagagggaagcacuuucug

SEQ ID NO: 1995 - RNA, 22 nt, Homo sapiens
aaaaugguucccuuuagagugu

SEQ ID NO: 1996 - RNA, 23 nt, Homo sapiens
gaacgcgcuucccuauagagggu

SEQ ID NO: 1997 - RNA, 22 nt, Homo sapiens
cucuagagggaagcacuuucug

SEQ ID NO: 1998 - RNA, 21 nt, Homo sapiens
ugagcuaaaugugugcuggga

SEQ ID NO: 1999 - RNA, 23 nt, Homo sapiens
aaggagcuuacaaucuagcuggg

SEQ ID NO: 2000 - RNA, 22 nt, Homo sapiens
caaagugccucccuuuagagug

SEQ ID NO: 2001 - RNA, 23 nt, Homo sapiens
uuuggcacuagcacauuuuugcu

SEQ ID NO: 2002 - RNA, 26 nt, Homo sapiens
gaugaugauggcagcaaauucugaaa

SEQ ID NO: 2003 - RNA, 23 nt, Homo sapiens
uacccuguagauccgaauuugug

SEQ ID NO: 2004 - RNA, 21 nt, Homo sapiens
uggacugcccugaucuggaga

SEQ ID NO: 2005 - RNA, 17 nt, Homo sapiens
uucaaguaauucaggug

SEQ ID NO: 2006 - RNA, 21 nt, Homo sapiens
ccaguccugugccugccgccu

SEQ ID NO: 2007 - RNA, 23 nt, Homo sapiens
uaaagugcuuauagugcagguag

SEQ ID NO: 2008 - RNA, 22 nt, Homo sapiens
uuggggaaacggccgcugagug

SEQ ID NO: 2009 - RNA, 23 nt, Homo sapiens
uacugcaucaggaacugauugga

SEQ ID NO: 2010 - RNA, 22 nt, Homo sapiens
uucaaguaauccaggauaggcu

SEQ ID NO: 2011 - RNA, 21 nt, Homo sapiens
uucaaguaauucaggauaggu

SEQ ID NO: 2012 - RNA, 22 nt, Homo sapiens
caaccuggaggacuccaugcug

SEQ ID NO: 2013 - RNA, 22 nt, Homo sapiens
aaaaguauuugcggguuuuguc

SEQ ID NO: 2014 - RNA, 22 nt, Homo sapiens
caaaaguaauuguggauuuugu

SEQ ID NO: 2015 - RNA, 22 nt, Homo sapiens
caaaguuuaagauccuugaagu

SEQ ID NO: 2016 - RNA, 20 nt, Homo sapiens
accaggaggcugaggccccu

SEQ ID NO: 2017 - RNA, 20 nt, Homo sapiens
agaccauggguucucauugu

SEQ ID NO: 2018 - RNA, 22 nt, Homo sapiens
uggagugugacaaugguguuug

SEQ ID NO: 2019 - RNA, 21 nt, Homo sapiens
uuaauaucggacaaccauugu

SEQ ID NO: 2020 - RNA, 20 nt, Homo sapiens
uaaggcacgcggugaaugcc

SEQ ID NO: 2021 - RNA, 21 nt, Homo sapiens
cucccacaugcaggguuugca

SEQ ID NO: 2022 - RNA, 22 nt, Homo sapiens
aacuggccuacaaagucccagu

SEQ ID NO: 2023 - RNA, 22 nt, Homo sapiens
aacuggcccucaaagucccgcu

SEQ ID NO: 2024 - RNA, 20 nt, Homo sapiens
gugcauugcuguugcauugc

SEQ ID NO: 2025 - RNA, 22 nt, Homo sapiens
aauccuuugucccugggugaga

SEQ ID NO: 2026 - RNA, 21 nt, Homo sapiens
uaaggcacccuucugaguaga

SEQ ID NO: 2027 - RNA, 22 nt, Homo sapiens
gagugccuucuuuuggagcguu

SEQ ID NO: 2028 - RNA, 22 nt, Homo sapiens
aagugccuccuuuuagaguguu

SEQ ID NO: 2029 - RNA, 21 nt, Homo sapiens
cacaagguauugguauuaccu

SEQ ID NO: 2030 - RNA, 23 nt, Homo sapiens
uccaguaccacgugucagggcca

SEQ ID NO: 2031 - RNA, 22 nt, Homo sapiens
ucuucucuguuuuggccaugug

SEQ ID NO: 2032 - RNA, 22 nt, Homo sapiens
cuuggcaccuagcaagcacuca

SEQ ID NO: 2033 - RNA, 22 nt, Homo sapiens
uagcagcacaucaugguuuaca

SEQ ID NO: 2034 - RNA, 22 nt, Homo sapiens
caaagaauucuccuuuugggcu

SEQ ID NO: 2035 - RNA, 20 nt, Homo sapiens
ccccagggcgacgcggcggg

SEQ ID NO: 2036 - RNA, 22 nt, Homo sapiens
uuauaaagcaaugagacugauu

SEQ ID NO: 2037 - RNA, 22 nt, Homo sapiens
caaucacuaacuccacugccau

SEQ ID NO: 2038 - RNA, 23 nt, Homo sapiens
gcagcagagaauaggacuacguc

SEQ ID NO: 2039 - RNA, 23 nt, Homo sapiens
uuuggcacuagcacauuuuugcu

SEQ ID NO: 2040 - RNA, 22 nt, Homo sapiens
ugagccccugugccgcccccag

SEQ ID NO: 2041 - RNA, 22 nt, Homo sapiens
acaggugagguucuugggagcc

SEQ ID NO: 2042 - RNA, 20 nt, Homo sapiens
guguguggaaaugcuucugc

SEQ ID NO: 2043 - RNA, 22 nt, Homo sapiens
gugugcggaaaugcuucugcua

SEQ ID NO: 2044 - RNA, 23 nt, Homo sapiens
cggcccgggcugcugcuguuccu

SEQ ID NO: 2045 - RNA, 24 nt, Homo sapiens
uuuggcaaugguagaacucacacu

SEQ ID NO: 2046 - RNA, 20 nt, Homo sapiens
ccccagggcgacgcggcggg

SEQ ID NO: 2047 - RNA, 22 nt, Homo sapiens
uucccuuugucauccuaugccu

SEQ ID NO: 2048 - RNA, 22 nt, Homo sapiens
uucccuuugucauccuucgccu

SEQ ID NO: 2049 - RNA, 22 nt, Homo sapiens
acagcaggcacagacaggcagu

SEQ ID NO: 2050 - RNA, 21 nt, Homo sapiens
gccccugggccuauccuagaa

SEQ ID NO: 2051 - RNA, 22 nt, Homo sapiens
uuauaaagcaaugagacugauu

SEQ ID NO: 2052 - RNA, 22 nt, Homo sapiens
uggcagugucuuagcugguugu

SEQ ID NO: 2053 - RNA, 23 nt, Homo sapiens
aggcaguguaguuagcugauugc

SEQ ID NO: 2054 - RNA, 22 nt, Homo sapiens
gccugcugggguggaaccuggu

SEQ ID NO: 2055 - RNA, 22 nt, Homo sapiens
uggcaguguauuguuagcuggu

SEQ ID NO: 2056 - RNA, 22 nt, Homo sapiens
aggcaguguauuguuagcuggc

SEQ ID NO: 2057 - RNA, 23 nt, Homo sapiens
aggaccugcgggacaagauucuu

SEQ ID NO: 2058 - RNA, 18 nt, Homo sapiens
ugcuuccuuucagagggu

SEQ ID NO: 2059 - RNA, 22 nt, Homo sapiens
aucuggagguaagaagcacuuu

SEQ ID NO: 2060 - RNA, 22 nt, Homo sapiens
cacgcucaugcacacacccaca

SEQ ID NO: 2061 - RNA, 20 nt, Homo sapiens
guagaggagauggcgcaggg

SEQ ID NO: 2062 - RNA, 22 nt, Homo sapiens
aggcagcgggguguaguggaua

SEQ ID NO: 2063 - RNA, 22 nt, Homo sapiens
ucaccagcccuguguucccuag

SEQ ID NO: 2064 - RNA, 22 nt, Homo sapiens
uggagugugacaaugguguuug

SEQ ID NO: 2065 - RNA, 18 nt, Homo sapiens
aucccaccucugccacca

SEQ ID NO: 2066 - RNA, 22 nt, Homo sapiens
uuagggcccuggcuccaucucc

SEQ ID NO: 2067 - RNA, 23 nt, Homo sapiens
agcugguguugugaaucaggccg

SEQ ID NO: 2068 - RNA, 20 nt, Homo sapiens
uacaguauagaugauguacu

SEQ ID NO: 2069 - RNA, 23 nt, Homo sapiens
guccaguuuucccaggaaucccu

SEQ ID NO: 2070 - RNA, 22 nt, Homo sapiens
aaaaccgucuaguuacaguugu

SEQ ID NO: 2071 - RNA, 20 nt, Homo sapiens
uguuuugauaacaguaaugu

SEQ ID NO: 2072 - RNA, 23 nt, Homo sapiens
uaagugcuuccauguuuuaguag

SEQ ID NO: 2073 - RNA, 23 nt, Homo sapiens
uaagugcuuccauguuugagugu

SEQ ID NO: 2074 - RNA, 22 nt, Homo sapiens
aaaccguuaccauuacugaguu

SEQ ID NO: 2075 - RNA, 22 nt, Homo sapiens
aacuguuugcagaggaaacuga

SEQ ID NO: 2076 - RNA, 22 nt, Homo sapiens
ccucccacacccaaggcuugca

SEQ ID NO: 2077 - RNA, 21 nt, Homo sapiens
gcgacccauacuugguuucag

SEQ ID NO: 2078 - RNA, 21 nt, Homo sapiens
aaaacggugagauuuuguuuu

SEQ ID NO: 2079 - RNA, 21 nt, Homo sapiens
uggaggagaaggaaggugaug

SEQ ID NO: 2080 - RNA, 21 nt, Homo sapiens
uggcagggaggcugggagggg

SEQ ID NO: 2081 - RNA, 22 nt, Homo sapiens
uggagugugacaaugguguuug

SEQ ID NO: 2082 - RNA, 23 nt, Homo sapiens
ucuggcuccgugucuucacuccc

SEQ ID NO: 2083 - RNA, 21 nt, Homo sapiens
cggcggggacggcgauugguc

SEQ ID NO: 2084 - RNA, 22 nt, Homo sapiens
cgcaggggccgggugcucaccg

SEQ ID NO: 2085 - RNA, 24 nt, Homo sapiens
uucuccaaaagaaagcacuuucug

SEQ ID NO: 2086 - RNA, 22 nt, Homo sapiens
aagugccuccuuuuagaguguu

SEQ ID NO: 2087 - RNA, 21 nt, Homo sapiens
agggggaaaguucuauagucc

SEQ ID NO: 2088 - RNA, 21 nt, Homo sapiens
uggguuuacguugggagaacu

SEQ ID NO: 2089 - RNA, 22 nt, Homo sapiens
aggcggggcgccgcgggaccgc

SEQ ID NO: 2090 - RNA, 21 nt, Homo sapiens
aaggcagggcccccgcucccc

SEQ ID NO: 2091 - RNA, 21 nt, Homo sapiens
uaggacacauggucuacuucu

SEQ ID NO: 2092 - RNA, 18 nt, Homo sapiens
cgggcguggugguggggg

SEQ ID NO: 2093 - RNA, 22 nt, Homo sapiens
cucggcgcggggcgcgggcucc

SEQ ID NO: 2094 - RNA, 23 nt, Homo sapiens
ucuggcuccgugucuucacuccc

SEQ ID NO: 2095 - RNA, 22 nt, Homo sapiens
ucucccaacccuuguaccagug

SEQ ID NO: 2096 - RNA, 23 nt, Homo sapiens
cggcccgggcugcugcuguuccu

SEQ ID NO: 2097 - RNA, 22 nt, Homo sapiens
uguaaacauccuacacucagcu

SEQ ID NO: 2098 - RNA, 21 nt, Homo sapiens
ucacuccucuccucccgucuu

SEQ ID NO: 2099 - RNA, 25 nt, Homo sapiens
aggggugguguugggacagcuccgu

SEQ ID NO: 2100 - RNA, 22 nt, Homo sapiens
gguggcccggccgugccugagg

SEQ ID NO: 2101 - RNA, 20 nt, Homo sapiens
accaggaggcugaggccccu

SEQ ID NO: 2102 - RNA, 23 nt, Homo sapiens
cgggucggaguuagcucaagcgg

SEQ ID NO: 2103 - RNA, 22 nt, Homo sapiens
caaagugccucccuuuagagug

SEQ ID NO: 2104 - RNA, 23 nt, Homo sapiens
aaaagugcuuacagugcagguag

SEQ ID NO: 2105 - RNA, 19 nt, Homo sapiens
uggauuuuuggaucaggga

SEQ ID NO: 2106 - RNA, 22 nt, Homo sapiens
uggagagaaaggcaguuccuga

SEQ ID NO: 2107 - RNA, 21 nt, Homo sapiens
cucccacaugcaggguuugca

SEQ ID NO: 2108 - RNA, 22 nt, Homo sapiens
uaugugggaugguaaaccgcuu

SEQ ID NO: 2109 - RNA, 22 nt, Homo sapiens
uggcagugucuuagcugguugu

SEQ ID NO: 2110 - RNA, 23 nt, Homo sapiens
uaaaucccauggugccuucuccu

SEQ ID NO: 2111 - RNA, 22 nt, Homo sapiens
gugagucucuaagaaaagagga

SEQ ID NO: 2112 - RNA, 21 nt, Homo sapiens
cgcgggugcuuacugacccuu

SEQ ID NO: 2113 - RNA, 20 nt, Homo sapiens
ggggagcuguggaagcagua

SEQ ID NO: 2114 - RNA, 22 nt, Homo sapiens
cuccugagccauucugagccuc

SEQ ID NO: 2115 - RNA, 22 nt, Homo sapiens
acaggugagguucuugggagcc

SEQ ID NO: 2116 - RNA, 22 nt, Homo sapiens
uucaccaccuucuccacccagc

SEQ ID NO: 2117 - RNA, 21 nt, Homo sapiens
uucaaguaauucaggauaggu

SEQ ID NO: 2118 - RNA, 22 nt, Homo sapiens
uguaaacauccucgacuggaag

SEQ ID NO: 2119 - RNA, 22 nt, Homo sapiens
uguaaacauccuacacucagcu

SEQ ID NO: 2120 - RNA, 23 nt, Homo sapiens
uguaaacauccuacacucucagc

SEQ ID NO: 2121 - RNA, 22 nt, Homo sapiens
uguaaacauccccgacuggaag

SEQ ID NO: 2122 - RNA, 22 nt, Homo sapiens
uguaaacauccuugacuggaag

SEQ ID NO: 2123 - RNA, 22 nt, Homo sapiens
uacucaggagaguggcaaucac

SEQ ID NO: 2124 - RNA, 21 nt, Homo sapiens
aacaggugacugguuagacaa

SEQ ID NO: 2125 - RNA, 22 nt, Homo sapiens
ugagaaccacgucugcucugag

SEQ ID NO: 2126 - RNA, 23 nt, Homo sapiens
ucaaaugcucagacuccuguggu

SEQ ID NO: 2127 - RNA, 21 nt, Homo sapiens
cuuuuugcggucugggcuugc

SEQ ID NO: 2128 - RNA, 23 nt, Homo sapiens
uauggcuuuuuauuccuauguga

SEQ ID NO: 2129 - RNA, 20 nt, Homo sapiens
ggggagcuguggaagcagua

SEQ ID NO: 2130 - RNA, 21 nt, Homo sapiens
auuugugcuuggcucugucac

SEQ ID NO: 2131 - RNA, 22 nt, Homo sapiens
acacagggcuguugugaagacu

SEQ ID NO: 2132 - RNA, 23 nt, Homo sapiens
gcaaagcacacggccugcagaga

SEQ ID NO: 2133 - RNA, 22 nt, Homo sapiens
uaaugccccuaaaaauccuuau

SEQ ID NO: 2134 - RNA, 22 nt, Homo sapiens
cuuaugcaagauucccuucuac

SEQ ID NO: 2135 - RNA, 22 nt, Homo sapiens
aaaaguaauugcgaguuuuacc

SEQ ID NO: 2136 - RNA, 22 nt, Homo sapiens
aaaaguaauugugguuuuggcc

SEQ ID NO: 2137 - RNA, 22 nt, Homo sapiens
aaaaguaauugcgguuuuugcc

SEQ ID NO: 2138 - RNA, 22 nt, Homo sapiens
aaaaguaauugugguuuuugcc

SEQ ID NO: 2139 - RNA, 22 nt, Homo sapiens
aaaaguaaucgcgguuuuuguc

SEQ ID NO: 2140 - RNA, 22 nt, Homo sapiens
aaaaguaauugcggauuuugcc

SEQ ID NO: 2141 - RNA, 22 nt, Homo sapiens
aaaaguaauugcggucuuuggu

SEQ ID NO: 2142 - RNA, 22 nt, Homo sapiens
uagcaaaaacugcaguuacuuu

SEQ ID NO: 2143 - RNA, 21 nt, Homo sapiens
uaaaguaaauaugcaccaaaa

SEQ ID NO: 2144 - RNA, 23 nt, Homo sapiens
aguauguucuuccaggacagaac

SEQ ID NO: 2145 - RNA, 23 nt, Homo sapiens
caguaacaaagauucauccuugu

SEQ ID NO: 2146 - RNA, 22 nt, Homo sapiens
ucuucucuguuuuggccaugug

SEQ ID NO: 2147 - RNA, 21 nt, Homo sapiens
gugccagcugcagugggggag

SEQ ID NO: 2148 - RNA, 21 nt, Homo sapiens
acggugcuggauguggccuuu

SEQ ID NO: 2149 - RNA, 17 nt, Homo sapiens
gugggggagaggcuguc

SEQ ID NO: 2150 - RNA, 17 nt, Homo sapiens
ucgccuccuccucuccc

SEQ ID NO: 2151 - RNA, 22 nt, Homo sapiens
caaagaauucuccuuuugggcu

SEQ ID NO: 2152 - RNA, 21 nt, Homo sapiens
auuugugcuuggcucugucac

SEQ ID NO: 2153 - RNA, 23 nt, Homo sapiens
uaagugcuuccauguuuugguga

SEQ ID NO: 2154 - RNA, 23 nt, Homo sapiens
uaagugcuuccauguuuuaguag

SEQ ID NO: 2155 - RNA, 23 nt, Homo sapiens
uaagugcuuccauguuucagugg

SEQ ID NO: 2156 - RNA, 23 nt, Homo sapiens
uaagugcuuccauguuugagugu

SEQ ID NO: 2157 - RNA, 17 nt, Homo sapiens
uaagugcuuccaugcuu

SEQ ID NO: 2158 - RNA, 23 nt, Homo sapiens
aaagugcugcgacauuugagcgu

SEQ ID NO: 2159 - RNA, 23 nt, Homo sapiens
gaagugcuucgauuuuggggugu

SEQ ID NO: 2160 - RNA, 22 nt, Homo sapiens
aagugcugucauagcugagguc

SEQ ID NO: 2161 - RNA, 22 nt, Homo sapiens
aaagugcuucccuuuggacugu

SEQ ID NO: 2162 - RNA, 21 nt, Homo sapiens
aaagugcuuccuuuuagaggg

SEQ ID NO: 2163 - RNA, 22 nt, Homo sapiens
aaagugcuuccuuuuagagggu

SEQ ID NO: 2164 - RNA, 22 nt, Homo sapiens
aaagugcuucucuuuggugggu

SEQ ID NO: 2165 - RNA, 21 nt, Homo sapiens
aaagugcuuccuuuuugaggg

SEQ ID NO: 2166 - RNA, 22 nt, Homo sapiens
uugugucaauaugcgaugaugu

SEQ ID NO: 2167 - RNA, 22 nt, Homo sapiens
ugugucacucgaugaccacugu

SEQ ID NO: 2168 - RNA, 20 nt, Homo sapiens
guugugucaguuuaucaaac

SEQ ID NO: 2169 - RNA, 21 nt, Homo sapiens
agaccuggcccagaccucagc

SEQ ID NO: 2170 - RNA, 21 nt, Homo sapiens
cccggagccaggaugcagcuc

SEQ ID NO: 2171 - RNA, 23 nt, Homo sapiens
ucuggcuccgugucuucacuccc

SEQ ID NO: 2172 - RNA, 22 nt, Homo sapiens
agaggcuggccgugaugaauuc

SEQ ID NO: 2173 - RNA, 19 nt, Homo sapiens
aggcugcggaauucaggac

SEQ ID NO: 2174 - RNA, 22 nt, Homo sapiens
acuccagccccacagccucagc

SEQ ID NO: 2175 - RNA, 22 nt, Homo sapiens
auccgcgcucugacucucugcc

SEQ ID NO: 2176 - RNA, 24 nt, Homo sapiens
uggggagcugaggcucugggggug

SEQ ID NO: 2177 - RNA, 22 nt, Homo sapiens
uggaauguaaagaaguauguau

SEQ ID NO: 2178 - RNA, 23 nt, Homo sapiens
gagggucuugggagggaugugac

SEQ ID NO: 2179 - RNA, 21 nt, Homo sapiens
ccccaccuccucucuccucag

SEQ ID NO: 2180 - RNA, 22 nt, Homo sapiens
uggguggucuggagauuugugc

SEQ ID NO: 2181 - RNA, 22 nt, Homo sapiens
uagcagcacauaaugguuugug

SEQ ID NO: 2182 - RNA, 22 nt, Homo sapiens
uagcagcacaucaugguuuaca

SEQ ID NO: 2183 - RNA, 22 nt, Homo sapiens
uagcagcacguaaauauuggcg

SEQ ID NO: 2184 - RNA, 22 nt, Homo sapiens
aacuguuugcagaggaaacuga

SEQ ID NO: 2185 - RNA, 22 nt, Homo sapiens
aacuguuugcagaggaaacuga

SEQ ID NO: 2186 - RNA, 21 nt, Homo sapiens
uagcagcacagaaauauuggc

SEQ ID NO: 2187 - RNA, 21 nt, Homo sapiens
uagcagcacagaaauauuggc

SEQ ID NO: 2188 - RNA, 21 nt, Homo sapiens
uagcagcacagaaauauuggc

SEQ ID NO: 2189 - RNA, 22 nt, Homo sapiens
uggaauguaaggaagugugugg

SEQ ID NO: 2190 - RNA, 21 nt, Homo sapiens
ccaccaccgugucugacacuu

SEQ ID NO: 2191 - RNA, 22 nt, Homo sapiens
uagcaccaucugaaaucgguua

SEQ ID NO: 2192 - RNA, 23 nt, Homo sapiens
uagcaccauuugaaaucaguguu

SEQ ID NO: 2193 - RNA, 22 nt, Homo sapiens
uagcaccauuugaaaucgguua

SEQ ID NO: 2194 - RNA, 21 nt, Homo sapiens
uaaagugcugacagugcagau

SEQ ID NO: 2195 - RNA, 23 nt, Homo sapiens
cagugcaaugauauugucaaagc

SEQ ID NO: 2196 - RNA, 22 nt, Homo sapiens
uggcagugucuuagcugguugu

SEQ ID NO: 2197 - RNA, 22 nt, Homo sapiens
uauguaauaugguccacaucuu

SEQ ID NO: 2198 - RNA, 22 nt, Homo sapiens
cagcagcaauucauguuuugaa

SEQ ID NO: 2199 - RNA, 21 nt, Homo sapiens
cagcagcacacugugguuugu

SEQ ID NO: 2200 - RNA, 21 nt, Homo sapiens
ugaguuggccaucugagugag

SEQ ID NO: 2201 - RNA, 25 nt, Homo sapiens
aggggugguguugggacagcuccgu

SEQ ID NO: 2202 - RNA, 20 nt, Homo sapiens
aggaauguuccuucuuugcc

SEQ ID NO: 2203 - RNA, 23 nt, Homo sapiens
aaacucuacuuguccuucugagu

SEQ ID NO: 2204 - RNA, 19 nt, Homo sapiens
agcugucugaaaaugucuu

SEQ ID NO: 2205 - RNA, 20 nt, Homo sapiens
ggggagcuguggaagcagua

SEQ ID NO: 2206 - RNA, 22 nt, Homo sapiens
acaguagagggaggaaucgcag

SEQ ID NO: 2207 - RNA, 22 nt, Homo sapiens
ugagguaguagguuguauaguu

SEQ ID NO: 2208 - RNA, 22 nt, Homo sapiens
ugagguaguagguugugugguu

SEQ ID NO: 2209 - RNA, 22 nt, Homo sapiens
ugagguaguagguuguaugguu

SEQ ID NO: 2210 - RNA, 22 nt, Homo sapiens
agagguaguagguugcauaguu

SEQ ID NO: 2211 - RNA, 22 nt, Homo sapiens
ugagguaggagguuguauaguu

SEQ ID NO: 2212 - RNA, 22 nt, Homo sapiens
ugagguaguagauuguauaguu

SEQ ID NO: 2213 - RNA, 22 nt, Homo sapiens
ugagguaguaguuuguacaguu

SEQ ID NO: 2214 - RNA, 22 nt, Homo sapiens
ugagguaguaguuugugcuguu

SEQ ID NO: 2215 - RNA, 21 nt, Homo sapiens
uggcagggaggcugggagggg

SEQ ID NO: 2216 - RNA, 18 nt, Homo sapiens
cgggcguggugguggggg

SEQ ID NO: 2217 - RNA, 22 nt, Homo sapiens
ucugggcaacaaagugagaccu

SEQ ID NO: 2218 - RNA, 19 nt, Homo sapiens
uggauuuuuggaucaggga

SEQ ID NO: 2219 - RNA, 22 nt, Homo sapiens
uguaacagcaacuccaugugga

SEQ ID NO: 2220 - RNA, 21 nt, Homo sapiens
aggggugcuaucugugauuga

SEQ ID NO: 2221 - RNA, 22 nt, Homo sapiens
gcugacuccuaguccagggcuc

SEQ ID NO: 2222 - RNA, 22 nt, Homo sapiens
uaaugccccuaaaaauccuuau

SEQ ID NO: 2223 - RNA, 25 nt, Homo sapiens
aggggugguguugggacagcuccgu

SEQ ID NO: 2224 - RNA, 25 nt, Homo sapiens
gcugggcagggcuucugagcuccuu

SEQ ID NO: 2225 - RNA, 21 nt, Homo sapiens
uggguuuacguugggagaacu

SEQ ID NO: 2226 - RNA, 20 nt, Homo sapiens
ggggagcuguggaagcagua

SEQ ID NO: 2227 - RNA, 21 nt, Homo sapiens
aaggcagggcccccgcucccc

SEQ ID NO: 2228 - RNA, 22 nt, Homo sapiens
ugagguaguaaguuguauuguu

SEQ ID NO: 2229 - RNA, 22 nt, Homo sapiens
ucggccugaccacccaccccac

SEQ ID NO: 2230 - RNA, 24 nt, Homo sapiens
agccuggaagcuggagccugcagu

SEQ ID NO: 2231 - RNA, 18 nt, Homo sapiens
gucccuguucaggcgcca

SEQ ID NO: 2232 - RNA, 17 nt, Homo sapiens
gugggggagaggcuguc

SEQ ID NO: 2233 - RNA, 20 nt, Homo sapiens
uaaagagcccuguggagaca

SEQ ID NO: 2234 - RNA, 22 nt, Homo sapiens
cagugcaaugaugaaagggcau

SEQ ID NO: 2235 - RNA, 18 nt, Homo sapiens
cagggaggugaaugugau

SEQ ID NO: 2236 - RNA, 18 nt, Homo sapiens
ugaggcaguagauugaau

SEQ ID NO: 2237 - RNA, 23 nt, Homo sapiens
ugugcaaaucuaugcaaaacuga

SEQ ID NO: 2238 - RNA, 22 nt, Homo sapiens
aacaauauccuggugcugagug

SEQ ID NO: 2239 - RNA, 22 nt, Homo sapiens
agagguaguagguugcauaguu

SEQ ID NO: 2240 - RNA, 23 nt, Homo sapiens
ucccuguccuccaggagcucacg

SEQ ID NO: 2241 - RNA, 21 nt, Homo sapiens
aagccugcccggcuccucggg

SEQ ID NO: 2242 - RNA, 21 nt, Homo sapiens
aggaggcagcgcucucaggac

SEQ ID NO: 2243 - RNA, 23 nt, Homo sapiens
aggaagcccuggaggggcuggag

SEQ ID NO: 2244 - RNA, 24 nt, Homo sapiens
uggggagcugaggcucugggggug

SEQ ID NO: 2245 - RNA, 18 nt, Homo sapiens
ucagcuggcccucauuuc

SEQ ID NO: 2246 - RNA, 18 nt, Homo sapiens
ucagcuggcccucauuuc

SEQ ID NO: 2247 - RNA, 22 nt, Homo sapiens
ucaccagcccuguguucccuag

SEQ ID NO: 2248 - RNA, 24 nt, Homo sapiens
ucccugagacccuuuaaccuguga

SEQ ID NO: 2249 - RNA, 22 nt, Homo sapiens
ucccugagacccuaacuuguga

SEQ ID NO: 2250 - RNA, 23 nt, Homo sapiens
ccucagggcuguagaacagggcu

SEQ ID NO: 2251 - RNA, 23 nt, Homo sapiens
agcugguguugugaaucaggccg

SEQ ID NO: 2252 - RNA, 22 nt, Homo sapiens
uuggggaaacggccgcugagug

SEQ ID NO: 2253 - RNA, 21 nt, Homo sapiens
aucacauugccagggauuucc

SEQ ID NO: 2254 - RNA, 21 nt, Homo sapiens
aucacauugccagggauuacc

SEQ ID NO: 2255 - RNA, 23 nt, Homo sapiens
ucccccaggugugauucugauuu

SEQ ID NO: 2256 - RNA, 22 nt, Homo sapiens
ucaggcucaguccccucccgau

SEQ ID NO: 2257 - RNA, 22 nt, Homo sapiens
aguggggaacccuuccaugagg

SEQ ID NO: 2258 - RNA, 24 nt, Homo sapiens
acaaagugcuucccuuuagagugu

SEQ ID NO: 2259 - RNA, 22 nt, Homo sapiens
acaaagugcuucccuuuagagu

SEQ ID NO: 2260 - RNA, 25 nt, Homo sapiens
aggggugguguugggacagcuccgu

SEQ ID NO: 2261 - RNA, 23 nt, Homo sapiens
aucccuugcaggggcuguugggu

SEQ ID NO: 2262 - RNA, 24 nt, Homo sapiens
acugggggcuuucgggcucugcgu

SEQ ID NO: 2263 - RNA, 24 nt, Homo sapiens
ugccugggucucuggccugcgcgu

SEQ ID NO: 2264 - RNA, 22 nt, Homo sapiens
acuccagccccacagccucagc

SEQ ID NO: 2265 - RNA, 20 nt, Homo sapiens
ggggagcuguggaagcagua

SEQ ID NO: 2266 - RNA, 27 nt, Homo sapiens
cacuguaggugauggugagagugggca

SEQ ID NO: 2267 - RNA, 18 nt, Homo sapiens
ucagcuggcccucauuuc

SEQ ID NO: 2268 - RNA, 17 nt, Homo sapiens
gugggggagaggcuguc

SEQ ID NO: 2269 - RNA, 22 nt, Homo sapiens
ucuacagugcacgugucuccag

SEQ ID NO: 2270 - RNA, 22 nt, Homo sapiens
uggagagaaaggcaguuccuga

SEQ ID NO: 2271 - RNA, 23 nt, Homo sapiens
ucccccaggugugauucugauuu

SEQ ID NO: 2272 - RNA, 21 nt, Homo sapiens
agggggaaaguucuauagucc

SEQ ID NO: 2273 - RNA, 24 nt, Homo sapiens
acugggggcuuucgggcucugcgu

SEQ ID NO: 2274 - RNA, 22 nt, Homo sapiens
gucccucuccaaaugugucuug

SEQ ID NO: 2275 - RNA, 20 nt, Homo sapiens
guagaggagauggcgcaggg

SEQ ID NO: 2276 - RNA, 22 nt, Homo sapiens
ucuucucuguuuuggccaugug

SEQ ID NO: 2277 - RNA, 22 nt, Homo sapiens
cuccugagccauucugagccuc

SEQ ID NO: 2278 - RNA, 21 nt, Homo sapiens
uggcagggaggcugggagggg

SEQ ID NO: 2279 - RNA, 22 nt, Homo sapiens
uuugguccccuucaaccagcug

SEQ ID NO: 2280 - RNA, 22 nt, Homo sapiens
cuagguauggucccagggaucc

SEQ ID NO: 2281 - RNA, 23 nt, Homo sapiens
uaauccuugcuaccugggugaga

SEQ ID NO: 2282 - RNA, 22 nt, Homo sapiens
uucacaaggaggugucauuuau

SEQ ID NO: 2283 - RNA, 22 nt, Homo sapiens
ugugacagauugauaacugaaa

SEQ ID NO: 2284 - RNA, 22 nt, Homo sapiens
aaccagcaccccaacuuuggac

SEQ ID NO: 2285 - RNA, 21 nt, Homo sapiens
guggcugcacucacuuccuuc

SEQ ID NO: 2286 - RNA, 21 nt, Homo sapiens
aaggcagggcccccgcucccc

SEQ ID NO: 2287 - RNA, 22 nt, Homo sapiens
uagguuauccguguugccuucg

SEQ ID NO: 2288 - RNA, 21 nt, Homo sapiens
auguaugugugcaugugcaug

SEQ ID NO: 2289 - RNA, 23 nt, Homo sapiens
gcaaagcacacggccugcagaga

SEQ ID NO: 2290 - RNA, 21 nt, Homo sapiens
aauauaacacagauggccugu

SEQ ID NO: 2291 - RNA, 23 nt, Homo sapiens
uggugcggagagggcccacagug

SEQ ID NO: 2292 - RNA, 20 nt, Homo sapiens
ucacuguucagacaggcgga

SEQ ID NO: 2293 - RNA, 21 nt, Homo sapiens
agugaaugauggguucugacc

SEQ ID NO: 2294 - RNA, 22 nt, Homo sapiens
ucguaccgugaguaauaaugcg

SEQ ID NO: 2295 - RNA, 21 nt, Homo sapiens
uaccacaggguagaaccacgg

SEQ ID NO: 2296 - RNA, 21 nt, Homo sapiens
gguuugguccuagccuuucua

SEQ ID NO: 2297 - RNA, 23 nt, Homo sapiens
cuguaauauaaauuuaauuuauu

SEQ ID NO: 2298 - RNA, 23 nt, Homo sapiens
uaagugcuuccauguuuuaguag

SEQ ID NO: 2299 - RNA, 23 nt, Homo sapiens
uaagugcuuccauguuugagugu

SEQ ID NO: 2300 - RNA, 22 nt, Homo sapiens
aacuguuugcagaggaaacuga

SEQ ID NO: 2301 - RNA, 21 nt, Homo sapiens
uaauuuuauguauaagcuagu

SEQ ID NO: 2302 - RNA, 23 nt, Homo sapiens
acuuacagacaagagccuugcuc

SEQ ID NO: 2303 - RNA, 23 nt, Homo sapiens
uggaagacuagugauuuuguugu

SEQ ID NO: 2304 - RNA, 18 nt, Homo sapiens
ucagcuggcccucauuuc

SEQ ID NO: 2305 - RNA, 18 nt, Homo sapiens
ucagcuggcccucauuuc

SEQ ID NO: 2306 - RNA, 17 nt, Homo sapiens
ucgccuccuccucuccc

SEQ ID NO: 2307 - RNA, 22 nt, Homo sapiens
ucugggcaacaaagugagaccu

SEQ ID NO: 2308 - RNA, 22 nt, Homo sapiens
ucugggcaacaaagugagaccu

SEQ ID NO: 2309 - RNA, 21 nt, Homo sapiens
gcccuccgcccgugcaccccg

SEQ ID NO: 2310 - RNA, 23 nt, Homo sapiens
ucuggcuccgugucuucacuccc

SEQ ID NO: 2311 - RNA, 25 nt, Homo sapiens
cccccacaaccgcgcuugacuagcu

SEQ ID NO: 2312 - RNA, 20 nt, Homo sapiens
ccuccugcccuccuugcugu

SEQ ID NO: 2313 - RNA, 22 nt, Homo sapiens
cauugcacuugucucggucuga

SEQ ID NO: 2314 - RNA, 21 nt, Homo sapiens
ucacuccucuccucccgucuu

SEQ ID NO: 2315 - RNA, 22 nt, Homo sapiens
agaggcuggccgugaugaauuc

SEQ ID NO: 2316 - RNA, 22 nt, Homo sapiens
cgucaacacuugcugguuuccu

SEQ ID NO: 2317 - RNA, 19 nt, Homo sapiens
aggcugcggaauucaggac

SEQ ID NO: 2318 - RNA, 25 nt, Homo sapiens
gcugggcagggcuucugagcuccuu

SEQ ID NO: 2319 - RNA, 25 nt, Homo sapiens
gcugggcagggcuucugagcuccuu

SEQ ID NO: 2320 - RNA, 21 nt, Homo sapiens
agggggaaaguucuauagucc

SEQ ID NO: 2321 - RNA, 25 nt, Homo sapiens
ggcggagggaaguagguccguuggu

SEQ ID NO: 2322 - RNA, 20 nt, Homo sapiens
accaggaggcugaggccccu

SEQ ID NO: 2323 - RNA, 22 nt, Homo sapiens
acuccagccccacagccucagc

SEQ ID NO: 2324 - RNA, 22 nt, Homo sapiens
acuccagccccacagccucagc

SEQ ID NO: 2325 - RNA, 23 nt, Homo sapiens
guccaguuuucccaggaaucccu

SEQ ID NO: 2326 - RNA, 22 nt, Homo sapiens
uauggcacugguagaauucacu

SEQ ID NO: 2327 - RNA, 24 nt, Homo sapiens
agcagaagcagggagguucuccca

SEQ ID NO: 2328 - RNA, 23 nt, Homo sapiens
ucaagagcaauaacgaaaaaugu

SEQ ID NO: 2329 - RNA, 22 nt, Homo sapiens
aacuguuugcagaggaaacuga

SEQ ID NO: 2330 - RNA, 22 nt, Homo sapiens
uucucaaggaggugucguuuau

SEQ ID NO: 2331 - RNA, 23 nt, Homo sapiens
uucucgaggaaagaagcacuuuc

SEQ ID NO: 2332 - RNA, 23 nt, Homo sapiens
cucuugagggaagcacuuucugu

SEQ ID NO: 2333 - RNA, 22 nt, Homo sapiens
aggcagcgggguguaguggaua

SEQ ID NO: 2334 - RNA, 22 nt, Homo sapiens
caaagugccucccuuuagagug

SEQ ID NO: 2335 - RNA, 17 nt, Homo sapiens
ucgccuccuccucuccc

SEQ ID NO: 2336 - RNA, 22 nt, Homo sapiens
ucugggcaacaaagugagaccu

SEQ ID NO: 2337 - RNA, 21 nt, Homo sapiens
cggcggggacggcgauugguc

SEQ ID NO: 2338 - RNA, 21 nt, Homo sapiens
cggcggggacggcgauugguc

SEQ ID NO: 2339 - RNA, 22 nt, Homo sapiens
cccugugcccggcccacuucug

SEQ ID NO: 2340 - RNA, 22 nt, Homo sapiens
ugggucuuugcgggcgagauga

SEQ ID NO: 2341 - RNA, 22 nt, Homo sapiens
aacuggcccucaaagucccgcu

SEQ ID NO: 2342 - RNA, 22 nt, Homo sapiens
cauugcacuugucucggucuga

SEQ ID NO: 2343 - RNA, 22 nt, Homo sapiens
uguaaacauccuacacucagcu

SEQ ID NO: 2344 - RNA, 21 nt, Homo sapiens
aggcaagaugcuggcauagcu

SEQ ID NO: 2345 - RNA, 20 nt, Homo sapiens
ccucugggcccuuccuccag

SEQ ID NO: 2346 - RNA, 22 nt, Homo sapiens
ucucugggccugugucuuaggc

SEQ ID NO: 2347 - RNA, 21 nt, Homo sapiens
ugucuugcaggccgucaugca

SEQ ID NO: 2348 - RNA, 22 nt, Homo sapiens
ucaggcucaguccccucccgau

SEQ ID NO: 2349 - RNA, 25 nt, Homo sapiens
gcugggcagggcuucugagcuccuu

SEQ ID NO: 2350 - RNA, 22 nt, Homo sapiens
aggcggggcgccgcgggaccgc

SEQ ID NO: 2351 - RNA, 22 nt, Homo sapiens
aggcggggcgccgcgggaccgc

SEQ ID NO: 2352 - RNA, 20 nt, Homo sapiens
accaggaggcugaggccccu

SEQ ID NO: 2353 - RNA, 22 nt, Homo sapiens
ugcggggcuagggcuaacagca

SEQ ID NO: 2354 - RNA, 22 nt, Homo sapiens
uggaauguaaagaaguauguau

SEQ ID NO: 2355 - RNA, 23 nt, Homo sapiens
ccugcagcgacuugauggcuucc

SEQ ID NO: 2356 - RNA, 23 nt, Homo sapiens
ccugcagcgacuugauggcuucc

SEQ ID NO: 2357 - RNA, 22 nt, Homo sapiens
cagugcaauguuaaaagggcau

SEQ ID NO: 2358 - RNA, 22 nt, Homo sapiens
uaacacugucugguaaagaugg

SEQ ID NO: 2359 - RNA, 22 nt, Homo sapiens
ucugcccccuccgcugcugcca

SEQ ID NO: 2360 - RNA, 23 nt, Homo sapiens
cccaguguucagacuaccuguuc

SEQ ID NO: 2361 - RNA, 23 nt, Homo sapiens
cccaguguuuagacuaucuguuc

SEQ ID NO: 2362 - RNA, 22 nt, Homo sapiens
uaacacugucugguaacgaugu

SEQ ID NO: 2363 - RNA, 22 nt, Homo sapiens
uggaauguaaggaagugugugg

SEQ ID NO: 2364 - RNA, 21 nt, Homo sapiens
aucacauugccagggauuucc

SEQ ID NO: 2365 - RNA, 21 nt, Homo sapiens
aucacauugccagggauuacc

SEQ ID NO: 2366 - RNA, 21 nt, Homo sapiens
uaaagugcugacagugcagau

SEQ ID NO: 2367 - RNA, 23 nt, Homo sapiens
cagugcaaugauauugucaaagc

SEQ ID NO: 2368 - RNA, 20 nt, Homo sapiens
acugccccaggugcugcugg

SEQ ID NO: 2369 - RNA, 21 nt, Homo sapiens
cggggcagcucaguacaggau

SEQ ID NO: 2370 - RNA, 22 nt, Homo sapiens
ucagcaaacauuuauugugugc

SEQ ID NO: 2371 - RNA, 20 nt, Homo sapiens
aggaauguuccuucuuugcc

SEQ ID NO: 2372 - RNA, 24 nt, Homo sapiens
ugccugggucucuggccugcgcgu

SEQ ID NO: 2373 - RNA, 22 nt, Homo sapiens
acuccagccccacagccucagc

SEQ ID NO: 2374 - RNA, 26 nt, Homo sapiens
gaugaugauggcagcaaauucugaaa

SEQ ID NO: 2375 - RNA, 22 nt, Homo sapiens
cugaagcucagagggcucugau

SEQ ID NO: 2376 - RNA, 18 nt, Homo sapiens
uugagaaggaggcugcug

SEQ ID NO: 2377 - RNA, 18 nt, Homo sapiens
uugagaaggaggcugcug

SEQ ID NO: 2378 - RNA, 24 nt, Homo sapiens
uugcagcugccugggagugacuuc

SEQ ID NO: 2379 - RNA, 22 nt, Homo sapiens
uuugaggcuacagugagaugug

SEQ ID NO: 2380 - RNA, 22 nt, Homo sapiens
cagugcaaugaugaaagggcau

SEQ ID NO: 2381 - RNA, 21 nt, Homo sapiens
gugucuuuugcucugcaguca

SEQ ID NO: 2382 - RNA, 20 nt, Homo sapiens
cugcaaagggaagcccuuuc

SEQ ID NO: 2383 - RNA, 24 nt, Homo sapiens
acaaagugcuucccuuuagagugu

SEQ ID NO: 2384 - RNA, 22 nt, Homo sapiens
acaaagugcuucccuuuagagu

SEQ ID NO: 2385 - RNA, 23 nt, Homo sapiens
cucuugagggaagcacuuucugu

SEQ ID NO: 2386 - RNA, 20 nt, Homo sapiens
cugcaaagggaagcccuuuc

SEQ ID NO: 2387 - RNA, 20 nt, Homo sapiens
aggguguuucucucaucucu

SEQ ID NO: 2388 - RNA, 21 nt, Homo sapiens
uggcagggaggcugggagggg

SEQ ID NO: 2389 - RNA, 22 nt, Homo sapiens
uggagugugacaaugguguuug

SEQ ID NO: 2390 - RNA, 22 nt, Homo sapiens
ucggccugaccacccaccccac

SEQ ID NO: 2391 - RNA, 24 nt, Homo sapiens
uggcccugacugaagaccagcagu

SEQ ID NO: 2392 - RNA, 23 nt, Homo sapiens
ucuggcuccgugucuucacuccc

SEQ ID NO: 2393 - RNA, 22 nt, Homo sapiens
uggagagaaaggcaguuccuga

SEQ ID NO: 2394 - RNA, 21 nt, Homo sapiens
cggcggggacggcgauugguc

SEQ ID NO: 2395 - RNA, 22 nt, Homo sapiens
cgcaggggccgggugcucaccg

SEQ ID NO: 2396 - RNA, 22 nt, Homo sapiens
ucugcccccuccgcugcugcca

SEQ ID NO: 2397 - RNA, 20 nt, Homo sapiens
acugccccaggugcugcugg

SEQ ID NO: 2398 - RNA, 22 nt, Homo sapiens
uggcagugucuuagcugguugu

SEQ ID NO: 2399 - RNA, 23 nt, Homo sapiens
aggcaguguaguuagcugauugc

SEQ ID NO: 2400 - RNA, 23 nt, Homo sapiens
ucccccaggugugauucugauuu

SEQ ID NO: 2401 - RNA, 21 nt, Homo sapiens
aauauaacacagauggccugu

SEQ ID NO: 2402 - RNA, 22 nt, Homo sapiens
uggcaguguauuguuagcuggu

SEQ ID NO: 2403 - RNA, 22 nt, Homo sapiens
aggcaguguauuguuagcuggc

SEQ ID NO: 2404 - RNA, 21 nt, Homo sapiens
cggggcagcucaguacaggau

SEQ ID NO: 2405 - RNA, 23 nt, Homo sapiens
ugagugugugugugugagugugu

SEQ ID NO: 2406 - RNA, 24 nt, Homo sapiens
acugggggcuuucgggcucugcgu

SEQ ID NO: 2407 - RNA, 24 nt, Homo sapiens
ugccugggucucuggccugcgcgu

SEQ ID NO: 2408 - RNA, 22 nt, Homo sapiens
aggcggggcgccgcgggaccgc

SEQ ID NO: 2409 - RNA, 22 nt, Homo sapiens
cagugcaaugaugaaagggcau

SEQ ID NO: 2410 - RNA, 21 nt, Homo sapiens
cuagacugaagcuccuugagg

SEQ ID NO: 2411 - RNA, 22 nt, Homo sapiens
cucuagagggaagcacuuucug

SEQ ID NO: 2412 - RNA, 22 nt, Homo sapiens
aacuggccuacaaagucccagu

SEQ ID NO: 2413 - RNA, 22 nt, Homo sapiens
aacuggcccucaaagucccgcu

SEQ ID NO: 2414 - RNA, 22 nt, Homo sapiens
uguaacagcaacuccaugugga

SEQ ID NO: 2415 - RNA, 20 nt, Homo sapiens
ccuccugcccuccuugcugu

SEQ ID NO: 2416 - RNA, 22 nt, Homo sapiens
cucccacugcuucacuugacua

SEQ ID NO: 2417 - RNA, 22 nt, Homo sapiens
uuggggaaacggccgcugagug

SEQ ID NO: 2418 - RNA, 22 nt, Homo sapiens
cacuagauugugagcuccugga

SEQ ID NO: 2419 - RNA, 22 nt, Homo sapiens
uguaaacauccuacacucagcu

SEQ ID NO: 2420 - RNA, 22 nt, Homo sapiens
agaucagaaggugauuguggcu

SEQ ID NO: 2421 - RNA, 20 nt, Homo sapiens
auuccuagaaauuguucaua

SEQ ID NO: 2422 - RNA, 22 nt, Homo sapiens
aguggggaacccuuccaugagg

SEQ ID NO: 2423 - RNA, 22 nt, Homo sapiens
aaagugcauccuuuuagagugu

SEQ ID NO: 2424 - RNA, 22 nt, Homo sapiens
aaagugcauccuuuuagagguu

SEQ ID NO: 2425 - RNA, 22 nt, Homo sapiens
aaagugcaucuuuuuagaggau

SEQ ID NO: 2426 - RNA, 22 nt, Homo sapiens
ccucccacacccaaggcuugca

SEQ ID NO: 2427 - RNA, 22 nt, Homo sapiens
aaaaguaauugcgaguuuuacc

SEQ ID NO: 2428 - RNA, 22 nt, Homo sapiens
aaaaguaauugugguuuuggcc

SEQ ID NO: 2429 - RNA, 22 nt, Homo sapiens
aaaaguaauugcgguuuuugcc

SEQ ID NO: 2430 - RNA, 22 nt, Homo sapiens
aaaaguaauugugguuuuugcc

SEQ ID NO: 2431 - RNA, 22 nt, Homo sapiens
aaaaguaaucgcgguuuuuguc

SEQ ID NO: 2432 - RNA, 22 nt, Homo sapiens
aaaaguaauugcggauuuugcc

SEQ ID NO: 2433 - RNA, 22 nt, Homo sapiens
aaaaguaauugcggucuuuggu

SEQ ID NO: 2434 - RNA, 21 nt, Homo sapiens
uaaaguaaauaugcaccaaaa

SEQ ID NO: 2435 - RNA, 21 nt, Homo sapiens
caaagaggaaggucccauuac

SEQ ID NO: 2436 - RNA, 25 nt, Homo sapiens
aggggugguguugggacagcuccgu

SEQ ID NO: 2437 - RNA, 21 nt, Homo sapiens
aggaggcagcgcucucaggac

SEQ ID NO: 2438 - RNA, 20 nt, Homo sapiens
ggggagcuguggaagcagua

SEQ ID NO: 2439 - RNA, 22 nt, Homo sapiens
ugugcgcagggagaccucuccc

SEQ ID NO: 2440 - RNA, 22 nt, Homo sapiens
ucuucucuguuuuggccaugug

SEQ ID NO: 2441 - RNA, 21 nt, Homo sapiens
uggcagggaggcugggagggg

SEQ ID NO: 2442 - RNA, 23 nt, Homo sapiens
ucuggcuccgugucuucacuccc

SEQ ID NO: 2443 - RNA, 21 nt, Homo sapiens
cggcggggacggcgauugguc

SEQ ID NO: 2444 - RNA, 22 nt, Homo sapiens
cgcaggggccgggugcucaccg

SEQ ID NO: 2445 - RNA, 20 nt, Homo sapiens
ccccagggcgacgcggcggg

SEQ ID NO: 2446 - RNA, 22 nt, Homo sapiens
aacuggcccucaaagucccgcu

SEQ ID NO: 2447 - RNA, 20 nt, Homo sapiens
uguuuugauaacaguaaugu

SEQ ID NO: 2448 - RNA, 23 nt, Homo sapiens
ucccccaggugugauucugauuu

SEQ ID NO: 2449 - RNA, 18 nt, Homo sapiens
ugcuuccuuucagagggu

SEQ ID NO: 2450 - RNA, 22 nt, Homo sapiens
aucuggagguaagaagcacuuu

SEQ ID NO: 2451 - RNA, 21 nt, Homo sapiens
gcgacccacucuugguuucca

SEQ ID NO: 2452 - RNA, 21 nt, Homo sapiens
gcgacccauacuugguuucag

SEQ ID NO: 2453 - RNA, 24 nt, Homo sapiens
acugggggcuuucgggcucugcgu

SEQ ID NO: 2454 - RNA, 22 nt, Homo sapiens
aggcggggcgccgcgggaccgc

SEQ ID NO: 2455 - RNA, 23 nt, Homo sapiens
cgggucggaguuagcucaagcgg

SEQ ID NO: 2456 - RNA, 20 nt, Homo sapiens
ggggagcuguggaagcagua

SEQ ID NO: 2457 - RNA, 23 nt, Homo sapiens
agcagcauuguacagggcuauga

SEQ ID NO: 2458 - RNA, 23 nt, Homo sapiens
agcagcauuguacagggcuauca

SEQ ID NO: 2459 - RNA, 23 nt, Homo sapiens
ucuggcuccgugucuucacuccc

SEQ ID NO: 2460 - RNA, 22 nt, Homo sapiens
uagcagcacauaaugguuugug

SEQ ID NO: 2461 - RNA, 22 nt, Homo sapiens
uagcagcacaucaugguuuaca

SEQ ID NO: 2462 - RNA, 22 nt, Homo sapiens
uagcagcacguaaauauuggcg

SEQ ID NO: 2463 - RNA, 22 nt, Homo sapiens
uacccagagcaugcagugugaa

SEQ ID NO: 2464 - RNA, 22 nt, Homo sapiens
ucugcccccuccgcugcugcca

SEQ ID NO: 2465 - RNA, 23 nt, Homo sapiens
caacggaaucccaaaagcagcug

SEQ ID NO: 2466 - RNA, 21 nt, Homo sapiens
uagcagcacagaaauauuggc

SEQ ID NO: 2467 - RNA, 20 nt, Homo sapiens
acugccccaggugcugcugg

SEQ ID NO: 2468 - RNA, 22 nt, Homo sapiens
aauugcacgguauccaucugua

SEQ ID NO: 2469 - RNA, 22 nt, Homo sapiens
cagcagcaauucauguuuugaa

SEQ ID NO: 2470 - RNA, 22 nt, Homo sapiens
agaggcuggccgugaugaauuc

SEQ ID NO: 2471 - RNA, 21 nt, Homo sapiens
cggggcagcucaguacaggau

SEQ ID NO: 2472 - RNA, 21 nt, Homo sapiens
cagcagcacacugugguuugu

SEQ ID NO: 2473 - RNA, 25 nt, Homo sapiens
aggggugguguugggacagcuccgu

SEQ ID NO: 2474 - RNA, 21 nt, Homo sapiens
aggaggcagcgcucucaggac

SEQ ID NO: 2475 - RNA, 23 nt, Homo sapiens
ucugcucauaccccaugguuucu

SEQ ID NO: 2476 - RNA, 22 nt, Homo sapiens
caaagugccucccuuuagagug

SEQ ID NO: 2477 - RNA, 23 nt, Homo sapiens
ccaguuaccgcuuccgcuaccgc

SEQ ID NO: 2478 - RNA, 23 nt, Homo sapiens
aaaagugcuuacagugcagguag

SEQ ID NO: 2479 - RNA, 26 nt, Homo sapiens
aaguaguugguuuguaugagaugguu

SEQ ID NO: 2480 - RNA, 27 nt, Homo sapiens
auugaucaucgacacuucgaacgcaau

SEQ ID NO: 2481 - RNA, 22 nt, Homo sapiens
gaaguuguucgugguggauucg

SEQ ID NO: 2482 - RNA, 22 nt, Homo sapiens
uuuugcaauauguuccugaaua

SEQ ID NO: 2483 - RNA, 20 nt, Homo sapiens
cugcaaagggaagcccuuuc

SEQ ID NO: 2484 - RNA, 20 nt, Homo sapiens
cugcaaagggaagcccuuuc

SEQ ID NO: 2485 - RNA, 21 nt, Homo sapiens
aaacuacugaaaaucaaagau

SEQ ID NO: 2486 - RNA, 22 nt, Homo sapiens
uuugugaccugguccacuaacc

SEQ ID NO: 2487 - RNA, 23 nt, Homo sapiens
aggaugagcaaagaaaguagauu

SEQ ID NO: 2488 - RNA, 22 nt, Homo sapiens
cggaugagcaaagaaagugguu

SEQ ID NO: 2489 - RNA, 22 nt, Homo sapiens
augggugaauuuguagaaggau

SEQ ID NO: 2490 - RNA, 17 nt, Homo sapiens
gugggggagaggcuguc

SEQ ID NO: 2491 - RNA, 18 nt, Homo sapiens
cagggaggugaaugugau

SEQ ID NO: 2492 - RNA, 23 nt, Homo sapiens
ucuggcuccgugucuucacuccc

SEQ ID NO: 2493 - RNA, 23 nt, Homo sapiens
ucuggcuccgugucuucacuccc

SEQ ID NO: 2494 - RNA, 22 nt, Homo sapiens
uggagagaaaggcaguuccuga

SEQ ID NO: 2495 - RNA, 21 nt, Homo sapiens
cggcggggacggcgauugguc

SEQ ID NO: 2496 - RNA, 22 nt, Homo sapiens
uuauaaagcaaugagacugauu

SEQ ID NO: 2497 - RNA, 23 nt, Homo sapiens
ugaggggcagagagcgagacuuu

SEQ ID NO: 2498 - RNA, 25 nt, Homo sapiens
aggggugguguugggacagcuccgu

SEQ ID NO: 2499 - RNA, 22 nt, Homo sapiens
aggcggggcgccgcgggaccgc

SEQ ID NO: 2500 - RNA, 21 nt, Homo sapiens
uggaggagaaggaaggugaug

SEQ ID NO: 2501 - RNA, 21 nt, Homo sapiens
cgcgggugcuuacugacccuu

SEQ ID NO: 2502 - RNA, 20 nt, Homo sapiens
ggggagcuguggaagcagua

SEQ ID NO: 2503 - RNA, 22 nt, Homo sapiens
uggagugugacaaugguguuug

SEQ ID NO: 2504 - RNA, 22 nt, Homo sapiens
cuuggcaccuagcaagcacuca

SEQ ID NO: 2505 - RNA, 18 nt, Homo sapiens
cagggaggugaaugugau

SEQ ID NO: 2506 - RNA, 21 nt, Homo sapiens
cugaccuaugaauugacagcc

SEQ ID NO: 2507 - RNA, 22 nt, Homo sapiens
uagguaguuucauguuguuggg

SEQ ID NO: 2508 - RNA, 22 nt, Homo sapiens
aauugcacuuuagcaaugguga

SEQ ID NO: 2509 - RNA, 23 nt, Homo sapiens
uaauccuugcuaccugggugaga

SEQ ID NO: 2510 - RNA, 23 nt, Homo sapiens
uaauccuugcuaccugggugaga

SEQ ID NO: 2511 - RNA, 22 nt, Homo sapiens
uggugggcacagaaucuggacu

SEQ ID NO: 2512 - RNA, 23 nt, Homo sapiens
aucccuugcaggggcuguugggu

SEQ ID NO: 2513 - RNA, 22 nt, Homo sapiens
ugcggggcuagggcuaacagca

SEQ ID NO: 2514 - RNA, 23 nt, Homo sapiens
uuuggcacuagcacauuuuugcu

SEQ ID NO: 2515 - RNA, 20 nt, Homo sapiens
ucacaccugccucgcccccc

SEQ ID NO: 2516 - RNA, 21 nt, Homo sapiens
uccuucugcuccgucccccag

SEQ ID NO: 2517 - RNA, 21 nt, Homo sapiens
cuuuuugcggucugggcuugc

SEQ ID NO: 2518 - RNA, 18 nt, Homo sapiens
uugagaaggaggcugcug

SEQ ID NO: 2519 - RNA, 22 nt, Homo sapiens
cagugcaaugaugaaagggcau

SEQ ID NO: 2520 - RNA, 21 nt, Homo sapiens
caucccuugcaugguggaggg

SEQ ID NO: 2521 - RNA, 22 nt, Homo sapiens
uucccuuugucauccuaugccu

SEQ ID NO: 2522 - RNA, 22 nt, Homo sapiens
uucccuuugucauccuucgccu

SEQ ID NO: 2523 - RNA, 23 nt, Homo sapiens
cacucagccuugagggcacuuuc

SEQ ID NO: 2524 - RNA, 23 nt, Homo sapiens
ucugcucauaccccaugguuucu

SEQ ID NO: 2525 - RNA, 18 nt, Homo sapiens
cagggaggugaaugugau

SEQ ID NO: 2526 - RNA, 22 nt, Homo sapiens
uagcuuaucagacugauguuga

SEQ ID NO: 2527 - RNA, 22 nt, Homo sapiens
aagcugccaguugaagaacugu

SEQ ID NO: 2528 - RNA, 23 nt, Homo sapiens
ucuuggaguaggucauugggugg

SEQ ID NO: 2529 - RNA, 19 nt, Homo sapiens
ugagcugcuguaccaaaau

SEQ ID NO: 2530 - RNA, 22 nt, Homo sapiens
gucccucuccaaaugugucuug

SEQ ID NO: 2531 - RNA, 21 nt, Homo sapiens
uggaggagaaggaaggugaug

SEQ ID NO: 2532 - RNA, 21 nt, Homo sapiens
uacuuggaaaggcaucaguug

SEQ ID NO: 2533 - RNA, 21 nt, Homo sapiens
uggcagggaggcugggagggg

SEQ ID NO: 2534 - RNA, 22 nt, Homo sapiens
aacauucaaccugucggugagu

SEQ ID NO: 2535 - RNA, 23 nt, Homo sapiens
ugaguaccgccaugucuguuggg

SEQ ID NO: 2536 - RNA, 22 nt, Homo sapiens
uagcaccauuugaaaucgguua

SEQ ID NO: 2537 - RNA, 20 nt, Homo sapiens
acucaaacugugggggcacu

SEQ ID NO: 2538 - RNA, 23 nt, Homo sapiens
uacuccagagggcgucacucaug

SEQ ID NO: 2539 - RNA, 22 nt, Homo sapiens
cacgcucaugcacacacccaca

SEQ ID NO: 2540 - RNA, 22 nt, Homo sapiens
aaaccuguguuguucaagaguc

SEQ ID NO: 2541 - RNA, 22 nt, Homo sapiens
acuccagccccacagccucagc

SEQ ID NO: 2542 - RNA, 22 nt, Homo sapiens
caaagugccucccuuuagagug

SEQ ID NO: 2543 - RNA, 21 nt, Homo sapiens
aaggcagggcccccgcucccc

SEQ ID NO: 2544 - RNA, 23 nt, Homo sapiens
ucuggcuccgugucuucacuccc

SEQ ID NO: 2545 - RNA, 22 nt, Homo sapiens
uggagagaaaggcaguuccuga

SEQ ID NO: 2546 - RNA, 23 nt, Homo sapiens
ugaguaccgccaugucuguuggg

SEQ ID NO: 2547 - RNA, 21 nt, Homo sapiens
ucccacguuguggcccagcag

SEQ ID NO: 2548 - RNA, 21 nt, Homo sapiens
ucccacguuguggcccagcag

SEQ ID NO: 2549 - RNA, 23 nt, Homo sapiens
aggaagcccuggaggggcuggag

SEQ ID NO: 2550 - RNA, 23 nt, Homo sapiens
ucugcucauaccccaugguuucu

SEQ ID NO: 2551 - RNA, 23 nt, Homo sapiens
cgggucggaguuagcucaagcgg

SEQ ID NO: 2552 - RNA, 18 nt, Homo sapiens
cagggaggugaaugugau

SEQ ID NO: 2553 - RNA, 23 nt, Homo sapiens
uaaggugcaucuagugcagauag

SEQ ID NO: 2554 - RNA, 22 nt, Homo sapiens
uagguaguuuccuguuguuggg

SEQ ID NO: 2555 - RNA, 20 nt, Homo sapiens
ccuccugcccuccuugcugu

SEQ ID NO: 2556 - RNA, 21 nt, Homo sapiens
gaaggcgcuucccuuuggagu

SEQ ID NO: 2557 - RNA, 22 nt, Homo sapiens
gaaggcgcuucccuuuagagcg

SEQ ID NO: 2558 - RNA, 19 nt, Homo sapiens
gggcgccugugaucccaac

SEQ ID NO: 2559 - RNA, 23 nt, Homo sapiens
aucgcugcgguugcgagcgcugu

SEQ ID NO: 2560 - RNA, 22 nt, Homo sapiens
gucccucuccaaaugugucuug

SEQ ID NO: 2561 - RNA, 21 nt, Homo sapiens
aggaggcagcgcucucaggac

SEQ ID NO: 2562 - RNA, 22 nt, Homo sapiens
cugcccuggcccgagggaccga

SEQ ID NO: 2563 - RNA, 23 nt, Homo sapiens
cacccggcugugugcacaugugc

SEQ ID NO: 2564 - RNA, 26 nt, Homo sapiens
gaugaugauggcagcaaauucugaaa

SEQ ID NO: 2565 - RNA, 23 nt, Homo sapiens
gagggucuugggagggaugugac

SEQ ID NO: 2566 - RNA, 23 nt, Homo sapiens
ucuggcuccgugucuucacuccc

SEQ ID NO: 2567 - RNA, 22 nt, Homo sapiens
uagcagcacauaaugguuugug

SEQ ID NO: 2568 - RNA, 22 nt, Homo sapiens
uagcagcacaucaugguuuaca

SEQ ID NO: 2569 - RNA, 22 nt, Homo sapiens
uagcagcacguaaauauuggcg

SEQ ID NO: 2570 - RNA, 21 nt, Homo sapiens
uagcagcacagaaauauuggc

SEQ ID NO: 2571 - RNA, 23 nt, Homo sapiens
ugugcaaaucuaugcaaaacuga

SEQ ID NO: 2572 - RNA, 22 nt, Homo sapiens
aacaauauccuggugcugagug

SEQ ID NO: 2573 - RNA, 22 nt, Homo sapiens
agagguaguagguugcauaguu

SEQ ID NO: 2574 - RNA, 21 nt, Homo sapiens
aucacauugccagggauuucc

SEQ ID NO: 2575 - RNA, 21 nt, Homo sapiens
aucacauugccagggauuacc

SEQ ID NO: 2576 - RNA, 22 nt, Homo sapiens
cauugcacuugucucggucuga

SEQ ID NO: 2577 - RNA, 22 nt, Homo sapiens
aucacacaaaggcaacuuuugu

SEQ ID NO: 2578 - RNA, 23 nt, Homo sapiens
ugaggggcagagagcgagacuuu

SEQ ID NO: 2579 - RNA, 22 nt, Homo sapiens
cagcagcaauucauguuuugaa

SEQ ID NO: 2580 - RNA, 21 nt, Homo sapiens
cagcagcacacugugguuugu

SEQ ID NO: 2581 - RNA, 22 nt, Homo sapiens
gucccucuccaaaugugucuug

SEQ ID NO: 2582 - RNA, 25 nt, Homo sapiens
ggcggagggaaguagguccguuggu

SEQ ID NO: 2583 - RNA, 22 nt, Homo sapiens
ugcggggcuagggcuaacagca

SEQ ID NO: 2584 - RNA, 20 nt, Homo sapiens
cggcucugggucugugggga

SEQ ID NO: 2585 - RNA, 21 nt, Homo sapiens
uggaggagaaggaaggugaug

SEQ ID NO: 2586 - RNA, 22 nt, Homo sapiens
caaagugccucccuuuagagug

SEQ ID NO: 2587 - RNA, 21 nt, Homo sapiens
gugccagcugcagugggggag

SEQ ID NO: 2588 - RNA, 22 nt, Homo sapiens
uucuggaauucugugugaggga

SEQ ID NO: 2589 - RNA, 23 nt, Homo sapiens
caacggaaucccaaaagcagcug

SEQ ID NO: 2590 - RNA, 23 nt, Homo sapiens
ugugcaaaucuaugcaaaacuga

SEQ ID NO: 2591 - RNA, 22 nt, Homo sapiens
aacaauauccuggugcugagug

SEQ ID NO: 2592 - RNA, 22 nt, Homo sapiens
agagguaguagguugcauaguu

SEQ ID NO: 2593 - RNA, 22 nt, Homo sapiens
aaaagcuggguugagagggcga

SEQ ID NO: 2594 - RNA, 22 nt, Homo sapiens
aaaagcuggguugagagggcaa

SEQ ID NO: 2595 - RNA, 20 nt, Homo sapiens
aaaagcuggguugagagggu

SEQ ID NO: 2596 - RNA, 19 nt, Homo sapiens
aaaagcuggguugagagga

SEQ ID NO: 2597 - RNA, 21 nt, Homo sapiens
gugcauuguaguugcauugca

SEQ ID NO: 2598 - RNA, 23 nt, Homo sapiens
caaagcgcuucucuuuagagugu

SEQ ID NO: 2599 - RNA, 21 nt, Homo sapiens
cuccagagggaaguacuuucu

SEQ ID NO: 2600 - RNA, 21 nt, Homo sapiens
cuccagagggaugcacuuucu

SEQ ID NO: 2601 - RNA, 22 nt, Homo sapiens
caaaaaccacaguuucuuuugc

SEQ ID NO: 2602 - RNA, 19 nt, Homo sapiens
gugucugcuuccuguggga

SEQ ID NO: 2603 - RNA, 21 nt, Homo sapiens
ccuggaaacacugagguugug

SEQ ID NO: 2604 - RNA, 22 nt, Homo sapiens
uggagugugacaaugguguuug

SEQ ID NO: 2605 - RNA, 20 nt, Homo sapiens
cuuccucgucugucugcccc

SEQ ID NO: 2606 - RNA, 22 nt, Homo sapiens
acucggcguggcgucggucgug

SEQ ID NO: 2607 - RNA, 22 nt, Homo sapiens
uaacacugucugguaaagaugg

SEQ ID NO: 2608 - RNA, 22 nt, Homo sapiens
cucggcgcggggcgcgggcucc

SEQ ID NO: 2609 - RNA, 22 nt, Homo sapiens
uugcauauguaggaugucccau

SEQ ID NO: 2610 - RNA, 21 nt, Homo sapiens
gcaggaacuugugagucuccu

SEQ ID NO: 2611 - RNA, 22 nt, Homo sapiens
aggcagcgggguguaguggaua

SEQ ID NO: 2612 - RNA, 22 nt, Homo sapiens
uggagugugacaaugguguuug

SEQ ID NO: 2613 - RNA, 22 nt, Homo sapiens
ucucccaacccuuguaccagug

SEQ ID NO: 2614 - RNA, 21 nt, Homo sapiens
ucgaggagcucacagucuagu

SEQ ID NO: 2615 - RNA, 21 nt, Homo sapiens
cggcggggacggcgauugguc

SEQ ID NO: 2616 - RNA, 20 nt, Homo sapiens
ccccagggcgacgcggcggg

SEQ ID NO: 2617 - RNA, 23 nt, Homo sapiens
ugagcgccucgacgacagagccg

SEQ ID NO: 2618 - RNA, 22 nt, Homo sapiens
uaaugccccuaaaaauccuuau

SEQ ID NO: 2619 - RNA, 19 nt, Homo sapiens
gggcgccugugaucccaac

SEQ ID NO: 2620 - RNA, 22 nt, Homo sapiens
aggcggggcgccgcgggaccgc

SEQ ID NO: 2621 - RNA, 22 nt, Homo sapiens
gguggcccggccgugccugagg

SEQ ID NO: 2622 - RNA, 22 nt, Homo sapiens
ugcggggcuagggcuaacagca

SEQ ID NO: 2623 - RNA, 24 nt, Homo sapiens
agccuggaagcuggagccugcagu

SEQ ID NO: 2624 - RNA, 22 nt, Homo sapiens
uaguacugugcauaucaucuau

SEQ ID NO: 2625 - RNA, 23 nt, Homo sapiens
ucuggcuccgugucuucacuccc

SEQ ID NO: 2626 - RNA, 21 nt, Homo sapiens
cggcggggacggcgauugguc

SEQ ID NO: 2627 - RNA, 22 nt, Homo sapiens
ucugcccccuccgcugcugcca

SEQ ID NO: 2628 - RNA, 22 nt, Homo sapiens
cucccacugcuucacuugacua

SEQ ID NO: 2629 - RNA, 21 nt, Homo sapiens
uaaagugcugacagugcagau

SEQ ID NO: 2630 - RNA, 23 nt, Homo sapiens
cagugcaaugauauugucaaagc

SEQ ID NO: 2631 - RNA, 20 nt, Homo sapiens
acugccccaggugcugcugg

SEQ ID NO: 2632 - RNA, 22 nt, Homo sapiens
ucaggcucaguccccucccgau

SEQ ID NO: 2633 - RNA, 21 nt, Homo sapiens
cggggcagcucaguacaggau

SEQ ID NO: 2634 - RNA, 22 nt, Homo sapiens
cgucaacacuugcugguuuccu

SEQ ID NO: 2635 - RNA, 22 nt, Homo sapiens
ccucccacacccaaggcuugca

SEQ ID NO: 2636 - RNA, 22 nt, Homo sapiens
aggcggggcgccgcgggaccgc

SEQ ID NO: 2637 - RNA, 22 nt, Homo sapiens
ugcggggcuagggcuaacagca

SEQ ID NO: 2638 - RNA, 22 nt, Homo sapiens
ucuucucuguuuuggccaugug

SEQ ID NO: 2639 - RNA, 20 nt, Homo sapiens
ucacaccugccucgcccccc

SEQ ID NO: 2640 - RNA, 21 nt, Homo sapiens
uccuucugcuccgucccccag

SEQ ID NO: 2641 - RNA, 19 nt, Homo sapiens
uggauuuuuggaucaggga

SEQ ID NO: 2642 - RNA, 22 nt, Homo sapiens
uggcucaguucagcaggaacag

SEQ ID NO: 2643 - RNA, 22 nt, Homo sapiens
cuccuauaugaugccuuucuuc

SEQ ID NO: 2644 - RNA, 22 nt, Homo sapiens
uggcagugucuuagcugguugu

SEQ ID NO: 2645 - RNA, 23 nt, Homo sapiens
aggcaguguaguuagcugauugc

SEQ ID NO: 2646 - RNA, 22 nt, Homo sapiens
uggcaguguauuguuagcuggu

SEQ ID NO: 2647 - RNA, 22 nt, Homo sapiens
aggcaguguauuguuagcuggc

SEQ ID NO: 2648 - RNA, 22 nt, Homo sapiens
aggcaguguauuguuagcuggc

SEQ ID NO: 2649 - RNA, 18 nt, Homo sapiens
ugcuuccuuucagagggu

SEQ ID NO: 2650 - RNA, 22 nt, Homo sapiens
aucuggagguaagaagcacuuu

SEQ ID NO: 2651 - RNA, 23 nt, Homo sapiens
acuugggcacugaaacaaugucc

SEQ ID NO: 2652 - RNA, 19 nt, Homo sapiens
aguguggcuuucuuagagc

SEQ ID NO: 2653 - RNA, 21 nt, Homo sapiens
guggcugcacucacuuccuuc

SEQ ID NO: 2654 - RNA, 23 nt, Homo sapiens
aggaagcccuggaggggcuggag

SEQ ID NO: 2655 - RNA, 20 nt, Homo sapiens
gugucugggcggacagcugc

SEQ ID NO: 2656 - RNA, 22 nt, Homo sapiens
caaagaauucuccuuuugggcu

SEQ ID NO: 2657 - RNA, 21 nt, Homo sapiens
caagucacuagugguuccguu

SEQ ID NO: 2658 - RNA, 22 nt, Homo sapiens
gcugacuccuaguccagggcuc

SEQ ID NO: 2659 - RNA, 22 nt, Homo sapiens
gaauguugcucggugaaccccu

SEQ ID NO: 2660 - RNA, 22 nt, Homo sapiens
cgucaacacuugcugguuuccu

SEQ ID NO: 2661 - RNA, 22 nt, Homo sapiens
aaacauucgcggugcacuucuu

SEQ ID NO: 2662 - RNA, 23 nt, Homo sapiens
cuaauaguaucuaccacaauaaa

SEQ ID NO: 2663 - RNA, 23 nt, Homo sapiens
cuaauaguaucuaccacaauaaa

SEQ ID NO: 2664 - RNA, 22 nt, Homo sapiens
uuugugaccugguccacuaacc

SEQ ID NO: 2665 - RNA, 23 nt, Homo sapiens
aggaugagcaaagaaaguagauu

SEQ ID NO: 2666 - RNA, 22 nt, Homo sapiens
cggaugagcaaagaaagugguu

SEQ ID NO: 2667 - RNA, 22 nt, Homo sapiens
cagugcaauguuaaaagggcau

SEQ ID NO: 2668 - RNA, 18 nt, Homo sapiens
cagggaggugaaugugau

SEQ ID NO: 2669 - RNA, 22 nt, Homo sapiens
ugugacugguugaccagagggg

SEQ ID NO: 2670 - RNA, 22 nt, Homo sapiens
uaacacugucugguaaagaugg

SEQ ID NO: 2671 - RNA, 22 nt, Homo sapiens
cccugugcccggcccacuucug

SEQ ID NO: 2672 - RNA, 22 nt, Homo sapiens
uuggggaaacggccgcugagug

SEQ ID NO: 2673 - RNA, 22 nt, Homo sapiens
uaaucucagcuggcaacuguga

SEQ ID NO: 2674 - RNA, 21 nt, Homo sapiens
aucacauugccagggauuucc

SEQ ID NO: 2675 - RNA, 21 nt, Homo sapiens
aucacauugccagggauuacc

SEQ ID NO: 2676 - RNA, 22 nt, Homo sapiens
agaucgaccguguuauauucgc

SEQ ID NO: 2677 - RNA, 21 nt, Homo sapiens
acuggacuuggagucagaagg

SEQ ID NO: 2678 - RNA, 22 nt, Homo sapiens
uugggaucauuuugcauccaua

SEQ ID NO: 2679 - RNA, 21 nt, Homo sapiens
gcgacccacucuugguuucca

SEQ ID NO: 2680 - RNA, 21 nt, Homo sapiens
gcgacccauacuugguuucag

SEQ ID NO: 2681 - RNA, 21 nt, Homo sapiens
uggguuuacguugggagaacu

SEQ ID NO: 2682 - RNA, 25 nt, Homo sapiens
agggaucgcgggcggguggcggccu

SEQ ID NO: 2683 - RNA, 22 nt, Homo sapiens
gucccucuccaaaugugucuug

SEQ ID NO: 2684 - RNA, 20 nt, Homo sapiens
accaggaggcugaggccccu

SEQ ID NO: 2685 - RNA, 21 nt, Homo sapiens
uggaggagaaggaaggugaug

SEQ ID NO: 2686 - RNA, 23 nt, Homo sapiens
cugggaucuccggggucuugguu

SEQ ID NO: 2687 - RNA, 23 nt, Homo sapiens
cuggagauauggaagagcugugu

SEQ ID NO: 2688 - RNA, 22 nt, Homo sapiens
uagguuauccguguugccuucg

SEQ ID NO: 2689 - RNA, 25 nt, Homo sapiens
cccccacaaccgcgcuugacuagcu

SEQ ID NO: 2690 - RNA, 23 nt, Homo sapiens
uaagugcuuccauguuuugguga

SEQ ID NO: 2691 - RNA, 23 nt, Homo sapiens
uaagugcuuccauguuuuaguag

SEQ ID NO: 2692 - RNA, 23 nt, Homo sapiens
uaagugcuuccauguuucagugg

SEQ ID NO: 2693 - RNA, 23 nt, Homo sapiens
uaagugcuuccauguuugagugu

SEQ ID NO: 2694 - RNA, 17 nt, Homo sapiens
uaagugcuuccaugcuu

SEQ ID NO: 2695 - RNA, 23 nt, Homo sapiens
aaagugcugcgacauuugagcgu

SEQ ID NO: 2696 - RNA, 23 nt, Homo sapiens
gaagugcuucgauuuuggggugu

SEQ ID NO: 2697 - RNA, 21 nt, Homo sapiens
aauauaacacagauggccugu

SEQ ID NO: 2698 - RNA, 22 nt, Homo sapiens
gugacaucacauauacggcagc

SEQ ID NO: 2699 - RNA, 22 nt, Homo sapiens
aguggggaacccuuccaugagg

SEQ ID NO: 2700 - RNA, 22 nt, Homo sapiens
aacaucacagcaagucugugcu

SEQ ID NO: 2701 - RNA, 22 nt, Homo sapiens
aagugcugucauagcugagguc

SEQ ID NO: 2702 - RNA, 22 nt, Homo sapiens
aaagugcuucccuuuggacugu

SEQ ID NO: 2703 - RNA, 21 nt, Homo sapiens
aaagugcuuccuuuuagaggg

SEQ ID NO: 2704 - RNA, 22 nt, Homo sapiens
aaagugcuuccuuuuagagggu

SEQ ID NO: 2705 - RNA, 22 nt, Homo sapiens
aaagugcuucucuuuggugggu

SEQ ID NO: 2706 - RNA, 21 nt, Homo sapiens
aaagugcuuccuuuuugaggg

SEQ ID NO: 2707 - RNA, 20 nt, Homo sapiens
guccgcucggcgguggccca

SEQ ID NO: 2708 - RNA, 22 nt, Homo sapiens
aagauguggaaaaauuggaauc

SEQ ID NO: 2709 - RNA, 22 nt, Homo sapiens
agucauuggaggguuugagcag

SEQ ID NO: 2710 - RNA, 20 nt, Homo sapiens
auggagauagauauagaaau

SEQ ID NO: 2711 - RNA, 22 nt, Homo sapiens
gugagucucuaagaaaagagga

SEQ ID NO: 2712 - RNA, 25 nt, Homo sapiens
ggcggagggaaguagguccguuggu

SEQ ID NO: 2713 - RNA, 20 nt, Homo sapiens
agagucuugugaugucuugc

SEQ ID NO: 2714 - RNA, 23 nt, Homo sapiens
ucuggcuccgugucuucacuccc

SEQ ID NO: 2715 - RNA, 22 nt, Homo sapiens
uggagagaaaggcaguuccuga

SEQ ID NO: 2716 - RNA, 22 nt, Homo sapiens
uacccagagcaugcagugugaa

SEQ ID NO: 2717 - RNA, 22 nt, Homo sapiens
uguaaacauccuacacucagcu

SEQ ID NO: 2718 - RNA, 21 nt, Homo sapiens
uaaagugcugacagugcagau

SEQ ID NO: 2719 - RNA, 23 nt, Homo sapiens
cagugcaaugauauugucaaagc

SEQ ID NO: 2720 - RNA, 22 nt, Homo sapiens
aggugguccguggcgcguucgc

SEQ ID NO: 2721 - RNA, 20 nt, Homo sapiens
ccucugggcccuuccuccag

SEQ ID NO: 2722 - RNA, 22 nt, Homo sapiens
ucucugggccugugucuuaggc

SEQ ID NO: 2723 - RNA, 22 nt, Homo sapiens
aauugcacgguauccaucugua

SEQ ID NO: 2724 - RNA, 22 nt, Homo sapiens
ccucccacacccaaggcuugca

SEQ ID NO: 2725 - RNA, 22 nt, Homo sapiens
uggucuaggauuguuggaggag

SEQ ID NO: 2726 - RNA, 25 nt, Homo sapiens
aggggugguguugggacagcuccgu

SEQ ID NO: 2727 - RNA, 20 nt, Homo sapiens
accaggaggcugaggccccu

SEQ ID NO: 2728 - RNA, 23 nt, Homo sapiens
cacccggcugugugcacaugugc

SEQ ID NO: 2729 - RNA, 19 nt, Homo sapiens
gugaggacucgggaggugg

SEQ ID NO: 2730 - RNA, 22 nt, Homo sapiens
acaggugagguucuugggagcc

SEQ ID NO: 2731 - RNA, 21 nt, Homo sapiens
ccuguugaaguguaaucccca

SEQ ID NO: 2732 - RNA, 20 nt, Homo sapiens
ccccagggcgacgcggcggg

SEQ ID NO: 2733 - RNA, 21 nt, Homo sapiens
uucacaguggcuaaguuccgc

SEQ ID NO: 2734 - RNA, 23 nt, Homo sapiens
aucaacagacauuaauugggcgc

SEQ ID NO: 2735 - RNA, 23 nt, Homo sapiens
ucuuggaguaggucauugggugg

SEQ ID NO: 2736 - RNA, 22 nt, Homo sapiens
uugggaucauuuugcauccaua

SEQ ID NO: 2737 - RNA, 21 nt, Homo sapiens
aguuaaugaauccuggaaagu

SEQ ID NO: 2738 - RNA, 22 nt, Homo sapiens
aaccagcaccccaacuuuggac

SEQ ID NO: 2739 - RNA, 23 nt, Homo sapiens
cugggaucuccggggucuugguu

SEQ ID NO: 2740 - RNA, 23 nt, Homo sapiens
gcagcagagaauaggacuacguc

SEQ ID NO: 2741 - RNA, 22 nt, Homo sapiens
cuggacugagccgugcuacugg

SEQ ID NO: 2742 - RNA, 17 nt, Homo sapiens
uucaaguaauucaggug

SEQ ID NO: 2743 - RNA, 22 nt, Homo sapiens
uuugaggcuacagugagaugug

SEQ ID NO: 2744 - RNA, 22 nt, Homo sapiens
uuugaggcuacagugagaugug

SEQ ID NO: 2745 - RNA, 21 nt, Homo sapiens
uaccacaggguagaaccacgg

SEQ ID NO: 2746 - RNA, 22 nt, Homo sapiens
uucaaguaauccaggauaggcu

SEQ ID NO: 2747 - RNA, 21 nt, Homo sapiens
uucaaguaauucaggauaggu

SEQ ID NO: 2748 - RNA, 22 nt, Homo sapiens
gaggguuggguggaggcucucc

SEQ ID NO: 2749 - RNA, 22 nt, Homo sapiens
uguaaacauccuacacucagcu

SEQ ID NO: 2750 - RNA, 22 nt, Homo sapiens
aucacacaaaggcaacuuuugu

SEQ ID NO: 2751 - RNA, 23 nt, Homo sapiens
ugaggggcagagagcgagacuuu

SEQ ID NO: 2752 - RNA, 21 nt, Homo sapiens
gcaguccaugggcauauacac

SEQ ID NO: 2753 - RNA, 20 nt, Homo sapiens
accaggaggcugaggccccu

SEQ ID NO: 2754 - RNA, 20 nt, Homo sapiens
guagaggagauggcgcaggg

SEQ ID NO: 2755 - RNA, 22 nt, Homo sapiens
acccgucccguucguccccgga

SEQ ID NO: 2756 - RNA, 18 nt, Homo sapiens
gucccuguucaggcgcca

SEQ ID NO: 2757 - RNA, 18 nt, Homo sapiens
cagggaggugaaugugau

SEQ ID NO: 2758 - RNA, 22 nt, Homo sapiens
uggagagaaaggcaguuccuga

SEQ ID NO: 2759 - RNA, 22 nt, Homo sapiens
uaaugccccuaaaaauccuuau

SEQ ID NO: 2760 - RNA, 20 nt, Homo sapiens
aggguguuucucucaucucu

SEQ ID NO: 2761 - RNA, 21 nt, Homo sapiens
uggaggagaaggaaggugaug

SEQ ID NO: 2762 - RNA, 22 nt, Homo sapiens
ucuucucuguuuuggccaugug

SEQ ID NO: 2763 - RNA, 23 nt, Homo sapiens
caagucuuauuugagcaccuguu

SEQ ID NO: 2764 - RNA, 22 nt, Homo sapiens
cagugguuuuacccuaugguag

SEQ ID NO: 2765 - RNA, 21 nt, Homo sapiens
cuagacugaagcuccuugagg

SEQ ID NO: 2766 - RNA, 21 nt, Homo sapiens
cggcggggacggcgauugguc

SEQ ID NO: 2767 - RNA, 22 nt, Homo sapiens
ucugcccccuccgcugcugcca

SEQ ID NO: 2768 - RNA, 20 nt, Homo sapiens
acugccccaggugcugcugg

SEQ ID NO: 2769 - RNA, 21 nt, Homo sapiens
cggggcagcucaguacaggau

SEQ ID NO: 2770 - RNA, 22 nt, Homo sapiens
caaccuggaggacuccaugcug

SEQ ID NO: 2771 - RNA, 21 nt, Homo sapiens
cagcagcacacugugguuugu

SEQ ID NO: 2772 - RNA, 21 nt, Homo sapiens
cagcagcacacugugguuugu

SEQ ID NO: 2773 - RNA, 23 nt, Homo sapiens
uacuccagagggcgucacucaug

SEQ ID NO: 2774 - RNA, 22 nt, Homo sapiens
aggcggggcgccgcgggaccgc

SEQ ID NO: 2775 - RNA, 22 nt, Homo sapiens
aggcagcgggguguaguggaua

SEQ ID NO: 2776 - RNA, 21 nt, Homo sapiens
uggcagggaggcugggagggg

SEQ ID NO: 2777 - RNA, 21 nt, Homo sapiens
uaccacaggguagaaccacgg

SEQ ID NO: 2778 - RNA, 18 nt, Homo sapiens
ugaggcaguagauugaau

SEQ ID NO: 2779 - RNA, 22 nt, Homo sapiens
uguaaacauccucgacuggaag

SEQ ID NO: 2780 - RNA, 22 nt, Homo sapiens
uguaaacauccuacacucagcu

SEQ ID NO: 2781 - RNA, 23 nt, Homo sapiens
uguaaacauccuacacucucagc

SEQ ID NO: 2782 - RNA, 22 nt, Homo sapiens
uguaaacauccccgacuggaag

SEQ ID NO: 2783 - RNA, 22 nt, Homo sapiens
uguaaacauccuugacuggaag

SEQ ID NO: 2784 - RNA, 20 nt, Homo sapiens
ccucugggcccuuccuccag

SEQ ID NO: 2785 - RNA, 23 nt, Homo sapiens
gcaaagcacacggccugcagaga

SEQ ID NO: 2786 - RNA, 22 nt, Homo sapiens
ucucugggccugugucuuaggc

SEQ ID NO: 2787 - RNA, 22 nt, Homo sapiens
aauugcacgguauccaucugua

SEQ ID NO: 2788 - RNA, 21 nt, Homo sapiens
cggggcagcucaguacaggau

SEQ ID NO: 2789 - RNA, 18 nt, Homo sapiens
ugcuuccuuucagagggu

SEQ ID NO: 2790 - RNA, 22 nt, Homo sapiens
aucuggagguaagaagcacuuu

SEQ ID NO: 2791 - RNA, 22 nt, Homo sapiens
uggugggcacagaaucuggacu

SEQ ID NO: 2792 - RNA, 24 nt, Homo sapiens
acugggggcuuucgggcucugcgu

SEQ ID NO: 2793 - RNA, 21 nt, Homo sapiens
guggcugcacucacuuccuuc

SEQ ID NO: 2794 - RNA, 22 nt, Homo sapiens
uggugggccgcagaacaugugc

SEQ ID NO: 2795 - RNA, 21 nt, Homo sapiens
aaggcagggcccccgcucccc

SEQ ID NO: 2796 - RNA, 22 nt, Homo sapiens
aacccguagauccgaucuugug

SEQ ID NO: 2797 - RNA, 22 nt, Homo sapiens
cacccguagaaccgaccuugcg

SEQ ID NO: 2798 - RNA, 21 nt, Homo sapiens
uguucauguagauguuuaagc

SEQ ID NO: 2799 - RNA, 20 nt, Homo sapiens
gugucugggcggacagcugc

SEQ ID NO: 2800 - RNA, 22 nt, Homo sapiens
aacuggaucaauuauaggagug

SEQ ID NO: 2801 - RNA, 17 nt, Homo sapiens
gugggggagaggcuguc

SEQ ID NO: 2802 - RNA, 21 nt, Homo sapiens
uuaggccgcagaucuggguga

SEQ ID NO: 2803 - RNA, 22 nt, Homo sapiens
uggagagaaaggcaguuccuga

SEQ ID NO: 2804 - RNA, 22 nt, Homo sapiens
ucgugucuuguguugcagccgg

SEQ ID NO: 2805 - RNA, 23 nt, Homo sapiens
cccaguguucagacuaccuguuc

SEQ ID NO: 2806 - RNA, 23 nt, Homo sapiens
cccaguguuuagacuaucuguuc

SEQ ID NO: 2807 - RNA, 23 nt, Homo sapiens
caaagugcucauagugcagguag

SEQ ID NO: 2808 - RNA, 23 nt, Homo sapiens
agcuacauugucugcuggguuuc

SEQ ID NO: 2809 - RNA, 21 nt, Homo sapiens
gccccugggccuauccuagaa

SEQ ID NO: 2810 - RNA, 22 nt, Homo sapiens
aacuguuugcagaggaaacuga

SEQ ID NO: 2811 - RNA, 22 nt, Homo sapiens
aucuggagguaagaagcacuuu

SEQ ID NO: 2812 - RNA, 25 nt, Homo sapiens
aggggugguguugggacagcuccgu

SEQ ID NO: 2813 - RNA, 22 nt, Homo sapiens
ugagccccugugccgcccccag

SEQ ID NO: 2814 - RNA, 18 nt, Homo sapiens
cgggcguggugguggggg

SEQ ID NO: 2815 - RNA, 22 nt, Homo sapiens
cugaagcucagagggcucugau

SEQ ID NO: 2816 - RNA, 21 nt, Homo sapiens
cggcggggacggcgauugguc

SEQ ID NO: 2817 - RNA, 21 nt, Homo sapiens
ugacaacuauggaugagcucu

SEQ ID NO: 2818 - RNA, 22 nt, Homo sapiens
aaaaguaauugcggauuuugcc

SEQ ID NO: 2819 - RNA, 23 nt, Homo sapiens
aggaccugcgggacaagauucuu

SEQ ID NO: 2820 - RNA, 19 nt, Homo sapiens
ugggcguaucuguaugcua

SEQ ID NO: 2821 - RNA, 24 nt, Homo sapiens
gaccuggacauguuugugcccagu

SEQ ID NO: 2822 - RNA, 21 nt, Homo sapiens
agaccuggcccagaccucagc

SEQ ID NO: 2823 - RNA, 22 nt, Homo sapiens
aggcggggcgccgcgggaccgc

SEQ ID NO: 2824 - RNA, 22 nt, Homo sapiens
ugcggggcuagggcuaacagca

SEQ ID NO: 2825 - RNA, 21 nt, Homo sapiens
uggcagggaggcugggagggg

SEQ ID NO: 2826 - RNA, 24 nt, Homo sapiens
uggcccugacugaagaccagcagu

SEQ ID NO: 2827 - RNA, 25 nt, Homo sapiens
ugggaacggguuccggcagacgcug

SEQ ID NO: 2828 - RNA, 19 nt, Homo sapiens
gaugaugcugcugaugcug

SEQ ID NO: 2829 - RNA, 23 nt, Homo sapiens
ucuggcuccgugucuucacuccc

SEQ ID NO: 2830 - RNA, 21 nt, Homo sapiens
cggcggggacggcgauugguc

SEQ ID NO: 2831 - RNA, 22 nt, Homo sapiens
cgcaggggccgggugcucaccg

SEQ ID NO: 2832 - RNA, 22 nt, Homo sapiens
uguaaacauccuacacucagcu

SEQ ID NO: 2833 - RNA, 22 nt, Homo sapiens
aggcggggcgccgcgggaccgc

SEQ ID NO: 2834 - RNA, 22 nt, Homo sapiens
ugcggggcuagggcuaacagca

SEQ ID NO: 2835 - RNA, 21 nt, Homo sapiens
uggaggagaaggaaggugaug

SEQ ID NO: 2836 - RNA, 24 nt, Homo sapiens
uggggagcugaggcucugggggug

SEQ ID NO: 2837 - RNA, 22 nt, Homo sapiens
uggagugugacaaugguguuug

SEQ ID NO: 2838 - RNA, 21 nt, Homo sapiens
aagugaucuaaaggccuacau

SEQ ID NO: 2839 - RNA, 21 nt, Homo sapiens
cggcggggacggcgauugguc

SEQ ID NO: 2840 - RNA, 22 nt, Homo sapiens
agaggcuggccgugaugaauuc

SEQ ID NO: 2841 - RNA, 19 nt, Homo sapiens
gggcgccugugaucccaac

SEQ ID NO: 2842 - RNA, 22 nt, Homo sapiens
uccgagccugggucucccucuu

SEQ ID NO: 2843 - RNA, 22 nt, Homo sapiens
gucccucuccaaaugugucuug

SEQ ID NO: 2844 - RNA, 19 nt, Homo sapiens
ucuaggcugguacugcuga

SEQ ID NO: 2845 - RNA, 19 nt, Homo sapiens
aagcagcugccucugaggc

SEQ ID NO: 2846 - RNA, 22 nt, Homo sapiens
aggcggggcgccgcgggaccgc

SEQ ID NO: 2847 - RNA, 22 nt, Homo sapiens
ugcggggcuagggcuaacagca

SEQ ID NO: 2848 - RNA, 20 nt, Homo sapiens
ggggagcuguggaagcagua

SEQ ID NO: 2849 - RNA, 23 nt, Homo sapiens
aaaagugcuuacagugcagguag

SEQ ID NO: 2850 - RNA, 21 nt, Homo sapiens
uaaagugcugacagugcagau

SEQ ID NO: 2851 - RNA, 18 nt, Homo sapiens
uugagaaggaggcugcug

SEQ ID NO: 2852 - RNA, 22 nt, Homo sapiens
acucggcguggcgucggucgug

SEQ ID NO: 2853 - RNA, 23 nt, Homo sapiens
caaagugcuuacagugcagguag

SEQ ID NO: 2854 - RNA, 22 nt, Homo sapiens
cccugugcccggcccacuucug

SEQ ID NO: 2855 - RNA, 23 nt, Homo sapiens
uaaagugcuuauagugcagguag

SEQ ID NO: 2856 - RNA, 23 nt, Homo sapiens
caaagugcucauagugcagguag

SEQ ID NO: 2857 - RNA, 22 nt, Homo sapiens
uaaucucagcuggcaacuguga

SEQ ID NO: 2858 - RNA, 23 nt, Homo sapiens
uacuccagagggcgucacucaug

SEQ ID NO: 2859 - RNA, 22 nt, Homo sapiens
aaagugcauccuuuuagagugu

SEQ ID NO: 2860 - RNA, 22 nt, Homo sapiens
aaagugcauccuuuuagagugu

SEQ ID NO: 2861 - RNA, 22 nt, Homo sapiens
aaagugcauccuuuuagagguu

SEQ ID NO: 2862 - RNA, 22 nt, Homo sapiens
aaagugcauccuuuuagagguu

SEQ ID NO: 2863 - RNA, 22 nt, Homo sapiens
aaagugcaucuuuuuagaggau

SEQ ID NO: 2864 - RNA, 22 nt, Homo sapiens
aaagugcaucuuuuuagaggau

SEQ ID NO: 2865 - RNA, 22 nt, Homo sapiens
caaagugccucccuuuagagug

SEQ ID NO: 2866 - RNA, 24 nt, Homo sapiens
acaaagugcuucccuuuagagugu

SEQ ID NO: 2867 - RNA, 22 nt, Homo sapiens
acaaagugcuucccuuuagagu

SEQ ID NO: 2868 - RNA, 23 nt, Homo sapiens
cucuugagggaagcacuuucugu

SEQ ID NO: 2869 - RNA, 21 nt, Homo sapiens
gcgacccauacuugguuucag

SEQ ID NO: 2870 - RNA, 24 nt, Homo sapiens
cugaagugauguguaacugaucag

SEQ ID NO: 2871 - RNA, 23 nt, Homo sapiens
ugagugugugugugugagugugu

SEQ ID NO: 2872 - RNA, 19 nt, Homo sapiens
aagugugcagggcacuggu

SEQ ID NO: 2873 - RNA, 23 nt, Homo sapiens
caaagugcuguucgugcagguag

SEQ ID NO: 2874 - RNA, 22 nt, Homo sapiens
ugagccccugugccgcccccag

SEQ ID NO: 2875 - RNA, 22 nt, Homo sapiens
uggagugugacaaugguguuug

SEQ ID NO: 2876 - RNA, 24 nt, Homo sapiens
ucccugagacccuuuaaccuguga

SEQ ID NO: 2877 - RNA, 22 nt, Homo sapiens
ucccugagacccuaacuuguga

SEQ ID NO: 2878 - RNA, 23 nt, Homo sapiens
ccucagggcuguagaacagggcu

SEQ ID NO: 2879 - RNA, 22 nt, Homo sapiens
uggguggucuggagauuugugc

SEQ ID NO: 2880 - RNA, 22 nt, Homo sapiens
acucggcguggcgucggucgug

SEQ ID NO: 2881 - RNA, 21 nt, Homo sapiens
cggcggggacggcgauugguc

SEQ ID NO: 2882 - RNA, 20 nt, Homo sapiens
ccccagggcgacgcggcggg

SEQ ID NO: 2883 - RNA, 22 nt, Homo sapiens
cauugcacuugucucggucuga

SEQ ID NO: 2884 - RNA, 22 nt, Homo sapiens
aggugguccguggcgcguucgc

SEQ ID NO: 2885 - RNA, 21 nt, Homo sapiens
gccccugggccuauccuagaa

SEQ ID NO: 2886 - RNA, 23 nt, Homo sapiens
ugagcgccucgacgacagagccg

SEQ ID NO: 2887 - RNA, 23 nt, Homo sapiens
uagcagcgggaacaguucugcag

SEQ ID NO: 2888 - RNA, 22 nt, Homo sapiens
uacucaggagaguggcaaucac

SEQ ID NO: 2889 - RNA, 22 nt, Homo sapiens
uccgagccugggucucccucuu

SEQ ID NO: 2890 - RNA, 22 nt, Homo sapiens
aggcggggcgccgcgggaccgc

SEQ ID NO: 2891 - RNA, 22 nt, Homo sapiens
ugcggggcuagggcuaacagca

SEQ ID NO: 2892 - RNA, 23 nt, Homo sapiens
uccaguaccacgugucagggcca

SEQ ID NO: 2893 - RNA, 25 nt, Homo sapiens
cuagugagggacagaaccaggauuc

SEQ ID NO: 2894 - RNA, 21 nt, Homo sapiens
uaggacacauggucuacuucu

SEQ ID NO: 2895 - RNA, 21 nt, Homo sapiens
cggcggggacggcgauugguc

SEQ ID NO: 2896 - RNA, 22 nt, Homo sapiens
acagcaggcacagacaggcagu

SEQ ID NO: 2897 - RNA, 22 nt, Homo sapiens
gccugcugggguggaaccuggu

SEQ ID NO: 2898 - RNA, 23 nt, Homo sapiens
gcgaggaccccucggggucugac

SEQ ID NO: 2899 - RNA, 22 nt, Homo sapiens
aggcggggcgccgcgggaccgc

SEQ ID NO: 2900 - RNA, 23 nt, Homo sapiens
uggugcggagagggcccacagug

SEQ ID NO: 2901 - RNA, 22 nt, Homo sapiens
ugcggggcuagggcuaacagca

SEQ ID NO: 2902 - RNA, 23 nt, Homo sapiens
cgggucggaguuagcucaagcgg

SEQ ID NO: 2903 - RNA, 22 nt, Homo sapiens
auccgcgcucugacucucugcc

SEQ ID NO: 2904 - RNA, 23 nt, Homo sapiens
agcagcauuguacagggcuauga

SEQ ID NO: 2905 - RNA, 23 nt, Homo sapiens
ucaaaugcucagacuccuguggu

SEQ ID NO: 2906 - RNA, 23 nt, Homo sapiens
agcagcauuguacagggcuauca

SEQ ID NO: 2907 - RNA, 24 nt, Homo sapiens
agccuggaagcuggagccugcagu

SEQ ID NO: 2908 - RNA, 19 nt, Homo sapiens
uggauuuuuggaucaggga

SEQ ID NO: 2909 - RNA, 22 nt, Homo sapiens
cucccacugcuucacuugacua

SEQ ID NO: 2910 - RNA, 22 nt, Homo sapiens
uagcuuaucagacugauguuga

SEQ ID NO: 2911 - RNA, 22 nt, Homo sapiens
ucaggcucaguccccucccgau

SEQ ID NO: 2912 - RNA, 21 nt, Homo sapiens
cagcagcacacugugguuugu

SEQ ID NO: 2913 - RNA, 23 nt, Homo sapiens
uacuccagagggcgucacucaug

SEQ ID NO: 2914 - RNA, 23 nt, Homo sapiens
uacuccagagggcgucacucaug

SEQ ID NO: 2915 - RNA, 22 nt, Homo sapiens
aucuggagguaagaagcacuuu

SEQ ID NO: 2916 - RNA, 23 nt, Homo sapiens
caaagcgcuucucuuuagagugu

SEQ ID NO: 2917 - RNA, 21 nt, Homo sapiens
cuccagagggaaguacuuucu

SEQ ID NO: 2918 - RNA, 21 nt, Homo sapiens
cuccagagggaugcacuuucu

SEQ ID NO: 2919 - RNA, 22 nt, Homo sapiens
caaaaaccacaguuucuuuugc

SEQ ID NO: 2920 - RNA, 22 nt, Homo sapiens
gagcuuauucauaaaagugcag

SEQ ID NO: 2921 - RNA, 23 nt, Homo sapiens
uaaaucccauggugccuucuccu

SEQ ID NO: 2922 - RNA, 20 nt, Homo sapiens
cggcucugggucugugggga

SEQ ID NO: 2923 - RNA, 20 nt, Homo sapiens
guagaggagauggcgcaggg

SEQ ID NO: 2924 - RNA, 21 nt, Homo sapiens
uggcagggaggcugggagggg

SEQ ID NO: 2925 - RNA, 22 nt, Homo sapiens
agaaggaaauugaauucauuua

SEQ ID NO: 2926 - RNA, 24 nt, Homo sapiens
agccuggaagcuggagccugcagu

SEQ ID NO: 2927 - RNA, 20 nt, Homo sapiens
ucguuugccuuuuucugcuu

SEQ ID NO: 2928 - RNA, 22 nt, Homo sapiens
aguggggaacccuuccaugagg

SEQ ID NO: 2929 - RNA, 22 nt, Homo sapiens
ucagcaaacauuuauugugugc

SEQ ID NO: 2930 - RNA, 23 nt, Homo sapiens
cgggucggaguuagcucaagcgg

SEQ ID NO: 2931 - RNA, 20 nt, Homo sapiens
ggggagcuguggaagcagua

SEQ ID NO: 2932 - RNA, 22 nt, Homo sapiens
auccgcgcucugacucucugcc

SEQ ID NO: 2933 - RNA, 21 nt, Homo sapiens
aaggcagggcccccgcucccc

SEQ ID NO: 2934 - RNA, 20 nt, Homo sapiens
uaaagagcccuguggagaca

SEQ ID NO: 2935 - RNA, 17 nt, Homo sapiens
ucgccuccuccucuccc

SEQ ID NO: 2936 - RNA, 18 nt, Homo sapiens
cagggaggugaaugugau

SEQ ID NO: 2937 - RNA, 21 nt, Homo sapiens
cggcggggacggcgauugguc

SEQ ID NO: 2938 - RNA, 22 nt, Homo sapiens
uagguaguuucauguuguuggg

SEQ ID NO: 2939 - RNA, 22 nt, Homo sapiens
uagguaguuuccuguuguuggg

SEQ ID NO: 2940 - RNA, 23 nt, Homo sapiens
agcuacauugucugcuggguuuc

SEQ ID NO: 2941 - RNA, 22 nt, Homo sapiens
ugucaguuugucaaauacccca

SEQ ID NO: 2942 - RNA, 21 nt, Homo sapiens
agggggaaaguucuauagucc

SEQ ID NO: 2943 - RNA, 22 nt, Homo sapiens
aggcggggcgccgcgggaccgc

SEQ ID NO: 2944 - RNA, 21 nt, Homo sapiens
ucguggccuggucuccauuau

SEQ ID NO: 2945 - RNA, 22 nt, Homo sapiens
uguaaacauccuacacucagcu

SEQ ID NO: 2946 - RNA, 22 nt, Homo sapiens
uuauaaagcaaugagacugauu

SEQ ID NO: 2947 - RNA, 22 nt, Homo sapiens
cuuaugcaagauucccuucuac

SEQ ID NO: 2948 - RNA, 20 nt, Homo sapiens
auguauaaauguauacacac

SEQ ID NO: 2949 - RNA, 24 nt, Homo sapiens
ugccugggucucuggccugcgcgu

SEQ ID NO: 2950 - RNA, 22 nt, Homo sapiens
gguggcccggccgugccugagg

SEQ ID NO: 2951 - RNA, 18 nt, Homo sapiens
cagggaggugaaugugau

SEQ ID NO: 2952 - RNA, 23 nt, Homo sapiens
ucuggcuccgugucuucacuccc

SEQ ID NO: 2953 - RNA, 22 nt, Homo sapiens
uggagagaaaggcaguuccuga

SEQ ID NO: 2954 - RNA, 23 nt, Homo sapiens
uaaggugcaucuagugcagauag

SEQ ID NO: 2955 - RNA, 20 nt, Homo sapiens
ccuccugcccuccuugcugu

SEQ ID NO: 2956 - RNA, 22 nt, Homo sapiens
uagcuuaucagacugauguuga

SEQ ID NO: 2957 - RNA, 22 nt, Homo sapiens
uggcucaguucagcaggaacag

SEQ ID NO: 2958 - RNA, 22 nt, Homo sapiens
agaggcuggccgugaugaauuc

SEQ ID NO: 2959 - RNA, 21 nt, Homo sapiens
gaaggcgcuucccuuuggagu

SEQ ID NO: 2960 - RNA, 22 nt, Homo sapiens
gaaggcgcuucccuuuagagcg

SEQ ID NO: 2961 - RNA, 21 nt, Homo sapiens
aguuaaugaauccuggaaagu

SEQ ID NO: 2962 - RNA, 22 nt, Homo sapiens
uccgagccugggucucccucuu

SEQ ID NO: 2963 - RNA, 23 nt, Homo sapiens
aucccuugcaggggcuguugggu

SEQ ID NO: 2964 - RNA, 21 nt, Homo sapiens
aagugaucuaaaggccuacau

SEQ ID NO: 2965 - RNA, 22 nt, Homo sapiens
acaggugagguucuugggagcc

SEQ ID NO: 2966 - RNA, 22 nt, Homo sapiens
ugcuggaucagugguucgaguc

SEQ ID NO: 2967 - RNA, 23 nt, Homo sapiens
ugaguaccgccaugucuguuggg

SEQ ID NO: 2968 - RNA, 22 nt, Homo sapiens
ucaggccaggcacaguggcuca

SEQ ID NO: 2969 - RNA, 22 nt, Homo sapiens
aaaagcuggguugagagggcga

SEQ ID NO: 2970 - RNA, 22 nt, Homo sapiens
aaaagcuggguugagagggcaa

SEQ ID NO: 2971 - RNA, 20 nt, Homo sapiens
aaaagcuggguugagagggu

SEQ ID NO: 2972 - RNA, 19 nt, Homo sapiens
aaaagcuggguugagagga

SEQ ID NO: 2973 - RNA, 22 nt, Homo sapiens
uuaucagaaucuccagggguac

SEQ ID NO: 2974 - RNA, 23 nt, Homo sapiens
agguuguccguggugaguucgca

SEQ ID NO: 2975 - RNA, 23 nt, Homo sapiens
uagugcaauauugcuuauagggu

SEQ ID NO: 2976 - RNA, 21 nt, Homo sapiens
augauccaggaaccugccucu

SEQ ID NO: 2977 - RNA, 22 nt, Homo sapiens
aggcauugacuucucacuagcu

SEQ ID NO: 2978 - RNA, 18 nt, Homo sapiens
uugagaaggaggcugcug

SEQ ID NO: 2979 - RNA, 21 nt, Homo sapiens
cuccguuugccuguuucgcug

SEQ ID NO: 2980 - RNA, 23 nt, Homo sapiens
caacggaaucccaaaagcagcug

SEQ ID NO: 2981 - RNA, 22 nt, Homo sapiens
uggcaguguauuguuagcuggu

SEQ ID NO: 2982 - RNA, 22 nt, Homo sapiens
uaaugccccuaaaaauccuuau

SEQ ID NO: 2983 - RNA, 22 nt, Homo sapiens
caaaaaccacaguuucuuuugc

SEQ ID NO: 2984 - RNA, 22 nt, Homo sapiens
ugagaaccacgucugcucugag

SEQ ID NO: 2985 - RNA, 21 nt, Homo sapiens
uugugcuugaucuaaccaugu

SEQ ID NO: 2986 - RNA, 21 nt, Homo sapiens
uggaggagaaggaaggugaug

SEQ ID NO: 2987 - RNA, 21 nt, Homo sapiens
ccccaccuccucucuccucag

SEQ ID NO: 2988 - RNA, 24 nt, Homo sapiens
agccuggaagcuggagccugcagu

SEQ ID NO: 2989 - RNA, 18 nt, Homo sapiens
aucccaccucugccacca

SEQ ID NO: 2990 - RNA, 22 nt, Homo sapiens
cagugcaauguuaaaagggcau

SEQ ID NO: 2991 - RNA, 21 nt, Homo sapiens
aucacauugccagggauuucc

SEQ ID NO: 2992 - RNA, 21 nt, Homo sapiens
aucacauugccagggauuacc

SEQ ID NO: 2993 - RNA, 25 nt, Homo sapiens
aggggugguguugggacagcuccgu

SEQ ID NO: 2994 - RNA, 22 nt, Homo sapiens
cugcccuggcccgagggaccga

SEQ ID NO: 2995 - RNA, 21 nt, Homo sapiens
uggcagggaggcugggagggg

SEQ ID NO: 2996 - RNA, 22 nt, Homo sapiens
ccucuuccccuugucucuccag

SEQ ID NO: 2997 - RNA, 21 nt, Homo sapiens
cggcggggacggcgauugguc

SEQ ID NO: 2998 - RNA, 19 nt, Homo sapiens
gggcgccugugaucccaac

SEQ ID NO: 2999 - RNA, 21 nt, Homo sapiens
agaccuggcccagaccucagc

SEQ ID NO: 3000 - RNA, 19 nt, Homo sapiens
aguguggcuuucuuagagc

SEQ ID NO: 3001 - RNA, 21 nt, Homo sapiens
guggcugcacucacuuccuuc

SEQ ID NO: 3002 - RNA, 22 nt, Homo sapiens
aggcggggcgccgcgggaccgc

SEQ ID NO: 3003 - RNA, 22 nt, Homo sapiens
ugcggggcuagggcuaacagca

SEQ ID NO: 3004 - RNA, 20 nt, Homo sapiens
guagaggagauggcgcaggg

SEQ ID NO: 3005 - RNA, 22 nt, Homo sapiens
uggaauguaaggaagugugugg

SEQ ID NO: 3006 - RNA, 21 nt, Homo sapiens
uccugcgcgucccagaugccc

SEQ ID NO: 3007 - RNA, 21 nt, Homo sapiens
cggcggggacggcgauugguc

SEQ ID NO: 3008 - RNA, 22 nt, Homo sapiens
ucugcccccuccgcugcugcca

SEQ ID NO: 3009 - RNA, 20 nt, Homo sapiens
ccuccugcccuccuugcugu

SEQ ID NO: 3010 - RNA, 20 nt, Homo sapiens
acugccccaggugcugcugg

SEQ ID NO: 3011 - RNA, 22 nt, Homo sapiens
aacacaccugguuaaccucuuu

SEQ ID NO: 3012 - RNA, 22 nt, Homo sapiens
aacacaccuauucaaggauuca

SEQ ID NO: 3013 - RNA, 21 nt, Homo sapiens
cggggcagcucaguacaggau

SEQ ID NO: 3014 - RNA, 18 nt, Homo sapiens
ugcuuccuuucagagggu

SEQ ID NO: 3015 - RNA, 22 nt, Homo sapiens
aucuggagguaagaagcacuuu

SEQ ID NO: 3016 - RNA, 22 nt, Homo sapiens
aucuggagguaagaagcacuuu

SEQ ID NO: 3017 - RNA, 23 nt, Homo sapiens
caaagcgcuucucuuuagagugu

SEQ ID NO: 3018 - RNA, 21 nt, Homo sapiens
cuccagagggaaguacuuucu

SEQ ID NO: 3019 - RNA, 21 nt, Homo sapiens
cuccagagggaugcacuuucu

SEQ ID NO: 3020 - RNA, 20 nt, Homo sapiens
guccgcucggcgguggccca

SEQ ID NO: 3021 - RNA, 25 nt, Homo sapiens
ggcggagggaaguagguccguuggu

SEQ ID NO: 3022 - RNA, 22 nt, Homo sapiens
aggcggggcgccgcgggaccgc

SEQ ID NO: 3023 - RNA, 22 nt, Homo sapiens
ugcggggcuagggcuaacagca

SEQ ID NO: 3024 - RNA, 21 nt, Homo sapiens
uggaggagaaggaaggugaug

SEQ ID NO: 3025 - RNA, 23 nt, Homo sapiens
agcagcauuguacagggcuauga

SEQ ID NO: 3026 - RNA, 23 nt, Homo sapiens
agcagcauuguacagggcuauca

SEQ ID NO: 3027 - RNA, 22 nt, Homo sapiens
uagcagcacauaaugguuugug

SEQ ID NO: 3028 - RNA, 22 nt, Homo sapiens
uagcagcacaucaugguuuaca

SEQ ID NO: 3029 - RNA, 22 nt, Homo sapiens
uagcagcacguaaauauuggcg

SEQ ID NO: 3030 - RNA, 18 nt, Homo sapiens
ugaggcaguagauugaau

SEQ ID NO: 3031 - RNA, 21 nt, Homo sapiens
uagcagcacagaaauauuggc

SEQ ID NO: 3032 - RNA, 23 nt, Homo sapiens
uaaagugcuuauagugcagguag

SEQ ID NO: 3033 - RNA, 22 nt, Homo sapiens
aagcugccaguugaagaacugu

SEQ ID NO: 3034 - RNA, 23 nt, Homo sapiens
cgcauccccuagggcauuggugu

SEQ ID NO: 3035 - RNA, 23 nt, Homo sapiens
ugucugcccgcaugccugccucu

SEQ ID NO: 3036 - RNA, 22 nt, Homo sapiens
cagcagcaauucauguuuugaa

SEQ ID NO: 3037 - RNA, 21 nt, Homo sapiens
cagcagcacacugugguuugu

SEQ ID NO: 3038 - RNA, 22 nt, Homo sapiens
ucagcaaacauuuauugugugc

SEQ ID NO: 3039 - RNA, 19 nt, Homo sapiens
ugagcugcuguaccaaaau

SEQ ID NO: 3040 - RNA, 22 nt, Homo sapiens
aagauguggaaaaauuggaauc

SEQ ID NO: 3041 - RNA, 19 nt, Homo sapiens
gugucugcuuccuguggga

SEQ ID NO: 3042 - RNA, 21 nt, Homo sapiens
aggaggcagcgcucucaggac

SEQ ID NO: 3043 - RNA, 20 nt, Homo sapiens
cggcucugggucugugggga

SEQ ID NO: 3044 - RNA, 23 nt, Homo sapiens
ucugcucauaccccaugguuucu

SEQ ID NO: 3045 - RNA, 21 nt, Homo sapiens
uggcagggaggcugggagggg

SEQ ID NO: 3046 - RNA, 17 nt, Homo sapiens
ucgccuccuccucuccc

SEQ ID NO: 3047 - RNA, 22 nt, Homo sapiens
ucugggcaacaaagugagaccu

SEQ ID NO: 3048 - RNA, 24 nt, Homo sapiens
uggcccugacugaagaccagcagu

SEQ ID NO: 3049 - RNA, 23 nt, Homo sapiens
acuccauuuguuuugaugaugga

SEQ ID NO: 3050 - RNA, 21 nt, Homo sapiens
gcccuccgcccgugcaccccg

SEQ ID NO: 3051 - RNA, 22 nt, Homo sapiens
uggagagaaaggcaguuccuga

SEQ ID NO: 3052 - RNA, 21 nt, Homo sapiens
cggcggggacggcgauugguc

SEQ ID NO: 3053 - RNA, 22 nt, Homo sapiens
cauugcacuugucucggucuga

SEQ ID NO: 3054 - RNA, 22 nt, Homo sapiens
cauugcacuugucucggucuga

SEQ ID NO: 3055 - RNA, 22 nt, Homo sapiens
cuggcccucucugcccuuccgu

SEQ ID NO: 3056 - RNA, 23 nt, Homo sapiens
ucccccaggugugauucugauuu

SEQ ID NO: 3057 - RNA, 23 nt, Homo sapiens
uagugcaauauugcuuauagggu

SEQ ID NO: 3058 - RNA, 21 nt, Homo sapiens
aggguaagcugaaccucugau

SEQ ID NO: 3059 - RNA, 25 nt, Homo sapiens
gcugggcagggcuucugagcuccuu

SEQ ID NO: 3060 - RNA, 24 nt, Homo sapiens
acugggggcuuucgggcucugcgu

SEQ ID NO: 3061 - RNA, 25 nt, Homo sapiens
ggcggagggaaguagguccguuggu

SEQ ID NO: 3062 - RNA, 25 nt, Homo sapiens
ggcggagggaaguagguccguuggu

SEQ ID NO: 3063 - RNA, 22 nt, Homo sapiens
aggcggggcgccgcgggaccgc

SEQ ID NO: 3064 - RNA, 22 nt, Homo sapiens
ugcggggcuagggcuaacagca

SEQ ID NO: 3065 - RNA, 21 nt, Homo sapiens
uggaggagaaggaaggugaug

SEQ ID NO: 3066 - RNA, 22 nt, Homo sapiens
acuccagccccacagccucagc

SEQ ID NO: 3067 - RNA, 23 nt, Homo sapiens
ccugcagcgacuugauggcuucc

SEQ ID NO: 3068 - RNA, 23 nt, Homo sapiens
ccugcagcgacuugauggcuucc

SEQ ID NO: 3069 - RNA, 22 nt, Homo sapiens
uggagugugacaaugguguuug

SEQ ID NO: 3070 - RNA, 22 nt, Homo sapiens
uaacacugucugguaaagaugg

SEQ ID NO: 3071 - RNA, 23 nt, Homo sapiens
uaaggugcaucuagugcagauag

SEQ ID NO: 3072 - RNA, 23 nt, Homo sapiens
uaaggugcaucuagugcaguuag

SEQ ID NO: 3073 - RNA, 22 nt, Homo sapiens
uagguaguuucauguuguuggg

SEQ ID NO: 3074 - RNA, 23 nt, Homo sapiens
cccaguguucagacuaccuguuc

SEQ ID NO: 3075 - RNA, 23 nt, Homo sapiens
cccaguguuuagacuaucuguuc

SEQ ID NO: 3076 - RNA, 22 nt, Homo sapiens
uaacacugucugguaacgaugu

SEQ ID NO: 3077 - RNA, 22 nt, Homo sapiens
uccuucauuccaccggagucug

SEQ ID NO: 3078 - RNA, 22 nt, Homo sapiens
cauugcacuugucucggucuga

SEQ ID NO: 3079 - RNA, 22 nt, Homo sapiens
agaggcuggccgugaugaauuc

SEQ ID NO: 3080 - RNA, 21 nt, Homo sapiens
guggcugcacucacuuccuuc

SEQ ID NO: 3081 - RNA, 22 nt, Homo sapiens
ugcggggcuagggcuaacagca

SEQ ID NO: 3082 - RNA, 21 nt, Homo sapiens
gugccagcugcagugggggag

SEQ ID NO: 3083 - RNA, 21 nt, Homo sapiens
uggcagggaggcugggagggg

SEQ ID NO: 3084 - RNA, 22 nt, Homo sapiens
ucaccagcccuguguucccuag

SEQ ID NO: 3085 - RNA, 22 nt, Homo sapiens
ucggccugaccacccaccccac

SEQ ID NO: 3086 - RNA, 23 nt, Homo sapiens
agcugguguugugaaucaggccg

SEQ ID NO: 3087 - RNA, 23 nt, Homo sapiens
ucuggcuccgugucuucacuccc

SEQ ID NO: 3088 - RNA, 23 nt, Homo sapiens
uaaggugcaucuagugcagauag

SEQ ID NO: 3089 - RNA, 21 nt, Homo sapiens
cggcggggacggcgauugguc

SEQ ID NO: 3090 - RNA, 21 nt, Homo sapiens
cggcggggacggcgauugguc

SEQ ID NO: 3091 - RNA, 22 nt, Homo sapiens
cgcaggggccgggugcucaccg

SEQ ID NO: 3092 - RNA, 22 nt, Homo sapiens
cccugugcccggcccacuucug

SEQ ID NO: 3093 - RNA, 20 nt, Homo sapiens
ccccagggcgacgcggcggg

SEQ ID NO: 3094 - RNA, 21 nt, Homo sapiens
aucacauugccagggauuucc

SEQ ID NO: 3095 - RNA, 21 nt, Homo sapiens
aucacauugccagggauuacc

SEQ ID NO: 3096 - RNA, 23 nt, Homo sapiens
ucccccaggugugauucugauuu

SEQ ID NO: 3097 - RNA, 22 nt, Homo sapiens
uggugggcacagaaucuggacu

SEQ ID NO: 3098 - RNA, 19 nt, Homo sapiens
ugucucugcugggguuucu

SEQ ID NO: 3099 - RNA, 25 nt, Homo sapiens
aggggugguguugggacagcuccgu

SEQ ID NO: 3100 - RNA, 23 nt, Homo sapiens
gcgaggaccccucggggucugac

SEQ ID NO: 3101 - RNA, 22 nt, Homo sapiens
aaccagcaccccaacuuuggac

SEQ ID NO: 3102 - RNA, 24 nt, Homo sapiens
acugggggcuuucgggcucugcgu

SEQ ID NO: 3103 - RNA, 22 nt, Homo sapiens
uggugggccgcagaacaugugc

SEQ ID NO: 3104 - RNA, 22 nt, Homo sapiens
aggcggggcgccgcgggaccgc

SEQ ID NO: 3105 - RNA, 22 nt, Homo sapiens
aggcggggcgccgcgggaccgc

SEQ ID NO: 3106 - RNA, 22 nt, Homo sapiens
ugcggggcuagggcuaacagca

SEQ ID NO: 3107 - RNA, 22 nt, Homo sapiens
cugcccuggcccgagggaccga

SEQ ID NO: 3108 - RNA, 17 nt, Homo sapiens
ucgccuccuccucuccc

SEQ ID NO: 3109 - RNA, 21 nt, Homo sapiens
cggcggggacggcgauugguc

SEQ ID NO: 3110 - RNA, 20 nt, Homo sapiens
ccuccugcccuccuugcugu

SEQ ID NO: 3111 - RNA, 22 nt, Homo sapiens
cauugcacuugucucggucuga

SEQ ID NO: 3112 - RNA, 22 nt, Homo sapiens
agaggcuggccgugaugaauuc

SEQ ID NO: 3113 - RNA, 25 nt, Homo sapiens
ggcggagggaaguagguccguuggu

SEQ ID NO: 3114 - RNA, 22 nt, Homo sapiens
aggcggggcgccgcgggaccgc

SEQ ID NO: 3115 - RNA, 22 nt, Homo sapiens
ugcggggcuagggcuaacagca

SEQ ID NO: 3116 - RNA, 22 nt, Homo sapiens
uauugcacucgucccggccucc

SEQ ID NO: 3117 - RNA, 20 nt, Homo sapiens
ucacuguucagacaggcgga

SEQ ID NO: 3118 - RNA, 20 nt, Homo sapiens
uaaagagcccuguggagaca

SEQ ID NO: 3119 - RNA, 20 nt, Homo sapiens
uacaguauagaugauguacu

SEQ ID NO: 3120 - RNA, 21 nt, Homo sapiens
uugugcuugaucuaaccaugu

SEQ ID NO: 3121 - RNA, 22 nt, Homo sapiens
aacuguuugcagaggaaacuga

SEQ ID NO: 3122 - RNA, 21 nt, Homo sapiens
caaagguauuugugguuuuug

SEQ ID NO: 3123 - RNA, 21 nt, Homo sapiens
acggugcuggauguggccuuu

SEQ ID NO: 3124 - RNA, 18 nt, Homo sapiens
cgggcguggugguggggg

SEQ ID NO: 3125 - RNA, 23 nt, Homo sapiens
uggaguccaggaaucugcauuuu

SEQ ID NO: 3126 - RNA, 23 nt, Homo sapiens
ucuggcuccgugucuucacuccc

SEQ ID NO: 3127 - RNA, 22 nt, Homo sapiens
agacccuggucugcacucuauc

SEQ ID NO: 3128 - RNA, 23 nt, Homo sapiens
cacccggcugugugcacaugugc

SEQ ID NO: 3129 - RNA, 22 nt, Homo sapiens
uggagagaaaggcaguuccuga

SEQ ID NO: 3130 - RNA, 23 nt, Homo sapiens
ugaguaccgccaugucuguuggg

SEQ ID NO: 3131 - RNA, 20 nt, Homo sapiens
ccccagggcgacgcggcggg

SEQ ID NO: 3132 - RNA, 22 nt, Homo sapiens
cugugcgugugacagcggcuga

SEQ ID NO: 3133 - RNA, 25 nt, Homo sapiens
aggggugguguugggacagcuccgu

SEQ ID NO: 3134 - RNA, 23 nt, Homo sapiens
aucgcugcgguugcgagcgcugu

SEQ ID NO: 3135 - RNA, 22 nt, Homo sapiens
gguggcccggccgugccugagg

SEQ ID NO: 3136 - RNA, 23 nt, Homo sapiens
uggugcggagagggcccacagug

SEQ ID NO: 3137 - RNA, 17 nt, Homo sapiens
ucucgcuggggccucca

SEQ ID NO: 3138 - RNA, 20 nt, Homo sapiens
cggcucugggucugugggga

SEQ ID NO: 3139 - RNA, 21 nt, Homo sapiens
cgcgggugcuuacugacccuu

SEQ ID NO: 3140 - RNA, 23 nt, Homo sapiens
cgggucggaguuagcucaagcgg

SEQ ID NO: 3141 - RNA, 20 nt, Homo sapiens
ugagcccuguccucccgcag

SEQ ID NO: 3142 - RNA, 22 nt, Homo sapiens
acccgucccguucguccccgga

SEQ ID NO: 3143 - RNA, 22 nt, Homo sapiens
acccgucccguucguccccgga

SEQ ID NO: 3144 - RNA, 19 nt, Homo sapiens
gaugaugcugcugaugcug

SEQ ID NO: 3145 - RNA, 18 nt, Homo sapiens
ugaggcaguagauugaau

SEQ ID NO: 3146 - RNA, 22 nt, Homo sapiens
ucaggccaggcacaguggcuca

SEQ ID NO: 3147 - RNA, 21 nt, Homo sapiens
uugaaaggcuauuucuugguc

SEQ ID NO: 3148 - RNA, 22 nt, Homo sapiens
aguggggaacccuuccaugagg

SEQ ID NO: 3149 - RNA, 22 nt, Homo sapiens
aucuggagguaagaagcacuuu

SEQ ID NO: 3150 - RNA, 22 nt, Homo sapiens
gucccucuccaaaugugucuug

SEQ ID NO: 3151 - RNA, 21 nt, Homo sapiens
aggaggcagcgcucucaggac

SEQ ID NO: 3152 - RNA, 23 nt, Homo sapiens
uauucauuuauccccagccuaca

SEQ ID NO: 3153 - RNA, 20 nt, Homo sapiens
cggcucugggucugugggga

SEQ ID NO: 3154 - RNA, 22 nt, Homo sapiens
uauugcacucgucccggccucc

SEQ ID NO: 3155 - RNA, 22 nt, Homo sapiens
uauugcacucgucccggccucc

SEQ ID NO: 3156 - RNA, 22 nt, Homo sapiens
uggagugugacaaugguguuug

SEQ ID NO: 3157 - RNA, 24 nt, Homo sapiens
agccuggaagcuggagccugcagu

SEQ ID NO: 3158 - RNA, 23 nt, Homo sapiens
ucuggcuccgugucuucacuccc

SEQ ID NO: 3159 - RNA, 22 nt, Homo sapiens
ucucccaacccuuguaccagug

SEQ ID NO: 3160 - RNA, 23 nt, Homo sapiens
ugaguaccgccaugucuguuggg

SEQ ID NO: 3161 - RNA, 22 nt, Homo sapiens
uguaaacauccuacacucagcu

SEQ ID NO: 3162 - RNA, 22 nt, Homo sapiens
uuauaaagcaaugagacugauu

SEQ ID NO: 3163 - RNA, 19 nt, Homo sapiens
ugucucugcugggguuucu

SEQ ID NO: 3164 - RNA, 19 nt, Homo sapiens
ugucucugcugggguuucu

SEQ ID NO: 3165 - RNA, 25 nt, Homo sapiens
aggggugguguugggacagcuccgu

SEQ ID NO: 3166 - RNA, 22 nt, Homo sapiens
ugagaccucuggguucugagcu

SEQ ID NO: 3167 - RNA, 20 nt, Homo sapiens
ggggagcuguggaagcagua

SEQ ID NO: 3168 - RNA, 21 nt, Homo sapiens
aaggcagggcccccgcucccc

SEQ ID NO: 3169 - RNA, 22 nt, Homo sapiens
uuuucaacucuaaugggagaga

SEQ ID NO: 3170 - RNA, 18 nt, Homo sapiens
cagggaggugaaugugau

SEQ ID NO: 3171 - RNA, 23 nt, Homo sapiens
guccaguuuucccaggaaucccu

SEQ ID NO: 3172 - RNA, 23 nt, Homo sapiens
ucuggcuccgugucuucacuccc

SEQ ID NO: 3173 - RNA, 21 nt, Homo sapiens
cuagacugaagcuccuugagg

SEQ ID NO: 3174 - RNA, 22 nt, Homo sapiens
uauugcacauuacuaaguugca

SEQ ID NO: 3175 - RNA, 22 nt, Homo sapiens
aacacaccugguuaaccucuuu

SEQ ID NO: 3176 - RNA, 22 nt, Homo sapiens
aacacaccuauucaaggauuca

SEQ ID NO: 3177 - RNA, 22 nt, Homo sapiens
aauugcacgguauccaucugua

SEQ ID NO: 3178 - RNA, 20 nt, Homo sapiens
auuccuagaaauuguucaua

SEQ ID NO: 3179 - RNA, 23 nt, Homo sapiens
uaaauuucaccuuucugagaagg

SEQ ID NO: 3180 - RNA, 20 nt, Homo sapiens
auguauaaauguauacacac

SEQ ID NO: 3181 - RNA, 21 nt, Homo sapiens
guguugaaacaaucucuacug

SEQ ID NO: 3182 - RNA, 22 nt, Homo sapiens
aaauuauuguacaucggaugag

SEQ ID NO: 3183 - RNA, 22 nt, Homo sapiens
ugagccccugugccgcccccag

SEQ ID NO: 3184 - RNA, 24 nt, Homo sapiens
agccuggaagcuggagccugcagu

SEQ ID NO: 3185 - RNA, 17 nt, Homo sapiens
ucgccuccuccucuccc

SEQ ID NO: 3186 - RNA, 22 nt, Homo sapiens
gcccgcguguggagccaggugu

SEQ ID NO: 3187 - RNA, 22 nt, Homo sapiens
cauugcacuugucucggucuga

SEQ ID NO: 3188 - RNA, 22 nt, Homo sapiens
aaggagcucacagucuauugag

SEQ ID NO: 3189 - RNA, 21 nt, Homo sapiens
agggggaaaguucuauagucc

SEQ ID NO: 3190 - RNA, 25 nt, Homo sapiens
ggcggagggaaguagguccguuggu

SEQ ID NO: 3191 - RNA, 23 nt, Homo sapiens
aaggagcuuacaaucuagcuggg

SEQ ID NO: 3192 - RNA, 22 nt, Homo sapiens
ugcggggcuagggcuaacagca

SEQ ID NO: 3193 - RNA, 21 nt, Homo sapiens
uggaggagaaggaaggugaug

SEQ ID NO: 3194 - RNA, 18 nt, Homo sapiens
cagggaggugaaugugau

SEQ ID NO: 3195 - RNA, 23 nt, Homo sapiens
ucuggcuccgugucuucacuccc

SEQ ID NO: 3196 - RNA, 18 nt, Homo sapiens
ugaggcaguagauugaau

SEQ ID NO: 3197 - RNA, 22 nt, Homo sapiens
uucaccaccuucuccacccagc

SEQ ID NO: 3198 - RNA, 22 nt, Homo sapiens
ugucaguuugucaaauacccca

SEQ ID NO: 3199 - RNA, 22 nt, Homo sapiens
ucagcaaacauuuauugugugc

SEQ ID NO: 3200 - RNA, 21 nt, Homo sapiens
uggguuuacguugggagaacu

SEQ ID NO: 3201 - RNA, 22 nt, Homo sapiens
gucccucuccaaaugugucuug

SEQ ID NO: 3202 - RNA, 21 nt, Homo sapiens
aggaggcagcgcucucaggac

SEQ ID NO: 3203 - RNA, 21 nt, Homo sapiens
uggaggagaaggaaggugaug

SEQ ID NO: 3204 - RNA, 21 nt, Homo sapiens
uacucaaaaagcugucaguca

SEQ ID NO: 3205 - RNA, 20 nt, Homo sapiens
cuuccucgucugucugcccc

SEQ ID NO: 3206 - RNA, 18 nt, Homo sapiens
cgggcguggugguggggg

SEQ ID NO: 3207 - RNA, 17 nt, Homo sapiens
ucccaccgcugccaccc

SEQ ID NO: 3208 - RNA, 17 nt, Homo sapiens
ucgccuccuccucuccc

SEQ ID NO: 3209 - RNA, 19 nt, Homo sapiens
accgugcaaagguagcaua

SEQ ID NO: 3210 - RNA, 21 nt, Homo sapiens
auguaugugugcaugugcaug

SEQ ID NO: 3211 - RNA, 21 nt, Homo sapiens
gccccugggccuauccuagaa

SEQ ID NO: 3212 - RNA, 22 nt, Homo sapiens
uggugggcacagaaucuggacu

SEQ ID NO: 3213 - RNA, 22 nt, Homo sapiens
uggugggccgcagaacaugugc

SEQ ID NO: 3214 - RNA, 23 nt, Homo sapiens
ggcagguucucacccucucuagg

SEQ ID NO: 3215 - RNA, 21 nt, Homo sapiens
aaggcagggcccccgcucccc

SEQ ID NO: 3216 - RNA, 22 nt, Homo sapiens
agaaggaaauugaauucauuua

SEQ ID NO: 3217 - RNA, 24 nt, Homo sapiens
uggcccugacugaagaccagcagu

SEQ ID NO: 3218 - RNA, 24 nt, Homo sapiens
uggcccugacugaagaccagcagu

SEQ ID NO: 3219 - RNA, 22 nt, Homo sapiens
ucaaaacugaggggcauuuucu

SEQ ID NO: 3220 - RNA, 22 nt, Homo sapiens
ugcccuguggacucaguucugg

SEQ ID NO: 3221 - RNA, 22 nt, Homo sapiens
acacagggcuguugugaagacu

SEQ ID NO: 3222 - RNA, 22 nt, Homo sapiens
uggcagugucuuagcugguugu

SEQ ID NO: 3223 - RNA, 23 nt, Homo sapiens
aggcaguguaguuagcugauugc

SEQ ID NO: 3224 - RNA, 22 nt, Homo sapiens
auauaauacaaccugcuaagug

SEQ ID NO: 3225 - RNA, 22 nt, Homo sapiens
uggcaguguauuguuagcuggu

SEQ ID NO: 3226 - RNA, 22 nt, Homo sapiens
aggcaguguauuguuagcuggc

SEQ ID NO: 3227 - RNA, 22 nt, Homo sapiens
caaaacuggcaauuacuuuugc

SEQ ID NO: 3228 - RNA, 22 nt, Homo sapiens
aaaaacugagacuacuuuugca

SEQ ID NO: 3229 - RNA, 19 nt, Homo sapiens
aaaaacuguaauuacuuuu

SEQ ID NO: 3230 - RNA, 22 nt, Homo sapiens
ccaaaacugcaguuacuuuugc

SEQ ID NO: 3231 - RNA, 22 nt, Homo sapiens
auucuaauuucuccacgucuuu

SEQ ID NO: 3232 - RNA, 22 nt, Homo sapiens
uggauuucuuugugaaucacca

SEQ ID NO: 3233 - RNA, 23 nt, Homo sapiens
gagggucuugggagggaugugac

SEQ ID NO: 3234 - RNA, 22 nt, Homo sapiens
caggauguggucaaguguuguu

SEQ ID NO: 3235 - RNA, 18 nt, Homo sapiens
cagggaggugaaugugau

SEQ ID NO: 3236 - RNA, 21 nt, Homo sapiens
cugaccuaugaauugacagcc

SEQ ID NO: 3237 - RNA, 18 nt, Homo sapiens
uucacagggaggugucau

SEQ ID NO: 3238 - RNA, 22 nt, Homo sapiens
aucuggagguaagaagcacuuu

SEQ ID NO: 3239 - RNA, 23 nt, Homo sapiens
caaagcgcuucucuuuagagugu

SEQ ID NO: 3240 - RNA, 21 nt, Homo sapiens
cuccagagggaaguacuuucu

SEQ ID NO: 3241 - RNA, 21 nt, Homo sapiens
cuccagagggaugcacuuucu

SEQ ID NO: 3242 - RNA, 21 nt, Homo sapiens
uggaggagaaggaaggugaug

SEQ ID NO: 3243 - RNA, 21 nt, Homo sapiens
cugacuguugccguccuccag

SEQ ID NO: 3244 - RNA, 22 nt, Homo sapiens
aacccguagauccgaacuugug

SEQ ID NO: 3245 - RNA, 22 nt, Homo sapiens
aacccguagauccgaacuugug

SEQ ID NO: 3246 - RNA, 21 nt, Homo sapiens
ucguggccuggucuccauuau

SEQ ID NO: 3247 - RNA, 22 nt, Homo sapiens
ucggccugaccacccaccccac

SEQ ID NO: 3248 - RNA, 22 nt, Homo sapiens
ccucuuccccuugucucuccag

SEQ ID NO: 3249 - RNA, 22 nt, Homo sapiens
cugaagcucagagggcucugau

SEQ ID NO: 3250 - RNA, 19 nt, Homo sapiens
gaugaugcugcugaugcug

SEQ ID NO: 3251 - RNA, 18 nt, Homo sapiens
ugaggcaguagauugaau

SEQ ID NO: 3252 - RNA, 18 nt, Homo sapiens
ugaggcaguagauugaau

SEQ ID NO: 3253 - RNA, 22 nt, Homo sapiens
uacccagagcaugcagugugaa

SEQ ID NO: 3254 - RNA, 20 nt, Homo sapiens
ccucugggcccuuccuccag

SEQ ID NO: 3255 - RNA, 22 nt, Homo sapiens
ucucugggccugugucuuaggc

SEQ ID NO: 3256 - RNA, 22 nt, Homo sapiens
agaggcuggccgugaugaauuc

SEQ ID NO: 3257 - RNA, 22 nt, Homo sapiens
aguggggaacccuuccaugagg

SEQ ID NO: 3258 - RNA, 25 nt, Homo sapiens
aggggugguguugggacagcuccgu

SEQ ID NO: 3259 - RNA, 21 nt, Homo sapiens
aggaggcagcgcucucaggac

SEQ ID NO: 3260 - RNA, 21 nt, Homo sapiens
uggaggagaaggaaggugaug

SEQ ID NO: 3261 - RNA, 20 nt, Homo sapiens
guagaggagauggcgcaggg

SEQ ID NO: 3262 - RNA, 20 nt, Homo sapiens
ggggagcuguggaagcagua

SEQ ID NO: 3263 - RNA, 17 nt, Homo sapiens
ucgccuccuccucuccc

SEQ ID NO: 3264 - RNA, 18 nt, Homo sapiens
cagggaggugaaugugau

SEQ ID NO: 3265 - RNA, 23 nt, Homo sapiens
ucuggcuccgugucuucacuccc

SEQ ID NO: 3266 - RNA, 21 nt, Homo sapiens
cggcggggacggcgauugguc

SEQ ID NO: 3267 - RNA, 22 nt, Homo sapiens
cauugcacuugucucggucuga

SEQ ID NO: 3268 - RNA, 21 nt, Homo sapiens
uaaagugcugacagugcagau

SEQ ID NO: 3269 - RNA, 23 nt, Homo sapiens
cagugcaaugauauugucaaagc

SEQ ID NO: 3270 - RNA, 22 nt, Homo sapiens
aggcggggcgccgcgggaccgc

SEQ ID NO: 3271 - RNA, 22 nt, Homo sapiens
ugcggggcuagggcuaacagca

SEQ ID NO: 3272 - RNA, 21 nt, Homo sapiens
uggaggagaaggaaggugaug

SEQ ID NO: 3273 - RNA, 20 nt, Homo sapiens
ugagcccuguccucccgcag

SEQ ID NO: 3274 - RNA, 22 nt, Homo sapiens
ugcccuguggacucaguucugg

SEQ ID NO: 3275 - RNA, 22 nt, Homo sapiens
caaagaauucuccuuuugggcu

SEQ ID NO: 3276 - RNA, 22 nt, Homo sapiens
ucugcccccuccgcugcugcca

SEQ ID NO: 3277 - RNA, 20 nt, Homo sapiens
ccccagggcgacgcggcggg

SEQ ID NO: 3278 - RNA, 20 nt, Homo sapiens
uguuuugauaacaguaaugu

SEQ ID NO: 3279 - RNA, 22 nt, Homo sapiens
acacagggcuguugugaagacu

SEQ ID NO: 3280 - RNA, 22 nt, Homo sapiens
ugucaguuugucaaauacccca

SEQ ID NO: 3281 - RNA, 20 nt, Homo sapiens
acugccccaggugcugcugg

SEQ ID NO: 3282 - RNA, 22 nt, Homo sapiens
aacacaccugguuaaccucuuu

SEQ ID NO: 3283 - RNA, 21 nt, Homo sapiens
gccccugggccuauccuagaa

SEQ ID NO: 3284 - RNA, 22 nt, Homo sapiens
aacacaccuauucaaggauuca

SEQ ID NO: 3285 - RNA, 21 nt, Homo sapiens
cggggcagcucaguacaggau

SEQ ID NO: 3286 - RNA, 22 nt, Homo sapiens
aaacaaacauggugcacuucuu

SEQ ID NO: 3287 - RNA, 22 nt, Homo sapiens
caaaaaucucaauuacuuuugc

SEQ ID NO: 3288 - RNA, 21 nt, Homo sapiens
gcgacccauacuugguuucag

SEQ ID NO: 3289 - RNA, 21 nt, Homo sapiens
uggguuuacguugggagaacu

SEQ ID NO: 3290 - RNA, 20 nt, Homo sapiens
agaccauggguucucauugu

SEQ ID NO: 3291 - RNA, 22 nt, Homo sapiens
uggagugugacaaugguguuug

SEQ ID NO: 3292 - RNA, 20 nt, Homo sapiens
cggcucugggucugugggga

SEQ ID NO: 3293 - RNA, 22 nt, Homo sapiens
ccucuuccccuugucucuccag

SEQ ID NO: 3294 - RNA, 23 nt, Homo sapiens
ucuggcuccgugucuucacuccc

SEQ ID NO: 3295 - RNA, 21 nt, Homo sapiens
cggcggggacggcgauugguc

SEQ ID NO: 3296 - RNA, 22 nt, Homo sapiens
caaccuggaggacuccaugcug

SEQ ID NO: 3297 - RNA, 21 nt, Homo sapiens
agggggaaaguucuauagucc

SEQ ID NO: 3298 - RNA, 22 nt, Homo sapiens
aggcggggcgccgcgggaccgc

SEQ ID NO: 3299 - RNA, 20 nt, Homo sapiens
guagaggagauggcgcaggg

SEQ ID NO: 3300 - RNA, 17 nt, Homo sapiens
ucgccuccuccucuccc

SEQ ID NO: 3301 - RNA, 23 nt, Homo sapiens
ucuggcuccgugucuucacuccc

SEQ ID NO: 3302 - RNA, 20 nt, Homo sapiens
ccuccugcccuccuugcugu

SEQ ID NO: 3303 - RNA, 21 nt, Homo sapiens
uugugcuugaucuaaccaugu

SEQ ID NO: 3304 - RNA, 21 nt, Homo sapiens
ccaccaccgugucugacacuu

SEQ ID NO: 3305 - RNA, 21 nt, Homo sapiens
aggggugcuaucugugauuga

SEQ ID NO: 3306 - RNA, 23 nt, Homo sapiens
uggugcggagagggcccacagug

SEQ ID NO: 3307 - RNA, 21 nt, Homo sapiens
agaggauacccuuuguauguu

SEQ ID NO: 3308 - RNA, 17 nt, Homo sapiens
ucccaccgcugccaccc

SEQ ID NO: 3309 - RNA, 18 nt, Homo sapiens
cagggaggugaaugugau

SEQ ID NO: 3310 - RNA, 22 nt, Homo sapiens
uguaaacauccuacacucagcu

SEQ ID NO: 3311 - RNA, 23 nt, Homo sapiens
agcucggucugaggccccucagu

SEQ ID NO: 3312 - RNA, 23 nt, Homo sapiens
ucuuggaguaggucauugggugg

SEQ ID NO: 3313 - RNA, 21 nt, Homo sapiens
agggggaaaguucuauagucc

SEQ ID NO: 3314 - RNA, 22 nt, Homo sapiens
uggagugugacaaugguguuug

SEQ ID NO: 3315 - RNA, 21 nt, Homo sapiens
cggcggggacggcgauugguc

SEQ ID NO: 3316 - RNA, 22 nt, Homo sapiens
uaacacugucugguaacgaugu

SEQ ID NO: 3317 - RNA, 22 nt, Homo sapiens
uaauacugccugguaaugauga

SEQ ID NO: 3318 - RNA, 23 nt, Homo sapiens
ucccccaggugugauucugauuu

SEQ ID NO: 3319 - RNA, 22 nt, Homo sapiens
aagauguggaaaaauuggaauc

SEQ ID NO: 3320 - RNA, 24 nt, Homo sapiens
acugggggcuuucgggcucugcgu

SEQ ID NO: 3321 - RNA, 21 nt, Homo sapiens
guggcugcacucacuuccuuc

SEQ ID NO: 3322 - RNA, 22 nt, Homo sapiens
aggcggggcgccgcgggaccgc

SEQ ID NO: 3323 - RNA, 22 nt, Homo sapiens
ugcggggcuagggcuaacagca

SEQ ID NO: 3324 - RNA, 23 nt, Homo sapiens
ccugcagcgacuugauggcuucc

SEQ ID NO: 3325 - RNA, 17 nt, Homo sapiens
ucgccuccuccucuccc

SEQ ID NO: 3326 - RNA, 17 nt, Homo sapiens
ucgccuccuccucuccc

SEQ ID NO: 3327 - RNA, 24 nt, Homo sapiens
uugcagcugccugggagugacuuc

SEQ ID NO: 3328 - RNA, 18 nt, Homo sapiens
acguuggcucugguggug

SEQ ID NO: 3329 - RNA, 23 nt, Homo sapiens
ucuggcuccgugucuucacuccc

SEQ ID NO: 3330 - RNA, 22 nt, Homo sapiens
ucugcccccuccgcugcugcca

SEQ ID NO: 3331 - RNA, 20 nt, Homo sapiens
ccuccugcccuccuugcugu

SEQ ID NO: 3332 - RNA, 20 nt, Homo sapiens
acugccccaggugcugcugg

SEQ ID NO: 3333 - RNA, 23 nt, Homo sapiens
ugaggggcagagagcgagacuuu

SEQ ID NO: 3334 - RNA, 21 nt, Homo sapiens
cggggcagcucaguacaggau

SEQ ID NO: 3335 - RNA, 22 nt, Homo sapiens
auucugcauuuuuagcaaguuc

SEQ ID NO: 3336 - RNA, 19 nt, Homo sapiens
gggcgccugugaucccaac

SEQ ID NO: 3337 - RNA, 19 nt, Homo sapiens
aagcagcugccucugaggc

SEQ ID NO: 3338 - RNA, 22 nt, Homo sapiens
ugcggggcuagggcuaacagca

SEQ ID NO: 3339 - RNA, 22 nt, Homo sapiens
augggugaauuuguagaaggau

SEQ ID NO: 3340 - RNA, 18 nt, Homo sapiens
cagggaggugaaugugau

SEQ ID NO: 3341 - RNA, 23 nt, Homo sapiens
ucuggcuccgugucuucacuccc

SEQ ID NO: 3342 - RNA, 22 nt, Homo sapiens
uagcaccaucugaaaucgguua

SEQ ID NO: 3343 - RNA, 22 nt, Homo sapiens
caaaaaucucaauuacuuuugc

SEQ ID NO: 3344 - RNA, 20 nt, Homo sapiens
auguauaaauguauacacac

SEQ ID NO: 3345 - RNA, 21 nt, Homo sapiens
caaagaggaaggucccauuac

SEQ ID NO: 3346 - RNA, 23 nt, Homo sapiens
aucccuugcaggggcuguugggu

SEQ ID NO: 3347 - RNA, 22 nt, Homo sapiens
uggagagaaaggcaguuccuga

SEQ ID NO: 3348 - RNA, 21 nt, Homo sapiens
cggcggggacggcgauugguc

SEQ ID NO: 3349 - RNA, 20 nt, Homo sapiens
ccuccugcccuccuugcugu

SEQ ID NO: 3350 - RNA, 23 nt, Homo sapiens
ucccccaggugugauucugauuu

SEQ ID NO: 3351 - RNA, 23 nt, Homo sapiens
ugaggggcagagagcgagacuuu

SEQ ID NO: 3352 - RNA, 22 nt, Homo sapiens
aucuggagguaagaagcacuuu

SEQ ID NO: 3353 - RNA, 24 nt, Homo sapiens
acugggggcuuucgggcucugcgu

SEQ ID NO: 3354 - RNA, 22 nt, Homo sapiens
aggcggggcgccgcgggaccgc

SEQ ID NO: 3355 - RNA, 22 nt, Homo sapiens
ugcggggcuagggcuaacagca

SEQ ID NO: 3356 - RNA, 21 nt, Homo sapiens
uggaggagaaggaaggugaug

SEQ ID NO: 3357 - RNA, 22 nt, Homo sapiens
ugagccccugugccgcccccag

SEQ ID NO: 3358 - RNA, 22 nt, Homo sapiens
agaaggaaauugaauucauuua

SEQ ID NO: 3359 - RNA, 21 nt, Homo sapiens
agagaagaagaucagccugca

SEQ ID NO: 3360 - RNA, 22 nt, Homo sapiens
ugagaacugaauuccauggguu

SEQ ID NO: 3361 - RNA, 18 nt, Homo sapiens
ugaggcaguagauugaau

SEQ ID NO: 3362 - RNA, 22 nt, Homo sapiens
uacccagagcaugcagugugaa

SEQ ID NO: 3363 - RNA, 21 nt, Homo sapiens
auuugugcuuggcucugucac

SEQ ID NO: 3364 - RNA, 22 nt, Homo sapiens
aaaucucugcaggcaaauguga

SEQ ID NO: 3365 - RNA, 22 nt, Homo sapiens
gaggguuggguggaggcucucc

SEQ ID NO: 3366 - RNA, 20 nt, Homo sapiens
ccucugggcccuuccuccag

SEQ ID NO: 3367 - RNA, 22 nt, Homo sapiens
ucucugggccugugucuuaggc

SEQ ID NO: 3368 - RNA, 23 nt, Homo sapiens
ugucugcccgcaugccugccucu

SEQ ID NO: 3369 - RNA, 20 nt, Homo sapiens
auuccuagaaauuguucaua

SEQ ID NO: 3370 - RNA, 22 nt, Homo sapiens
auucugcauuuuuagcaaguuc

SEQ ID NO: 3371 - RNA, 22 nt, Homo sapiens
ugagaaccacgucugcucugag

SEQ ID NO: 3372 - RNA, 22 nt, Homo sapiens
gucccucuccaaaugugucuug

SEQ ID NO: 3373 - RNA, 21 nt, Homo sapiens
aggaggcagcgcucucaggac

SEQ ID NO: 3374 - RNA, 20 nt, Homo sapiens
ucugcaggguuugcuuugag

SEQ ID NO: 3375 - RNA, 20 nt, Homo sapiens
ucugcaggguuugcuuugag

SEQ ID NO: 3376 - RNA, 22 nt, Homo sapiens
acccgucccguucguccccgga

SEQ ID NO: 3377 - RNA, 24 nt, Homo sapiens
agccuggaagcuggagccugcagu

SEQ ID NO: 3378 - RNA, 22 nt, Homo sapiens
cuggacugagccgugcuacugg

SEQ ID NO: 3379 - RNA, 21 nt, Homo sapiens
ugcaggaccaagaugagcccu

SEQ ID NO: 3380 - RNA, 24 nt, Homo sapiens
ccagacagaauucuaugcacuuuc

SEQ ID NO: 3381 - RNA, 22 nt, Homo sapiens
gugugcggaaaugcuucugcua

SEQ ID NO: 3382 - RNA, 22 nt, Homo sapiens
acagcaggcacagacaggcagu

SEQ ID NO: 3383 - RNA, 21 nt, Homo sapiens
uugugcuugaucuaaccaugu

SEQ ID NO: 3384 - RNA, 21 nt, Homo sapiens
uucaaguaauucaggauaggu

SEQ ID NO: 3385 - RNA, 22 nt, Homo sapiens
uggcagugucuuagcugguugu

SEQ ID NO: 3386 - RNA, 22 nt, Homo sapiens
caaucacuaacuccacugccau

SEQ ID NO: 3387 - RNA, 23 nt, Homo sapiens
aggcaguguaguuagcugauugc

SEQ ID NO: 3388 - RNA, 24 nt, Homo sapiens
aauccuuggaaccuaggugugagu

SEQ ID NO: 3389 - RNA, 22 nt, Homo sapiens
gccugcugggguggaaccuggu

SEQ ID NO: 3390 - RNA, 21 nt, Homo sapiens
acuggacuuggagucagaagg

SEQ ID NO: 3391 - RNA, 22 nt, Homo sapiens
agaucagaaggugauuguggcu

SEQ ID NO: 3392 - RNA, 22 nt, Homo sapiens
acuggacuuagggucagaaggc

SEQ ID NO: 3393 - RNA, 22 nt, Homo sapiens
uggcaguguauuguuagcuggu

SEQ ID NO: 3394 - RNA, 22 nt, Homo sapiens
aggcaguguauuguuagcuggc

SEQ ID NO: 3395 - RNA, 21 nt, Homo sapiens
gcaguccaugggcauauacac

SEQ ID NO: 3396 - RNA, 19 nt, Homo sapiens
agcugucugaaaaugucuu

SEQ ID NO: 3397 - RNA, 23 nt, Homo sapiens
ugugcuugcucgucccgcccgca

SEQ ID NO: 3398 - RNA, 20 nt, Homo sapiens
cggcucugggucugugggga

SEQ ID NO: 3399 - RNA, 22 nt, Homo sapiens
uggguggucuggagauuugugc

SEQ ID NO: 3400 - RNA, 18 nt, Homo sapiens
cagggaggugaaugugau

SEQ ID NO: 3401 - RNA, 23 nt, Homo sapiens
ucuggcuccgugucuucacuccc

SEQ ID NO: 3402 - RNA, 22 nt, Homo sapiens
uggagagaaaggcaguuccuga

SEQ ID NO: 3403 - RNA, 22 nt, Homo sapiens
cccugugcccggcccacuucug

SEQ ID NO: 3404 - RNA, 21 nt, Homo sapiens
agcuacaucuggcuacugggu

SEQ ID NO: 3405 - RNA, 20 nt, Homo sapiens
guccgcucggcgguggccca

SEQ ID NO: 3406 - RNA, 25 nt, Homo sapiens
aggggugguguugggacagcuccgu

SEQ ID NO: 3407 - RNA, 21 nt, Homo sapiens
agggggaaaguucuauagucc

SEQ ID NO: 3408 - RNA, 25 nt, Homo sapiens
ggcggagggaaguagguccguuggu

SEQ ID NO: 3409 - RNA, 21 nt, Homo sapiens
uggaggagaaggaaggugaug

SEQ ID NO: 3410 - RNA, 23 nt, Homo sapiens
uacccuguagauccgaauuugug

SEQ ID NO: 3411 - RNA, 23 nt, Homo sapiens
uacccuguagaaccgaauuugug

SEQ ID NO: 3412 - RNA, 21 nt, Homo sapiens
uggcagggaggcugggagggg

SEQ ID NO: 3413 - RNA, 22 nt, Homo sapiens
ccucuuccccuugucucuccag

SEQ ID NO: 3414 - RNA, 20 nt, Homo sapiens
cuuccucgucugucugcccc

SEQ ID NO: 3415 - RNA, 25 nt, Homo sapiens
gggcgacaaagcaagacucuuucuu

SEQ ID NO: 3416 - RNA, 22 nt, Homo sapiens
cucggcgcggggcgcgggcucc

SEQ ID NO: 3417 - RNA, 18 nt, Homo sapiens
ugaggcaguagauugaau

SEQ ID NO: 3418 - RNA, 22 nt, Homo sapiens
cccugugcccggcccacuucug

SEQ ID NO: 3419 - RNA, 22 nt, Homo sapiens
uagguaguuuccuguuguuggg

SEQ ID NO: 3420 - RNA, 23 nt, Homo sapiens
ucccuguccuccaggagcucacg

SEQ ID NO: 3421 - RNA, 22 nt, Homo sapiens
uggcagugucuuagcugguugu

SEQ ID NO: 3422 - RNA, 22 nt, Homo sapiens
caaucacuaacuccacugccau

SEQ ID NO: 3423 - RNA, 23 nt, Homo sapiens
aggcaguguaguuagcugauugc

SEQ ID NO: 3424 - RNA, 22 nt, Homo sapiens
aauugcacgguauccaucugua

SEQ ID NO: 3425 - RNA, 23 nt, Homo sapiens
ugaggggcagagagcgagacuuu

SEQ ID NO: 3426 - RNA, 23 nt, Homo sapiens
aaugacacgaucacucccguuga

SEQ ID NO: 3427 - RNA, 22 nt, Homo sapiens
uggcaguguauuguuagcuggu

SEQ ID NO: 3428 - RNA, 22 nt, Homo sapiens
aggcaguguauuguuagcuggc

SEQ ID NO: 3429 - RNA, 25 nt, Homo sapiens
aggggugguguugggacagcuccgu

SEQ ID NO: 3430 - RNA, 21 nt, Homo sapiens
aggaggcagcgcucucaggac

SEQ ID NO: 3431 - RNA, 22 nt, Homo sapiens
acuccagccccacagccucagc

SEQ ID NO: 3432 - RNA, 20 nt, Homo sapiens
guagaggagauggcgcaggg

SEQ ID NO: 3433 - RNA, 21 nt, Homo sapiens
gugccagcugcagugggggag

SEQ ID NO: 3434 - RNA, 22 nt, Homo sapiens
uggaauguaaggaagugugugg

SEQ ID NO: 3435 - RNA, 22 nt, Homo sapiens
cccugugcccggcccacuucug

SEQ ID NO: 3436 - RNA, 19 nt, Homo sapiens
gggcgccugugaucccaac

SEQ ID NO: 3437 - RNA, 22 nt, Homo sapiens
ggggguccccggugcucggauc

SEQ ID NO: 3438 - RNA, 24 nt, Homo sapiens
ugccugggucucuggccugcgcgu

SEQ ID NO: 3439 - RNA, 22 nt, Homo sapiens
ccucuuccccuugucucuccag

SEQ ID NO: 3440 - RNA, 17 nt, Homo sapiens
ucccuguucgggcgcca

SEQ ID NO: 3441 - RNA, 19 nt, Homo sapiens
uggauuuuuggaucaggga

SEQ ID NO: 3442 - RNA, 22 nt, Homo sapiens
cagugcaauguuaaaagggcau

SEQ ID NO: 3443 - RNA, 22 nt, Homo sapiens
ugcccuguggacucaguucugg

SEQ ID NO: 3444 - RNA, 22 nt, Homo sapiens
cucuagagggaagcacuuucug

SEQ ID NO: 3445 - RNA, 22 nt, Homo sapiens
uguaacagcaacuccaugugga

SEQ ID NO: 3446 - RNA, 21 nt, Homo sapiens
aucacauugccagggauuucc

SEQ ID NO: 3447 - RNA, 21 nt, Homo sapiens
aucacauugccagggauuacc

SEQ ID NO: 3448 - RNA, 22 nt, Homo sapiens
uguaaacauccucgacuggaag

SEQ ID NO: 3449 - RNA, 22 nt, Homo sapiens
uguaaacauccuacacucagcu

SEQ ID NO: 3450 - RNA, 23 nt, Homo sapiens
uguaaacauccuacacucucagc

SEQ ID NO: 3451 - RNA, 22 nt, Homo sapiens
uguaaacauccccgacuggaag

SEQ ID NO: 3452 - RNA, 22 nt, Homo sapiens
uguaaacauccuugacuggaag

SEQ ID NO: 3453 - RNA, 22 nt, Homo sapiens
agaggcuggccgugaugaauuc

SEQ ID NO: 3454 - RNA, 22 nt, Homo sapiens
ugaaacauacacgggaaaccuc

SEQ ID NO: 3455 - RNA, 22 nt, Homo sapiens
caaaaaucucaauuacuuuugc

SEQ ID NO: 3456 - RNA, 23 nt, Homo sapiens
uaaaucccauggugccuucuccu

SEQ ID NO: 3457 - RNA, 20 nt, Homo sapiens
guagaggagauggcgcaggg

SEQ ID NO: 3458 - RNA, 22 nt, Homo sapiens
uuaucagaaucuccagggguac

SEQ ID NO: 3459 - RNA, 22 nt, Homo sapiens
uuauaauacaaccugauaagug

SEQ ID NO: 3460 - RNA, 22 nt, Homo sapiens
gguggcccggccgugccugagg

SEQ ID NO: 3461 - RNA, 22 nt, Homo sapiens
ccucuuccccuugucucuccag

SEQ ID NO: 3462 - RNA, 24 nt, Homo sapiens
ccagacagaauucuaugcacuuuc

SEQ ID NO: 3463 - RNA, 22 nt, Homo sapiens
acagcaggcacagacaggcagu

SEQ ID NO: 3464 - RNA, 22 nt, Homo sapiens
uguaaacauccucgacuggaag

SEQ ID NO: 3465 - RNA, 22 nt, Homo sapiens
uguaaacauccuacacucagcu

SEQ ID NO: 3466 - RNA, 23 nt, Homo sapiens
uguaaacauccuacacucucagc

SEQ ID NO: 3467 - RNA, 22 nt, Homo sapiens
uguaaacauccccgacuggaag

SEQ ID NO: 3468 - RNA, 22 nt, Homo sapiens
uguaaacauccuugacuggaag

SEQ ID NO: 3469 - RNA, 22 nt, Homo sapiens
gccugcugggguggaaccuggu

SEQ ID NO: 3470 - RNA, 21 nt, Homo sapiens
gaagugugccguggugugucu

SEQ ID NO: 3471 - RNA, 21 nt, Homo sapiens
agggggaaaguucuauagucc

SEQ ID NO: 3472 - RNA, 19 nt, Homo sapiens
agcugucugaaaaugucuu

SEQ ID NO: 3473 - RNA, 23 nt, Homo sapiens
aucgcugcgguugcgagcgcugu

SEQ ID NO: 3474 - RNA, 19 nt, Homo sapiens
aagugugcagggcacuggu

SEQ ID NO: 3475 - RNA, 22 nt, Homo sapiens
ugcggggcuagggcuaacagca

SEQ ID NO: 3476 - RNA, 20 nt, Homo sapiens
guagaggagauggcgcaggg

SEQ ID NO: 3477 - RNA, 22 nt, Homo sapiens
ugugcgcagggagaccucuccc

SEQ ID NO: 3478 - RNA, 22 nt, Homo sapiens
uggagugugacaaugguguuug

SEQ ID NO: 3479 - RNA, 18 nt, Homo sapiens
cgggcguggugguggggg

SEQ ID NO: 3480 - RNA, 21 nt, Homo sapiens
uugggacauacuuaugcuaaa

SEQ ID NO: 3481 - RNA, 22 nt, Homo sapiens
cgcaggggccgggugcucaccg

SEQ ID NO: 3482 - RNA, 21 nt, Homo sapiens
aggggugcuaucugugauuga

SEQ ID NO: 3483 - RNA, 19 nt, Homo sapiens
aggcacggugucagcaggc

SEQ ID NO: 3484 - RNA, 24 nt, Homo sapiens
ugccugggucucuggccugcgcgu

SEQ ID NO: 3485 - RNA, 22 nt, Homo sapiens
uggagugugacaaugguguuug

SEQ ID NO: 3486 - RNA, 17 nt, Homo sapiens
ucgccuccuccucuccc

SEQ ID NO: 3487 - RNA, 21 nt, Homo sapiens
uccugcgcgucccagaugccc

SEQ ID NO: 3488 - RNA, 21 nt, Homo sapiens
cggcggggacggcgauugguc

SEQ ID NO: 3489 - RNA, 23 nt, Homo sapiens
ugaguaccgccaugucuguuggg

SEQ ID NO: 3490 - RNA, 22 nt, Homo sapiens
ucugcccccuccgcugcugcca

SEQ ID NO: 3491 - RNA, 21 nt, Homo sapiens
agcuacaucuggcuacugggu

SEQ ID NO: 3492 - RNA, 20 nt, Homo sapiens
acugccccaggugcugcugg

SEQ ID NO: 3493 - RNA, 20 nt, Homo sapiens
gugcauugcuguugcauugc

SEQ ID NO: 3494 - RNA, 21 nt, Homo sapiens
cggggcagcucaguacaggau

SEQ ID NO: 3495 - RNA, 22 nt, Homo sapiens
gagugccuucuuuuggagcguu

SEQ ID NO: 3496 - RNA, 22 nt, Homo sapiens
aagugccuccuuuuagaguguu

SEQ ID NO: 3497 - RNA, 22 nt, Homo sapiens
uacgucaucguugucaucguca

SEQ ID NO: 3498 - RNA, 22 nt, Homo sapiens
aggcggggcgccgcgggaccgc

SEQ ID NO: 3499 - RNA, 22 nt, Homo sapiens
ugcggggcuagggcuaacagca

SEQ ID NO: 3500 - RNA, 20 nt, Homo sapiens
ucugcaggguuugcuuugag

SEQ ID NO: 3501 - RNA, 22 nt, Homo sapiens
uggagugugacaaugguguuug

SEQ ID NO: 3502 - RNA, 22 nt, Homo sapiens
ucggccugaccacccaccccac

SEQ ID NO: 3503 - RNA, 22 nt, Homo sapiens
uggagagaaaggcaguuccuga

SEQ ID NO: 3504 - RNA, 21 nt, Homo sapiens
ugauuguccaaacgcaauucu

SEQ ID NO: 3505 - RNA, 23 nt, Homo sapiens
ucccccaggugugauucugauuu

SEQ ID NO: 3506 - RNA, 24 nt, Homo sapiens
acugggggcuuucgggcucugcgu

SEQ ID NO: 3507 - RNA, 24 nt, Homo sapiens
ugccugggucucuggccugcgcgu

SEQ ID NO: 3508 - RNA, 26 nt, Homo sapiens
gaugaugauggcagcaaauucugaaa

SEQ ID NO: 3509 - RNA, 20 nt, Homo sapiens
gugucugggcggacagcugc

SEQ ID NO: 3510 - RNA, 21 nt, Homo sapiens
uccuucugcuccgucccccag

SEQ ID NO: 3511 - RNA, 22 nt, Homo sapiens
cagugcaauguuaaaagggcau

SEQ ID NO: 3512 - RNA, 22 nt, Homo sapiens
cagugcaaugaugaaagggcau

SEQ ID NO: 3513 - RNA, 19 nt, Homo sapiens
gaugaugcugcugaugcug

SEQ ID NO: 3514 - RNA, 24 nt, Homo sapiens
ccagacagaauucuaugcacuuuc

SEQ ID NO: 3515 - RNA, 23 nt, Homo sapiens
cagugcaauaguauugucaaagc

SEQ ID NO: 3516 - RNA, 23 nt, Homo sapiens
cagugcaaugauauugucaaagc

SEQ ID NO: 3517 - RNA, 21 nt, Homo sapiens
ugucuugcaggccgucaugca

SEQ ID NO: 3518 - RNA, 23 nt, Homo sapiens
uagugcaauauugcuuauagggu

SEQ ID NO: 3519 - RNA, 22 nt, Homo sapiens
caugccuugaguguaggaccgu

SEQ ID NO: 3520 - RNA, 21 nt, Homo sapiens
cccggagccaggaugcagcuc

SEQ ID NO: 3521 - RNA, 21 nt, Homo sapiens
cccggagccaggaugcagcuc

SEQ ID NO: 3522 - RNA, 19 nt, Homo sapiens
gaugaugcugcugaugcug

SEQ ID NO: 3523 - RNA, 21 nt, Homo sapiens
ucgaggagcucacagucuagu

SEQ ID NO: 3524 - RNA, 23 nt, Homo sapiens
ugaguaccgccaugucuguuggg

SEQ ID NO: 3525 - RNA, 23 nt, Homo sapiens
ucaagagcaauaacgaaaaaugu

SEQ ID NO: 3526 - RNA, 19 nt, Homo sapiens
ugagcugcuguaccaaaau

SEQ ID NO: 3527 - RNA, 20 nt, Homo sapiens
guccgcucggcgguggccca

SEQ ID NO: 3528 - RNA, 23 nt, Homo sapiens
acuugggcacugaaacaaugucc

SEQ ID NO: 3529 - RNA, 23 nt, Homo sapiens
ggcagguucucacccucucuagg

SEQ ID NO: 3530 - RNA, 22 nt, Homo sapiens
cuggacugagccgugcuacugg

SEQ ID NO: 3531 - RNA, 21 nt, Homo sapiens
uggacugcccugaucuggaga

SEQ ID NO: 3532 - RNA, 22 nt, Homo sapiens
ugagaacugaauuccauggguu

SEQ ID NO: 3533 - RNA, 22 nt, Homo sapiens
aaggagcucacagucuauugag

SEQ ID NO: 3534 - RNA, 21 nt, Homo sapiens
acuggacuuggagucagaagg

SEQ ID NO: 3535 - RNA, 22 nt, Homo sapiens
acuggacuuagggucagaaggc

SEQ ID NO: 3536 - RNA, 21 nt, Homo sapiens
gcaguccaugggcauauacac

SEQ ID NO: 3537 - RNA, 19 nt, Homo sapiens
ugagcugcuguaccaaaau

SEQ ID NO: 3538 - RNA, 20 nt, Homo sapiens
guugugucaguuuaucaaac

SEQ ID NO: 3539 - RNA, 22 nt, Homo sapiens
augcugacauauuuacuagagg

SEQ ID NO: 3540 - RNA, 19 nt, Homo sapiens
aagcagcugccucugaggc

SEQ ID NO: 3541 - RNA, 23 nt, Homo sapiens
aaggagcuuacaaucuagcuggg

SEQ ID NO: 3542 - RNA, 23 nt, Homo sapiens
aaggagcuuacaaucuagcuggg

SEQ ID NO: 3543 - RNA, 22 nt, Homo sapiens
ucuucucuguuuuggccaugug

SEQ ID NO: 3544 - RNA, 21 nt, Homo sapiens
ucguggccuggucuccauuau

SEQ ID NO: 3545 - RNA, 23 nt, Homo sapiens
aggaugagcaaagaaaguagauu

SEQ ID NO: 3546 - RNA, 22 nt, Homo sapiens
cggaugagcaaagaaagugguu

SEQ ID NO: 3547 - RNA, 23 nt, Homo sapiens
cggcccgggcugcugcuguuccu

SEQ ID NO: 3548 - RNA, 23 nt, Homo sapiens
uuaaugcuaaucgugauaggggu

SEQ ID NO: 3549 - RNA, 23 nt, Homo sapiens
ucaagagcaauaacgaaaaaugu

SEQ ID NO: 3550 - RNA, 23 nt, Homo sapiens
ucaagagcaauaacgaaaaaugu

SEQ ID NO: 3551 - RNA, 22 nt, Homo sapiens
uggcagugucuuagcugguugu

SEQ ID NO: 3552 - RNA, 22 nt, Homo sapiens
cgucaacacuugcugguuuccu

SEQ ID NO: 3553 - RNA, 22 nt, Homo sapiens
aagugcugucauagcugagguc

SEQ ID NO: 3554 - RNA, 23 nt, Homo sapiens
cacucagccuugagggcacuuuc

SEQ ID NO: 3555 - RNA, 23 nt, Homo sapiens
acuugggcacugaaacaaugucc

SEQ ID NO: 3556 - RNA, 21 nt, Homo sapiens
guggcugcacucacuuccuuc

SEQ ID NO: 3557 - RNA, 22 nt, Homo sapiens
gguggcccggccgugccugagg

SEQ ID NO: 3558 - RNA, 21 nt, Homo sapiens
uggaggagaaggaaggugaug

SEQ ID NO: 3559 - RNA, 21 nt, Homo sapiens
ugcaggaccaagaugagcccu

SEQ ID NO: 3560 - RNA, 21 nt, Homo sapiens
uccugcgcgucccagaugccc

SEQ ID NO: 3561 - RNA, 22 nt, Homo sapiens
uggagagaaaggcaguuccuga

SEQ ID NO: 3562 - RNA, 21 nt, Homo sapiens
gccccugggccuauccuagaa

SEQ ID NO: 3563 - RNA, 19 nt, Homo sapiens
aggcugcggaauucaggac

SEQ ID NO: 3564 - RNA, 22 nt, Homo sapiens
ggggguccccggugcucggauc

SEQ ID NO: 3565 - RNA, 23 nt, Homo sapiens
uggugcggagagggcccacagug

SEQ ID NO: 3566 - RNA, 22 nt, Homo sapiens
acuccagccccacagccucagc

SEQ ID NO: 3567 - RNA, 24 nt, Homo sapiens
uggggagcugaggcucugggggug

SEQ ID NO: 3568 - RNA, 21 nt, Homo sapiens
cccggagccaggaugcagcuc

SEQ ID NO: 3569 - RNA, 18 nt, Homo sapiens
ucagcuggcccucauuuc

SEQ ID NO: 3570 - RNA, 22 nt, Homo sapiens
augguacccuggcauacugagu

SEQ ID NO: 3571 - RNA, 18 nt, Homo sapiens
cgggcguggugguggggg

SEQ ID NO: 3572 - RNA, 17 nt, Homo sapiens
ucccaccgcugccaccc

SEQ ID NO: 3573 - RNA, 21 nt, Homo sapiens
cggcggggacggcgauugguc

SEQ ID NO: 3574 - RNA, 20 nt, Homo sapiens
ccccagggcgacgcggcggg

SEQ ID NO: 3575 - RNA, 25 nt, Homo sapiens
cccccacaaccgcgcuugacuagcu

SEQ ID NO: 3576 - RNA, 21 nt, Homo sapiens
gccccugggccuauccuagaa

SEQ ID NO: 3577 - RNA, 22 nt, Homo sapiens
ucaggcucaguccccucccgau

SEQ ID NO: 3578 - RNA, 22 nt, Homo sapiens
uggugggcacagaaucuggacu

SEQ ID NO: 3579 - RNA, 21 nt, Homo sapiens
aagccugcccggcuccucggg

SEQ ID NO: 3580 - RNA, 22 nt, Homo sapiens
uggugggccgcagaacaugugc

SEQ ID NO: 3581 - RNA, 25 nt, Homo sapiens
ggcggagggaaguagguccguuggu

SEQ ID NO: 3582 - RNA, 22 nt, Homo sapiens
aggcggggcgccgcgggaccgc

SEQ ID NO: 3583 - RNA, 22 nt, Homo sapiens
ugagaccucuggguucugagcu

SEQ ID NO: 3584 - RNA, 24 nt, Homo sapiens
uggggagcugaggcucugggggug

SEQ ID NO: 3585 - RNA, 21 nt, Homo sapiens
aaggcagggcccccgcucccc

SEQ ID NO: 3586 - RNA, 18 nt, Homo sapiens
gucccuguucaggcgcca

SEQ ID NO: 3587 - RNA, 18 nt, Homo sapiens
cagggaggugaaugugau

SEQ ID NO: 3588 - RNA, 21 nt, Homo sapiens
cggcggggacggcgauugguc

SEQ ID NO: 3589 - RNA, 21 nt, Homo sapiens
ccaguccugugccugccgccu

SEQ ID NO: 3590 - RNA, 22 nt, Homo sapiens
ucugcccccuccgcugcugcca

SEQ ID NO: 3591 - RNA, 22 nt, Homo sapiens
cccugugcccggcccacuucug

SEQ ID NO: 3592 - RNA, 22 nt, Homo sapiens
cccugugcccggcccacuucug

SEQ ID NO: 3593 - RNA, 22 nt, Homo sapiens
acagcaggcacagacaggcagu

SEQ ID NO: 3594 - RNA, 22 nt, Homo sapiens
acacagggcuguugugaagacu

SEQ ID NO: 3595 - RNA, 22 nt, Homo sapiens
acacagggcuguugugaagacu

SEQ ID NO: 3596 - RNA, 20 nt, Homo sapiens
acugccccaggugcugcugg

SEQ ID NO: 3597 - RNA, 22 nt, Homo sapiens
gcugacuccuaguccagggcuc

SEQ ID NO: 3598 - RNA, 22 nt, Homo sapiens
gcugacuccuaguccagggcuc

SEQ ID NO: 3599 - RNA, 22 nt, Homo sapiens
gccugcugggguggaaccuggu

SEQ ID NO: 3600 - RNA, 22 nt, Homo sapiens
gucauacacggcucuccucucu

SEQ ID NO: 3601 - RNA, 21 nt, Homo sapiens
cggggcagcucaguacaggau

SEQ ID NO: 3602 - RNA, 22 nt, Homo sapiens
augcugacauauuuacuagagg

SEQ ID NO: 3603 - RNA, 22 nt, Homo sapiens
uacccauugcauaucggaguug

SEQ ID NO: 3604 - RNA, 22 nt, Homo sapiens
aggcggggcgccgcgggaccgc

SEQ ID NO: 3605 - RNA, 22 nt, Homo sapiens
ugcggggcuagggcuaacagca

SEQ ID NO: 3606 - RNA, 22 nt, Homo sapiens
ugugcgcagggagaccucuccc

SEQ ID NO: 3607 - RNA, 22 nt, Homo sapiens
acgcccuucccccccuucuuca

SEQ ID NO: 3608 - RNA, 22 nt, Homo sapiens
agaaggaaauugaauucauuua

SEQ ID NO: 3609 - RNA, 20 nt, Homo sapiens
acucaaacugugggggcacu

SEQ ID NO: 3610 - RNA, 21 nt, Homo sapiens
uugaaaggcuauuucuugguc

SEQ ID NO: 3611 - RNA, 22 nt, Homo sapiens
ugaguauuacauggccaaucuc

SEQ ID NO: 3612 - RNA, 24 nt, Homo sapiens
uggggagcugaggcucugggggug

SEQ ID NO: 3613 - RNA, 21 nt, Homo sapiens
cggcggggacggcgauugguc

SEQ ID NO: 3614 - RNA, 22 nt, Homo sapiens
uagguaguuuccuguuguuggg

SEQ ID NO: 3615 - RNA, 22 nt, Homo sapiens
ugugacagauugauaacugaaa

SEQ ID NO: 3616 - RNA, 25 nt, Homo sapiens
aggggugguguugggacagcuccgu

SEQ ID NO: 3617 - RNA, 23 nt, Homo sapiens
aucccuugcaggggcuguugggu

SEQ ID NO: 3618 - RNA, 22 nt, Homo sapiens
aggcagcgggguguaguggaua

SEQ ID NO: 3619 - RNA, 20 nt, Homo sapiens
ggggagcuguggaagcagua

SEQ ID NO: 3620 - RNA, 20 nt, Homo sapiens
uaaggcacgcggugaaugcc

SEQ ID NO: 3621 - RNA, 22 nt, Homo sapiens
agaaggaaauugaauucauuua

SEQ ID NO: 3622 - RNA, 21 nt, Homo sapiens
agugaaugauggguucugacc

SEQ ID NO: 3623 - RNA, 22 nt, Homo sapiens
uuggggaaacggccgcugagug

SEQ ID NO: 3624 - RNA, 21 nt, Homo sapiens
agcuacaucuggcuacugggu

SEQ ID NO: 3625 - RNA, 17 nt, Homo sapiens
uaauugcuuccauguuu

SEQ ID NO: 3626 - RNA, 21 nt, Homo sapiens
uaaggcacccuucugaguaga

SEQ ID NO: 3627 - RNA, 22 nt, Homo sapiens
uucucaaggaggugucguuuau

SEQ ID NO: 3628 - RNA, 23 nt, Homo sapiens
cucuugagggaagcacuuucugu

SEQ ID NO: 3629 - RNA, 24 nt, Homo sapiens
cugaagugauguguaacugaucag

SEQ ID NO: 3630 - RNA, 19 nt, Homo sapiens
ugucucugcugggguuucu

SEQ ID NO: 3631 - RNA, 21 nt, Homo sapiens
gaagugugccguggugugucu

SEQ ID NO: 3632 - RNA, 22 nt, Homo sapiens
auaauacaugguuaaccucuuu

SEQ ID NO: 3633 - RNA, 20 nt, Homo sapiens
guagaggagauggcgcaggg

SEQ ID NO: 3634 - RNA, 21 nt, Homo sapiens
agaggauacccuuuguauguu

SEQ ID NO: 3635 - RNA, 23 nt, Homo sapiens
ucuggcuccgugucuucacuccc

SEQ ID NO: 3636 - RNA, 21 nt, Homo sapiens
cggcggggacggcgauugguc

SEQ ID NO: 3637 - RNA, 22 nt, Homo sapiens
cccugugcccggcccacuucug

SEQ ID NO: 3638 - RNA, 23 nt, Homo sapiens
caacggaaucccaaaagcagcug

SEQ ID NO: 3639 - RNA, 20 nt, Homo sapiens
ccucugggcccuuccuccag

SEQ ID NO: 3640 - RNA, 22 nt, Homo sapiens
ucucugggccugugucuuaggc

SEQ ID NO: 3641 - RNA, 22 nt, Homo sapiens
aauugcacgguauccaucugua

SEQ ID NO: 3642 - RNA, 23 nt, Homo sapiens
ugaggggcagagagcgagacuuu

SEQ ID NO: 3643 - RNA, 25 nt, Homo sapiens
aggggugguguugggacagcuccgu

SEQ ID NO: 3644 - RNA, 24 nt, Homo sapiens
ugccugggucucuggccugcgcgu

SEQ ID NO: 3645 - RNA, 22 nt, Homo sapiens
aggcggggcgccgcgggaccgc

SEQ ID NO: 3646 - RNA, 20 nt, Homo sapiens
cggcucugggucugugggga

SEQ ID NO: 3647 - RNA, 18 nt, Homo sapiens
cgggcguggugguggggg

SEQ ID NO: 3648 - RNA, 22 nt, Homo sapiens
uuuagagacggggucuugcucu

SEQ ID NO: 3649 - RNA, 22 nt, Homo sapiens
cagugcaaugaugaaagggcau

SEQ ID NO: 3650 - RNA, 22 nt, Homo sapiens
aucacacaaaggcaacuuuugu

SEQ ID NO: 3651 - RNA, 23 nt, Homo sapiens
caagucuuauuugagcaccuguu

SEQ ID NO: 3652 - RNA, 22 nt, Homo sapiens
uauggcacugguagaauucacu

SEQ ID NO: 3653 - RNA, 22 nt, Homo sapiens
uagcaccauuugaaaucgguua

SEQ ID NO: 3654 - RNA, 23 nt, Homo sapiens
uaagugcuuccauguuuuaguag

SEQ ID NO: 3655 - RNA, 23 nt, Homo sapiens
uaagugcuuccauguuugagugu

SEQ ID NO: 3656 - RNA, 23 nt, Homo sapiens
uauucauuuauccccagccuaca

SEQ ID NO: 3657 - RNA, 22 nt, Homo sapiens
uggagugugacaaugguguuug

SEQ ID NO: 3658 - RNA, 22 nt, Homo sapiens
uaacacugucugguaaagaugg

SEQ ID NO: 3659 - RNA, 22 nt, Homo sapiens
uagcagcacauaaugguuugug

SEQ ID NO: 3660 - RNA, 22 nt, Homo sapiens
uagcagcacaucaugguuuaca

SEQ ID NO: 3661 - RNA, 22 nt, Homo sapiens
uagcagcacguaaauauuggcg

SEQ ID NO: 3662 - RNA, 20 nt, Homo sapiens
ccccagggcgacgcggcggg

SEQ ID NO: 3663 - RNA, 21 nt, Homo sapiens
uagcagcacagaaauauuggc

SEQ ID NO: 3664 - RNA, 22 nt, Homo sapiens
uuggggaaacggccgcugagug

SEQ ID NO: 3665 - RNA, 21 nt, Homo sapiens
uaaagugcugacagugcagau

SEQ ID NO: 3666 - RNA, 23 nt, Homo sapiens
cagugcaaugauauugucaaagc

SEQ ID NO: 3667 - RNA, 22 nt, Homo sapiens
uuauaaagcaaugagacugauu

SEQ ID NO: 3668 - RNA, 22 nt, Homo sapiens
cagcagcaauucauguuuugaa

SEQ ID NO: 3669 - RNA, 22 nt, Homo sapiens
aguggggaacccuuccaugagg

SEQ ID NO: 3670 - RNA, 21 nt, Homo sapiens
cagcagcacacugugguuugu

SEQ ID NO: 3671 - RNA, 22 nt, Homo sapiens
ugugucacucgaugaccacugu

SEQ ID NO: 3672 - RNA, 20 nt, Homo sapiens
ggggagcuguggaagcagua

SEQ ID NO: 3673 - RNA, 22 nt, Homo sapiens
ugagguaguagguuguauaguu

SEQ ID NO: 3674 - RNA, 22 nt, Homo sapiens
ugagguaguagguugugugguu

SEQ ID NO: 3675 - RNA, 19 nt, Homo sapiens
ugucucugcugggguuucu

SEQ ID NO: 3676 - RNA, 23 nt, Homo sapiens
ucaaaugcucagacuccuguggu

SEQ ID NO: 3677 - RNA, 23 nt, Homo sapiens
aaaagugcuuacagugcagguag

SEQ ID NO: 3678 - RNA, 22 nt, Homo sapiens
acaggugagguucuugggagcc

SEQ ID NO: 3679 - RNA, 21 nt, Homo sapiens
ucacagugaaccggucucuuu

SEQ ID NO: 3680 - RNA, 22 nt, Homo sapiens
uaacacugucugguaaagaugg

SEQ ID NO: 3681 - RNA, 22 nt, Homo sapiens
ucagugcacuacagaacuuugu

SEQ ID NO: 3682 - RNA, 22 nt, Homo sapiens
ucagugcaucacagaacuuugu

SEQ ID NO: 3683 - RNA, 21 nt, Homo sapiens
ucagugcaugacagaacuugg

SEQ ID NO: 3684 - RNA, 23 nt, Homo sapiens
cccaguguucagacuaccuguuc

SEQ ID NO: 3685 - RNA, 23 nt, Homo sapiens
cccaguguuuagacuaucuguuc

SEQ ID NO: 3686 - RNA, 22 nt, Homo sapiens
uaacacugucugguaacgaugu

SEQ ID NO: 3687 - RNA, 22 nt, Homo sapiens
gaaguuguucgugguggauucg

SEQ ID NO: 3688 - RNA, 22 nt, Homo sapiens
uugcauauguaggaugucccau

SEQ ID NO: 3689 - RNA, 20 nt, Homo sapiens
auguauaaauguauacacac

SEQ ID NO: 3690 - RNA, 23 nt, Homo sapiens
uucauuugguauaaaccgcgauu

SEQ ID NO: 3691 - RNA, 21 nt, Homo sapiens
guucaaauccagaucuauaac

SEQ ID NO: 3692 - RNA, 24 nt, Homo sapiens
gaccuggacauguuugugcccagu

SEQ ID NO: 3693 - RNA, 23 nt, Homo sapiens
ggcagguucucacccucucuagg

SEQ ID NO: 3694 - RNA, 23 nt, Homo sapiens
ucugcucauaccccaugguuucu

SEQ ID NO: 3695 - RNA, 21 nt, Homo sapiens
ccuggaaacacugagguugug

SEQ ID NO: 3696 - RNA, 21 nt, Homo sapiens
uggcagggaggcugggagggg

SEQ ID NO: 3697 - RNA, 18 nt, Homo sapiens
ugaggcaguagauugaau

SEQ ID NO: 3698 - RNA, 22 nt, Homo sapiens
cgcaggggccgggugcucaccg

SEQ ID NO: 3699 - RNA, 23 nt, Homo sapiens
caacggaaucccaaaagcagcug

SEQ ID NO: 3700 - RNA, 25 nt, Homo sapiens
cccccacaaccgcgcuugacuagcu

SEQ ID NO: 3701 - RNA, 20 nt, Homo sapiens
agagguauagggcaugggaa

SEQ ID NO: 3702 - RNA, 22 nt, Homo sapiens
uccagcaucagugauuuuguug

SEQ ID NO: 3703 - RNA, 23 nt, Homo sapiens
agguuacccgagcaacuuugcau

SEQ ID NO: 3704 - RNA, 21 nt, Homo sapiens
uugaaaggcuauuucuugguc

SEQ ID NO: 3705 - RNA, 22 nt, Homo sapiens
caaccuggaggacuccaugcug

SEQ ID NO: 3706 - RNA, 24 nt, Homo sapiens
gaccuggacauguuugugcccagu

SEQ ID NO: 3707 - RNA, 23 nt, Homo sapiens
uauucauuuauccccagccuaca

SEQ ID NO: 3708 - RNA, 20 nt, Homo sapiens
accaggaggcugaggccccu

SEQ ID NO: 3709 - RNA, 22 nt, Homo sapiens
uauaccucaguuuuaucaggug

SEQ ID NO: 3710 - RNA, 21 nt, Homo sapiens
aaggcagggcccccgcucccc

SEQ ID NO: 3711 - RNA, 23 nt, Homo sapiens
ccugcagcgacuugauggcuucc

SEQ ID NO: 3712 - RNA, 22 nt, Homo sapiens
uggagugugacaaugguguuug

SEQ ID NO: 3713 - RNA, 22 nt, Homo sapiens
ucggccugaccacccaccccac

SEQ ID NO: 3714 - RNA, 24 nt, Homo sapiens
uggcccugacugaagaccagcagu

SEQ ID NO: 3715 - RNA, 23 nt, Homo sapiens
ucuggcuccgugucuucacuccc

SEQ ID NO: 3716 - RNA, 23 nt, Homo sapiens
cggcccgggcugcugcuguuccu

SEQ ID NO: 3717 - RNA, 21 nt, Homo sapiens
uccugcgcgucccagaugccc

SEQ ID NO: 3718 - RNA, 21 nt, Homo sapiens
cggcggggacggcgauugguc

SEQ ID NO: 3719 - RNA, 23 nt, Homo sapiens
ugaguaccgccaugucuguuggg

SEQ ID NO: 3720 - RNA, 22 nt, Homo sapiens
cuggcccucucugcccuuccgu

SEQ ID NO: 3721 - RNA, 23 nt, Homo sapiens
agugccugagggaguaagagccc

SEQ ID NO: 3722 - RNA, 19 nt, Homo sapiens
ugagcugcuguaccaaaau

SEQ ID NO: 3723 - RNA, 24 nt, Homo sapiens
ugccugggucucuggccugcgcgu

SEQ ID NO: 3724 - RNA, 24 nt, Homo sapiens
ugccugggucucuggccugcgcgu

SEQ ID NO: 3725 - RNA, 22 nt, Homo sapiens
aggcggggcgccgcgggaccgc

SEQ ID NO: 3726 - RNA, 22 nt, Homo sapiens
gguggcccggccgugccugagg

SEQ ID NO: 3727 - RNA, 22 nt, Homo sapiens
ugcggggcuagggcuaacagca

SEQ ID NO: 3728 - RNA, 21 nt, Homo sapiens
cgcgggugcuuacugacccuu

SEQ ID NO: 3729 - RNA, 21 nt, Homo sapiens
aaggcagggcccccgcucccc

SEQ ID NO: 3730 - RNA, 23 nt, Homo sapiens
cacccggcugugugcacaugugc

SEQ ID NO: 3731 - RNA, 21 nt, Homo sapiens
gaaggcgcuucccuuuggagu

SEQ ID NO: 3732 - RNA, 21 nt, Homo sapiens
cccggagccaggaugcagcuc

SEQ ID NO: 3733 - RNA, 21 nt, Homo sapiens
cccggagccaggaugcagcuc

SEQ ID NO: 3734 - RNA, 17 nt, Homo sapiens
ucgccuccuccucuccc

SEQ ID NO: 3735 - RNA, 22 nt, Homo sapiens
uggcucaguucagcaggaacag

SEQ ID NO: 3736 - RNA, 22 nt, Homo sapiens
gaaagcgcuucccuuugcugga

SEQ ID NO: 3737 - RNA, 22 nt, Homo sapiens
caaagcgcuccccuuuagaggu

SEQ ID NO: 3738 - RNA, 23 nt, Homo sapiens
caaagcgcuucucuuuagagugu

SEQ ID NO: 3739 - RNA, 21 nt, Homo sapiens
caaagcgcuucccuuuggagc

SEQ ID NO: 3740 - RNA, 21 nt, Homo sapiens
gaaagcgcuucucuuuagagg

SEQ ID NO: 3741 - RNA, 20 nt, Homo sapiens
auguauaaauguauacacac

SEQ ID NO: 3742 - RNA, 23 nt, Homo sapiens
uuacaguuguucaaccaguuacu

SEQ ID NO: 3743 - RNA, 22 nt, Homo sapiens
ugugcgcagggagaccucuccc

SEQ ID NO: 3744 - RNA, 23 nt, Homo sapiens
ccugcagcgacuugauggcuucc

SEQ ID NO: 3745 - RNA, 20 nt, Homo sapiens
ucugcaggguuugcuuugag

SEQ ID NO: 3746 - RNA, 22 nt, Homo sapiens
augggugaauuuguagaaggau

SEQ ID NO: 3747 - RNA, 21 nt, Homo sapiens
ugcaggaccaagaugagcccu

SEQ ID NO: 3748 - RNA, 22 nt, Homo sapiens
ucucccaacccuuguaccagug

SEQ ID NO: 3749 - RNA, 21 nt, Homo sapiens
cggcggggacggcgauugguc

SEQ ID NO: 3750 - RNA, 20 nt, Homo sapiens
ccccagggcgacgcggcggg

SEQ ID NO: 3751 - RNA, 21 nt, Homo sapiens
uaaagugcugacagugcagau

SEQ ID NO: 3752 - RNA, 23 nt, Homo sapiens
cagugcaaugauauugucaaagc

SEQ ID NO: 3753 - RNA, 22 nt, Homo sapiens
uggugggcacagaaucuggacu

SEQ ID NO: 3754 - RNA, 22 nt, Homo sapiens
uggugggccgcagaacaugugc

SEQ ID NO: 3755 - RNA, 22 nt, Homo sapiens
aggcggggcgccgcgggaccgc

SEQ ID NO: 3756 - RNA, 22 nt, Homo sapiens
ugagaccucuggguucugagcu

SEQ ID NO: 3757 - RNA, 23 nt, Homo sapiens
ccugcagcgacuugauggcuucc

SEQ ID NO: 3758 - RNA, 23 nt, Homo sapiens
ccugcagcgacuugauggcuucc

SEQ ID NO: 3759 - RNA, 22 nt, Homo sapiens
uggagugugacaaugguguuug

SEQ ID NO: 3760 - RNA, 23 nt, Homo sapiens
cucucaccacugcccucccacag

SEQ ID NO: 3761 - RNA, 17 nt, Homo sapiens
gugggggagaggcuguc

SEQ ID NO: 3762 - RNA, 24 nt, Homo sapiens
uugcagcugccugggagugacuuc

SEQ ID NO: 3763 - RNA, 18 nt, Homo sapiens
cagggaggugaaugugau

SEQ ID NO: 3764 - RNA, 23 nt, Homo sapiens
ucuggcuccgugucuucacuccc

SEQ ID NO: 3765 - RNA, 22 nt, Homo sapiens
uccuucauuccaccggagucug

SEQ ID NO: 3766 - RNA, 22 nt, Homo sapiens
cauugcacuugucucggucuga

SEQ ID NO: 3767 - RNA, 23 nt, Homo sapiens
ucccccaggugugauucugauuu

SEQ ID NO: 3768 - RNA, 23 nt, Homo sapiens
ugaggggcagagagcgagacuuu

SEQ ID NO: 3769 - RNA, 22 nt, Homo sapiens
ucaggcucaguccccucccgau

SEQ ID NO: 3770 - RNA, 22 nt, Homo sapiens
agaggcuggccgugaugaauuc

SEQ ID NO: 3771 - RNA, 19 nt, Homo sapiens
ugagcugcuguaccaaaau

SEQ ID NO: 3772 - RNA, 23 nt, Homo sapiens
gaacgccuguucuugccaggugg

SEQ ID NO: 3773 - RNA, 25 nt, Homo sapiens
ggcggagggaaguagguccguuggu

SEQ ID NO: 3774 - RNA, 24 nt, Homo sapiens
ugccugggucucuggccugcgcgu

SEQ ID NO: 3775 - RNA, 22 nt, Homo sapiens
ugagccccugugccgcccccag

SEQ ID NO: 3776 - RNA, 22 nt, Homo sapiens
uggagugugacaaugguguuug

SEQ ID NO: 3777 - RNA, 22 nt, Homo sapiens
acccgucccguucguccccgga

SEQ ID NO: 3778 - RNA, 21 nt, Homo sapiens
cggcggggacggcgauugguc

SEQ ID NO: 3779 - RNA, 22 nt, Homo sapiens
uccgagccugggucucccucuu

SEQ ID NO: 3780 - RNA, 23 nt, Homo sapiens
uggugcggagagggcccacagug

SEQ ID NO: 3781 - RNA, 22 nt, Homo sapiens
ugcggggcuagggcuaacagca

SEQ ID NO: 3782 - RNA, 21 nt, Homo sapiens
cgcgggugcuuacugacccuu

SEQ ID NO: 3783 - RNA, 22 nt, Homo sapiens
auccgcgcucugacucucugcc

SEQ ID NO: 3784 - RNA, 20 nt, Homo sapiens
cuuccucgucugucugcccc

SEQ ID NO: 3785 - RNA, 18 nt, Homo sapiens
aucccaccucugccacca

SEQ ID NO: 3786 - RNA, 22 nt, Homo sapiens
augggugaauuuguagaaggau

SEQ ID NO: 3787 - RNA, 22 nt, Homo sapiens
ugugacugguugaccagagggg

SEQ ID NO: 3788 - RNA, 22 nt, Homo sapiens
ugcccuguggacucaguucugg

SEQ ID NO: 3789 - RNA, 20 nt, Homo sapiens
ccuccugcccuccuugcugu

SEQ ID NO: 3790 - RNA, 23 nt, Homo sapiens
ucccuguccuccaggagcucacg

SEQ ID NO: 3791 - RNA, 23 nt, Homo sapiens
ugaggggcagagagcgagacuuu

SEQ ID NO: 3792 - RNA, 18 nt, Homo sapiens
ugcuuccuuucagagggu

SEQ ID NO: 3793 - RNA, 22 nt, Homo sapiens
aucuggagguaagaagcacuuu

SEQ ID NO: 3794 - RNA, 22 nt, Homo sapiens
ccucccacacccaaggcuugca

SEQ ID NO: 3795 - RNA, 21 nt, Homo sapiens
cgcgggugcuuacugacccuu

SEQ ID NO: 3796 - RNA, 22 nt, Homo sapiens
ccucuuccccuugucucuccag

SEQ ID NO: 3797 - RNA, 23 nt, Homo sapiens
aggaugagcaaagaaaguagauu

SEQ ID NO: 3798 - RNA, 22 nt, Homo sapiens
cggaugagcaaagaaagugguu

SEQ ID NO: 3799 - RNA, 17 nt, Homo sapiens
gugggggagaggcuguc

SEQ ID NO: 3800 - RNA, 22 nt, Homo sapiens
cugaagcucagagggcucugau

SEQ ID NO: 3801 - RNA, 17 nt, Homo sapiens
ucgccuccuccucuccc

SEQ ID NO: 3802 - RNA, 22 nt, Homo sapiens
ggagacgcggcccuguuggagu

SEQ ID NO: 3803 - RNA, 25 nt, Homo sapiens
cccccacaaccgcgcuugacuagcu

SEQ ID NO: 3804 - RNA, 20 nt, Homo sapiens
ggggagcuguggaagcagua

SEQ ID NO: 3805 - RNA, 22 nt, Homo sapiens
caaagugccucccuuuagagug

SEQ ID NO: 3806 - RNA, 24 nt, Homo sapiens
uggggagcugaggcucugggggug

SEQ ID NO: 3807 - RNA, 21 nt, Homo sapiens
ucguggccuggucuccauuau

SEQ ID NO: 3808 - RNA, 21 nt, Homo sapiens
uggcagggaggcugggagggg

SEQ ID NO: 3809 - RNA, 17 nt, Homo sapiens
ucgccuccuccucuccc

SEQ ID NO: 3810 - RNA, 22 nt, Homo sapiens
ucugggcaacaaagugagaccu

SEQ ID NO: 3811 - RNA, 23 nt, Homo sapiens
cggcccgggcugcugcuguuccu

SEQ ID NO: 3812 - RNA, 22 nt, Homo sapiens
cgcaggggccgggugcucaccg

SEQ ID NO: 3813 - RNA, 21 nt, Homo sapiens
ccaccaccgugucugacacuu

SEQ ID NO: 3814 - RNA, 25 nt, Homo sapiens
gcugggcagggcuucugagcuccuu

SEQ ID NO: 3815 - RNA, 22 nt, Homo sapiens
uccgagccugggucucccucuu

SEQ ID NO: 3816 - RNA, 21 nt, Homo sapiens
acagucugcugagguuggagc

SEQ ID NO: 3817 - RNA, 22 nt, Homo sapiens
gguggcccggccgugccugagg

SEQ ID NO: 3818 - RNA, 21 nt, Homo sapiens
cggcggggacggcgauugguc

SEQ ID NO: 3819 - RNA, 22 nt, Homo sapiens
cauugcacuugucucggucuga

SEQ ID NO: 3820 - RNA, 23 nt, Homo sapiens
ucccccaggugugauucugauuu

SEQ ID NO: 3821 - RNA, 19 nt, Homo sapiens
aggcugcggaauucaggac

SEQ ID NO: 3822 - RNA, 24 nt, Homo sapiens
acugggggcuuucgggcucugcgu

SEQ ID NO: 3823 - RNA, 22 nt, Homo sapiens
aggcggggcgccgcgggaccgc

SEQ ID NO: 3824 - RNA, 22 nt, Homo sapiens
ugcggggcuagggcuaacagca

SEQ ID NO: 3825 - RNA, 20 nt, Homo sapiens
cggcucugggucugugggga

SEQ ID NO: 3826 - RNA, 22 nt, Homo sapiens
ugagguaguaguuugugcuguu

SEQ ID NO: 3827 - RNA, 22 nt, Homo sapiens
ugagguaguaguuugugcuguu

SEQ ID NO: 3828 - RNA, 23 nt, Homo sapiens
ccugcagcgacuugauggcuucc

SEQ ID NO: 3829 - RNA, 20 nt, Homo sapiens
ucugcaggguuugcuuugag

SEQ ID NO: 3830 - RNA, 19 nt, Homo sapiens
uggauuuuuggaucaggga

SEQ ID NO: 3831 - RNA, 18 nt, Homo sapiens
cagggaggugaaugugau

SEQ ID NO: 3832 - RNA, 23 nt, Homo sapiens
ucuggcuccgugucuucacuccc

SEQ ID NO: 3833 - RNA, 22 nt, Homo sapiens
ucugcccccuccgcugcugcca

SEQ ID NO: 3834 - RNA, 20 nt, Homo sapiens
ccuccugcccuccuugcugu

SEQ ID NO: 3835 - RNA, 20 nt, Homo sapiens
acugccccaggugcugcugg

SEQ ID NO: 3836 - RNA, 22 nt, Homo sapiens
aauugcacgguauccaucugua

SEQ ID NO: 3837 - RNA, 22 nt, Homo sapiens
agaggcuggccgugaugaauuc

SEQ ID NO: 3838 - RNA, 21 nt, Homo sapiens
cggggcagcucaguacaggau

SEQ ID NO: 3839 - RNA, 25 nt, Homo sapiens
aggggugguguugggacagcuccgu

SEQ ID NO: 3840 - RNA, 23 nt, Homo sapiens
uggugcggagagggcccacagug

SEQ ID NO: 3841 - RNA, 22 nt, Homo sapiens
ugcggggcuagggcuaacagca

SEQ ID NO: 3842 - RNA, 21 nt, Homo sapiens
uggaggagaaggaaggugaug

SEQ ID NO: 3843 - RNA, 24 nt, Homo sapiens
uggggagcugaggcucugggggug

SEQ ID NO: 3844 - RNA, 22 nt, Homo sapiens
uggaauguaaggaagugugugg

SEQ ID NO: 3845 - RNA, 18 nt, Homo sapiens
cagggaggugaaugugau

SEQ ID NO: 3846 - RNA, 22 nt, Homo sapiens
cagugguuuuacccuaugguag

SEQ ID NO: 3847 - RNA, 23 nt, Homo sapiens
ucuggcuccgugucuucacuccc

SEQ ID NO: 3848 - RNA, 23 nt, Homo sapiens
ucaagagcaauaacgaaaaaugu

SEQ ID NO: 3849 - RNA, 21 nt, Homo sapiens
cagcagcacacugugguuugu

SEQ ID NO: 3850 - RNA, 22 nt, Homo sapiens
caaaacuggcaauuacuuuugc

SEQ ID NO: 3851 - RNA, 22 nt, Homo sapiens
aaaaacugagacuacuuuugca

SEQ ID NO: 3852 - RNA, 19 nt, Homo sapiens
aaaaacuguaauuacuuuu

SEQ ID NO: 3853 - RNA, 21 nt, Homo sapiens
uggguuuacguugggagaacu

SEQ ID NO: 3854 - RNA, 22 nt, Homo sapiens
gucccucuccaaaugugucuug

SEQ ID NO: 3855 - RNA, 23 nt, Homo sapiens
ccugcagcgacuugauggcuucc

SEQ ID NO: 3856 - RNA, 20 nt, Homo sapiens
gugucugggcggacagcugc

SEQ ID NO: 3857 - RNA, 21 nt, Homo sapiens
uggacugcccugaucuggaga

SEQ ID NO: 3858 - RNA, 24 nt, Homo sapiens
ccagacagaauucuaugcacuuuc

SEQ ID NO: 3859 - RNA, 23 nt, Homo sapiens
ucuggcuccgugucuucacuccc

SEQ ID NO: 3860 - RNA, 23 nt, Homo sapiens
caaagugcuuacagugcagguag

SEQ ID NO: 3861 - RNA, 21 nt, Homo sapiens
cggcggggacggcgauugguc

SEQ ID NO: 3862 - RNA, 22 nt, Homo sapiens
cccugugcccggcccacuucug

SEQ ID NO: 3863 - RNA, 19 nt, Homo sapiens
accgugcaaagguagcaua

SEQ ID NO: 3864 - RNA, 21 nt, Homo sapiens
uucaaguaauucaggauaggu

SEQ ID NO: 3865 - RNA, 22 nt, Homo sapiens
uggcagugucuuagcugguugu

SEQ ID NO: 3866 - RNA, 23 nt, Homo sapiens
aggcaguguaguuagcugauugc

SEQ ID NO: 3867 - RNA, 22 nt, Homo sapiens
uggcaguguauuguuagcuggu

SEQ ID NO: 3868 - RNA, 22 nt, Homo sapiens
aggcaguguauuguuagcuggc

SEQ ID NO: 3869 - RNA, 22 nt, Homo sapiens
uacugcagacguggcaaucaug

SEQ ID NO: 3870 - RNA, 21 nt, Homo sapiens
uacugcagacaguggcaauca

SEQ ID NO: 3871 - RNA, 22 nt, Homo sapiens
agacuucccauuugaagguggc

SEQ ID NO: 3872 - RNA, 19 nt, Homo sapiens
agcugucugaaaaugucuu

SEQ ID NO: 3873 - RNA, 22 nt, Homo sapiens
aggcggggcgccgcgggaccgc

SEQ ID NO: 3874 - RNA, 22 nt, Homo sapiens
ugcggggcuagggcuaacagca

SEQ ID NO: 3875 - RNA, 22 nt, Homo sapiens
caaagugccucccuuuagagug

SEQ ID NO: 3876 - RNA, 22 nt, Homo sapiens
uggagugugacaaugguguuug

SEQ ID NO: 3877 - RNA, 20 nt, Homo sapiens
gugucugggcggacagcugc

SEQ ID NO: 3878 - RNA, 17 nt, Homo sapiens
ucgccuccuccucuccc

SEQ ID NO: 3879 - RNA, 18 nt, Homo sapiens
cagggaggugaaugugau

SEQ ID NO: 3880 - RNA, 18 nt, Homo sapiens
cagggaggugaaugugau

SEQ ID NO: 3881 - RNA, 24 nt, Homo sapiens
ccagacagaauucuaugcacuuuc

SEQ ID NO: 3882 - RNA, 23 nt, Homo sapiens
ucuggcuccgugucuucacuccc

SEQ ID NO: 3883 - RNA, 22 nt, Homo sapiens
caaagaauucuccuuuugggcu

SEQ ID NO: 3884 - RNA, 21 nt, Homo sapiens
cggcggggacggcgauugguc

SEQ ID NO: 3885 - RNA, 22 nt, Homo sapiens
aaaagcuggguugagagggcga

SEQ ID NO: 3886 - RNA, 22 nt, Homo sapiens
aaaagcuggguugagagggcaa

SEQ ID NO: 3887 - RNA, 20 nt, Homo sapiens
aaaagcuggguugagagggu

SEQ ID NO: 3888 - RNA, 19 nt, Homo sapiens
aaaagcuggguugagagga

SEQ ID NO: 3889 - RNA, 23 nt, Homo sapiens
ugaggggcagagagcgagacuuu

SEQ ID NO: 3890 - RNA, 23 nt, Homo sapiens
uacuccagagggcgucacucaug

SEQ ID NO: 3891 - RNA, 22 nt, Homo sapiens
aucuggagguaagaagcacuuu

SEQ ID NO: 3892 - RNA, 23 nt, Homo sapiens
caaagcgcuucucuuuagagugu

SEQ ID NO: 3893 - RNA, 21 nt, Homo sapiens
cuccagagggaaguacuuucu

SEQ ID NO: 3894 - RNA, 21 nt, Homo sapiens
cuccagagggaugcacuuucu

SEQ ID NO: 3895 - RNA, 21 nt, Homo sapiens
ugaguuggccaucugagugag

SEQ ID NO: 3896 - RNA, 23 nt, Homo sapiens
gaacgccuguucuugccaggugg

SEQ ID NO: 3897 - RNA, 19 nt, Homo sapiens
agcugucugaaaaugucuu

SEQ ID NO: 3898 - RNA, 22 nt, Homo sapiens
aggcggggcgccgcgggaccgc

SEQ ID NO: 3899 - RNA, 22 nt, Homo sapiens
ugcggggcuagggcuaacagca

SEQ ID NO: 3900 - RNA, 21 nt, Homo sapiens
uggaggagaaggaaggugaug

SEQ ID NO: 3901 - RNA, 20 nt, Homo sapiens
guagaggagauggcgcaggg

SEQ ID NO: 3902 - RNA, 22 nt, Homo sapiens
uagcagcacauaaugguuugug

SEQ ID NO: 3903 - RNA, 22 nt, Homo sapiens
uagcagcacaucaugguuuaca

SEQ ID NO: 3904 - RNA, 22 nt, Homo sapiens
uagcagcacguaaauauuggcg

SEQ ID NO: 3905 - RNA, 18 nt, Homo sapiens
ugaggcaguagauugaau

SEQ ID NO: 3906 - RNA, 22 nt, Homo sapiens
cgcaggggccgggugcucaccg

SEQ ID NO: 3907 - RNA, 21 nt, Homo sapiens
uagcagcacagaaauauuggc

SEQ ID NO: 3908 - RNA, 22 nt, Homo sapiens
uuauaaagcaaugagacugauu

SEQ ID NO: 3909 - RNA, 22 nt, Homo sapiens
uggcagugucuuagcugguugu

SEQ ID NO: 3910 - RNA, 22 nt, Homo sapiens
cagcagcaauucauguuuugaa

SEQ ID NO: 3911 - RNA, 21 nt, Homo sapiens
cagcagcacacugugguuugu

SEQ ID NO: 3912 - RNA, 20 nt, Homo sapiens
ggggagcuguggaagcagua

SEQ ID NO: 3913 - RNA, 21 nt, Homo sapiens
aaggcagggcccccgcucccc

SEQ ID NO: 3914 - RNA, 22 nt, Homo sapiens
cagugcaauguuaaaagggcau

SEQ ID NO: 3915 - RNA, 22 nt, Homo sapiens
uagguaguuucauguuguuggg

SEQ ID NO: 3916 - RNA, 22 nt, Homo sapiens
uagguaguuuccuguuguuggg

SEQ ID NO: 3917 - RNA, 22 nt, Homo sapiens
uaacacugucugguaacgaugu

SEQ ID NO: 3918 - RNA, 22 nt, Homo sapiens
uaauacugccugguaaugauga

SEQ ID NO: 3919 - RNA, 21 nt, Homo sapiens
aucacauugccagggauuucc

SEQ ID NO: 3920 - RNA, 21 nt, Homo sapiens
aucacauugccagggauuacc

SEQ ID NO: 3921 - RNA, 23 nt, Homo sapiens
ccuaguagguguccaguaagugu

SEQ ID NO: 3922 - RNA, 22 nt, Homo sapiens
uuauaauacaaccugauaagug

SEQ ID NO: 3923 - RNA, 22 nt, Homo sapiens
auauaauacaaccugcuaagug

SEQ ID NO: 3924 - RNA, 21 nt, Homo sapiens
ucuaguaagaguggcagucga

SEQ ID NO: 3925 - RNA, 23 nt, Homo sapiens
caguaacaaagauucauccuugu

SEQ ID NO: 3926 - RNA, 22 nt, Homo sapiens
caggauguggucaaguguuguu

SEQ ID NO: 3927 - RNA, 22 nt, Homo sapiens
aaaaccgucuaguuacaguugu

SEQ ID NO: 3928 - RNA, 22 nt, Homo sapiens
uagcuuaucagacugauguuga

SEQ ID NO: 3929 - RNA, 24 nt, Homo sapiens
aauccuuggaaccuaggugugagu

SEQ ID NO: 3930 - RNA, 21 nt, Homo sapiens
aucauagaggaaaauccacgu

SEQ ID NO: 3931 - RNA, 22 nt, Homo sapiens
aucauagaggaaaauccauguu

SEQ ID NO: 3932 - RNA, 20 nt, Homo sapiens
cugcaaagggaagcccuuuc

SEQ ID NO: 3933 - RNA, 20 nt, Homo sapiens
cugcaaagggaagcccuuuc

SEQ ID NO: 3934 - RNA, 22 nt, Homo sapiens
auucuaauuucuccacgucuuu

SEQ ID NO: 3935 - RNA, 21 nt, Homo sapiens
uagauaaaauauugguaccug

SEQ ID NO: 3936 - RNA, 21 nt, Homo sapiens
uaauuuuauguauaagcuagu

SEQ ID NO: 3937 - RNA, 22 nt, Homo sapiens
gagcuuauucauaaaagugcag

SEQ ID NO: 3938 - RNA, 23 nt, Homo sapiens
acuugggcacugaaacaaugucc

SEQ ID NO: 3939 - RNA, 17 nt, Homo sapiens
ucgccuccuccucuccc

SEQ ID NO: 3940 - RNA, 22 nt, Homo sapiens
cucggcgcggggcgcgggcucc

SEQ ID NO: 3941 - RNA, 22 nt, Homo sapiens
gugugcggaaaugcuucugcua

SEQ ID NO: 3942 - RNA, 18 nt, Homo sapiens
ugaggcaguagauugaau

SEQ ID NO: 3943 - RNA, 21 nt, Homo sapiens
agggcccccccucaauccugu

SEQ ID NO: 3944 - RNA, 21 nt, Homo sapiens
gcaggaacuugugagucuccu

SEQ ID NO: 3945 - RNA, 21 nt, Homo sapiens
aaggcagggcccccgcucccc

SEQ ID NO: 3946 - RNA, 21 nt, Homo sapiens
cccggagccaggaugcagcuc

SEQ ID NO: 3947 - RNA, 21 nt, Homo sapiens
ucguggccuggucuccauuau

SEQ ID NO: 3948 - RNA, 22 nt, Homo sapiens
ugagccccugugccgcccccag

SEQ ID NO: 3949 - RNA, 22 nt, Homo sapiens
uggagugugacaaugguguuug

SEQ ID NO: 3950 - RNA, 18 nt, Homo sapiens
cgggcguggugguggggg

SEQ ID NO: 3951 - RNA, 21 nt, Homo sapiens
cggcggggacggcgauugguc

SEQ ID NO: 3952 - RNA, 22 nt, Homo sapiens
cgcaggggccgggugcucaccg

SEQ ID NO: 3953 - RNA, 22 nt, Homo sapiens
ucgugcaucccuuuagaguguu

SEQ ID NO: 3954 - RNA, 21 nt, Homo sapiens
uuggccacaauggguuagaac

SEQ ID NO: 3955 - RNA, 21 nt, Homo sapiens
agggggaaaguucuauagucc

SEQ ID NO: 3956 - RNA, 22 nt, Homo sapiens
aggcggggcgccgcgggaccgc

SEQ ID NO: 3957 - RNA, 22 nt, Homo sapiens
ugcggggcuagggcuaacagca

SEQ ID NO: 3958 - RNA, 20 nt, Homo sapiens
ggggagcuguggaagcagua

SEQ ID NO: 3959 - RNA, 22 nt, Homo sapiens
agaaggaaauugaauucauuua

SEQ ID NO: 3960 - RNA, 17 nt, Homo sapiens
ucccuguucgggcgcca

SEQ ID NO: 3961 - RNA, 19 nt, Homo sapiens
uggauuuuuggaucaggga

SEQ ID NO: 3962 - RNA, 22 nt, Homo sapiens
uguaacagcaacuccaugugga

SEQ ID NO: 3963 - RNA, 22 nt, Homo sapiens
uccuucauuccaccggagucug

SEQ ID NO: 3964 - RNA, 22 nt, Homo sapiens
ugucaguuugucaaauacccca

SEQ ID NO: 3965 - RNA, 22 nt, Homo sapiens
uagcaccaucugaaaucgguua

SEQ ID NO: 3966 - RNA, 22 nt, Homo sapiens
uguaaacauccucgacuggaag

SEQ ID NO: 3967 - RNA, 22 nt, Homo sapiens
uguaaacauccccgacuggaag

SEQ ID NO: 3968 - RNA, 22 nt, Homo sapiens
uguaaacauccuugacuggaag

SEQ ID NO: 3969 - RNA, 23 nt, Homo sapiens
uaaauuucaccuuucugagaagg

SEQ ID NO: 3970 - RNA, 22 nt, Homo sapiens
ggagaaauuauccuuggugugu

SEQ ID NO: 3971 - RNA, 21 nt, Homo sapiens
uagauaaaauauugguaccug

SEQ ID NO: 3972 - RNA, 22 nt, Homo sapiens
uuagggcccuggcuccaucucc

SEQ ID NO: 3973 - RNA, 22 nt, Homo sapiens
ucucccaacccuuguaccagug

SEQ ID NO: 3974 - RNA, 23 nt, Homo sapiens
uaaggugcaucuagugcaguuag

SEQ ID NO: 3975 - RNA, 22 nt, Homo sapiens
ugauauguuugauauauuaggu

SEQ ID NO: 3976 - RNA, 21 nt, Homo sapiens
ugauauguuugauauuggguu

SEQ ID NO: 3977 - RNA, 22 nt, Homo sapiens
gauuagggugcuuagcuguuaa

SEQ ID NO: 3978 - RNA, 22 nt, Homo sapiens
agaguugagucuggacgucccg

SEQ ID NO: 3979 - RNA, 22 nt, Homo sapiens
cuggcccucucugcccuuccgu

SEQ ID NO: 3980 - RNA, 22 nt, Homo sapiens
gguggcccggccgugccugagg

SEQ ID NO: 3981 - RNA, 25 nt, Homo sapiens
cuagugagggacagaaccaggauuc

SEQ ID NO: 3982 - RNA, 22 nt, Homo sapiens
augguacccuggcauacugagu

SEQ ID NO: 3983 - RNA, 22 nt, Homo sapiens
uuagggcccuggcuccaucucc

SEQ ID NO: 3984 - RNA, 22 nt, Homo sapiens
uuagggcccuggcuccaucucc

SEQ ID NO: 3985 - RNA, 21 nt, Homo sapiens
uaccacaggguagaaccacgg

SEQ ID NO: 3986 - RNA, 20 nt, Homo sapiens
ccccagggcgacgcggcggg

SEQ ID NO: 3987 - RNA, 21 nt, Homo sapiens
caagucacuagugguuccguu

SEQ ID NO: 3988 - RNA, 24 nt, Homo sapiens
agcagaagcagggagguucuccca

SEQ ID NO: 3989 - RNA, 22 nt, Homo sapiens
uguaaacauccuacacucagcu

SEQ ID NO: 3990 - RNA, 22 nt, Homo sapiens
cuggcccucucugcccuuccgu

SEQ ID NO: 3991 - RNA, 21 nt, Homo sapiens
gccccugggccuauccuagaa

SEQ ID NO: 3992 - RNA, 22 nt, Homo sapiens
aaucacuaaccacacggccagg

SEQ ID NO: 3993 - RNA, 22 nt, Homo sapiens
uucucaaggaggugucguuuau

SEQ ID NO: 3994 - RNA, 22 nt, Homo sapiens
auucugcauuuuuagcaaguuc

SEQ ID NO: 3995 - RNA, 22 nt, Homo sapiens
gguggcccggccgugccugagg

SEQ ID NO: 3996 - RNA, 21 nt, Homo sapiens
gcaggaacuugugagucuccu

SEQ ID NO: 3997 - RNA, 22 nt, Homo sapiens
uggagugugacaaugguguuug

SEQ ID NO: 3998 - RNA, 17 nt, Homo sapiens
gugggggagaggcuguc

SEQ ID NO: 3999 - RNA, 21 nt, Homo sapiens
gcccuccgcccgugcaccccg

SEQ ID NO: 4000 - RNA, 23 nt, Homo sapiens
ucuggcuccgugucuucacuccc

SEQ ID NO: 4001 - RNA, 22 nt, Homo sapiens
caaagaauucuccuuuugggcu

SEQ ID NO: 4002 - RNA, 21 nt, Homo sapiens
cggcggggacggcgauugguc

SEQ ID NO: 4003 - RNA, 21 nt, Homo sapiens
cggcggggacggcgauugguc

SEQ ID NO: 4004 - RNA, 22 nt, Homo sapiens
cucccacugcuucacuugacua

SEQ ID NO: 4005 - RNA, 22 nt, Homo sapiens
cauugcacuugucucggucuga

SEQ ID NO: 4006 - RNA, 21 nt, Homo sapiens
agggcccccccucaauccugu

SEQ ID NO: 4007 - RNA, 22 nt, Homo sapiens
uguaaacauccuacacucagcu

SEQ ID NO: 4008 - RNA, 23 nt, Homo sapiens
ugaggggcagagagcgagacuuu

SEQ ID NO: 4009 - RNA, 22 nt, Homo sapiens
ccucccacacccaaggcuugca

SEQ ID NO: 4010 - RNA, 22 nt, Homo sapiens
uggugggcacagaaucuggacu

SEQ ID NO: 4011 - RNA, 25 nt, Homo sapiens
aggggugguguugggacagcuccgu

SEQ ID NO: 4012 - RNA, 25 nt, Homo sapiens
aggggugguguugggacagcuccgu

SEQ ID NO: 4013 - RNA, 22 nt, Homo sapiens
uggugggccgcagaacaugugc

SEQ ID NO: 4014 - RNA, 22 nt, Homo sapiens
aggcggggcgccgcgggaccgc

SEQ ID NO: 4015 - RNA, 22 nt, Homo sapiens
aggcggggcgccgcgggaccgc

SEQ ID NO: 4016 - RNA, 20 nt, Homo sapiens
ggggagcuguggaagcagua

SEQ ID NO: 4017 - RNA, 20 nt, Homo sapiens
ggggagcuguggaagcagua

SEQ ID NO: 4018 - RNA, 23 nt, Homo sapiens
cacccggcugugugcacaugugc

SEQ ID NO: 4019 - RNA, 22 nt, Homo sapiens
augggugaauuuguagaaggau

SEQ ID NO: 4020 - RNA, 22 nt, Homo sapiens
ucugggcaacaaagugagaccu

SEQ ID NO: 4021 - RNA, 22 nt, Homo sapiens
uggagagaaaggcaguuccuga

SEQ ID NO: 4022 - RNA, 24 nt, Homo sapiens
aauccuuggaaccuaggugugagu

SEQ ID NO: 4023 - RNA, 22 nt, Homo sapiens
caugccuugaguguaggaccgu

SEQ ID NO: 4024 - RNA, 25 nt, Homo sapiens
gcugggcagggcuucugagcuccuu

SEQ ID NO: 4025 - RNA, 23 nt, Homo sapiens
uggugcggagagggcccacagug

SEQ ID NO: 4026 - RNA, 22 nt, Homo sapiens
uaacagucuacagccauggucg

SEQ ID NO: 4027 - RNA, 25 nt, Homo sapiens
cccccacaaccgcgcuugacuagcu

SEQ ID NO: 4028 - RNA, 21 nt, Homo sapiens
uaacagucuccagucacggcc

SEQ ID NO: 4029 - RNA, 22 nt, Homo sapiens
uguaaacauccucgacuggaag

SEQ ID NO: 4030 - RNA, 22 nt, Homo sapiens
uguaaacauccccgacuggaag

SEQ ID NO: 4031 - RNA, 22 nt, Homo sapiens
uguaaacauccuugacuggaag

SEQ ID NO: 4032 - RNA, 22 nt, Homo sapiens
aacuguuugcagaggaaacuga

SEQ ID NO: 4033 - RNA, 21 nt, Homo sapiens
uuaagacuugcagugauguuu

SEQ ID NO: 4034 - RNA, 22 nt, Homo sapiens
ugagaaccacgucugcucugag

SEQ ID NO: 4035 - RNA, 21 nt, Homo sapiens
cugacuguugccguccuccag

SEQ ID NO: 4036 - RNA, 22 nt, Homo sapiens
ucaccagcccuguguucccuag

SEQ ID NO: 4037 - RNA, 22 nt, Homo sapiens
ccucuuccccuugucucuccag

SEQ ID NO: 4038 - RNA, 23 nt, Homo sapiens
agcugguguugugaaucaggccg

SEQ ID NO: 4039 - RNA, 22 nt, Homo sapiens
uggagagaaaggcaguuccuga

SEQ ID NO: 4040 - RNA, 21 nt, Homo sapiens
cggcggggacggcgauugguc

SEQ ID NO: 4041 - RNA, 21 nt, Homo sapiens
aucacauugccagggauuucc

SEQ ID NO: 4042 - RNA, 21 nt, Homo sapiens
aucacauugccagggauuacc

SEQ ID NO: 4043 - RNA, 19 nt, Homo sapiens
aggcacggugucagcaggc

SEQ ID NO: 4044 - RNA, 22 nt, Homo sapiens
aggcggggcgccgcgggaccgc

SEQ ID NO: 4045 - RNA, 23 nt, Homo sapiens
aaggagcuuacaaucuagcuggg

SEQ ID NO: 4046 - RNA, 20 nt, Homo sapiens
guagaggagauggcgcaggg

SEQ ID NO: 4047 - RNA, 23 nt, Homo sapiens
gagggucuugggagggaugugac

SEQ ID NO: 4048 - RNA, 20 nt, Homo sapiens
ggggagcuguggaagcagua

SEQ ID NO: 4049 - RNA, 22 nt, Homo sapiens
ugagaacugaauuccauggguu

SEQ ID NO: 4050 - RNA, 24 nt, Homo sapiens
uuuggcaaugguagaacucacacu

SEQ ID NO: 4051 - RNA, 18 nt, Homo sapiens
ugaggcaguagauugaau

SEQ ID NO: 4052 - RNA, 22 nt, Homo sapiens
caaagaauucuccuuuugggcu

SEQ ID NO: 4053 - RNA, 20 nt, Homo sapiens
ccuccugcccuccuugcugu

SEQ ID NO: 4054 - RNA, 21 nt, Homo sapiens
ugagaugaagcacuguagcuc

SEQ ID NO: 4055 - RNA, 21 nt, Homo sapiens
uaguagaccguauagcguacg

SEQ ID NO: 4056 - RNA, 22 nt, Homo sapiens
aucacacaaaggcaacuuuugu

SEQ ID NO: 4057 - RNA, 22 nt, Homo sapiens
ugugacagauugauaacugaaa

SEQ ID NO: 4058 - RNA, 21 nt, Homo sapiens
agggggaaaguucuauagucc

SEQ ID NO: 4059 - RNA, 21 nt, Homo sapiens
aaggcagggcccccgcucccc

SEQ ID NO: 4060 - RNA, 21 nt, Homo sapiens
uggcagggaggcugggagggg

SEQ ID NO: 4061 - RNA, 18 nt, Homo sapiens
cagggaggugaaugugau

SEQ ID NO: 4062 - RNA, 23 nt, Homo sapiens
ucuggcuccgugucuucacuccc

SEQ ID NO: 4063 - RNA, 22 nt, Homo sapiens
uggagagaaaggcaguuccuga

SEQ ID NO: 4064 - RNA, 22 nt, Homo sapiens
cgcaggggccgggugcucaccg

SEQ ID NO: 4065 - RNA, 22 nt, Homo sapiens
ucugcccccuccgcugcugcca

SEQ ID NO: 4066 - RNA, 20 nt, Homo sapiens
ccccagggcgacgcggcggg

SEQ ID NO: 4067 - RNA, 22 nt, Homo sapiens
cauugcacuugucucggucuga

SEQ ID NO: 4068 - RNA, 20 nt, Homo sapiens
acugccccaggugcugcugg

SEQ ID NO: 4069 - RNA, 21 nt, Homo sapiens
cggggcagcucaguacaggau

SEQ ID NO: 4070 - RNA, 21 nt, Homo sapiens
ugaguuggccaucugagugag

SEQ ID NO: 4071 - RNA, 24 nt, Homo sapiens
acugggggcuuucgggcucugcgu

SEQ ID NO: 4072 - RNA, 21 nt, Homo sapiens
uggaggagaaggaaggugaug

SEQ ID NO: 4073 - RNA, 22 nt, Homo sapiens
cugcccuggcccgagggaccga

SEQ ID NO: 4074 - RNA, 21 nt, Homo sapiens
aaggcagggcccccgcucccc

SEQ ID NO: 4075 - RNA, 21 nt, Homo sapiens
aauaauacaugguugaucuuu

SEQ ID NO: 4076 - RNA, 22 nt, Homo sapiens
aucaugaugggcuccucggugu

SEQ ID NO: 4077 - RNA, 22 nt, Homo sapiens
cuuaugcaagauucccuucuac

SEQ ID NO: 4078 - RNA, 22 nt, Homo sapiens
ugaguauuacauggccaaucuc

SEQ ID NO: 4079 - RNA, 22 nt, Homo sapiens
aagauguggaaaaauuggaauc

SEQ ID NO: 4080 - RNA, 23 nt, Homo sapiens
acuuacagacaagagccuugcuc

SEQ ID NO: 4081 - RNA, 22 nt, Homo sapiens
caaucacuaacuccacugccau

SEQ ID NO: 4082 - RNA, 22 nt, Homo sapiens
aaucacuaaccacacggccagg

SEQ ID NO: 4083 - RNA, 22 nt, Homo sapiens
acccgucccguucguccccgga

SEQ ID NO: 4084 - RNA, 18 nt, Homo sapiens
acguuggcucugguggug

SEQ ID NO: 4085 - RNA, 23 nt, Homo sapiens
cggcccgggcugcugcuguuccu

SEQ ID NO: 4086 - RNA, 21 nt, Homo sapiens
cggcggggacggcgauugguc

SEQ ID NO: 4087 - RNA, 22 nt, Homo sapiens
cgcaggggccgggugcucaccg

SEQ ID NO: 4088 - RNA, 21 nt, Homo sapiens
aggggugcuaucugugauuga

SEQ ID NO: 4089 - RNA, 23 nt, Homo sapiens
gaacgcgcuucccuauagagggu

SEQ ID NO: 4090 - RNA, 21 nt, Homo sapiens
gcuaguccugacucagccagu

SEQ ID NO: 4091 - RNA, 19 nt, Homo sapiens
ucuaggcugguacugcuga

SEQ ID NO: 4092 - RNA, 22 nt, Homo sapiens
aggcggggcgccgcgggaccgc

SEQ ID NO: 4093 - RNA, 22 nt, Homo sapiens
uauugcacucgucccggccucc

SEQ ID NO: 4094 - RNA, 17 nt, Homo sapiens
ucgccuccuccucuccc

SEQ ID NO: 4095 - RNA, 24 nt, Homo sapiens
uuuggcaaugguagaacucacacu

SEQ ID NO: 4096 - RNA, 18 nt, Homo sapiens
ugaggcaguagauugaau

SEQ ID NO: 4097 - RNA, 21 nt, Homo sapiens
cggcggggacggcgauugguc

SEQ ID NO: 4098 - RNA, 22 nt, Homo sapiens
cauugcacuugucucggucuga

SEQ ID NO: 4099 - RNA, 19 nt, Homo sapiens
gggcgccugugaucccaac

SEQ ID NO: 4100 - RNA, 21 nt, Homo sapiens
aggaggcagcgcucucaggac

SEQ ID NO: 4101 - RNA, 25 nt, Homo sapiens
ggcggagggaaguagguccguuggu

SEQ ID NO: 4102 - RNA, 22 nt, Homo sapiens
aggcggggcgccgcgggaccgc

SEQ ID NO: 4103 - RNA, 21 nt, Homo sapiens
uccgguucucagggcuccacc

SEQ ID NO: 4104 - RNA, 21 nt, Homo sapiens
cgcgggugcuuacugacccuu

SEQ ID NO: 4105 - RNA, 20 nt, Homo sapiens
ggggagcuguggaagcagua

SEQ ID NO: 4106 - RNA, 26 nt, Homo sapiens
gaugaugauggcagcaaauucugaaa

SEQ ID NO: 4107 - RNA, 21 nt, Homo sapiens
agagaagaagaucagccugca

SEQ ID NO: 4108 - RNA, 17 nt, Homo sapiens
ucgccuccuccucuccc

SEQ ID NO: 4109 - RNA, 22 nt, Homo sapiens
uucuggaauucugugugaggga

SEQ ID NO: 4110 - RNA, 22 nt, Homo sapiens
ucaaaacugaggggcauuuucu

SEQ ID NO: 4111 - RNA, 22 nt, Homo sapiens
cagugguuuuacccuaugguag

SEQ ID NO: 4112 - RNA, 22 nt, Homo sapiens
uaacacugucugguaaagaugg

SEQ ID NO: 4113 - RNA, 21 nt, Homo sapiens
gccccugggccuauccuagaa

SEQ ID NO: 4114 - RNA, 22 nt, Homo sapiens
caaaacuggcaauuacuuuugc

SEQ ID NO: 4115 - RNA, 22 nt, Homo sapiens
aaaaacugagacuacuuuugca

SEQ ID NO: 4116 - RNA, 19 nt, Homo sapiens
aaaaacuguaauuacuuuu

SEQ ID NO: 4117 - RNA, 22 nt, Homo sapiens
ccaaaacugcaguuacuuuugc

SEQ ID NO: 4118 - RNA, 21 nt, Homo sapiens
acagucugcugagguuggagc

SEQ ID NO: 4119 - RNA, 22 nt, Homo sapiens
ggagacgcggcccuguuggagu

SEQ ID NO: 4120 - RNA, 21 nt, Homo sapiens
uaaagugcugacagugcagau

SEQ ID NO: 4121 - RNA, 21 nt, Homo sapiens
ccccaccuccucucuccucag

SEQ ID NO: 4122 - RNA, 22 nt, Homo sapiens
ccucuuccccuugucucuccag

SEQ ID NO: 4123 - RNA, 18 nt, Homo sapiens
aucccaccucugccacca

SEQ ID NO: 4124 - RNA, 20 nt, Homo sapiens
ccuccugcccuccuugcugu

SEQ ID NO: 4125 - RNA, 22 nt, Homo sapiens
aaggagcucacagucuauugag

SEQ ID NO: 4126 - RNA, 22 nt, Homo sapiens
uaaugccccuaaaaauccuuau

SEQ ID NO: 4127 - RNA, 22 nt, Homo sapiens
gguggcccggccgugccugagg

SEQ ID NO: 4128 - RNA, 23 nt, Homo sapiens
aaggagcuuacaaucuagcuggg

SEQ ID NO: 4129 - RNA, 21 nt, Homo sapiens
uggaggagaaggaaggugaug

SEQ ID NO: 4130 - RNA, 22 nt, Homo sapiens
uccauuacacuacccugccucu

SEQ ID NO: 4131 - RNA, 22 nt, Homo sapiens
acaguagagggaggaaucgcag

SEQ ID NO: 4132 - RNA, 22 nt, Homo sapiens
uggagugugacaaugguguuug

SEQ ID NO: 4133 - RNA, 22 nt, Homo sapiens
aggcaguguauuguuagcuggc

SEQ ID NO: 4134 - RNA, 20 nt, Homo sapiens
ccucugggcccuuccuccag

SEQ ID NO: 4135 - RNA, 22 nt, Homo sapiens
ucucugggccugugucuuaggc

SEQ ID NO: 4136 - RNA, 23 nt, Homo sapiens
uauucauuuauccccagccuaca

SEQ ID NO: 4137 - RNA, 21 nt, Homo sapiens
gaaggcgcuucccuuuggagu

SEQ ID NO: 4138 - RNA, 19 nt, Homo sapiens
aauggauuuuuggagcagg

SEQ ID NO: 4139 - RNA, 19 nt, Homo sapiens
auggauaaggcuuuggcuu

SEQ ID NO: 4140 - RNA, 21 nt, Homo sapiens
ucacagugaaccggucucuuu

SEQ ID NO: 4141 - RNA, 22 nt, Homo sapiens
ucuauacagacccuggcuuuuc

SEQ ID NO: 4142 - RNA, 19 nt, Homo sapiens
uggauuuuuggaucaggga

SEQ ID NO: 4143 - RNA, 22 nt, Homo sapiens
cagugcaauguuaaaagggcau

SEQ ID NO: 4144 - RNA, 22 nt, Homo sapiens
cagugcaaugaugaaagggcau

SEQ ID NO: 4145 - RNA, 23 nt, Homo sapiens
ugugcaaaucuaugcaaaacuga

SEQ ID NO: 4146 - RNA, 23 nt, Homo sapiens
ugugcaaauccaugcaaaacuga

SEQ ID NO: 4147 - RNA, 21 nt, Homo sapiens
uucacaguggcuaaguuccgc

SEQ ID NO: 4148 - RNA, 21 nt, Homo sapiens
uucacaguggcuaaguucugc

SEQ ID NO: 4149 - RNA, 23 nt, Homo sapiens
cagugcaauaguauugucaaagc

SEQ ID NO: 4150 - RNA, 23 nt, Homo sapiens
cagugcaaugauauugucaaagc

SEQ ID NO: 4151 - RNA, 23 nt, Homo sapiens
ccuaguagguguccaguaagugu

SEQ ID NO: 4152 - RNA, 21 nt, Homo sapiens
aauaauacaugguugaucuuu

SEQ ID NO: 4153 - RNA, 23 nt, Homo sapiens
uagugcaauauugcuuauagggu

SEQ ID NO: 4154 - RNA, 21 nt, Homo sapiens
uuuugcaccuuuuggagugaa

SEQ ID NO: 4155 - RNA, 22 nt, Homo sapiens
caaaaaucucaauuacuuuugc

SEQ ID NO: 4156 - RNA, 23 nt, Homo sapiens
guuugcacgggugggccuugucu

SEQ ID NO: 4157 - RNA, 23 nt, Homo sapiens
uauucauuuauccccagccuaca

SEQ ID NO: 4158 - RNA, 22 nt, Homo sapiens
uggagagaaaggcaguuccuga

SEQ ID NO: 4159 - RNA, 22 nt, Homo sapiens
uugagaaugaugaaucauuagg

SEQ ID NO: 4160 - RNA, 22 nt, Homo sapiens
caaaacuggcaauuacuuuugc

SEQ ID NO: 4161 - RNA, 22 nt, Homo sapiens
aaaaacugagacuacuuuugca

SEQ ID NO: 4162 - RNA, 19 nt, Homo sapiens
aaaaacuguaauuacuuuu

SEQ ID NO: 4163 - RNA, 21 nt, Homo sapiens
ccaguccugugccugccgccu

SEQ ID NO: 4164 - RNA, 22 nt, Homo sapiens
aggcagcgggguguaguggaua

SEQ ID NO: 4165 - RNA, 21 nt, Homo sapiens
auguaugugugcaugugcaug

SEQ ID NO: 4166 - RNA, 22 nt, Homo sapiens
cuuaugcaagauucccuucuac

SEQ ID NO: 4167 - RNA, 21 nt, Homo sapiens
auugacacuucugugaguaga

SEQ ID NO: 4168 - RNA, 22 nt, Homo sapiens
uugugucaauaugcgaugaugu

SEQ ID NO: 4169 - RNA, 23 nt, Homo sapiens
ugaggggcagagagcgagacuuu

SEQ ID NO: 4170 - RNA, 23 nt, Homo sapiens
uacuccagagggcgucacucaug

SEQ ID NO: 4171 - RNA, 22 nt, Homo sapiens
aaaacuguaauuacuuuuguac

SEQ ID NO: 4172 - RNA, 22 nt, Homo sapiens
aguauucuguaccagggaaggu

SEQ ID NO: 4173 - RNA, 22 nt, Homo sapiens
ugagaacugaauuccauggguu

SEQ ID NO: 4174 - RNA, 22 nt, Homo sapiens
ugagaacugaauuccauaggcu

SEQ ID NO: 4175 - RNA, 22 nt, Homo sapiens
uagcaaaaacugcaguuacuuu

SEQ ID NO: 4176 - RNA, 17 nt, Homo sapiens
uucaaguaauucaggug

SEQ ID NO: 4177 - RNA, 24 nt, Homo sapiens
ccagacagaauucuaugcacuuuc

SEQ ID NO: 4178 - RNA, 22 nt, Homo sapiens
caaagaauucuccuuuugggcu

SEQ ID NO: 4179 - RNA, 22 nt, Homo sapiens
uucaaguaauccaggauaggcu

SEQ ID NO: 4180 - RNA, 21 nt, Homo sapiens
uucaaguaauucaggauaggu

SEQ ID NO: 4181 - RNA, 22 nt, Homo sapiens
uguaacagcaacuccaugugga

SEQ ID NO: 4182 - RNA, 22 nt, Homo sapiens
agaaggaaauugaauucauuua

SEQ ID NO: 4183 - RNA, 21 nt, Homo sapiens
auccuugcuaucugggugcua

SEQ ID NO: 4184 - RNA, 22 nt, Homo sapiens
uggagugugacaaugguguuug

SEQ ID NO: 4185 - RNA, 22 nt, Homo sapiens
uggagugugacaaugguguuug

SEQ ID NO: 4186 - RNA, 23 nt, Homo sapiens
ucuggcuccgugucuucacuccc

SEQ ID NO: 4187 - RNA, 20 nt, Homo sapiens
ccccagggcgacgcggcggg

SEQ ID NO: 4188 - RNA, 22 nt, Homo sapiens
uagcuuaucagacugauguuga

SEQ ID NO: 4189 - RNA, 21 nt, Homo sapiens
gccccugggccuauccuagaa

SEQ ID NO: 4190 - RNA, 23 nt, Homo sapiens
ucccccaggugugauucugauuu

SEQ ID NO: 4191 - RNA, 23 nt, Homo sapiens
gcgaggaccccucggggucugac

SEQ ID NO: 4192 - RNA, 24 nt, Homo sapiens
acugggggcuuucgggcucugcgu

SEQ ID NO: 4193 - RNA, 24 nt, Homo sapiens
ugccugggucucuggccugcgcgu

SEQ ID NO: 4194 - RNA, 21 nt, Homo sapiens
uggcagggaggcugggagggg

SEQ ID NO: 4195 - RNA, 17 nt, Homo sapiens
ucgccuccuccucuccc

SEQ ID NO: 4196 - RNA, 21 nt, Homo sapiens
cggcggggacggcgauugguc

SEQ ID NO: 4197 - RNA, 22 nt, Homo sapiens
ucugcccccuccgcugcugcca

SEQ ID NO: 4198 - RNA, 22 nt, Homo sapiens
cauugcacuugucucggucuga

SEQ ID NO: 4199 - RNA, 20 nt, Homo sapiens
acugccccaggugcugcugg

SEQ ID NO: 4200 - RNA, 21 nt, Homo sapiens
cggggcagcucaguacaggau

SEQ ID NO: 4201 - RNA, 25 nt, Homo sapiens
ggcggagggaaguagguccguuggu

SEQ ID NO: 4202 - RNA, 22 nt, Homo sapiens
aggcggggcgccgcgggaccgc

SEQ ID NO: 4203 - RNA, 22 nt, Homo sapiens
ugcggggcuagggcuaacagca

SEQ ID NO: 4204 - RNA, 22 nt, Homo sapiens
aggcagcgggguguaguggaua

SEQ ID NO: 4205 - RNA, 22 nt, Homo sapiens
auccgcgcucugacucucugcc

SEQ ID NO: 4206 - RNA, 20 nt, Homo sapiens
cgugccacccuuuuccccag

SEQ ID NO: 4207 - RNA, 20 nt, Homo sapiens
cgugccacccuuuuccccag

SEQ ID NO: 4208 - RNA, 23 nt, Homo sapiens
aacauucaacgcugucggugagu

SEQ ID NO: 4209 - RNA, 22 nt, Homo sapiens
uggagagaaaggcaguuccuga

SEQ ID NO: 4210 - RNA, 22 nt, Homo sapiens
uagguaguuucauguuguuggg

SEQ ID NO: 4211 - RNA, 23 nt, Homo sapiens
caaagugcucauagugcagguag

SEQ ID NO: 4212 - RNA, 22 nt, Homo sapiens
aauugcacuuuagcaaugguga

SEQ ID NO: 4213 - RNA, 20 nt, Homo sapiens
ccauggaucuccaggugggu

SEQ ID NO: 4214 - RNA, 22 nt, Homo sapiens
cgucaacacuugcugguuuccu

SEQ ID NO: 4215 - RNA, 21 nt, Homo sapiens
aaaacggugagauuuuguuuu

SEQ ID NO: 4216 - RNA, 22 nt, Homo sapiens
cgaaaacagcaauuaccuuugc

SEQ ID NO: 4217 - RNA, 21 nt, Homo sapiens
uuggccacaauggguuagaac

SEQ ID NO: 4218 - RNA, 23 nt, Homo sapiens
gacacgggcgacagcugcggccc

SEQ ID NO: 4219 - RNA, 21 nt, Homo sapiens
acagucugcugagguuggagc

SEQ ID NO: 4220 - RNA, 19 nt, Homo sapiens
gugucugcuuccuguggga

SEQ ID NO: 4221 - RNA, 22 nt, Homo sapiens
ugcggggcuagggcuaacagca

SEQ ID NO: 4222 - RNA, 21 nt, Homo sapiens
cacuguguccuuucugcguag

SEQ ID NO: 4223 - RNA, 27 nt, Homo sapiens
accuucuuguauaagcacugugcuaaa

SEQ ID NO: 4224 - RNA, 18 nt, Homo sapiens
uugagaaggaggcugcug

SEQ ID NO: 4225 - RNA, 20 nt, Homo sapiens
auuccuagaaauuguucaua

SEQ ID NO: 4226 - RNA, 18 nt, Homo sapiens
ugcuuccuuucagagggu

SEQ ID NO: 4227 - RNA, 22 nt, Homo sapiens
aucuggagguaagaagcacuuu

SEQ ID NO: 4228 - RNA, 22 nt, Homo sapiens
ugaaggucuacugugugccagg

SEQ ID NO: 4229 - RNA, 23 nt, Homo sapiens
acuuacagacaagagccuugcuc

SEQ ID NO: 4230 - RNA, 21 nt, Homo sapiens
aggcaagaugcuggcauagcu

SEQ ID NO: 4231 - RNA, 22 nt, Homo sapiens
ucagcaaacauuuauugugugc

SEQ ID NO: 4232 - RNA, 24 nt, Homo sapiens
ccagacagaauucuaugcacuuuc

SEQ ID NO: 4233 - RNA, 22 nt, Homo sapiens
uaacacugucugguaaagaugg

SEQ ID NO: 4234 - RNA, 24 nt, Homo sapiens
uuuggcaaugguagaacucacacu

SEQ ID NO: 4235 - RNA, 22 nt, Homo sapiens
uaacacugucugguaacgaugu

SEQ ID NO: 4236 - RNA, 22 nt, Homo sapiens
aagcugccaguugaagaacugu

SEQ ID NO: 4237 - RNA, 23 nt, Homo sapiens
aaugacacgaucacucccguuga

SEQ ID NO: 4238 - RNA, 22 nt, Homo sapiens
ucaggcucaguccccucccgau

SEQ ID NO: 4239 - RNA, 19 nt, Homo sapiens
ugagcugcuguaccaaaau

SEQ ID NO: 4240 - RNA, 19 nt, Homo sapiens
agcugucugaaaaugucuu

SEQ ID NO: 4241 - RNA, 19 nt, Homo sapiens
gugucugcuuccuguggga

SEQ ID NO: 4242 - RNA, 21 nt, Homo sapiens
uggaggagaaggaaggugaug

SEQ ID NO: 4243 - RNA, 22 nt, Homo sapiens
ugcaacuuaccugagucauuga

SEQ ID NO: 4244 - RNA, 22 nt, Homo sapiens
auccgcgcucugacucucugcc

SEQ ID NO: 4245 - RNA, 18 nt, Homo sapiens
aucccaccucugccacca

SEQ ID NO: 4246 - RNA, 22 nt, Homo sapiens
caggauguggucaaguguuguu

SEQ ID NO: 4247 - RNA, 17 nt, Homo sapiens
ucgccuccuccucuccc

SEQ ID NO: 4248 - RNA, 18 nt, Homo sapiens
cagggaggugaaugugau

SEQ ID NO: 4249 - RNA, 21 nt, Homo sapiens
cggcggggacggcgauugguc

SEQ ID NO: 4250 - RNA, 22 nt, Homo sapiens
ucaggccaggcacaguggcuca

SEQ ID NO: 4251 - RNA, 22 nt, Homo sapiens
ccucccacacccaaggcuugca

SEQ ID NO: 4252 - RNA, 24 nt, Homo sapiens
ugccugggucucuggccugcgcgu

SEQ ID NO: 4253 - RNA, 22 nt, Homo sapiens
aggcggggcgccgcgggaccgc

SEQ ID NO: 4254 - RNA, 22 nt, Homo sapiens
ugcggggcuagggcuaacagca

SEQ ID NO: 4255 - RNA, 20 nt, Homo sapiens
ggggagcuguggaagcagua

SEQ ID NO: 4256 - RNA, 21 nt, Homo sapiens
guucaaauccagaucuauaac

SEQ ID NO: 4257 - RNA, 21 nt, Homo sapiens
ucacagugaaccggucucuuu

SEQ ID NO: 4258 - RNA, 23 nt, Homo sapiens
ucuuggaguaggucauugggugg

SEQ ID NO: 4259 - RNA, 24 nt, Homo sapiens
cugaagugauguguaacugaucag

SEQ ID NO: 4260 - RNA, 22 nt, Homo sapiens
aacuggcccucaaagucccgcu

SEQ ID NO: 4261 - RNA, 22 nt, Homo sapiens
gaaguuguucgugguggauucg

SEQ ID NO: 4262 - RNA, 20 nt, Homo sapiens
uaaagagcccuguggagaca

SEQ ID NO: 4263 - RNA, 22 nt, Homo sapiens
cgucaacacuugcugguuuccu

SEQ ID NO: 4264 - RNA, 22 nt, Homo sapiens
uuugugaccugguccacuaacc

SEQ ID NO: 4265 - RNA, 21 nt, Homo sapiens
uggaggagaaggaaggugaug

SEQ ID NO: 4266 - RNA, 21 nt, Homo sapiens
ucguggccuggucuccauuau

SEQ ID NO: 4267 - RNA, 22 nt, Homo sapiens
ugagccccugugccgcccccag

SEQ ID NO: 4268 - RNA, 20 nt, Homo sapiens
ucguuugccuuuuucugcuu

SEQ ID NO: 4269 - RNA, 22 nt, Homo sapiens
ucagugcaucacagaacuuugu

SEQ ID NO: 4270 - RNA, 22 nt, Homo sapiens
uagcagcacauaaugguuugug

SEQ ID NO: 4271 - RNA, 22 nt, Homo sapiens
uagcagcacaucaugguuuaca

SEQ ID NO: 4272 - RNA, 22 nt, Homo sapiens
uagcagcacguaaauauuggcg

SEQ ID NO: 4273 - RNA, 21 nt, Homo sapiens
cggcggggacggcgauugguc

SEQ ID NO: 4274 - RNA, 21 nt, Homo sapiens
uagcagcacagaaauauuggc

SEQ ID NO: 4275 - RNA, 22 nt, Homo sapiens
acagcaggcacagacaggcagu

SEQ ID NO: 4276 - RNA, 22 nt, Homo sapiens
gccugcugggguggaaccuggu

SEQ ID NO: 4277 - RNA, 22 nt, Homo sapiens
cagcagcaauucauguuuugaa

SEQ ID NO: 4278 - RNA, 22 nt, Homo sapiens
uuuugcgauguguuccuaauau

SEQ ID NO: 4279 - RNA, 21 nt, Homo sapiens
cagcagcacacugugguuugu

SEQ ID NO: 4280 - RNA, 22 nt, Homo sapiens
aucuggagguaagaagcacuuu

SEQ ID NO: 4281 - RNA, 22 nt, Homo sapiens
auucugcauuuuuagcaaguuc

SEQ ID NO: 4282 - RNA, 19 nt, Homo sapiens
gggcgccugugaucccaac

SEQ ID NO: 4283 - RNA, 21 nt, Homo sapiens
ugagcuaaaugugugcuggga

SEQ ID NO: 4284 - RNA, 22 nt, Homo sapiens
uccgagccugggucucccucuu

SEQ ID NO: 4285 - RNA, 22 nt, Homo sapiens
aggcggggcgccgcgggaccgc

SEQ ID NO: 4286 - RNA, 22 nt, Homo sapiens
ugcggggcuagggcuaacagca

SEQ ID NO: 4287 - RNA, 22 nt, Homo sapiens
ugagaaccacgucugcucugag

SEQ ID NO: 4288 - RNA, 22 nt, Homo sapiens
uuuagagacggggucuugcucu

SEQ ID NO: 4289 - RNA, 22 nt, Homo sapiens
cucccacugcuucacuugacua

SEQ ID NO: 4290 - RNA, 22 nt, Homo sapiens
cauugcacuugucucggucuga

SEQ ID NO: 4291 - RNA, 22 nt, Homo sapiens
ccucccacacccaaggcuugca

SEQ ID NO: 4292 - RNA, 22 nt, Homo sapiens
uugugucaauaugcgaugaugu

SEQ ID NO: 4293 - RNA, 22 nt, Homo sapiens
ugugucacucgaugaccacugu

SEQ ID NO: 4294 - RNA, 21 nt, Homo sapiens
ugagaugaagcacuguagcuc

SEQ ID NO: 4295 - RNA, 21 nt, Homo sapiens
uaguagaccguauagcguacg

SEQ ID NO: 4296 - RNA, 21 nt, Homo sapiens
auccuugcuaucugggugcua

SEQ ID NO: 4297 - RNA, 22 nt, Homo sapiens
uagcuuaucagacugauguuga

SEQ ID NO: 4298 - RNA, 22 nt, Homo sapiens
gagcuuauucauaaaagugcag

SEQ ID NO: 4299 - RNA, 23 nt, Homo sapiens
ucuggcuccgugucuucacuccc

SEQ ID NO: 4300 - RNA, 22 nt, Homo sapiens
caaagaauucuccuuuugggcu

SEQ ID NO: 4301 - RNA, 23 nt, Homo sapiens
ugaguaccgccaugucuguuggg

SEQ ID NO: 4302 - RNA, 22 nt, Homo sapiens
aacuggcccucaaagucccgcu

SEQ ID NO: 4303 - RNA, 23 nt, Homo sapiens
uaaagugcuuauagugcagguag

SEQ ID NO: 4304 - RNA, 23 nt, Homo sapiens
uacugcaucaggaacugauugga

SEQ ID NO: 4305 - RNA, 23 nt, Homo sapiens
cacucagccuugagggcacuuuc

SEQ ID NO: 4306 - RNA, 24 nt, Homo sapiens
uucuccaaaagaaagcacuuucug

SEQ ID NO: 4307 - RNA, 22 nt, Homo sapiens
aagugccuccuuuuagaguguu

SEQ ID NO: 4308 - RNA, 23 nt, Homo sapiens
uauggcuuuuuauuccuauguga

SEQ ID NO: 4309 - RNA, 21 nt, Homo sapiens
uugugcuugaucuaaccaugu

SEQ ID NO: 4310 - RNA, 22 nt, Homo sapiens
agacuucccauuugaagguggc

SEQ ID NO: 4311 - RNA, 27 nt, Homo sapiens
accuucuuguauaagcacugugcuaaa

SEQ ID NO: 4312 - RNA, 22 nt, Homo sapiens
cuccugagccauucugagccuc

SEQ ID NO: 4313 - RNA, 21 nt, Homo sapiens
ccaccaccgugucugacacuu

SEQ ID NO: 4314 - RNA, 23 nt, Homo sapiens
ucccuguccuccaggagcucacg

SEQ ID NO: 4315 - RNA, 21 nt, Homo sapiens
ccgucgccgccacccgagccg

SEQ ID NO: 4316 - RNA, 22 nt, Homo sapiens
uggagugugacaaugguguuug

SEQ ID NO: 4317 - RNA, 20 nt, Homo sapiens
ccccagggcgacgcggcggg

SEQ ID NO: 4318 - RNA, 22 nt, Homo sapiens
cucccacugcuucacuugacua

SEQ ID NO: 4319 - RNA, 22 nt, Homo sapiens
agacccuggucugcacucuauc

SEQ ID NO: 4320 - RNA, 24 nt, Homo sapiens
uggggagcugaggcucugggggug

SEQ ID NO: 4321 - RNA, 17 nt, Homo sapiens
ucccuguucgggcgcca

SEQ ID NO: 4322 - RNA, 22 nt, Homo sapiens
uauacaagggcagacucucucu

SEQ ID NO: 4323 - RNA, 22 nt, Homo sapiens
uauacaagggcaagcucucugu

SEQ ID NO: 4324 - RNA, 22 nt, Homo sapiens
acuuguaugcuagcucagguag

SEQ ID NO: 4325 - RNA, 21 nt, Homo sapiens
gcccuccgcccgugcaccccg

SEQ ID NO: 4326 - RNA, 21 nt, Homo sapiens
gccccugggccuauccuagaa

SEQ ID NO: 4327 - RNA, 21 nt, Homo sapiens
agggggaaaguucuauagucc

SEQ ID NO: 4328 - RNA, 22 nt, Homo sapiens
cugcccuggcccgagggaccga

SEQ ID NO: 4329 - RNA, 22 nt, Homo sapiens
uagguaguuuccuguuguuggg

SEQ ID NO: 4330 - RNA, 22 nt, Homo sapiens
cgcaggggccgggugcucaccg

SEQ ID NO: 4331 - RNA, 23 nt, Homo sapiens
ucccccaggugugauucugauuu

SEQ ID NO: 4332 - RNA, 24 nt, Homo sapiens
acugggggcuuucgggcucugcgu

SEQ ID NO: 4333 - RNA, 24 nt, Homo sapiens
uucuccaaaagaaagcacuuucug

SEQ ID NO: 4334 - RNA, 22 nt, Homo sapiens
aagugccuccuuuuagaguguu

SEQ ID NO: 4335 - RNA, 22 nt, Homo sapiens
uacguagauauauauguauuuu

SEQ ID NO: 4336 - RNA, 22 nt, Homo sapiens
uuuucaacucuaaugggagaga

SEQ ID NO: 4337 - RNA, 21 nt, Homo sapiens
uaccacaggguagaaccacgg

SEQ ID NO: 4338 - RNA, 22 nt, Homo sapiens
uagcagcacaucaugguuuaca

SEQ ID NO: 4339 - RNA, 20 nt, Homo sapiens
uguuuugauaacaguaaugu

SEQ ID NO: 4340 - RNA, 22 nt, Homo sapiens
cagcagcaauucauguuuugaa

SEQ ID NO: 4341 - RNA, 22 nt, Homo sapiens
cagcagcaauucauguuuugaa

SEQ ID NO: 4342 - RNA, 21 nt, Homo sapiens
cagcagcacacugugguuugu

SEQ ID NO: 4343 - RNA, 21 nt, Homo sapiens
gaagugugccguggugugucu

SEQ ID NO: 4344 - RNA, 22 nt, Homo sapiens
cacacacugcaauuacuuuugc

SEQ ID NO: 4345 - RNA, 22 nt, Homo sapiens
ggagaaauuauccuuggugugu

SEQ ID NO: 4346 - RNA, 20 nt, Homo sapiens
ugagcccuguccucccgcag

SEQ ID NO: 4347 - RNA, 22 nt, Homo sapiens
ugagaacugaauuccauggguu

SEQ ID NO: 4348 - RNA, 21 nt, Homo sapiens
gcccuccgcccgugcaccccg

SEQ ID NO: 4349 - RNA, 22 nt, Homo sapiens
ucagugcacuacagaacuuugu

SEQ ID NO: 4350 - RNA, 22 nt, Homo sapiens
ucagugcaucacagaacuuugu

SEQ ID NO: 4351 - RNA, 23 nt, Homo sapiens
ucuggcuccgugucuucacuccc

SEQ ID NO: 4352 - RNA, 21 nt, Homo sapiens
ucagugcaugacagaacuugg

SEQ ID NO: 4353 - RNA, 22 nt, Homo sapiens
cucccacugcuucacuugacua

SEQ ID NO: 4354 - RNA, 22 nt, Homo sapiens
uguaaacauccuacacucagcu

SEQ ID NO: 4355 - RNA, 23 nt, Homo sapiens
ugaggggcagagagcgagacuuu

SEQ ID NO: 4356 - RNA, 22 nt, Homo sapiens
ccucccacacccaaggcuugca

SEQ ID NO: 4357 - RNA, 20 nt, Homo sapiens
guccgcucggcgguggccca

SEQ ID NO: 4358 - RNA, 21 nt, Homo sapiens
aagccugcccggcuccucggg

SEQ ID NO: 4359 - RNA, 25 nt, Homo sapiens
ggcggagggaaguagguccguuggu

SEQ ID NO: 4360 - RNA, 22 nt, Homo sapiens
ugcggggcuagggcuaacagca

SEQ ID NO: 4361 - RNA, 22 nt, Homo sapiens
ugagaaccacgucugcucugag

SEQ ID NO: 4362 - RNA, 21 nt, Homo sapiens
cggcggggacggcgauugguc

SEQ ID NO: 4363 - RNA, 22 nt, Homo sapiens
aggcggggcgccgcgggaccgc

SEQ ID NO: 4364 - RNA, 21 nt, Homo sapiens
aagccugcccggcuccucggg

SEQ ID NO: 4365 - RNA, 22 nt, Homo sapiens
agaaggaaauugaauucauuua

SEQ ID NO: 4366 - RNA, 22 nt, Homo sapiens
uucuggaauucugugugaggga

SEQ ID NO: 4367 - RNA, 22 nt, Homo sapiens
aagcccuuaccccaaaaagcau

SEQ ID NO: 4368 - RNA, 21 nt, Homo sapiens
acagucugcugagguuggagc

SEQ ID NO: 4369 - RNA, 23 nt, Homo sapiens
aaaagugcuuacagugcagguag

SEQ ID NO: 4370 - RNA, 22 nt, Homo sapiens
uccauuacacuacccugccucu

SEQ ID NO: 4371 - RNA, 22 nt, Homo sapiens
ucgugcaucccuuuagaguguu

SEQ ID NO: 4372 - RNA, 22 nt, Homo sapiens
ucagcaaacauuuauugugugc

SEQ ID NO: 4373 - RNA, 25 nt, Homo sapiens
gggcgacaaagcaagacucuuucuu

SEQ ID NO: 4374 - RNA, 21 nt, Homo sapiens
aguuaggauuaggucguggaa

SEQ ID NO: 4375 - RNA, 22 nt, Homo sapiens
uucaccaccuucuccacccagc

SEQ ID NO: 4376 - RNA, 22 nt, Homo sapiens
gcugacuccuaguccagggcuc

SEQ ID NO: 4377 - RNA, 22 nt, Homo sapiens
caaaacuggcaauuacuuuugc

SEQ ID NO: 4378 - RNA, 22 nt, Homo sapiens
aaaaacugagacuacuuuugca

SEQ ID NO: 4379 - RNA, 19 nt, Homo sapiens
aaaaacuguaauuacuuuu

SEQ ID NO: 4380 - RNA, 20 nt, Homo sapiens
guagaggagauggcgcaggg

SEQ ID NO: 4381 - RNA, 24 nt, Homo sapiens
aauccuuggaaccuaggugugagu

SEQ ID NO: 4382 - RNA, 23 nt, Homo sapiens
cuggagauauggaagagcugugu

SEQ ID NO: 4383 - RNA, 20 nt, Homo sapiens
auggagauagauauagaaau

SEQ ID NO: 4384 - RNA, 21 nt, Homo sapiens
uucaaguaauucaggauaggu

SEQ ID NO: 4385 - RNA, 22 nt, Homo sapiens
auaauacaugguuaaccucuuu

SEQ ID NO: 4386 - RNA, 21 nt, Homo sapiens
auauaugaugacuuagcuuuu

SEQ ID NO: 4387 - RNA, 22 nt, Homo sapiens
uccuguacugagcugccccgag

SEQ ID NO: 4388 - RNA, 21 nt, Homo sapiens
uacucaaaaagcugucaguca

SEQ ID NO: 4389 - RNA, 21 nt, Homo sapiens
aauaauacaugguugaucuuu

SEQ ID NO: 4390 - RNA, 23 nt, Homo sapiens
ugcaccaugguugucugagcaug

SEQ ID NO: 4391 - RNA, 21 nt, Homo sapiens
uaccacaggguagaaccacgg

SEQ ID NO: 4392 - RNA, 21 nt, Homo sapiens
uuuccauaggugaugagucac

SEQ ID NO: 4393 - RNA, 22 nt, Homo sapiens
uauacaagggcagacucucucu

SEQ ID NO: 4394 - RNA, 22 nt, Homo sapiens
uauacaagggcaagcucucugu

SEQ ID NO: 4395 - RNA, 22 nt, Homo sapiens
acuuguaugcuagcucagguag

SEQ ID NO: 4396 - RNA, 22 nt, Homo sapiens
cacuagauugugagcuccugga

SEQ ID NO: 4397 - RNA, 23 nt, Homo sapiens
cuaauaguaucuaccacaauaaa

SEQ ID NO: 4398 - RNA, 21 nt, Homo sapiens
gugucuuuugcucugcaguca

SEQ ID NO: 4399 - RNA, 22 nt, Homo sapiens
cugcccuggcccgagggaccga

SEQ ID NO: 4400 - RNA, 21 nt, Homo sapiens
uuaauaucggacaaccauugu

SEQ ID NO: 4401 - RNA, 22 nt, Homo sapiens
gaggguuggguggaggcucucc

SEQ ID NO: 4402 - RNA, 21 nt, Homo sapiens
uacaguacugugauaacugaa

SEQ ID NO: 4403 - RNA, 20 nt, Homo sapiens
ugagcccuguccucccgcag

SEQ ID NO: 4404 - RNA, 21 nt, Homo sapiens
ucuuguguucucuagaucagu

SEQ ID NO: 4405 - RNA, 22 nt, Homo sapiens
agaucagaaggugauuguggcu

SEQ ID NO: 4406 - RNA, 22 nt, Homo sapiens
uuaugguuugccugggacugag

SEQ ID NO: 4407 - RNA, 20 nt, Homo sapiens
agaccauggguucucauugu

SEQ ID NO: 4408 - RNA, 22 nt, Homo sapiens
uggagugugacaaugguguuug

SEQ ID NO: 4409 - RNA, 22 nt, Homo sapiens
aaacauucgcggugcacuucuu

SEQ ID NO: 4410 - RNA, 20 nt, Homo sapiens
accaggaggcugaggccccu

SEQ ID NO: 4411 - RNA, 20 nt, Homo sapiens
guguguggaaaugcuucugc

SEQ ID NO: 4412 - RNA, 22 nt, Homo sapiens
ucaccagcccuguguucccuag

SEQ ID NO: 4413 - RNA, 23 nt, Homo sapiens
agcugguguugugaaucaggccg

SEQ ID NO: 4414 - RNA, 19 nt, Homo sapiens
aagcagcugccucugaggc

SEQ ID NO: 4415 - RNA, 21 nt, Homo sapiens
uggacugcccugaucuggaga

SEQ ID NO: 4416 - RNA, 21 nt, Homo sapiens
caaagaggaaggucccauuac

SEQ ID NO: 4417 - RNA, 22 nt, Homo sapiens
cuccugagccauucugagccuc

SEQ ID NO: 4418 - RNA, 22 nt, Homo sapiens
uccuguacugagcugccccgag

SEQ ID NO: 4419 - RNA, 17 nt, Homo sapiens
gugggggagaggcuguc

SEQ ID NO: 4420 - RNA, 20 nt, Homo sapiens
cgugccacccuuuuccccag

SEQ ID NO: 4421 - RNA, 24 nt, Homo sapiens
uuuggcaaugguagaacucacacu

SEQ ID NO: 4422 - RNA, 22 nt, Homo sapiens
ugagaaccacgucugcucugag

SEQ ID NO: 4423 - RNA, 20 nt, Homo sapiens
ucugcaggguuugcuuugag

SEQ ID NO: 4424 - RNA, 22 nt, Homo sapiens
ugugacugguugaccagagggg

SEQ ID NO: 4425 - RNA, 22 nt, Homo sapiens
aaccagcaccccaacuuuggac

SEQ ID NO: 4426 - RNA, 21 nt, Homo sapiens
cuagacugaagcuccuugagg

SEQ ID NO: 4427 - RNA, 22 nt, Homo sapiens
uucacaaggaggugucauuuau

SEQ ID NO: 4428 - RNA, 22 nt, Homo sapiens
uaacacugucugguaaagaugg

SEQ ID NO: 4429 - RNA, 22 nt, Homo sapiens
uaacacugucugguaacgaugu

SEQ ID NO: 4430 - RNA, 21 nt, Homo sapiens
aucauagaggaaaauccacgu

SEQ ID NO: 4431 - RNA, 22 nt, Homo sapiens
aucauagaggaaaauccauguu

SEQ ID NO: 4432 - RNA, 20 nt, Homo sapiens
ccuccugcccuccuugcugu

SEQ ID NO: 4433 - RNA, 22 nt, Homo sapiens
uagcuuaucagacugauguuga

SEQ ID NO: 4434 - RNA, 22 nt, Homo sapiens
aggugguccguggcgcguucgc

SEQ ID NO: 4435 - RNA, 23 nt, Homo sapiens
ugaguaccgccaugucuguuggg

SEQ ID NO: 4436 - RNA, 22 nt, Homo sapiens
ugggucuuugcgggcgagauga

SEQ ID NO: 4437 - RNA, 23 nt, Homo sapiens
uagugcaauauugcuuauagggu

SEQ ID NO: 4438 - RNA, 22 nt, Homo sapiens
caaucacuaacuccacugccau

SEQ ID NO: 4439 - RNA, 22 nt, Homo sapiens
aaauuauuguacaucggaugag

SEQ ID NO: 4440 - RNA, 22 nt, Homo sapiens
ugcccuguggacucaguucugg

SEQ ID NO: 4441 - RNA, 22 nt, Homo sapiens
acacagggcuguugugaagacu

SEQ ID NO: 4442 - RNA, 22 nt, Homo sapiens
ggagaaauuauccuuggugugu

SEQ ID NO: 4443 - RNA, 26 nt, Homo sapiens
gaugaugauggcagcaaauucugaaa

SEQ ID NO: 4444 - RNA, 22 nt, Homo sapiens
aacccguagauccgaacuugug

SEQ ID NO: 4445 - RNA, 21 nt, Homo sapiens
uaaagugcugacagugcagau

SEQ ID NO: 4446 - RNA, 21 nt, Homo sapiens
ccccaccuccucucuccucag

SEQ ID NO: 4447 - RNA, 17 nt, Homo sapiens
ucgccuccuccucuccc

SEQ ID NO: 4448 - RNA, 23 nt, Homo sapiens
ucuggcuccgugucuucacuccc

SEQ ID NO: 4449 - RNA, 21 nt, Homo sapiens
cggcggggacggcgauugguc

SEQ ID NO: 4450 - RNA, 21 nt, Homo sapiens
cggcggggacggcgauugguc

SEQ ID NO: 4451 - RNA, 22 nt, Homo sapiens
cauugcacuugucucggucuga

SEQ ID NO: 4452 - RNA, 22 nt, Homo sapiens
uguaaacauccuacacucagcu

SEQ ID NO: 4453 - RNA, 21 nt, Homo sapiens
uugaaaggcuauuucuugguc

SEQ ID NO: 4454 - RNA, 22 nt, Homo sapiens
uucucaaggaggugucguuuau

SEQ ID NO: 4455 - RNA, 23 nt, Homo sapiens
ucggggaucaucaugucacgaga

SEQ ID NO: 4456 - RNA, 22 nt, Homo sapiens
ggggguccccggugcucggauc

SEQ ID NO: 4457 - RNA, 25 nt, Homo sapiens
ggcggagggaaguagguccguuggu

SEQ ID NO: 4458 - RNA, 22 nt, Homo sapiens
aggcggggcgccgcgggaccgc

SEQ ID NO: 4459 - RNA, 22 nt, Homo sapiens
aggcggggcgccgcgggaccgc

SEQ ID NO: 4460 - RNA, 22 nt, Homo sapiens
ugcggggcuagggcuaacagca

SEQ ID NO: 4461 - RNA, 22 nt, Homo sapiens
ugcggggcuagggcuaacagca

SEQ ID NO: 4462 - RNA, 20 nt, Homo sapiens
ggggagcuguggaagcagua

SEQ ID NO: 4463 - RNA, 22 nt, Homo sapiens
caaaguuuaagauccuugaagu

SEQ ID NO: 4464 - RNA, 22 nt, Homo sapiens
ccucuuccccuugucucuccag

SEQ ID NO: 4465 - RNA, 21 nt, Homo sapiens
aguuaggauuaggucguggaa

SEQ ID NO: 4466 - RNA, 22 nt, Homo sapiens
ugagaacugaauuccauggguu

SEQ ID NO: 4467 - RNA, 22 nt, Homo sapiens
ugagaacugaauuccauaggcu

SEQ ID NO: 4468 - RNA, 23 nt, Homo sapiens
ugugcaaaucuaugcaaaacuga

SEQ ID NO: 4469 - RNA, 23 nt, Homo sapiens
ugugcaaauccaugcaaaacuga

SEQ ID NO: 4470 - RNA, 21 nt, Homo sapiens
uuuugcaccuuuuggagugaa

SEQ ID NO: 4471 - RNA, 23 nt, Homo sapiens
guuugcacgggugggccuugucu

SEQ ID NO: 4472 - RNA, 23 nt, Homo sapiens
uaaaucccauggugccuucuccu

SEQ ID NO: 4473 - RNA, 24 nt, Homo sapiens
ugccugggucucuggccugcgcgu

SEQ ID NO: 4474 - RNA, 21 nt, Homo sapiens
ucccacguuguggcccagcag

SEQ ID NO: 4475 - RNA, 21 nt, Homo sapiens
uugugcuugaucuaaccaugu

SEQ ID NO: 4476 - RNA, 17 nt, Homo sapiens
gugggggagaggcuguc

SEQ ID NO: 4477 - RNA, 21 nt, Homo sapiens
guucaaauccagaucuauaac

SEQ ID NO: 4478 - RNA, 23 nt, Homo sapiens
uacccuguagauccgaauuugug

SEQ ID NO: 4479 - RNA, 23 nt, Homo sapiens
uacccuguagaaccgaauuugug

SEQ ID NO: 4480 - RNA, 22 nt, Homo sapiens
acacagggcuguugugaagacu

SEQ ID NO: 4481 - RNA, 22 nt, Homo sapiens
caaaaguaauuguggauuuugu

SEQ ID NO: 4482 - RNA, 21 nt, Homo sapiens
aauauuauacagucaaccucu

SEQ ID NO: 4483 - RNA, 22 nt, Homo sapiens
uagcaaaaacugcaguuacuuu

SEQ ID NO: 4484 - RNA, 21 nt, Homo sapiens
ugagcuaaaugugugcuggga

SEQ ID NO: 4485 - RNA, 22 nt, Homo sapiens
aacuguuugcagaggaaacuga

SEQ ID NO: 4486 - RNA, 21 nt, Homo sapiens
uagcagcacagaaauauuggc

SEQ ID NO: 4487 - RNA, 22 nt, Homo sapiens
uaacacugucugguaacgaugu

SEQ ID NO: 4488 - RNA, 22 nt, Homo sapiens
uaauacugccugguaaugauga

SEQ ID NO: 4489 - RNA, 23 nt, Homo sapiens
ugaguaccgccaugucuguuggg

SEQ ID NO: 4490 - RNA, 21 nt, Homo sapiens
cucccacaugcaggguuugca

SEQ ID NO: 4491 - RNA, 21 nt, Homo sapiens
uucaaguaauucaggauaggu

SEQ ID NO: 4492 - RNA, 22 nt, Homo sapiens
uagcaccaucugaaaucgguua

SEQ ID NO: 4493 - RNA, 23 nt, Homo sapiens
uagcaccauuugaaaucaguguu

SEQ ID NO: 4494 - RNA, 22 nt, Homo sapiens
uagcaccauuugaaaucgguua

SEQ ID NO: 4495 - RNA, 21 nt, Homo sapiens
auugacacuucugugaguaga

SEQ ID NO: 4496 - RNA, 18 nt, Homo sapiens
ugcuuccuuucagagggu

SEQ ID NO: 4497 - RNA, 22 nt, Homo sapiens
aucuggagguaagaagcacuuu

SEQ ID NO: 4498 - RNA, 22 nt, Homo sapiens
auucugcauuuuuagcaaguuc

SEQ ID NO: 4499 - RNA, 22 nt, Homo sapiens
ugagaaccacgucugcucugag

SEQ ID NO: 4500 - RNA, 20 nt, Homo sapiens
agaccauggguucucauugu

SEQ ID NO: 4501 - RNA, 22 nt, Homo sapiens
uugugucaauaugcgaugaugu

SEQ ID NO: 4502 - RNA, 23 nt, Homo sapiens
aucgcugcgguugcgagcgcugu

SEQ ID NO: 4503 - RNA, 17 nt, Homo sapiens
ucucgcuggggccucca

SEQ ID NO: 4504 - RNA, 20 nt, Homo sapiens
cggcucugggucugugggga

SEQ ID NO: 4505 - RNA, 22 nt, Homo sapiens
uuauaaagcaaugagacugauu

SEQ ID NO: 4506 - RNA, 22 nt, Homo sapiens
ugagguaguaguuugugcuguu

SEQ ID NO: 4507 - RNA, 18 nt, Homo sapiens
cagggaggugaaugugau

SEQ ID NO: 4508 - RNA, 23 nt, Homo sapiens
ucuggcuccgugucuucacuccc

SEQ ID NO: 4509 - RNA, 21 nt, Homo sapiens
cggcggggacggcgauugguc

SEQ ID NO: 4510 - RNA, 20 nt, Homo sapiens
ccucugggcccuuccuccag

SEQ ID NO: 4511 - RNA, 22 nt, Homo sapiens
ucucugggccugugucuuaggc

SEQ ID NO: 4512 - RNA, 21 nt, Homo sapiens
auccuugcuaucugggugcua

SEQ ID NO: 4513 - RNA, 22 nt, Homo sapiens
aggcggggcgccgcgggaccgc

SEQ ID NO: 4514 - RNA, 22 nt, Homo sapiens
ugcggggcuagggcuaacagca

SEQ ID NO: 4515 - RNA, 22 nt, Homo sapiens
ugugcgcagggagaccucuccc

SEQ ID NO: 4516 - RNA, 25 nt, Homo sapiens
cccccacaaccgcgcuugacuagcu

SEQ ID NO: 4517 - RNA, 23 nt, Homo sapiens
ugagugugugugugugagugugu

SEQ ID NO: 4518 - RNA, 21 nt, Homo sapiens
ccuguugaaguguaaucccca

SEQ ID NO: 4519 - RNA, 22 nt, Homo sapiens
uggagagaaaggcaguuccuga

SEQ ID NO: 4520 - RNA, 22 nt, Homo sapiens
uagcaccaucugaaaucgguua

SEQ ID NO: 4521 - RNA, 22 nt, Homo sapiens
uguaaacauccucgacuggaag

SEQ ID NO: 4522 - RNA, 22 nt, Homo sapiens
uguaaacauccccgacuggaag

SEQ ID NO: 4523 - RNA, 22 nt, Homo sapiens
uguaaacauccuugacuggaag

SEQ ID NO: 4524 - RNA, 23 nt, Homo sapiens
ugagcgccucgacgacagagccg

SEQ ID NO: 4525 - RNA, 23 nt, Homo sapiens
aucaacagacauuaauugggcgc

SEQ ID NO: 4526 - RNA, 22 nt, Homo sapiens
aucuggagguaagaagcacuuu

SEQ ID NO: 4527 - RNA, 21 nt, Homo sapiens
gaaggcgcuucccuuuggagu

SEQ ID NO: 4528 - RNA, 22 nt, Homo sapiens
gaaggcgcuucccuuuagagcg

SEQ ID NO: 4529 - RNA, 21 nt, Homo sapiens
guguugaaacaaucucuacug

SEQ ID NO: 4530 - RNA, 21 nt, Homo sapiens
uggaggagaaggaaggugaug

SEQ ID NO: 4531 - RNA, 27 nt, Homo sapiens
cacuguaggugauggugagagugggca

SEQ ID NO: 4532 - RNA, 23 nt, Homo sapiens
uauggcuuuucauuccuauguga

SEQ ID NO: 4533 - RNA, 22 nt, Homo sapiens
ucuacagugcacgugucuccag

SEQ ID NO: 4534 - RNA, 22 nt, Homo sapiens
uggagagaaaggcaguuccuga

SEQ ID NO: 4535 - RNA, 19 nt, Homo sapiens
ugagcugcuguaccaaaau

SEQ ID NO: 4536 - RNA, 22 nt, Homo sapiens
ugagaaccacgucugcucugag

SEQ ID NO: 4537 - RNA, 25 nt, Homo sapiens
aggggugguguugggacagcuccgu

SEQ ID NO: 4538 - RNA, 22 nt, Homo sapiens
ugcggggcuagggcuaacagca

SEQ ID NO: 4539 - RNA, 20 nt, Homo sapiens
cggcucugggucugugggga

SEQ ID NO: 4540 - RNA, 23 nt, Homo sapiens
cgggucggaguuagcucaagcgg

SEQ ID NO: 4541 - RNA, 20 nt, Homo sapiens
ggggagcuguggaagcagua

SEQ ID NO: 4542 - RNA, 23 nt, Homo sapiens
caaagugcuuacagugcagguag

SEQ ID NO: 4543 - RNA, 21 nt, Homo sapiens
ccaccaccgugucugacacuu

SEQ ID NO: 4544 - RNA, 22 nt, Homo sapiens
uacugcagacguggcaaucaug

SEQ ID NO: 4545 - RNA, 21 nt, Homo sapiens
uacugcagacaguggcaauca

SEQ ID NO: 4546 - RNA, 18 nt, Homo sapiens
cgggcguggugguggggg

SEQ ID NO: 4547 - RNA, 21 nt, Homo sapiens
ugcaggaccaagaugagcccu

SEQ ID NO: 4548 - RNA, 21 nt, Homo sapiens
uggacugcccugaucuggaga

SEQ ID NO: 4549 - RNA, 23 nt, Homo sapiens
uggaguccaggaaucugcauuuu

SEQ ID NO: 4550 - RNA, 25 nt, Homo sapiens
ugggaacggguuccggcagacgcug

SEQ ID NO: 4551 - RNA, 21 nt, Homo sapiens
uccugcgcgucccagaugccc

SEQ ID NO: 4552 - RNA, 21 nt, Homo sapiens
ccaguccugugccugccgccu

SEQ ID NO: 4553 - RNA, 22 nt, Homo sapiens
ucugcccccuccgcugcugcca

SEQ ID NO: 4554 - RNA, 22 nt, Homo sapiens
uuggggaaacggccgcugagug

SEQ ID NO: 4555 - RNA, 20 nt, Homo sapiens
ccucugggcccuuccuccag

SEQ ID NO: 4556 - RNA, 22 nt, Homo sapiens
ucucugggccugugucuuaggc

SEQ ID NO: 4557 - RNA, 22 nt, Homo sapiens
caaucacuaacuccacugccau

SEQ ID NO: 4558 - RNA, 21 nt, Homo sapiens
cggggcagcucaguacaggau

SEQ ID NO: 4559 - RNA, 23 nt, Homo sapiens
ugagugugugugugugagugugu

SEQ ID NO: 4560 - RNA, 23 nt, Homo sapiens
gcgaggaccccucggggucugac

SEQ ID NO: 4561 - RNA, 24 nt, Homo sapiens
gaccuggacauguuugugcccagu

SEQ ID NO: 4562 - RNA, 19 nt, Homo sapiens
aagugugcagggcacuggu

SEQ ID NO: 4563 - RNA, 22 nt, Homo sapiens
ugugcgcagggagaccucuccc

SEQ ID NO: 4564 - RNA, 22 nt, Homo sapiens
caaaguuuaagauccuugaagu

SEQ ID NO: 4565 - RNA, 22 nt, Homo sapiens
aacuggccuacaaagucccagu

SEQ ID NO: 4566 - RNA, 22 nt, Homo sapiens
aacuggcccucaaagucccgcu

SEQ ID NO: 4567 - RNA, 25 nt, Homo sapiens
ggcggagggaaguagguccguuggu

SEQ ID NO: 4568 - RNA, 24 nt, Homo sapiens
uggggagcugaggcucugggggug

SEQ ID NO: 4569 - RNA, 23 nt, Homo sapiens
ucauagcccuguacaaugcugcu

SEQ ID NO: 4570 - RNA, 21 nt, Homo sapiens
gugccagcugcagugggggag

SEQ ID NO: 4571 - RNA, 21 nt, Homo sapiens
uggcagggaggcugggagggg

SEQ ID NO: 4572 - RNA, 21 nt, Homo sapiens
ccccaccuccucucuccucag

SEQ ID NO: 4573 - RNA, 18 nt, Homo sapiens
cgggcguggugguggggg

SEQ ID NO: 4574 - RNA, 23 nt, Homo sapiens
agcuacauugucugcuggguuuc

SEQ ID NO: 4575 - RNA, 21 nt, Homo sapiens
gaaggcgcuucccuuuggagu

SEQ ID NO: 4576 - RNA, 22 nt, Homo sapiens
gaaggcgcuucccuuuagagcg

SEQ ID NO: 4577 - RNA, 22 nt, Homo sapiens
uggugggcacagaaucuggacu

SEQ ID NO: 4578 - RNA, 19 nt, Homo sapiens
gggcgccugugaucccaac

SEQ ID NO: 4579 - RNA, 19 nt, Homo sapiens
gggcgccugugaucccaac

SEQ ID NO: 4580 - RNA, 25 nt, Homo sapiens
aggggugguguugggacagcuccgu

SEQ ID NO: 4581 - RNA, 21 nt, Homo sapiens
agaccuggcccagaccucagc

SEQ ID NO: 4582 - RNA, 22 nt, Homo sapiens
uggugggccgcagaacaugugc

SEQ ID NO: 4583 - RNA, 20 nt, Homo sapiens
ggggagcuguggaagcagua

SEQ ID NO: 4584 - RNA, 17 nt, Homo sapiens
ucccaccgcugccaccc

SEQ ID NO: 4585 - RNA, 21 nt, Homo sapiens
gcccuccgcccgugcaccccg

SEQ ID NO: 4586 - RNA, 23 nt, Homo sapiens
ucuggcuccgugucuucacuccc

SEQ ID NO: 4587 - RNA, 23 nt, Homo sapiens
ucuggcuccgugucuucacuccc

SEQ ID NO: 4588 - RNA, 23 nt, Homo sapiens
cggcccgggcugcugcuguuccu

SEQ ID NO: 4589 - RNA, 21 nt, Homo sapiens
cggcggggacggcgauugguc

SEQ ID NO: 4590 - RNA, 22 nt, Homo sapiens
cauugcacuugucucggucuga

SEQ ID NO: 4591 - RNA, 22 nt, Homo sapiens
cgucaacacuugcugguuuccu

SEQ ID NO: 4592 - RNA, 25 nt, Homo sapiens
aggggugguguugggacagcuccgu

SEQ ID NO: 4593 - RNA, 25 nt, Homo sapiens
ggcggagggaaguagguccguuggu

SEQ ID NO: 4594 - RNA, 22 nt, Homo sapiens
aggcggggcgccgcgggaccgc

SEQ ID NO: 4595 - RNA, 20 nt, Homo sapiens
ggggagcuguggaagcagua

SEQ ID NO: 4596 - RNA, 24 nt, Homo sapiens
uggggagcugaggcucugggggug

SEQ ID NO: 4597 - RNA, 22 nt, Homo sapiens
gucccucuccaaaugugucuug

SEQ ID NO: 4598 - RNA, 22 nt, Homo sapiens
uggagugugacaaugguguuug

SEQ ID NO: 4599 - RNA, 23 nt, Homo sapiens
cacucagccuugagggcacuuuc

SEQ ID NO: 4600 - RNA, 20 nt, Homo sapiens
accaggaggcugaggccccu

SEQ ID NO: 4601 - RNA, 22 nt, Homo sapiens
caaagugccucccuuuagagug

SEQ ID NO: 4602 - RNA, 24 nt, Homo sapiens
uggggagcugaggcucugggggug

SEQ ID NO: 4603 - RNA, 22 nt, Homo sapiens
ucugcccccuccgcugcugcca

SEQ ID NO: 4604 - RNA, 22 nt, Homo sapiens
cauugcacuugucucggucuga

SEQ ID NO: 4605 - RNA, 20 nt, Homo sapiens
acugccccaggugcugcugg

SEQ ID NO: 4606 - RNA, 21 nt, Homo sapiens
cggggcagcucaguacaggau

SEQ ID NO: 4607 - RNA, 22 nt, Homo sapiens
uucuggaauucugugugaggga

SEQ ID NO: 4608 - RNA, 22 nt, Homo sapiens
aagcccuuaccccaaaaagcau

SEQ ID NO: 4609 - RNA, 23 nt, Homo sapiens
acuccauuuguuuugaugaugga

SEQ ID NO: 4610 - RNA, 22 nt, Homo sapiens
ucucccaacccuuguaccagug

SEQ ID NO: 4611 - RNA, 22 nt, Homo sapiens
ugauauguuugauauauuaggu

SEQ ID NO: 4612 - RNA, 23 nt, Homo sapiens
caacggaaucccaaaagcagcug

SEQ ID NO: 4613 - RNA, 22 nt, Homo sapiens
uuggggaaacggccgcugagug

SEQ ID NO: 4614 - RNA, 23 nt, Homo sapiens
agcuacauugucugcuggguuuc

SEQ ID NO: 4615 - RNA, 20 nt, Homo sapiens
ccucugggcccuuccuccag

SEQ ID NO: 4616 - RNA, 22 nt, Homo sapiens
ucucugggccugugucuuaggc

SEQ ID NO: 4617 - RNA, 20 nt, Homo sapiens
gugcauugcuguugcauugc

SEQ ID NO: 4618 - RNA, 23 nt, Homo sapiens
ucucacacagaaaucgcacccgu

SEQ ID NO: 4619 - RNA, 23 nt, Homo sapiens
ucccccaggugugauucugauuu

SEQ ID NO: 4620 - RNA, 22 nt, Homo sapiens
aucacacaaaggcaacuuuugu

SEQ ID NO: 4621 - RNA, 22 nt, Homo sapiens
agaggcuggccgugaugaauuc

SEQ ID NO: 4622 - RNA, 22 nt, Homo sapiens
aguggggaacccuuccaugagg

SEQ ID NO: 4623 - RNA, 22 nt, Homo sapiens
gagugccuucuuuuggagcguu

SEQ ID NO: 4624 - RNA, 22 nt, Homo sapiens
aagugccuccuuuuagaguguu

SEQ ID NO: 4625 - RNA, 23 nt, Homo sapiens
agugccugagggaguaagagccc

SEQ ID NO: 4626 - RNA, 25 nt, Homo sapiens
aggggugguguugggacagcuccgu

SEQ ID NO: 4627 - RNA, 21 nt, Homo sapiens
acagucugcugagguuggagc

SEQ ID NO: 4628 - RNA, 24 nt, Homo sapiens
acugggggcuuucgggcucugcgu

SEQ ID NO: 4629 - RNA, 20 nt, Homo sapiens
ggggagcuguggaagcagua

SEQ ID NO: 4630 - RNA, 21 nt, Homo sapiens
gugccagcugcagugggggag

SEQ ID NO: 4631 - RNA, 22 nt, Homo sapiens
ucagugcaucacagaacuuugu

SEQ ID NO: 4632 - RNA, 22 nt, Homo sapiens
uggagagaaaggcaguuccuga

SEQ ID NO: 4633 - RNA, 22 nt, Homo sapiens
aaaucucugcaggcaaauguga

SEQ ID NO: 4634 - RNA, 22 nt, Homo sapiens
aacaauauccuggugcugagug

SEQ ID NO: 4635 - RNA, 22 nt, Homo sapiens
aauugcacgguauccaucugua

SEQ ID NO: 4636 - RNA, 22 nt, Homo sapiens
aucaugaugggcuccucggugu

SEQ ID NO: 4637 - RNA, 22 nt, Homo sapiens
uaugugccuuuggacuacaucg

SEQ ID NO: 4638 - RNA, 22 nt, Homo sapiens
cgaaaacagcaauuaccuuugc

SEQ ID NO: 4639 - RNA, 25 nt, Homo sapiens
aggggugguguugggacagcuccgu

SEQ ID NO: 4640 - RNA, 24 nt, Homo sapiens
ugccugggucucuggccugcgcgu

SEQ ID NO: 4641 - RNA, 23 nt, Homo sapiens
aaggagcuuacaaucuagcuggg

SEQ ID NO: 4642 - RNA, 21 nt, Homo sapiens
uggaggagaaggaaggugaug

SEQ ID NO: 4643 - RNA, 24 nt, Homo sapiens
agcagaagcagggagguucuccca

SEQ ID NO: 4644 - RNA, 22 nt, Homo sapiens
uggagugugacaaugguguuug

SEQ ID NO: 4645 - RNA, 21 nt, Homo sapiens
acucuagcugccaaaggcgcu

SEQ ID NO: 4646 - RNA, 24 nt, Homo sapiens
agccuggaagcuggagccugcagu

SEQ ID NO: 4647 - RNA, 22 nt, Homo sapiens
acucggcguggcgucggucgug

SEQ ID NO: 4648 - RNA, 23 nt, Homo sapiens
cggcccgggcugcugcuguuccu

SEQ ID NO: 4649 - RNA, 23 nt, Homo sapiens
cggcccgggcugcugcuguuccu

SEQ ID NO: 4650 - RNA, 21 nt, Homo sapiens
cggcggggacggcgauugguc

SEQ ID NO: 4651 - RNA, 21 nt, Homo sapiens
cggcggggacggcgauugguc

SEQ ID NO: 4652 - RNA, 24 nt, Homo sapiens
acugggggcuuucgggcucugcgu

SEQ ID NO: 4653 - RNA, 22 nt, Homo sapiens
aggcggggcgccgcgggaccgc

SEQ ID NO: 4654 - RNA, 22 nt, Homo sapiens
aggcggggcgccgcgggaccgc

SEQ ID NO: 4655 - RNA, 22 nt, Homo sapiens
ugcggggcuagggcuaacagca

SEQ ID NO: 4656 - RNA, 22 nt, Homo sapiens
ugcggggcuagggcuaacagca

SEQ ID NO: 4657 - RNA, 23 nt, Homo sapiens
ccugcagcgacuugauggcuucc

SEQ ID NO: 4658 - RNA, 23 nt, Homo sapiens
ccugcagcgacuugauggcuucc

SEQ ID NO: 4659 - RNA, 22 nt, Homo sapiens
ugagccccugugccgcccccag

SEQ ID NO: 4660 - RNA, 22 nt, Homo sapiens
acccgucccguucguccccgga

SEQ ID NO: 4661 - RNA, 23 nt, Homo sapiens
ucuggcuccgugucuucacuccc

SEQ ID NO: 4662 - RNA, 22 nt, Homo sapiens
uggacggagaacugauaagggu

SEQ ID NO: 4663 - RNA, 22 nt, Homo sapiens
ucugcccccuccgcugcugcca

SEQ ID NO: 4664 - RNA, 20 nt, Homo sapiens
acugccccaggugcugcugg

SEQ ID NO: 4665 - RNA, 23 nt, Homo sapiens
ugaggggcagagagcgagacuuu

SEQ ID NO: 4666 - RNA, 21 nt, Homo sapiens
cggggcagcucaguacaggau

SEQ ID NO: 4667 - RNA, 21 nt, Homo sapiens
aauggcgccacuaggguugug

SEQ ID NO: 4668 - RNA, 21 nt, Homo sapiens
uggaggagaaggaaggugaug

SEQ ID NO: 4669 - RNA, 22 nt, Homo sapiens
aggcagcgggguguaguggaua

SEQ ID NO: 4670 - RNA, 22 nt, Homo sapiens
uauugcacucgucccggccucc

SEQ ID NO: 4671 - RNA, 22 nt, Homo sapiens
ugagccccugugccgcccccag

SEQ ID NO: 4672 - RNA, 22 nt, Homo sapiens
aggcaguguauuguuagcuggc

SEQ ID NO: 4673 - RNA, 21 nt, Homo sapiens
aggguaagcugaaccucugau

SEQ ID NO: 4674 - RNA, 22 nt, Homo sapiens
uucuggaauucugugugaggga

SEQ ID NO: 4675 - RNA, 21 nt, Homo sapiens
aggcaagaugcuggcauagcu

SEQ ID NO: 4676 - RNA, 21 nt, Homo sapiens
gcaggaacuugugagucuccu

SEQ ID NO: 4677 - RNA, 23 nt, Homo sapiens
acuucaccugguccacuagccgu

SEQ ID NO: 4678 - RNA, 23 nt, Homo sapiens
uauggcuuuuuauuccuauguga

SEQ ID NO: 4679 - RNA, 23 nt, Homo sapiens
uauggcuuuucauuccuauguga

SEQ ID NO: 4680 - RNA, 21 nt, Homo sapiens
gugccagcugcagugggggag

SEQ ID NO: 4681 - RNA, 20 nt, Homo sapiens
ucacaccugccucgcccccc

SEQ ID NO: 4682 - RNA, 18 nt, Homo sapiens
uccagugcccuccucucc

SEQ ID NO: 4683 - RNA, 21 nt, Homo sapiens
cggcggggacggcgauugguc

SEQ ID NO: 4684 - RNA, 20 nt, Homo sapiens
ccccagggcgacgcggcggg

SEQ ID NO: 4685 - RNA, 22 nt, Homo sapiens
cauugcacuugucucggucuga

SEQ ID NO: 4686 - RNA, 21 nt, Homo sapiens
aggggugcuaucugugauuga

SEQ ID NO: 4687 - RNA, 21 nt, Homo sapiens
gaaggcgcuucccuuuggagu

SEQ ID NO: 4688 - RNA, 22 nt, Homo sapiens
gaaggcgcuucccuuuagagcg

SEQ ID NO: 4689 - RNA, 19 nt, Homo sapiens
gggcgccugugaucccaac

SEQ ID NO: 4690 - RNA, 19 nt, Homo sapiens
aguguggcuuucuuagagc

SEQ ID NO: 4691 - RNA, 22 nt, Homo sapiens
aggcggggcgccgcgggaccgc

SEQ ID NO: 4692 - RNA, 23 nt, Homo sapiens
uggugcggagagggcccacagug

SEQ ID NO: 4693 - RNA, 21 nt, Homo sapiens
uggaggagaaggaaggugaug

SEQ ID NO: 4694 - RNA, 20 nt, Homo sapiens
ggggagcuguggaagcagua

SEQ ID NO: 4695 - RNA, 22 nt, Homo sapiens
uggagugugacaaugguguuug

SEQ ID NO: 4696 - RNA, 22 nt, Homo sapiens
uuugguccccuucaaccagcug

SEQ ID NO: 4697 - RNA, 22 nt, Homo sapiens
uuugguccccuucaaccagcua

SEQ ID NO: 4698 - RNA, 21 nt, Homo sapiens
uugaaaggcuauuucuugguc

SEQ ID NO: 4699 - RNA, 19 nt, Homo sapiens
aggcugcggaauucaggac

SEQ ID NO: 4700 - RNA, 21 nt, Homo sapiens
uguucauguagauguuuaagc

SEQ ID NO: 4701 - RNA, 22 nt, Homo sapiens
uuugaggcuacagugagaugug

SEQ ID NO: 4702 - RNA, 22 nt, Homo sapiens
uagcagcacauaaugguuugug

SEQ ID NO: 4703 - RNA, 22 nt, Homo sapiens
uagcagcacaucaugguuuaca

SEQ ID NO: 4704 - RNA, 22 nt, Homo sapiens
uagcagcacguaaauauuggcg

SEQ ID NO: 4705 - RNA, 21 nt, Homo sapiens
uagcagcacagaaauauuggc

SEQ ID NO: 4706 - RNA, 17 nt, Homo sapiens
uaauugcuuccauguuu

SEQ ID NO: 4707 - RNA, 22 nt, Homo sapiens
cagcagcaauucauguuuugaa

SEQ ID NO: 4708 - RNA, 21 nt, Homo sapiens
cagcagcacacugugguuugu

SEQ ID NO: 4709 - RNA, 20 nt, Homo sapiens
agaccauggguucucauugu

SEQ ID NO: 4710 - RNA, 22 nt, Homo sapiens
uggagugugacaaugguguuug

SEQ ID NO: 4711 - RNA, 22 nt, Homo sapiens
auccgcgcucugacucucugcc

SEQ ID NO: 4712 - RNA, 22 nt, Homo sapiens
ccucuuccccuugucucuccag

SEQ ID NO: 4713 - RNA, 24 nt, Homo sapiens
ucccugagacccuuuaaccuguga

SEQ ID NO: 4714 - RNA, 22 nt, Homo sapiens
ucccugagacccuaacuuguga

SEQ ID NO: 4715 - RNA, 23 nt, Homo sapiens
ccucagggcuguagaacagggcu

SEQ ID NO: 4716 - RNA, 22 nt, Homo sapiens
uagcagcacauaaugguuugug

SEQ ID NO: 4717 - RNA, 22 nt, Homo sapiens
uagcagcacaucaugguuuaca

SEQ ID NO: 4718 - RNA, 22 nt, Homo sapiens
uagcagcacguaaauauuggcg

SEQ ID NO: 4719 - RNA, 21 nt, Homo sapiens
uagcagcacagaaauauuggc

SEQ ID NO: 4720 - RNA, 22 nt, Homo sapiens
gaggguuggguggaggcucucc

SEQ ID NO: 4721 - RNA, 20 nt, Homo sapiens
ccucugggcccuuccuccag

SEQ ID NO: 4722 - RNA, 22 nt, Homo sapiens
ucucugggccugugucuuaggc

SEQ ID NO: 4723 - RNA, 22 nt, Homo sapiens
aauugcacuuuagcaaugguga

SEQ ID NO: 4724 - RNA, 22 nt, Homo sapiens
cagcagcaauucauguuuugaa

SEQ ID NO: 4725 - RNA, 21 nt, Homo sapiens
cagcagcacacugugguuugu

SEQ ID NO: 4726 - RNA, 23 nt, Homo sapiens
uagcagcgggaacaguucugcag

SEQ ID NO: 4727 - RNA, 22 nt, Homo sapiens
uacucaggagaguggcaaucac

SEQ ID NO: 4728 - RNA, 22 nt, Homo sapiens
uucucaaggaggugucguuuau

SEQ ID NO: 4729 - RNA, 23 nt, Homo sapiens
aucgcugcgguugcgagcgcugu

SEQ ID NO: 4730 - RNA, 20 nt, Homo sapiens
ggggagcuguggaagcagua

SEQ ID NO: 4731 - RNA, 22 nt, Homo sapiens
caaagugccucccuuuagagug

SEQ ID NO: 4732 - RNA, 20 nt, Homo sapiens
aaaguagcuguaccauuugc

SEQ ID NO: 4733 - RNA, 21 nt, Homo sapiens
cccggagccaggaugcagcuc

SEQ ID NO: 4734 - RNA, 21 nt, Homo sapiens
cccggagccaggaugcagcuc

SEQ ID NO: 4735 - RNA, 17 nt, Homo sapiens
ucgccuccuccucuccc

SEQ ID NO: 4736 - RNA, 18 nt, Homo sapiens
cagggaggugaaugugau

SEQ ID NO: 4737 - RNA, 21 nt, Homo sapiens
gcccuccgcccgugcaccccg

SEQ ID NO: 4738 - RNA, 23 nt, Homo sapiens
ucuggcuccgugucuucacuccc

SEQ ID NO: 4739 - RNA, 19 nt, Homo sapiens
gggcgccugugaucccaac

SEQ ID NO: 4740 - RNA, 19 nt, Homo sapiens
aggcugcggaauucaggac

SEQ ID NO: 4741 - RNA, 22 nt, Homo sapiens
gucccucuccaaaugugucuug

SEQ ID NO: 4742 - RNA, 23 nt, Homo sapiens
ugucacucggcucggcccacuac

SEQ ID NO: 4743 - RNA, 22 nt, Homo sapiens
acuccagccccacagccucagc

SEQ ID NO: 4744 - RNA, 22 nt, Homo sapiens
cucggcgcggggcgcgggcucc

SEQ ID NO: 4745 - RNA, 22 nt, Homo sapiens
gcccgcguguggagccaggugu

SEQ ID NO: 4746 - RNA, 23 nt, Homo sapiens
ucuggcuccgugucuucacuccc

SEQ ID NO: 4747 - RNA, 23 nt, Homo sapiens
cggcccgggcugcugcuguuccu

SEQ ID NO: 4748 - RNA, 23 nt, Homo sapiens
cggcccgggcugcugcuguuccu

SEQ ID NO: 4749 - RNA, 22 nt, Homo sapiens
uguaaacauccuacacucagcu

SEQ ID NO: 4750 - RNA, 23 nt, Homo sapiens
ucuuggaguaggucauugggugg

SEQ ID NO: 4751 - RNA, 21 nt, Homo sapiens
uggcagggaggcugggagggg

SEQ ID NO: 4752 - RNA, 18 nt, Homo sapiens
aucccaccucugccacca

SEQ ID NO: 4753 - RNA, 22 nt, Homo sapiens
uguaaacauccuacacucagcu

SEQ ID NO: 4754 - RNA, 22 nt, Homo sapiens
ccucccacacccaaggcuugca

SEQ ID NO: 4755 - RNA, 21 nt, Homo sapiens
cccggagccaggaugcagcuc

SEQ ID NO: 4756 - RNA, 22 nt, Homo sapiens
ugugagguuggcauuguugucu

SEQ ID NO: 4757 - RNA, 22 nt, Homo sapiens
ugugacugguugaccagagggg

SEQ ID NO: 4758 - RNA, 19 nt, Homo sapiens
aggcugcggaauucaggac

SEQ ID NO: 4759 - RNA, 21 nt, Homo sapiens
guggcugcacucacuuccuuc

SEQ ID NO: 4760 - RNA, 21 nt, Homo sapiens
cggcggggacggcgauugguc

SEQ ID NO: 4761 - RNA, 23 nt, Homo sapiens
ugaggggcagagagcgagacuuu

SEQ ID NO: 4762 - RNA, 19 nt, Homo sapiens
aggcugcggaauucaggac

SEQ ID NO: 4763 - RNA, 22 nt, Homo sapiens
aggcggggcgccgcgggaccgc

SEQ ID NO: 4764 - RNA, 22 nt, Homo sapiens
ugcggggcuagggcuaacagca

SEQ ID NO: 4765 - RNA, 21 nt, Homo sapiens
cccggagccaggaugcagcuc

SEQ ID NO: 4766 - RNA, 21 nt, Homo sapiens
uccugcgcgucccagaugccc

SEQ ID NO: 4767 - RNA, 22 nt, Homo sapiens
uccgagccugggucucccucuu

SEQ ID NO: 4768 - RNA, 22 nt, Homo sapiens
aggcagcgggguguaguggaua

SEQ ID NO: 4769 - RNA, 21 nt, Homo sapiens
cagcagcacacugugguuugu

SEQ ID NO: 4770 - RNA, 22 nt, Homo sapiens
caaagugccucccuuuagagug

SEQ ID NO: 4771 - RNA, 22 nt, Homo sapiens
uggagugugacaaugguguuug

SEQ ID NO: 4772 - RNA, 22 nt, Homo sapiens
ccucuuccccuugucucuccag

SEQ ID NO: 4773 - RNA, 22 nt, Homo sapiens
uaacacugucugguaaagaugg

SEQ ID NO: 4774 - RNA, 22 nt, Homo sapiens
aacuggccuacaaagucccagu

SEQ ID NO: 4775 - RNA, 22 nt, Homo sapiens
aacuggcccucaaagucccgcu

SEQ ID NO: 4776 - RNA, 22 nt, Homo sapiens
cauugcacuugucucggucuga

SEQ ID NO: 4777 - RNA, 23 nt, Homo sapiens
aaugacacgaucacucccguuga

SEQ ID NO: 4778 - RNA, 22 nt, Homo sapiens
uugggaucauuuugcauccaua

SEQ ID NO: 4779 - RNA, 22 nt, Homo sapiens
gucccucuccaaaugugucuug

SEQ ID NO: 4780 - RNA, 23 nt, Homo sapiens
cugggaucuccggggucuugguu

SEQ ID NO: 4781 - RNA, 22 nt, Homo sapiens
uuuagagacggggucuugcucu

SEQ ID NO: 4782 - RNA, 22 nt, Homo sapiens
ugcccuuaaaggugaacccagu

SEQ ID NO: 4783 - RNA, 20 nt, Homo sapiens
ggggagcuguggaagcagua

SEQ ID NO: 4784 - RNA, 23 nt, Homo sapiens
gcagcagagaauaggacuacguc

SEQ ID NO: 4785 - RNA, 25 nt, Homo sapiens
aggggugguguugggacagcuccgu

SEQ ID NO: 4786 - RNA, 21 nt, Homo sapiens
gugccagcugcagugggggag

SEQ ID NO: 4787 - RNA, 18 nt, Homo sapiens
ucagcuggcccucauuuc

SEQ ID NO: 4788 - RNA, 22 nt, Homo sapiens
ugagccccugugccgcccccag

SEQ ID NO: 4789 - RNA, 18 nt, Homo sapiens
aucccaccucugccacca

SEQ ID NO: 4790 - RNA, 17 nt, Homo sapiens
ucccaccgcugccaccc

SEQ ID NO: 4791 - RNA, 23 nt, Homo sapiens
ucuggcuccgugucuucacuccc

SEQ ID NO: 4792 - RNA, 22 nt, Homo sapiens
uggagagaaaggcaguuccuga

SEQ ID NO: 4793 - RNA, 21 nt, Homo sapiens
uaaagugcugacagugcagau

SEQ ID NO: 4794 - RNA, 23 nt, Homo sapiens
cagugcaaugauauugucaaagc

SEQ ID NO: 4795 - RNA, 22 nt, Homo sapiens
ccucccacacccaaggcuugca

SEQ ID NO: 4796 - RNA, 20 nt, Homo sapiens
cggcucugggucugugggga

SEQ ID NO: 4797 - RNA, 20 nt, Homo sapiens
ggggagcuguggaagcagua

SEQ ID NO: 4798 - RNA, 21 nt, Homo sapiens
uacucaaaaagcugucaguca

SEQ ID NO: 4799 - RNA, 23 nt, Homo sapiens
gcagcagagaauaggacuacguc

SEQ ID NO: 4800 - RNA, 23 nt, Homo sapiens
ugaguaccgccaugucuguuggg

SEQ ID NO: 4801 - RNA, 27 nt, Homo sapiens
accuucuuguauaagcacugugcuaaa

SEQ ID NO: 4802 - RNA, 24 nt, Homo sapiens
agccuggaagcuggagccugcagu

SEQ ID NO: 4803 - RNA, 23 nt, Homo sapiens
acuccauuuguuuugaugaugga

SEQ ID NO: 4804 - RNA, 21 nt, Homo sapiens
gcccuccgcccgugcaccccg

SEQ ID NO: 4805 - RNA, 23 nt, Homo sapiens
ucuggcuccgugucuucacuccc

SEQ ID NO: 4806 - RNA, 22 nt, Homo sapiens
ucaggccaggcacaguggcuca

SEQ ID NO: 4807 - RNA, 21 nt, Homo sapiens
cacauuacacggucgaccucu

SEQ ID NO: 4808 - RNA, 22 nt, Homo sapiens
cuggcccucucugcccuuccgu

SEQ ID NO: 4809 - RNA, 22 nt, Homo sapiens
uauguaauaugguccacaucuu

SEQ ID NO: 4810 - RNA, 24 nt, Homo sapiens
uggcccugacugaagaccagcagu

SEQ ID NO: 4811 - RNA, 22 nt, Homo sapiens
cuggcccucucugcccuuccgu

SEQ ID NO: 4812 - RNA, 20 nt, Homo sapiens
gugcauugcuguugcauugc

SEQ ID NO: 4813 - RNA, 22 nt, Homo sapiens
gagugccuucuuuuggagcguu

SEQ ID NO: 4814 - RNA, 22 nt, Homo sapiens
aagugccuccuuuuagaguguu

SEQ ID NO: 4815 - RNA, 21 nt, Homo sapiens
ugcaggaccaagaugagcccu

SEQ ID NO: 4816 - RNA, 18 nt, Homo sapiens
cagggaggugaaugugau

SEQ ID NO: 4817 - RNA, 22 nt, Homo sapiens
aguggggaacccuuccaugagg

SEQ ID NO: 4818 - RNA, 25 nt, Homo sapiens
aggggugguguugggacagcuccgu

SEQ ID NO: 4819 - RNA, 24 nt, Homo sapiens
ugccugggucucuggccugcgcgu

SEQ ID NO: 4820 - RNA, 21 nt, Homo sapiens
uggaggagaaggaaggugaug

SEQ ID NO: 4821 - RNA, 20 nt, Homo sapiens
ggggagcuguggaagcagua

SEQ ID NO: 4822 - RNA, 22 nt, Homo sapiens
aacccguagauccgaucuugug

SEQ ID NO: 4823 - RNA, 22 nt, Homo sapiens
cacccguagaaccgaccuugcg

SEQ ID NO: 4824 - RNA, 21 nt, Homo sapiens
ugcaggaccaagaugagcccu

SEQ ID NO: 4825 - RNA, 22 nt, Homo sapiens
uagcagcacauaaugguuugug

SEQ ID NO: 4826 - RNA, 22 nt, Homo sapiens
uagcagcacaucaugguuuaca

SEQ ID NO: 4827 - RNA, 22 nt, Homo sapiens
uagcagcacguaaauauuggcg

SEQ ID NO: 4828 - RNA, 21 nt, Homo sapiens
uagcagcacagaaauauuggc

SEQ ID NO: 4829 - RNA, 22 nt, Homo sapiens
cagcagcaauucauguuuugaa

SEQ ID NO: 4830 - RNA, 21 nt, Homo sapiens
cagcagcacacugugguuugu

SEQ ID NO: 4831 - RNA, 23 nt, Homo sapiens
aaggagcuuacaaucuagcuggg

SEQ ID NO: 4832 - RNA, 25 nt, Homo sapiens
ggcggagggaaguagguccguuggu

SEQ ID NO: 4833 - RNA, 23 nt, Homo sapiens
ucaagagcaauaacgaaaaaugu

SEQ ID NO: 4834 - RNA, 23 nt, Homo sapiens
ucuggcuccgugucuucacuccc

SEQ ID NO: 4835 - RNA, 22 nt, Homo sapiens
uacucaggagaguggcaaucac

SEQ ID NO: 4836 - RNA, 20 nt, Homo sapiens
uaaggcacgcggugaaugcc

SEQ ID NO: 4837 - RNA, 22 nt, Homo sapiens
cucuagagggaagcacuuucug

SEQ ID NO: 4838 - RNA, 21 nt, Homo sapiens
aaagcgcuucccuucagagug

SEQ ID NO: 4839 - RNA, 21 nt, Homo sapiens
gaaagcgcuucucuuuagagg

SEQ ID NO: 4840 - RNA, 22 nt, Homo sapiens
aaagugcauccuuuuagagugu

SEQ ID NO: 4841 - RNA, 22 nt, Homo sapiens
cucuagagggaagcgcuuucug

SEQ ID NO: 4842 - RNA, 22 nt, Homo sapiens
cucuagagggaagcgcuuucug

SEQ ID NO: 4843 - RNA, 22 nt, Homo sapiens
cucuagagggaagcacuuucug

SEQ ID NO: 4844 - RNA, 22 nt, Homo sapiens
aaaaugguucccuuuagagugu

SEQ ID NO: 4845 - RNA, 23 nt, Homo sapiens
gaacgcgcuucccuauagagggu

SEQ ID NO: 4846 - RNA, 22 nt, Homo sapiens
cucuagagggaagcacuuucug

SEQ ID NO: 4847 - RNA, 22 nt, Homo sapiens
uggcucaguucagcaggaacag

SEQ ID NO: 4848 - RNA, 24 nt, Homo sapiens
ucccugagacccuuuaaccuguga

SEQ ID NO: 4849 - RNA, 22 nt, Homo sapiens
ucccugagacccuaacuuguga

SEQ ID NO: 4850 - RNA, 23 nt, Homo sapiens
ccucagggcuguagaacagggcu

SEQ ID NO: 4851 - RNA, 22 nt, Homo sapiens
gguccagaggggagauagguuc

SEQ ID NO: 4852 - RNA, 21 nt, Homo sapiens
cuccagagggaaguacuuucu

SEQ ID NO: 4853 - RNA, 21 nt, Homo sapiens
cuccagagggaugcacuuucu

SEQ ID NO: 4854 - RNA, 22 nt, Homo sapiens
ugagccccugugccgcccccag

SEQ ID NO: 4855 - RNA, 22 nt, Homo sapiens
uuagggcccuggcuccaucucc

SEQ ID NO: 4856 - RNA, 21 nt, Homo sapiens
cauaaaguagaaagcacuacu

SEQ ID NO: 4857 - RNA, 22 nt, Homo sapiens
uggagagaaaggcaguuccuga

SEQ ID NO: 4858 - RNA, 21 nt, Homo sapiens
cggcggggacggcgauugguc

SEQ ID NO: 4859 - RNA, 21 nt, Homo sapiens
agggcccccccucaauccugu

SEQ ID NO: 4860 - RNA, 22 nt, Homo sapiens
uuauaaagcaaugagacugauu

SEQ ID NO: 4861 - RNA, 23 nt, Homo sapiens
ucccccaggugugauucugauuu

SEQ ID NO: 4862 - RNA, 21 nt, Homo sapiens
uuuccauaggugaugagucac

SEQ ID NO: 4863 - RNA, 24 nt, Homo sapiens
acugggggcuuucgggcucugcgu

SEQ ID NO: 4864 - RNA, 22 nt, Homo sapiens
aggcggggcgccgcgggaccgc

SEQ ID NO: 4865 - RNA, 23 nt, Homo sapiens
aggaagcccuggaggggcuggag

SEQ ID NO: 4866 - RNA, 22 nt, Homo sapiens
acccgucccguucguccccgga

SEQ ID NO: 4867 - RNA, 23 nt, Homo sapiens
ucuggcuccgugucuucacuccc

SEQ ID NO: 4868 - RNA, 23 nt, Homo sapiens
ucuggcuccgugucuucacuccc

SEQ ID NO: 4869 - RNA, 21 nt, Homo sapiens
uccugcgcgucccagaugccc

SEQ ID NO: 4870 - RNA, 21 nt, Homo sapiens
cggcggggacggcgauugguc

SEQ ID NO: 4871 - RNA, 21 nt, Homo sapiens
agggcccccccucaauccugu

SEQ ID NO: 4872 - RNA, 21 nt, Homo sapiens
agggcccccccucaauccugu

SEQ ID NO: 4873 - RNA, 23 nt, Homo sapiens
ucccccaggugugauucugauuu

SEQ ID NO: 4874 - RNA, 25 nt, Homo sapiens
aggggugguguugggacagcuccgu

SEQ ID NO: 4875 - RNA, 24 nt, Homo sapiens
acugggggcuuucgggcucugcgu

SEQ ID NO: 4876 - RNA, 22 nt, Homo sapiens
aggcggggcgccgcgggaccgc

SEQ ID NO: 4877 - RNA, 22 nt, Homo sapiens
ugcggggcuagggcuaacagca

SEQ ID NO: 4878 - RNA, 20 nt, Homo sapiens
ggggagcuguggaagcagua

SEQ ID NO: 4879 - RNA, 22 nt, Homo sapiens
uauugcacucgucccggccucc

SEQ ID NO: 4880 - RNA, 23 nt, Homo sapiens
uacccuguagauccgaauuugug

SEQ ID NO: 4881 - RNA, 23 nt, Homo sapiens
uacccuguagaaccgaauuugug

SEQ ID NO: 4882 - RNA, 20 nt, Homo sapiens
ucacaccugccucgcccccc

SEQ ID NO: 4883 - RNA, 24 nt, Homo sapiens
ucccugagacccuuuaaccuguga

SEQ ID NO: 4884 - RNA, 22 nt, Homo sapiens
ucccugagacccuaacuuguga

SEQ ID NO: 4885 - RNA, 23 nt, Homo sapiens
ccucagggcuguagaacagggcu

SEQ ID NO: 4886 - RNA, 22 nt, Homo sapiens
cucccacugcuucacuugacua

SEQ ID NO: 4887 - RNA, 23 nt, Homo sapiens
ucccuguccuccaggagcucacg

SEQ ID NO: 4888 - RNA, 22 nt, Homo sapiens
uugggaucauuuugcauccaua

SEQ ID NO: 4889 - RNA, 22 nt, Homo sapiens
uccuguacugagcugccccgag

SEQ ID NO: 4890 - RNA, 21 nt, Homo sapiens
auccuugcuaucugggugcua

SEQ ID NO: 4891 - RNA, 22 nt, Homo sapiens
agacccuggucugcacucuauc

SEQ ID NO: 4892 - RNA, 22 nt, Homo sapiens
uacucaggagaguggcaaucac

SEQ ID NO: 4893 - RNA, 22 nt, Homo sapiens
aucuggagguaagaagcacuuu

SEQ ID NO: 4894 - RNA, 23 nt, Homo sapiens
caaagcgcuucucuuuagagugu

SEQ ID NO: 4895 - RNA, 21 nt, Homo sapiens
cuccagagggaaguacuuucu

SEQ ID NO: 4896 - RNA, 21 nt, Homo sapiens
cuccagagggaugcacuuucu

SEQ ID NO: 4897 - RNA, 23 nt, Homo sapiens
cugggaucuccggggucuugguu

SEQ ID NO: 4898 - RNA, 18 nt, Homo sapiens
ucagcuggcccucauuuc

SEQ ID NO: 4899 - RNA, 22 nt, Homo sapiens
uggagugugacaaugguguuug

SEQ ID NO: 4900 - RNA, 21 nt, Homo sapiens
uccuucugcuccgucccccag

SEQ ID NO: 4901 - RNA, 24 nt, Homo sapiens
ucccugagacccuuuaaccuguga

SEQ ID NO: 4902 - RNA, 22 nt, Homo sapiens
ucccugagacccuaacuuguga

SEQ ID NO: 4903 - RNA, 23 nt, Homo sapiens
ccucagggcuguagaacagggcu

SEQ ID NO: 4904 - RNA, 20 nt, Homo sapiens
ccuccugcccuccuugcugu

SEQ ID NO: 4905 - RNA, 22 nt, Homo sapiens
uuggggaaacggccgcugagug

SEQ ID NO: 4906 - RNA, 21 nt, Homo sapiens
auuugugcuuggcucugucac

SEQ ID NO: 4907 - RNA, 23 nt, Homo sapiens
agcuacauugucugcuggguuuc

SEQ ID NO: 4908 - RNA, 22 nt, Homo sapiens
cauugcacuugucucggucuga

SEQ ID NO: 4909 - RNA, 24 nt, Homo sapiens
agcagaagcagggagguucuccca

SEQ ID NO: 4910 - RNA, 22 nt, Homo sapiens
uggcaguguauuguuagcuggu

SEQ ID NO: 4911 - RNA, 22 nt, Homo sapiens
ugaguauuacauggccaaucuc

SEQ ID NO: 4912 - RNA, 23 nt, Homo sapiens
cacucagccuugagggcacuuuc

SEQ ID NO: 4913 - RNA, 22 nt, Homo sapiens
auucugcauuuuuagcaaguuc

SEQ ID NO: 4914 - RNA, 23 nt, Homo sapiens
uggaagacuagugauuuuguugu

SEQ ID NO: 4915 - RNA, 22 nt, Homo sapiens
cugcccuggcccgagggaccga

SEQ ID NO: 4916 - RNA, 21 nt, Homo sapiens
ccccaccuccucucuccucag

SEQ ID NO: 4917 - RNA, 19 nt, Homo sapiens
gugaggacucgggaggugg

SEQ ID NO: 4918 - RNA, 20 nt, Homo sapiens
cuuccucgucugucugcccc

SEQ ID NO: 4919 - RNA, 21 nt, Homo sapiens
ugagaugaagcacuguagcuc

SEQ ID NO: 4920 - RNA, 20 nt, Homo sapiens
ccucugggcccuuccuccag

SEQ ID NO: 4921 - RNA, 22 nt, Homo sapiens
ucucugggccugugucuuaggc

SEQ ID NO: 4922 - RNA, 23 nt, Homo sapiens
ucucacacagaaaucgcacccgu

SEQ ID NO: 4923 - RNA, 22 nt, Homo sapiens
aguggggaacccuuccaugagg

SEQ ID NO: 4924 - RNA, 21 nt, Homo sapiens
aacaggugacugguuagacaa

SEQ ID NO: 4925 - RNA, 21 nt, Homo sapiens
ugaguuggccaucugagugag

SEQ ID NO: 4926 - RNA, 22 nt, Homo sapiens
ggggguccccggugcucggauc

SEQ ID NO: 4927 - RNA, 21 nt, Homo sapiens
uggaggagaaggaaggugaug

SEQ ID NO: 4928 - RNA, 20 nt, Homo sapiens
ggggagcuguggaagcagua

SEQ ID NO: 4929 - RNA, 22 nt, Homo sapiens
ucuucucuguuuuggccaugug

SEQ ID NO: 4930 - RNA, 21 nt, Homo sapiens
uggaggagaaggaaggugaug

SEQ ID NO: 4931 - RNA, 21 nt, Homo sapiens
ugagcuaaaugugugcuggga

SEQ ID NO: 4932 - RNA, 18 nt, Homo sapiens
cagggaggugaaugugau

SEQ ID NO: 4933 - RNA, 23 nt, Homo sapiens
ucuggcuccgugucuucacuccc

SEQ ID NO: 4934 - RNA, 22 nt, Homo sapiens
uagguuauccguguugccuucg

SEQ ID NO: 4935 - RNA, 21 nt, Homo sapiens
cucccacaugcaggguuugca

SEQ ID NO: 4936 - RNA, 22 nt, Homo sapiens
uucccuuugucauccuaugccu

SEQ ID NO: 4937 - RNA, 22 nt, Homo sapiens
cugugcgugugacagcggcuga

SEQ ID NO: 4938 - RNA, 22 nt, Homo sapiens
uucccuuugucauccuucgccu

SEQ ID NO: 4939 - RNA, 22 nt, Homo sapiens
cuggcccucucugcccuuccgu

SEQ ID NO: 4940 - RNA, 22 nt, Homo sapiens
uaugugccuuuggacuacaucg

SEQ ID NO: 4941 - RNA, 23 nt, Homo sapiens
acuugggcacugaaacaaugucc

SEQ ID NO: 4942 - RNA, 21 nt, Homo sapiens
aggaggcagcgcucucaggac

SEQ ID NO: 4943 - RNA, 23 nt, Homo sapiens
ggcagguucucacccucucuagg

SEQ ID NO: 4944 - RNA, 23 nt, Homo sapiens
aaggagcuuacaaucuagcuggg

SEQ ID NO: 4945 - RNA, 18 nt, Homo sapiens
aucccaccucugccacca

SEQ ID NO: 4946 - RNA, 22 nt, Homo sapiens
ccucccacacccaaggcuugca

SEQ ID NO: 4947 - RNA, 20 nt, Homo sapiens
uaaggcacgcggugaaugcc

SEQ ID NO: 4948 - RNA, 21 nt, Homo sapiens
uaaggcacccuucugaguaga

SEQ ID NO: 4949 - RNA, 24 nt, Homo sapiens
ccagacagaauucuaugcacuuuc

SEQ ID NO: 4950 - RNA, 20 nt, Homo sapiens
guagaggagauggcgcaggg

SEQ ID NO: 4951 - RNA, 26 nt, Homo sapiens
aaguaguugguuuguaugagaugguu

SEQ ID NO: 4952 - RNA, 21 nt, Homo sapiens
agggcccccccucaauccugu

SEQ ID NO: 4953 - RNA, 23 nt, Homo sapiens
agcucggucugaggccccucagu

SEQ ID NO: 4954 - RNA, 22 nt, Homo sapiens
uucucaaggaggugucguuuau

SEQ ID NO: 4955 - RNA, 23 nt, Homo sapiens
cucuugagggaagcacuuucugu

SEQ ID NO: 4956 - RNA, 22 nt, Homo sapiens
uugagaaugaugaaucauuagg

SEQ ID NO: 4957 - RNA, 23 nt, Homo sapiens
acuugggcacugaaacaaugucc

SEQ ID NO: 4958 - RNA, 21 nt, Homo sapiens
gaaggcgcuucccuuuggagu

SEQ ID NO: 4959 - RNA, 22 nt, Homo sapiens
acaguagucugcacauugguua

SEQ ID NO: 4960 - RNA, 22 nt, Homo sapiens
acaguagucugcacauugguua

SEQ ID NO: 4961 - RNA, 17 nt, Homo sapiens
ucgccuccuccucuccc

SEQ ID NO: 4962 - RNA, 22 nt, Homo sapiens
aaggagcucacagucuauugag

SEQ ID NO: 4963 - RNA, 22 nt, Homo sapiens
gagcuuauucauaaaagugcag

SEQ ID NO: 4964 - RNA, 23 nt, Homo sapiens
aaggagcuuacaaucuagcuggg

SEQ ID NO: 4965 - RNA, 21 nt, Homo sapiens
cugaccuaugaauugacagcc

SEQ ID NO: 4966 - RNA, 23 nt, Homo sapiens
uauucauuuauccccagccuaca

SEQ ID NO: 4967 - RNA, 22 nt, Homo sapiens
cgucaacacuugcugguuuccu

SEQ ID NO: 4968 - RNA, 25 nt, Homo sapiens
aggggugguguugggacagcuccgu

SEQ ID NO: 4969 - RNA, 23 nt, Homo sapiens
ucuggcuccgugucuucacuccc

SEQ ID NO: 4970 - RNA, 21 nt, Homo sapiens
cggcggggacggcgauugguc

SEQ ID NO: 4971 - RNA, 23 nt, Homo sapiens
uacuccagagggcgucacucaug

SEQ ID NO: 4972 - RNA, 22 nt, Homo sapiens
aggcggggcgccgcgggaccgc

SEQ ID NO: 4973 - RNA, 24 nt, Homo sapiens
uggggagcugaggcucugggggug

SEQ ID NO: 4974 - RNA, 22 nt, Homo sapiens
aucacacaaaggcaacuuuugu

SEQ ID NO: 4975 - RNA, 23 nt, Homo sapiens
cacucagccuugagggcacuuuc

SEQ ID NO: 4976 - RNA, 24 nt, Homo sapiens
gaccuggacauguuugugcccagu

SEQ ID NO: 4977 - RNA, 23 nt, Homo sapiens
ucucacacagaaaucgcacccgu

SEQ ID NO: 4978 - RNA, 20 nt, Homo sapiens
accaggaggcugaggccccu

SEQ ID NO: 4979 - RNA, 22 nt, Homo sapiens
uucuggaauucugugugaggga

SEQ ID NO: 4980 - RNA, 22 nt, Homo sapiens
aagcccuuaccccaaaaagcau

SEQ ID NO: 4981 - RNA, 18 nt, Homo sapiens
ugaggcaguagauugaau

SEQ ID NO: 4982 - RNA, 21 nt, Homo sapiens
aggaggcagcgcucucaggac

SEQ ID NO: 4983 - RNA, 21 nt, Homo sapiens
aaggcagggcccccgcucccc

SEQ ID NO: 4984 - RNA, 23 nt, Homo sapiens
cgcauccccuagggcauuggugu

SEQ ID NO: 4985 - RNA, 21 nt, Homo sapiens
gugcauuguaguugcauugca

SEQ ID NO: 4986 - RNA, 22 nt, Homo sapiens
cucccacugcuucacuugacua

SEQ ID NO: 4987 - RNA, 20 nt, Homo sapiens
guguguggaaaugcuucugc

SEQ ID NO: 4988 - RNA, 20 nt, Homo sapiens
acucaaacugugggggcacu

SEQ ID NO: 4989 - RNA, 21 nt, Homo sapiens
cccggagccaggaugcagcuc

SEQ ID NO: 4990 - RNA, 22 nt, Homo sapiens
uggagagaaaggcaguuccuga

SEQ ID NO: 4991 - RNA, 22 nt, Homo sapiens
uacccagagcaugcagugugaa

SEQ ID NO: 4992 - RNA, 23 nt, Homo sapiens
caacggaaucccaaaagcagcug

SEQ ID NO: 4993 - RNA, 21 nt, Homo sapiens
ccaccaccgugucugacacuu

SEQ ID NO: 4994 - RNA, 23 nt, Homo sapiens
ucccccaggugugauucugauuu

SEQ ID NO: 4995 - RNA, 19 nt, Homo sapiens
aggcugcggaauucaggac

SEQ ID NO: 4996 - RNA, 21 nt, Homo sapiens
ugagcuaaaugugugcuggga

SEQ ID NO: 4997 - RNA, 24 nt, Homo sapiens
acugggggcuuucgggcucugcgu

SEQ ID NO: 4998 - RNA, 21 nt, Homo sapiens
guggcugcacucacuuccuuc

SEQ ID NO: 4999 - RNA, 23 nt, Homo sapiens
ugucacucggcucggcccacuac

SEQ ID NO: 5000 - RNA, 23 nt, Homo sapiens
cgggucggaguuagcucaagcgg

SEQ ID NO: 5001 - RNA, 22 nt, Homo sapiens
uggagugugacaaugguguuug

SEQ ID NO: 5002 - RNA, 27 nt, Homo sapiens
accuucuuguauaagcacugugcuaaa

SEQ ID NO: 5003 - RNA, 23 nt, Homo sapiens
ucuggcuccgugucuucacuccc

SEQ ID NO: 5004 - RNA, 22 nt, Homo sapiens
uccuucauuccaccggagucug

SEQ ID NO: 5005 - RNA, 21 nt, Homo sapiens
acuggacuuggagucagaagg

SEQ ID NO: 5006 - RNA, 22 nt, Homo sapiens
cgucaacacuugcugguuuccu

SEQ ID NO: 5007 - RNA, 19 nt, Homo sapiens
ugucucugcugggguuucu

SEQ ID NO: 5008 - RNA, 23 nt, Homo sapiens
cacccggcugugugcacaugugc

SEQ ID NO: 5009 - RNA, 18 nt, Homo sapiens
acguuggcucugguggug

SEQ ID NO: 5010 - RNA, 23 nt, Homo sapiens
ucuggcuccgugucuucacuccc

SEQ ID NO: 5011 - RNA, 21 nt, Homo sapiens
ucgaggagcucacagucuagu

SEQ ID NO: 5012 - RNA, 22 nt, Homo sapiens
uggagagaaaggcaguuccuga

SEQ ID NO: 5013 - RNA, 21 nt, Homo sapiens
cggcggggacggcgauugguc

SEQ ID NO: 5014 - RNA, 22 nt, Homo sapiens
cccugugcccggcccacuucug

SEQ ID NO: 5015 - RNA, 22 nt, Homo sapiens
aagcugccaguugaagaacugu

SEQ ID NO: 5016 - RNA, 19 nt, Homo sapiens
ugagcugcuguaccaaaau

SEQ ID NO: 5017 - RNA, 19 nt, Homo sapiens
gggcgccugugaucccaac

SEQ ID NO: 5018 - RNA, 22 nt, Homo sapiens
aggcggggcgccgcgggaccgc

SEQ ID NO: 5019 - RNA, 23 nt, Homo sapiens
cgggucggaguuagcucaagcgg

SEQ ID NO: 5020 - RNA, 20 nt, Homo sapiens
ggggagcuguggaagcagua

SEQ ID NO: 5021 - RNA, 22 nt, Homo sapiens
uggagugugacaaugguguuug

SEQ ID NO: 5022 - RNA, 21 nt, Homo sapiens
agugaaugauggguucugacc

SEQ ID NO: 5023 - RNA, 24 nt, Homo sapiens
ucccugagacccuuuaaccuguga

SEQ ID NO: 5024 - RNA, 22 nt, Homo sapiens
ucccugagacccuaacuuguga

SEQ ID NO: 5025 - RNA, 23 nt, Homo sapiens
ccucagggcuguagaacagggcu

SEQ ID NO: 5026 - RNA, 24 nt, Homo sapiens
uggcccugacugaagaccagcagu

SEQ ID NO: 5027 - RNA, 22 nt, Homo sapiens
uuugaggcuacagugagaugug

SEQ ID NO: 5028 - RNA, 22 nt, Homo sapiens
uggagagaaaggcaguuccuga

SEQ ID NO: 5029 - RNA, 22 nt, Homo sapiens
caaagaauucuccuuuugggcu

SEQ ID NO: 5030 - RNA, 21 nt, Homo sapiens
cggcggggacggcgauugguc

SEQ ID NO: 5031 - RNA, 22 nt, Homo sapiens
agaggcuggccgugaugaauuc

SEQ ID NO: 5032 - RNA, 24 nt, Homo sapiens
acaaagugcuucccuuuagagugu

SEQ ID NO: 5033 - RNA, 22 nt, Homo sapiens
acaaagugcuucccuuuagagu

SEQ ID NO: 5034 - RNA, 22 nt, Homo sapiens
uggucuaggauuguuggaggag

SEQ ID NO: 5035 - RNA, 22 nt, Homo sapiens
aaccagcaccccaacuuuggac

SEQ ID NO: 5036 - RNA, 22 nt, Homo sapiens
aggcggggcgccgcgggaccgc

SEQ ID NO: 5037 - RNA, 22 nt, Homo sapiens
ugcggggcuagggcuaacagca

SEQ ID NO: 5038 - RNA, 22 nt, Homo sapiens
agaggcuggccgugaugaauuc

SEQ ID NO: 5039 - RNA, 19 nt, Homo sapiens
aggcugcggaauucaggac

SEQ ID NO: 5040 - RNA, 23 nt, Homo sapiens
cuggagauauggaagagcugugu

SEQ ID NO: 5041 - RNA, 17 nt, Homo sapiens
ucauauugcuucuuucu

SEQ ID NO: 5042 - RNA, 22 nt, Homo sapiens
cugugcgugugacagcggcuga

SEQ ID NO: 5043 - RNA, 22 nt, Homo sapiens
uuggggaaacggccgcugagug

SEQ ID NO: 5044 - RNA, 22 nt, Homo sapiens
uaaucucagcuggcaacuguga

SEQ ID NO: 5045 - RNA, 23 nt, Homo sapiens
ucaagagcaauaacgaaaaaugu

SEQ ID NO: 5046 - RNA, 22 nt, Homo sapiens
cgaaaacagcaauuaccuuugc

SEQ ID NO: 5047 - RNA, 21 nt, Homo sapiens
uagauaaaauauugguaccug

SEQ ID NO: 5048 - RNA, 23 nt, Homo sapiens
uucauuugguauaaaccgcgauu

SEQ ID NO: 5049 - RNA, 20 nt, Homo sapiens
auggagauagauauagaaau

SEQ ID NO: 5050 - RNA, 21 nt, Homo sapiens
cugacuguugccguccuccag

SEQ ID NO: 5051 - RNA, 22 nt, Homo sapiens
cccugugcccggcccacuucug

SEQ ID NO: 5052 - RNA, 22 nt, Homo sapiens
uagcagcacauaaugguuugug

SEQ ID NO: 5053 - RNA, 22 nt, Homo sapiens
uagcagcacaucaugguuuaca

SEQ ID NO: 5054 - RNA, 22 nt, Homo sapiens
uagcagcacguaaauauuggcg

SEQ ID NO: 5055 - RNA, 21 nt, Homo sapiens
uagcagcacagaaauauuggc

SEQ ID NO: 5056 - RNA, 22 nt, Homo sapiens
acagcaggcacagacaggcagu

SEQ ID NO: 5057 - RNA, 22 nt, Homo sapiens
cagcagcaauucauguuuugaa

SEQ ID NO: 5058 - RNA, 21 nt, Homo sapiens
cagcagcacacugugguuugu

SEQ ID NO: 5059 - RNA, 22 nt, Homo sapiens
gcugacuccuaguccagggcuc

SEQ ID NO: 5060 - RNA, 21 nt, Homo sapiens
ucgaggagcucacagucuagu

SEQ ID NO: 5061 - RNA, 21 nt, Homo sapiens
cggcggggacggcgauugguc

SEQ ID NO: 5062 - RNA, 22 nt, Homo sapiens
ucugcccccuccgcugcugcca

SEQ ID NO: 5063 - RNA, 25 nt, Homo sapiens
cccccacaaccgcgcuugacuagcu

SEQ ID NO: 5064 - RNA, 21 nt, Homo sapiens
agggcccccccucaauccugu

SEQ ID NO: 5065 - RNA, 20 nt, Homo sapiens
acugccccaggugcugcugg

SEQ ID NO: 5066 - RNA, 21 nt, Homo sapiens
cggggcagcucaguacaggau

SEQ ID NO: 5067 - RNA, 19 nt, Homo sapiens
aggcacggugucagcaggc

SEQ ID NO: 5068 - RNA, 22 nt, Homo sapiens
aggcagcgggguguaguggaua

SEQ ID NO: 5069 - RNA, 21 nt, Homo sapiens
uugcucacuguucuucccuag

SEQ ID NO: 5070 - RNA, 18 nt, Homo sapiens
cgggcguggugguggggg

SEQ ID NO: 5071 - RNA, 17 nt, Homo sapiens
ucgccuccuccucuccc

SEQ ID NO: 5072 - RNA, 21 nt, Homo sapiens
gcccuccgcccgugcaccccg

SEQ ID NO: 5073 - RNA, 23 nt, Homo sapiens
ucuggcuccgugucuucacuccc

SEQ ID NO: 5074 - RNA, 23 nt, Homo sapiens
uagcagcgggaacaguucugcag

SEQ ID NO: 5075 - RNA, 23 nt, Homo sapiens
ucugcucauaccccaugguuucu

SEQ ID NO: 5076 - RNA, 22 nt, Homo sapiens
uucaacggguauuuauugagca

SEQ ID NO: 5077 - RNA, 22 nt, Homo sapiens
cagugcaaugaugaaagggcau

SEQ ID NO: 5078 - RNA, 23 nt, Homo sapiens
guccaguuuucccaggaaucccu

SEQ ID NO: 5079 - RNA, 22 nt, Homo sapiens
caaagaauucuccuuuugggcu

SEQ ID NO: 5080 - RNA, 23 nt, Homo sapiens
uaaggugcaucuagugcaguuag

SEQ ID NO: 5081 - RNA, 22 nt, Homo sapiens
gauuagggugcuuagcuguuaa

SEQ ID NO: 5082 - RNA, 22 nt, Homo sapiens
uaaugccccuaaaaauccuuau

SEQ ID NO: 5083 - RNA, 22 nt, Homo sapiens
aaaaguauuugcggguuuuguc

SEQ ID NO: 5084 - RNA, 23 nt, Homo sapiens
uauucauuuauccccagccuaca

SEQ ID NO: 5085 - RNA, 22 nt, Homo sapiens
ucuucucuguuuuggccaugug

SEQ ID NO: 5086 - RNA, 22 nt, Homo sapiens
uggagugugacaaugguguuug

SEQ ID NO: 5087 - RNA, 21 nt, Homo sapiens
uaccacaggguagaaccacgg

SEQ ID NO: 5088 - RNA, 21 nt, Homo sapiens
cggcggggacggcgauugguc

SEQ ID NO: 5089 - RNA, 21 nt, Homo sapiens
aaagcgcuucccuucagagug

SEQ ID NO: 5090 - RNA, 23 nt, Homo sapiens
aucgcugcgguugcgagcgcugu

SEQ ID NO: 5091 - RNA, 22 nt, Homo sapiens
aggcggggcgccgcgggaccgc

SEQ ID NO: 5092 - RNA, 17 nt, Homo sapiens
ucucgcuggggccucca

SEQ ID NO: 5093 - RNA, 22 nt, Homo sapiens
ugcggggcuagggcuaacagca

SEQ ID NO: 5094 - RNA, 22 nt, Homo sapiens
aggcagcgggguguaguggaua

SEQ ID NO: 5095 - RNA, 24 nt, Homo sapiens
uggggagcugaggcucugggggug

SEQ ID NO: 5096 - RNA, 21 nt, Homo sapiens
uaaagugcugacagugcagau

SEQ ID NO: 5097 - RNA, 21 nt, Homo sapiens
ccgucgccgccacccgagccg

SEQ ID NO: 5098 - RNA, 20 nt, Homo sapiens
ucugcaggguuugcuuugag

SEQ ID NO: 5099 - RNA, 20 nt, Homo sapiens
ucugcaggguuugcuuugag

SEQ ID NO: 5100 - RNA, 22 nt, Homo sapiens
ucguaccgugaguaauaaugcg

SEQ ID NO: 5101 - RNA, 22 nt, Homo sapiens
augguacccuggcauacugagu

SEQ ID NO: 5102 - RNA, 24 nt, Homo sapiens
uggcccugacugaagaccagcagu

SEQ ID NO: 5103 - RNA, 21 nt, Homo sapiens
ugagaugaagcacuguagcuc

SEQ ID NO: 5104 - RNA, 22 nt, Homo sapiens
ucagugcacuacagaacuuugu

SEQ ID NO: 5105 - RNA, 22 nt, Homo sapiens
ucagugcaucacagaacuuugu

SEQ ID NO: 5106 - RNA, 21 nt, Homo sapiens
ucagugcaugacagaacuugg

SEQ ID NO: 5107 - RNA, 21 nt, Homo sapiens
uccugcgcgucccagaugccc

SEQ ID NO: 5108 - RNA, 22 nt, Homo sapiens
cgcaggggccgggugcucaccg

SEQ ID NO: 5109 - RNA, 20 nt, Homo sapiens
ccuccugcccuccuugcugu

SEQ ID NO: 5110 - RNA, 23 nt, Homo sapiens
ugagcgccucgacgacagagccg

SEQ ID NO: 5111 - RNA, 22 nt, Homo sapiens
uuauaaagcaaugagacugauu

SEQ ID NO: 5112 - RNA, 22 nt, Homo sapiens
aggcagcgggguguaguggaua

SEQ ID NO: 5113 - RNA, 22 nt, Homo sapiens
ugugcgcagggagaccucuccc

SEQ ID NO: 5114 - RNA, 21 nt, Homo sapiens
ccccaccuccucucuccucag

SEQ ID NO: 5115 - RNA, 21 nt, Homo sapiens
ccccaccuccucucuccucag

SEQ ID NO: 5116 - RNA, 20 nt, Homo sapiens
ugagcccuguccucccgcag

SEQ ID NO: 5117 - RNA, 22 nt, Homo sapiens
cucuagagggaagcacuuucug

SEQ ID NO: 5118 - RNA, 22 nt, Homo sapiens
uguaacagcaacuccaugugga

SEQ ID NO: 5119 - RNA, 22 nt, Homo sapiens
cucccacugcuucacuugacua

SEQ ID NO: 5120 - RNA, 22 nt, Homo sapiens
caaucacuaacuccacugccau

SEQ ID NO: 5121 - RNA, 22 nt, Homo sapiens
aagugcugucauagcugagguc

SEQ ID NO: 5122 - RNA, 22 nt, Homo sapiens
ccucccacacccaaggcuugca

SEQ ID NO: 5123 - RNA, 22 nt, Homo sapiens
uggugggcacagaaucuggacu

SEQ ID NO: 5124 - RNA, 21 nt, Homo sapiens
ugacaacuauggaugagcucu

SEQ ID NO: 5125 - RNA, 22 nt, Homo sapiens
uggugggccgcagaacaugugc

SEQ ID NO: 5126 - RNA, 21 nt, Homo sapiens
uacucaaaaagcugucaguca

SEQ ID NO: 5127 - RNA, 20 nt, Homo sapiens
ggggagcuguggaagcagua

SEQ ID NO: 5128 - RNA, 18 nt, Homo sapiens
ugaggcaguagauugaau

SEQ ID NO: 5129 - RNA, 23 nt, Homo sapiens
ucaaaugcucagacuccuguggu

SEQ ID NO: 5130 - RNA, 24 nt, Homo sapiens
ucccugagacccuuuaaccuguga

SEQ ID NO: 5131 - RNA, 22 nt, Homo sapiens
ucccugagacccuaacuuguga

SEQ ID NO: 5132 - RNA, 23 nt, Homo sapiens
ccucagggcuguagaacagggcu

SEQ ID NO: 5133 - RNA, 23 nt, Homo sapiens
ucuggcuccgugucuucacuccc

SEQ ID NO: 5134 - RNA, 21 nt, Homo sapiens
gccccugggccuauccuagaa

SEQ ID NO: 5135 - RNA, 22 nt, Homo sapiens
uaaugccccuaaaaauccuuau

SEQ ID NO: 5136 - RNA, 22 nt, Homo sapiens
aggcaguguauuguuagcuggc

SEQ ID NO: 5137 - RNA, 22 nt, Homo sapiens
uacucaggagaguggcaaucac

SEQ ID NO: 5138 - RNA, 22 nt, Homo sapiens
guggguacggcccagugggggg

SEQ ID NO: 5139 - RNA, 22 nt, Homo sapiens
cagugcaauguuaaaagggcau

SEQ ID NO: 5140 - RNA, 22 nt, Homo sapiens
cagugcaaugaugaaagggcau

SEQ ID NO: 5141 - RNA, 23 nt, Homo sapiens
ucuggcuccgugucuucacuccc

SEQ ID NO: 5142 - RNA, 22 nt, Homo sapiens
caaagaauucuccuuuugggcu

SEQ ID NO: 5143 - RNA, 22 nt, Homo sapiens
ucugcccccuccgcugcugcca

SEQ ID NO: 5144 - RNA, 23 nt, Homo sapiens
cccaguguucagacuaccuguuc

SEQ ID NO: 5145 - RNA, 23 nt, Homo sapiens
cccaguguuuagacuaucuguuc

SEQ ID NO: 5146 - RNA, 23 nt, Homo sapiens
ugugcaaaucuaugcaaaacuga

SEQ ID NO: 5147 - RNA, 23 nt, Homo sapiens
ugugcaaauccaugcaaaacuga

SEQ ID NO: 5148 - RNA, 23 nt, Homo sapiens
cagugcaauaguauugucaaagc

SEQ ID NO: 5149 - RNA, 23 nt, Homo sapiens
cagugcaaugauauugucaaagc

SEQ ID NO: 5150 - RNA, 22 nt, Homo sapiens
uguaaacauccuacacucagcu

SEQ ID NO: 5151 - RNA, 20 nt, Homo sapiens
acugccccaggugcugcugg

SEQ ID NO: 5152 - RNA, 23 nt, Homo sapiens
ucucacacagaaaucgcacccgu

SEQ ID NO: 5153 - RNA, 23 nt, Homo sapiens
ugaggggcagagagcgagacuuu

SEQ ID NO: 5154 - RNA, 22 nt, Homo sapiens
uuuugcgauguguuccuaauau

SEQ ID NO: 5155 - RNA, 23 nt, Homo sapiens
uagugcaauauugcuuauagggu

SEQ ID NO: 5156 - RNA, 21 nt, Homo sapiens
cggggcagcucaguacaggau

SEQ ID NO: 5157 - RNA, 21 nt, Homo sapiens
cagcagcacacugugguuugu

SEQ ID NO: 5158 - RNA, 21 nt, Homo sapiens
uuuugcaccuuuuggagugaa

SEQ ID NO: 5159 - RNA, 20 nt, Homo sapiens
cugcaaagggaagcccuuuc

SEQ ID NO: 5160 - RNA, 22 nt, Homo sapiens
aaagugcauccuuuuagagugu

SEQ ID NO: 5161 - RNA, 22 nt, Homo sapiens
aaagugcauccuuuuagagguu

SEQ ID NO: 5162 - RNA, 22 nt, Homo sapiens
aaagugcaucuuuuuagaggau

SEQ ID NO: 5163 - RNA, 20 nt, Homo sapiens
cugcaaagggaagcccuuuc

SEQ ID NO: 5164 - RNA, 22 nt, Homo sapiens
ccucccacacccaaggcuugca

SEQ ID NO: 5165 - RNA, 22 nt, Homo sapiens
caaaaaccacaguuucuuuugc

SEQ ID NO: 5166 - RNA, 21 nt, Homo sapiens
gcgacccauacuugguuucag

SEQ ID NO: 5167 - RNA, 23 nt, Homo sapiens
guuugcacgggugggccuugucu

SEQ ID NO: 5168 - RNA, 23 nt, Homo sapiens
ugagugugugugugugagugugu

SEQ ID NO: 5169 - RNA, 22 nt, Homo sapiens
cacacacugcaauuacuuuugc

SEQ ID NO: 5170 - RNA, 22 nt, Homo sapiens
uggugguuuacaaaguaauuca

SEQ ID NO: 5171 - RNA, 22 nt, Homo sapiens
caaagugccucccuuuagagug

SEQ ID NO: 5172 - RNA, 23 nt, Homo sapiens
ucuggcuccgugucuucacuccc

SEQ ID NO: 5173 - RNA, 18 nt, Homo sapiens
uccagugcccuccucucc

SEQ ID NO: 5174 - RNA, 20 nt, Homo sapiens
gugcauugcuguugcauugc

SEQ ID NO: 5175 - RNA, 22 nt, Homo sapiens
gagugccuucuuuuggagcguu

SEQ ID NO: 5176 - RNA, 22 nt, Homo sapiens
aagugccuccuuuuagaguguu

SEQ ID NO: 5177 - RNA, 23 nt, Homo sapiens
agugccugagggaguaagagccc

SEQ ID NO: 5178 - RNA, 23 nt, Homo sapiens
ccugcagcgacuugauggcuucc

SEQ ID NO: 5179 - RNA, 23 nt, Homo sapiens
ccugcagcgacuugauggcuucc

SEQ ID NO: 5180 - RNA, 22 nt, Homo sapiens
uagcuuaucagacugauguuga

SEQ ID NO: 5181 - RNA, 21 nt, Homo sapiens
gccccugggccuauccuagaa

SEQ ID NO: 5182 - RNA, 21 nt, Homo sapiens
cggggcagcucaguacaggau

SEQ ID NO: 5183 - RNA, 23 nt, Homo sapiens
agugccugagggaguaagagccc

SEQ ID NO: 5184 - RNA, 22 nt, Homo sapiens
gucccucuccaaaugugucuug

SEQ ID NO: 5185 - RNA, 22 nt, Homo sapiens
uacccauugcauaucggaguug

SEQ ID NO: 5186 - RNA, 18 nt, Homo sapiens
cgggcguggugguggggg

SEQ ID NO: 5187 - RNA, 22 nt, Homo sapiens
uaacacugucugguaaagaugg

SEQ ID NO: 5188 - RNA, 21 nt, Homo sapiens
cggcggggacggcgauugguc

SEQ ID NO: 5189 - RNA, 22 nt, Homo sapiens
aggcggggcgccgcgggaccgc

SEQ ID NO: 5190 - RNA, 22 nt, Homo sapiens
ugcaacgaaccugagccacuga

SEQ ID NO: 5191 - RNA, 18 nt, Homo sapiens
ucagcuggcccucauuuc

SEQ ID NO: 5192 - RNA, 23 nt, Homo sapiens
ucuggcuccgugucuucacuccc

SEQ ID NO: 5193 - RNA, 20 nt, Homo sapiens
ccccagggcgacgcggcggg

SEQ ID NO: 5194 - RNA, 23 nt, Homo sapiens
agcuacauugucugcuggguuuc

SEQ ID NO: 5195 - RNA, 23 nt, Homo sapiens
aaugacacgaucacucccguuga

SEQ ID NO: 5196 - RNA, 22 nt, Homo sapiens
uggugggcacagaaucuggacu

SEQ ID NO: 5197 - RNA, 21 nt, Homo sapiens
caaagaggaaggucccauuac

SEQ ID NO: 5198 - RNA, 22 nt, Homo sapiens
uggugggccgcagaacaugugc

SEQ ID NO: 5199 - RNA, 25 nt, Homo sapiens
aggggugguguugggacagcuccgu

SEQ ID NO: 5200 - RNA, 21 nt, Homo sapiens
ccccaccuccucucuccucag

SEQ ID NO: 5201 - RNA, 22 nt, Homo sapiens
ucggccugaccacccaccccac

SEQ ID NO: 5202 - RNA, 17 nt, Homo sapiens
ucgccuccuccucuccc

SEQ ID NO: 5203 - RNA, 23 nt, Homo sapiens
ucuggcuccgugucuucacuccc

SEQ ID NO: 5204 - RNA, 21 nt, Homo sapiens
cggcggggacggcgauugguc

SEQ ID NO: 5205 - RNA, 22 nt, Homo sapiens
uguaaacauccucgacuggaag

SEQ ID NO: 5206 - RNA, 22 nt, Homo sapiens
uguaaacauccuacacucagcu

SEQ ID NO: 5207 - RNA, 23 nt, Homo sapiens
uguaaacauccuacacucucagc

SEQ ID NO: 5208 - RNA, 22 nt, Homo sapiens
uguaaacauccccgacuggaag

SEQ ID NO: 5209 - RNA, 22 nt, Homo sapiens
uguaaacauccuugacuggaag

SEQ ID NO: 5210 - RNA, 18 nt, Homo sapiens
ugcuuccuuucagagggu

SEQ ID NO: 5211 - RNA, 22 nt, Homo sapiens
aucuggagguaagaagcacuuu

SEQ ID NO: 5212 - RNA, 24 nt, Homo sapiens
gaccuggacauguuugugcccagu

SEQ ID NO: 5213 - RNA, 25 nt, Homo sapiens
agggaucgcgggcggguggcggccu

SEQ ID NO: 5214 - RNA, 22 nt, Homo sapiens
aggcggggcgccgcgggaccgc

SEQ ID NO: 5215 - RNA, 23 nt, Homo sapiens
aggaagcccuggaggggcuggag

SEQ ID NO: 5216 - RNA, 22 nt, Homo sapiens
ugcggggcuagggcuaacagca

SEQ ID NO: 5217 - RNA, 20 nt, Homo sapiens
ggggagcuguggaagcagua

SEQ ID NO: 5218 - RNA, 20 nt, Homo sapiens
ggggagcuguggaagcagua

SEQ ID NO: 5219 - RNA, 22 nt, Homo sapiens
cucccacugcuucacuugacua

SEQ ID NO: 5220 - RNA, 22 nt, Homo sapiens
aaaagcuggguugagagggcga

SEQ ID NO: 5221 - RNA, 22 nt, Homo sapiens
aaaagcuggguugagagggcaa

SEQ ID NO: 5222 - RNA, 20 nt, Homo sapiens
aaaagcuggguugagagggu

SEQ ID NO: 5223 - RNA, 19 nt, Homo sapiens
aaaagcuggguugagagga

SEQ ID NO: 5224 - RNA, 22 nt, Homo sapiens
uuuguucguucggcucgcguga

SEQ ID NO: 5225 - RNA, 22 nt, Homo sapiens
aaacaaacauggugcacuucuu

SEQ ID NO: 5226 - RNA, 23 nt, Homo sapiens
uuucaagccagggggcguuuuuc

SEQ ID NO: 5227 - RNA, 22 nt, Homo sapiens
aucuggagguaagaagcacuuu

SEQ ID NO: 5228 - RNA, 22 nt, Homo sapiens
aucuggagguaagaagcacuuu

SEQ ID NO: 5229 - RNA, 19 nt, Homo sapiens
agcugucugaaaaugucuu

SEQ ID NO: 5230 - RNA, 21 nt, Homo sapiens
uugcucacuguucuucccuag

SEQ ID NO: 5231 - RNA, 21 nt, Homo sapiens
cauaaaguagaaagcacuacu

SEQ ID NO: 5232 - RNA, 23 nt, Homo sapiens
uuaaugcuaaucgugauaggggu

SEQ ID NO: 5233 - RNA, 22 nt, Homo sapiens
uguaaacauccucgacuggaag

SEQ ID NO: 5234 - RNA, 22 nt, Homo sapiens
uguaaacauccuacacucagcu

SEQ ID NO: 5235 - RNA, 23 nt, Homo sapiens
uguaaacauccuacacucucagc

SEQ ID NO: 5236 - RNA, 22 nt, Homo sapiens
uguaaacauccccgacuggaag

SEQ ID NO: 5237 - RNA, 22 nt, Homo sapiens
uguaaacauccuugacuggaag

SEQ ID NO: 5238 - RNA, 25 nt, Homo sapiens
gggcgacaaagcaagacucuuucuu

SEQ ID NO: 5239 - RNA, 22 nt, Homo sapiens
ugcccuguggacucaguucugg

SEQ ID NO: 5240 - RNA, 21 nt, Homo sapiens
cggcggggacggcgauugguc

SEQ ID NO: 5241 - RNA, 21 nt, Homo sapiens
cggcggggacggcgauugguc

SEQ ID NO: 5242 - RNA, 22 nt, Homo sapiens
cauugcacuugucucggucuga

SEQ ID NO: 5243 - RNA, 22 nt, Homo sapiens
cgucaacacuugcugguuuccu

SEQ ID NO: 5244 - RNA, 22 nt, Homo sapiens
ggggguccccggugcucggauc

SEQ ID NO: 5245 - RNA, 22 nt, Homo sapiens
aggcggggcgccgcgggaccgc

SEQ ID NO: 5246 - RNA, 22 nt, Homo sapiens
aggcggggcgccgcgggaccgc

SEQ ID NO: 5247 - RNA, 22 nt, Homo sapiens
ugcggggcuagggcuaacagca

SEQ ID NO: 5248 - RNA, 22 nt, Homo sapiens
ugagguaguagguuguaugguu

SEQ ID NO: 5249 - RNA, 23 nt, Homo sapiens
guguuaauuaaaccucuauuuac

SEQ ID NO: 5250 - RNA, 18 nt, Homo sapiens
ugcuuccuuucagagggu

SEQ ID NO: 5251 - RNA, 22 nt, Homo sapiens
aucuggagguaagaagcacuuu

SEQ ID NO: 5252 - RNA, 21 nt, Homo sapiens
ucccacguuguggcccagcag

SEQ ID NO: 5253 - RNA, 22 nt, Homo sapiens
uauugcacucgucccggccucc

SEQ ID NO: 5254 - RNA, 22 nt, Homo sapiens
cucggcgcggggcgcgggcucc

SEQ ID NO: 5255 - RNA, 20 nt, Homo sapiens
agagguauagggcaugggaa

SEQ ID NO: 5256 - RNA, 23 nt, Homo sapiens
ucucacacagaaaucgcacccgu

SEQ ID NO: 5257 - RNA, 21 nt, Homo sapiens
agugaaugauggguucugacc

SEQ ID NO: 5258 - RNA, 22 nt, Homo sapiens
cagugcaaugaugaaagggcau

SEQ ID NO: 5259 - RNA, 23 nt, Homo sapiens
guccaguuuucccaggaaucccu

SEQ ID NO: 5260 - RNA, 23 nt, Homo sapiens
uuaaugcuaaucgugauaggggu

SEQ ID NO: 5261 - RNA, 23 nt, Homo sapiens
aacauucaacgcugucggugagu

SEQ ID NO: 5262 - RNA, 23 nt, Homo sapiens
aacauucauugcugucggugggu

SEQ ID NO: 5263 - RNA, 22 nt, Homo sapiens
aacauucaaccugucggugagu

SEQ ID NO: 5264 - RNA, 23 nt, Homo sapiens
aacauucauuguugucggugggu

SEQ ID NO: 5265 - RNA, 22 nt, Homo sapiens
acagcaggcacagacaggcagu

SEQ ID NO: 5266 - RNA, 22 nt, Homo sapiens
caaucacuaacuccacugccau

SEQ ID NO: 5267 - RNA, 22 nt, Homo sapiens
gccugcugggguggaaccuggu

SEQ ID NO: 5268 - RNA, 21 nt, Homo sapiens
caaagaggaaggucccauuac

SEQ ID NO: 5269 - RNA, 22 nt, Homo sapiens
cugcccuggcccgagggaccga

SEQ ID NO: 5270 - RNA, 20 nt, Homo sapiens
guagaggagauggcgcaggg

SEQ ID NO: 5271 - RNA, 22 nt, Homo sapiens
uggaauguaaagaaguauguau

SEQ ID NO: 5272 - RNA, 23 nt, Homo sapiens
ucaaaugcucagacuccuguggu

SEQ ID NO: 5273 - RNA, 21 nt, Homo sapiens
ccccaccuccucucuccucag

SEQ ID NO: 5274 - RNA, 18 nt, Homo sapiens
aucccaccucugccacca

SEQ ID NO: 5275 - RNA, 22 nt, Homo sapiens
uggguggucuggagauuugugc

SEQ ID NO: 5276 - RNA, 22 nt, Homo sapiens
cagugcaauguuaaaagggcau

SEQ ID NO: 5277 - RNA, 22 nt, Homo sapiens
ugagaacugaauuccauggguu

SEQ ID NO: 5278 - RNA, 22 nt, Homo sapiens
ugagaacugaauuccauaggcu

SEQ ID NO: 5279 - RNA, 23 nt, Homo sapiens
ucuggcuccgugucuucacuccc

SEQ ID NO: 5280 - RNA, 22 nt, Homo sapiens
uggaauguaaggaagugugugg

SEQ ID NO: 5281 - RNA, 21 nt, Homo sapiens
ccaccaccgugucugacacuu

SEQ ID NO: 5282 - RNA, 21 nt, Homo sapiens
aucacauugccagggauuucc

SEQ ID NO: 5283 - RNA, 21 nt, Homo sapiens
aucacauugccagggauuacc

SEQ ID NO: 5284 - RNA, 22 nt, Homo sapiens
aaggagcucacagucuauugag

SEQ ID NO: 5285 - RNA, 22 nt, Homo sapiens
agaucagaaggugauuguggcu

SEQ ID NO: 5286 - RNA, 22 nt, Homo sapiens
uguaaacauccuacacucagcu

SEQ ID NO: 5287 - RNA, 22 nt, Homo sapiens
ucaggcucaguccccucccgau

SEQ ID NO: 5288 - RNA, 21 nt, Homo sapiens
cagcagcacacugugguuugu

SEQ ID NO: 5289 - RNA, 20 nt, Homo sapiens
cugcaaagggaagcccuuuc

SEQ ID NO: 5290 - RNA, 20 nt, Homo sapiens
cugcaaagggaagcccuuuc

SEQ ID NO: 5291 - RNA, 22 nt, Homo sapiens
ccucccacacccaaggcuugca

SEQ ID NO: 5292 - RNA, 20 nt, Homo sapiens
aggaauguuccuucuuugcc

SEQ ID NO: 5293 - RNA, 20 nt, Homo sapiens
accaggaggcugaggccccu

SEQ ID NO: 5294 - RNA, 23 nt, Homo sapiens
aaggagcuuacaaucuagcuggg

SEQ ID NO: 5295 - RNA, 21 nt, Homo sapiens
uggaggagaaggaaggugaug

SEQ ID NO: 5296 - RNA, 22 nt, Homo sapiens
uggugguuuacaaaguaauuca

SEQ ID NO: 5297 - RNA, 22 nt, Homo sapiens
uggagagaaaggcaguuccuga

SEQ ID NO: 5298 - RNA, 22 nt, Homo sapiens
acucggcguggcgucggucgug

SEQ ID NO: 5299 - RNA, 21 nt, Homo sapiens
cggcggggacggcgauugguc

SEQ ID NO: 5300 - RNA, 22 nt, Homo sapiens
cauugcacuugucucggucuga

SEQ ID NO: 5301 - RNA, 21 nt, Homo sapiens
agggcccccccucaauccugu

SEQ ID NO: 5302 - RNA, 21 nt, Homo sapiens
agggcccccccucaauccugu

SEQ ID NO: 5303 - RNA, 22 nt, Homo sapiens
aucacacaaaggcaacuuuugu

SEQ ID NO: 5304 - RNA, 22 nt, Homo sapiens
aggcggggcgccgcgggaccgc

SEQ ID NO: 5305 - RNA, 22 nt, Homo sapiens
ugcggggcuagggcuaacagca

SEQ ID NO: 5306 - RNA, 22 nt, Homo sapiens
aacccguagauccgaucuugug

SEQ ID NO: 5307 - RNA, 22 nt, Homo sapiens
cacccguagaaccgaccuugcg

SEQ ID NO: 5308 - RNA, 22 nt, Homo sapiens
ucggccugaccacccaccccac

SEQ ID NO: 5309 - RNA, 17 nt, Homo sapiens
gugggggagaggcuguc

SEQ ID NO: 5310 - RNA, 25 nt, Homo sapiens
ugggaacggguuccggcagacgcug

SEQ ID NO: 5311 - RNA, 22 nt, Homo sapiens
cucggcgcggggcgcgggcucc

SEQ ID NO: 5312 - RNA, 23 nt, Homo sapiens
ucuggcuccgugucuucacuccc

SEQ ID NO: 5313 - RNA, 21 nt, Homo sapiens
uccugcgcgucccagaugccc

SEQ ID NO: 5314 - RNA, 21 nt, Homo sapiens
cggcggggacggcgauugguc

SEQ ID NO: 5315 - RNA, 22 nt, Homo sapiens
cauugcacuugucucggucuga

SEQ ID NO: 5316 - RNA, 23 nt, Homo sapiens
ucccccaggugugauucugauuu

SEQ ID NO: 5317 - RNA, 23 nt, Homo sapiens
ugaggggcagagagcgagacuuu

SEQ ID NO: 5318 - RNA, 19 nt, Homo sapiens
ugagcugcuguaccaaaau

SEQ ID NO: 5319 - RNA, 19 nt, Homo sapiens
aggcacggugucagcaggc

SEQ ID NO: 5320 - RNA, 24 nt, Homo sapiens
acugggggcuuucgggcucugcgu

SEQ ID NO: 5321 - RNA, 24 nt, Homo sapiens
ugccugggucucuggccugcgcgu

SEQ ID NO: 5322 - RNA, 22 nt, Homo sapiens
aggcggggcgccgcgggaccgc

SEQ ID NO: 5323 - RNA, 23 nt, Homo sapiens
cgggucggaguuagcucaagcgg

SEQ ID NO: 5324 - RNA, 20 nt, Homo sapiens
ggggagcuguggaagcagua

SEQ ID NO: 5325 - RNA, 25 nt, Homo sapiens
agggaucgcgggcggguggcggccu

SEQ ID NO: 5326 - RNA, 23 nt, Homo sapiens
gagggucuugggagggaugugac

SEQ ID NO: 5327 - RNA, 21 nt, Homo sapiens
gugccagcugcagugggggag

SEQ ID NO: 5328 - RNA, 18 nt, Homo sapiens
uugagaaggaggcugcug

SEQ ID NO: 5329 - RNA, 22 nt, Homo sapiens
uaacacugucugguaaagaugg

SEQ ID NO: 5330 - RNA, 22 nt, Homo sapiens
uaacacugucugguaacgaugu

SEQ ID NO: 5331 - RNA, 20 nt, Homo sapiens
accaggaggcugaggccccu

SEQ ID NO: 5332 - RNA, 22 nt, Homo sapiens
ugagccccugugccgcccccag

SEQ ID NO: 5333 - RNA, 22 nt, Homo sapiens
cagugcaaugaugaaagggcau

SEQ ID NO: 5334 - RNA, 18 nt, Homo sapiens
cagggaggugaaugugau

SEQ ID NO: 5335 - RNA, 22 nt, Homo sapiens
aguggggaacccuuccaugagg

SEQ ID NO: 5336 - RNA, 21 nt, Homo sapiens
caaagaggaaggucccauuac

SEQ ID NO: 5337 - RNA, 21 nt, Homo sapiens
gaagugugccguggugugucu

SEQ ID NO: 5338 - RNA, 20 nt, Homo sapiens
ggggagcuguggaagcagua

SEQ ID NO: 5339 - RNA, 22 nt, Homo sapiens
agaaggaaauugaauucauuua

SEQ ID NO: 5340 - RNA, 21 nt, Homo sapiens
cugaccuaugaauugacagcc

SEQ ID NO: 5341 - RNA, 21 nt, Homo sapiens
augaccuaugaauugacagac

SEQ ID NO: 5342 - RNA, 22 nt, Homo sapiens
gcugacuccuaguccagggcuc

SEQ ID NO: 5343 - RNA, 21 nt, Homo sapiens
caaagaggaaggucccauuac

SEQ ID NO: 5344 - RNA, 21 nt, Homo sapiens
ccgucgccgccacccgagccg

SEQ ID NO: 5345 - RNA, 18 nt, Homo sapiens
cgggcguggugguggggg

SEQ ID NO: 5346 - RNA, 17 nt, Homo sapiens
ucgccuccuccucuccc

SEQ ID NO: 5347 - RNA, 23 nt, Homo sapiens
uguaguguuuccuacuuuaugga

SEQ ID NO: 5348 - RNA, 20 nt, Homo sapiens
guguguggaaaugcuucugc

SEQ ID NO: 5349 - RNA, 20 nt, Homo sapiens
ccuccugcccuccuugcugu

SEQ ID NO: 5350 - RNA, 23 nt, Homo sapiens
caaagugcucauagugcagguag

SEQ ID NO: 5351 - RNA, 18 nt, Homo sapiens
ugcuuccuuucagagggu

SEQ ID NO: 5352 - RNA, 22 nt, Homo sapiens
aucuggagguaagaagcacuuu

SEQ ID NO: 5353 - RNA, 23 nt, Homo sapiens
gaacgcgcuucccuauagagggu

SEQ ID NO: 5354 - RNA, 21 nt, Homo sapiens
aagccugcccggcuccucggg

SEQ ID NO: 5355 - RNA, 22 nt, Homo sapiens
cacacacugcaauuacuuuugc

SEQ ID NO: 5356 - RNA, 21 nt, Homo sapiens
aaggcagggcccccgcucccc

SEQ ID NO: 5357 - RNA, 23 nt, Homo sapiens
uauucauuuauccccagccuaca

SEQ ID NO: 5358 - RNA, 21 nt, Homo sapiens
guggcugcacucacuuccuuc

SEQ ID NO: 5359 - RNA, 23 nt, Homo sapiens
cggcccgggcugcugcuguuccu

SEQ ID NO: 5360 - RNA, 23 nt, Homo sapiens
cggcccgggcugcugcuguuccu

SEQ ID NO: 5361 - RNA, 21 nt, Homo sapiens
agggcccccccucaauccugu

SEQ ID NO: 5362 - RNA, 22 nt, Homo sapiens
cgucaacacuugcugguuuccu

SEQ ID NO: 5363 - RNA, 20 nt, Homo sapiens
accaggaggcugaggccccu

SEQ ID NO: 5364 - RNA, 22 nt, Homo sapiens
ugcggggcuagggcuaacagca

SEQ ID NO: 5365 - RNA, 22 nt, Homo sapiens
cugcccuggcccgagggaccga

SEQ ID NO: 5366 - RNA, 22 nt, Homo sapiens
ucaccagcccuguguucccuag

SEQ ID NO: 5367 - RNA, 22 nt, Homo sapiens
acgcccuucccccccuucuuca

SEQ ID NO: 5368 - RNA, 22 nt, Homo sapiens
acgcccuucccccccuucuuca

SEQ ID NO: 5369 - RNA, 23 nt, Homo sapiens
agcugguguugugaaucaggccg

SEQ ID NO: 5370 - RNA, 21 nt, Homo sapiens
cggcggggacggcgauugguc

SEQ ID NO: 5371 - RNA, 20 nt, Homo sapiens
uguuuugauaacaguaaugu

SEQ ID NO: 5372 - RNA, 20 nt, Homo sapiens
ccucugggcccuuccuccag

SEQ ID NO: 5373 - RNA, 22 nt, Homo sapiens
ucucugggccugugucuuaggc

SEQ ID NO: 5374 - RNA, 21 nt, Homo sapiens
gccccugggccuauccuagaa

SEQ ID NO: 5375 - RNA, 22 nt, Homo sapiens
ucaggcucaguccccucccgau

SEQ ID NO: 5376 - RNA, 22 nt, Homo sapiens
aggcggggcgccgcgggaccgc

SEQ ID NO: 5377 - RNA, 20 nt, Homo sapiens
cggcucugggucugugggga

SEQ ID NO: 5378 - RNA, 20 nt, Homo sapiens
ggggagcuguggaagcagua

SEQ ID NO: 5379 - RNA, 24 nt, Homo sapiens
gaccuggacauguuugugcccagu

SEQ ID NO: 5380 - RNA, 21 nt, Homo sapiens
uggcagggaggcugggagggg

SEQ ID NO: 5381 - RNA, 22 nt, Homo sapiens
cuggacugagccgugcuacugg

SEQ ID NO: 5382 - RNA, 22 nt, Homo sapiens
gguccagaggggagauagguuc

SEQ ID NO: 5383 - RNA, 22 nt, Homo sapiens
aaggagcucacagucuauugag

SEQ ID NO: 5384 - RNA, 21 nt, Homo sapiens
acuggacuuggagucagaagg

SEQ ID NO: 5385 - RNA, 22 nt, Homo sapiens
acuggacuuagggucagaaggc

SEQ ID NO: 5386 - RNA, 21 nt, Homo sapiens
gcaguccaugggcauauacac

SEQ ID NO: 5387 - RNA, 20 nt, Homo sapiens
ccauggaucuccaggugggu

SEQ ID NO: 5388 - RNA, 18 nt, Homo sapiens
uucacagggaggugucau

SEQ ID NO: 5389 - RNA, 23 nt, Homo sapiens
caaagcgcuucucuuuagagugu

SEQ ID NO: 5390 - RNA, 21 nt, Homo sapiens
cuccagagggaaguacuuucu

SEQ ID NO: 5391 - RNA, 21 nt, Homo sapiens
cuccagagggaugcacuuucu

SEQ ID NO: 5392 - RNA, 22 nt, Homo sapiens
cgaaaacagcaauuaccuuugc

SEQ ID NO: 5393 - RNA, 21 nt, Homo sapiens
guggcugcacucacuuccuuc

SEQ ID NO: 5394 - RNA, 23 nt, Homo sapiens
aaggagcuuacaaucuagcuggg

SEQ ID NO: 5395 - RNA, 21 nt, Homo sapiens
aaggcagggcccccgcucccc

SEQ ID NO: 5396 - RNA, 22 nt, Homo sapiens
uggguggucuggagauuugugc

SEQ ID NO: 5397 - RNA, 18 nt, Homo sapiens
cagggaggugaaugugau

SEQ ID NO: 5398 - RNA, 22 nt, Homo sapiens
uggagagaaaggcaguuccuga

SEQ ID NO: 5399 - RNA, 23 nt, Homo sapiens
uaaggugcaucuagugcagauag

SEQ ID NO: 5400 - RNA, 22 nt, Homo sapiens
cccugugcccggcccacuucug

SEQ ID NO: 5401 - RNA, 20 nt, Homo sapiens
ccccagggcgacgcggcggg

SEQ ID NO: 5402 - RNA, 23 nt, Homo sapiens
cccaguguucagacuaccuguuc

SEQ ID NO: 5403 - RNA, 23 nt, Homo sapiens
cccaguguuuagacuaucuguuc

SEQ ID NO: 5404 - RNA, 21 nt, Homo sapiens
gccccugggccuauccuagaa

SEQ ID NO: 5405 - RNA, 22 nt, Homo sapiens
aauugcacgguauccaucugua

SEQ ID NO: 5406 - RNA, 22 nt, Homo sapiens
agaggcuggccgugaugaauuc

SEQ ID NO: 5407 - RNA, 22 nt, Homo sapiens
aguggggaacccuuccaugagg

SEQ ID NO: 5408 - RNA, 19 nt, Homo sapiens
gagccaguuggacaggagc

SEQ ID NO: 5409 - RNA, 25 nt, Homo sapiens
aggggugguguugggacagcuccgu

SEQ ID NO: 5410 - RNA, 22 nt, Homo sapiens
gucccucuccaaaugugucuug

SEQ ID NO: 5411 - RNA, 24 nt, Homo sapiens
ugccugggucucuggccugcgcgu

SEQ ID NO: 5412 - RNA, 23 nt, Homo sapiens
aggaagcccuggaggggcuggag

SEQ ID NO: 5413 - RNA, 21 nt, Homo sapiens
uggaggagaaggaaggugaug

SEQ ID NO: 5414 - RNA, 22 nt, Homo sapiens
cugcccuggcccgagggaccga

SEQ ID NO: 5415 - RNA, 22 nt, Homo sapiens
cacuggcuccuuucuggguaga

SEQ ID NO: 5416 - RNA, 20 nt, Homo sapiens
ggggagcuguggaagcagua

SEQ ID NO: 5417 - RNA, 21 nt, Homo sapiens
aaggcagggcccccgcucccc

SEQ ID NO: 5418 - RNA, 22 nt, Homo sapiens
ugagguaguagguuguauaguu

SEQ ID NO: 5419 - RNA, 22 nt, Homo sapiens
ugagguaguagguugugugguu

SEQ ID NO: 5420 - RNA, 19 nt, Homo sapiens
ugucucugcugggguuucu

SEQ ID NO: 5421 - RNA, 21 nt, Homo sapiens
auauaugaugacuuagcuuuu

SEQ ID NO: 5422 - RNA, 18 nt, Homo sapiens
cagggaggugaaugugau

SEQ ID NO: 5423 - RNA, 21 nt, Homo sapiens
uaccacaggguagaaccacgg

SEQ ID NO: 5424 - RNA, 23 nt, Homo sapiens
ucuggcuccgugucuucacuccc

SEQ ID NO: 5425 - RNA, 22 nt, Homo sapiens
uagcuuaucagacugauguuga

SEQ ID NO: 5426 - RNA, 22 nt, Homo sapiens
gaggguuggguggaggcucucc

SEQ ID NO: 5427 - RNA, 21 nt, Homo sapiens
auguaugugugcaugugcaug

SEQ ID NO: 5428 - RNA, 24 nt, Homo sapiens
agcagaagcagggagguucuccca

SEQ ID NO: 5429 - RNA, 22 nt, Homo sapiens
auucugcauuuuuagcaaguuc

SEQ ID NO: 5430 - RNA, 20 nt, Homo sapiens
auguauaaauguauacacac

SEQ ID NO: 5431 - RNA, 23 nt, Homo sapiens
ugagugugugugugugagugugu

SEQ ID NO: 5432 - RNA, 22 nt, Homo sapiens
ugugucacucgaugaccacugu

SEQ ID NO: 5433 - RNA, 22 nt, Homo sapiens
cacacacugcaauuacuuuugc

SEQ ID NO: 5434 - RNA, 22 nt, Homo sapiens
gucccucuccaaaugugucuug

SEQ ID NO: 5435 - RNA, 22 nt, Homo sapiens
ugagccccugugccgcccccag

SEQ ID NO: 5436 - RNA, 17 nt, Homo sapiens
gugggggagaggcuguc

SEQ ID NO: 5437 - RNA, 21 nt, Homo sapiens
cggcggggacggcgauugguc

SEQ ID NO: 5438 - RNA, 20 nt, Homo sapiens
ccccagggcgacgcggcggg

SEQ ID NO: 5439 - RNA, 23 nt, Homo sapiens
caacggaaucccaaaagcagcug

SEQ ID NO: 5440 - RNA, 23 nt, Homo sapiens
ucccccaggugugauucugauuu

SEQ ID NO: 5441 - RNA, 22 nt, Homo sapiens
uggugggcacagaaucuggacu

SEQ ID NO: 5442 - RNA, 25 nt, Homo sapiens
aggggugguguugggacagcuccgu

SEQ ID NO: 5443 - RNA, 24 nt, Homo sapiens
acugggggcuuucgggcucugcgu

SEQ ID NO: 5444 - RNA, 22 nt, Homo sapiens
uggugggccgcagaacaugugc

SEQ ID NO: 5445 - RNA, 22 nt, Homo sapiens
aggcggggcgccgcgggaccgc

SEQ ID NO: 5446 - RNA, 22 nt, Homo sapiens
ugcggggcuagggcuaacagca

SEQ ID NO: 5447 - RNA, 24 nt, Homo sapiens
uggggagcugaggcucugggggug

SEQ ID NO: 5448 - RNA, 22 nt, Homo sapiens
ucaccagcccuguguucccuag

SEQ ID NO: 5449 - RNA, 23 nt, Homo sapiens
agcugguguugugaaucaggccg

SEQ ID NO: 5450 - RNA, 22 nt, Homo sapiens
cauugcacuugucucggucuga

SEQ ID NO: 5451 - RNA, 23 nt, Homo sapiens
ucaagagcaauaacgaaaaaugu

SEQ ID NO: 5452 - RNA, 23 nt, Homo sapiens
ugagcgccucgacgacagagccg

SEQ ID NO: 5453 - RNA, 22 nt, Homo sapiens
ucaggcucaguccccucccgau

SEQ ID NO: 5454 - RNA, 23 nt, Homo sapiens
cacccggcugugugcacaugugc

SEQ ID NO: 5455 - RNA, 22 nt, Homo sapiens
uucauucggcuguccagaugua

SEQ ID NO: 5456 - RNA, 23 nt, Homo sapiens
uuaaugcuaaucgugauaggggu

SEQ ID NO: 5457 - RNA, 22 nt, Homo sapiens
aacuggccuacaaagucccagu

SEQ ID NO: 5458 - RNA, 22 nt, Homo sapiens
aacuggcccucaaagucccgcu

SEQ ID NO: 5459 - RNA, 23 nt, Homo sapiens
cucucaccacugcccucccacag

SEQ ID NO: 5460 - RNA, 22 nt, Homo sapiens
uuagggcccuggcuccaucucc

SEQ ID NO: 5461 - RNA, 22 nt, Homo sapiens
acucggcguggcgucggucgug

SEQ ID NO: 5462 - RNA, 18 nt, Homo sapiens
cagggaggugaaugugau

SEQ ID NO: 5463 - RNA, 23 nt, Homo sapiens
ucuggcuccgugucuucacuccc

SEQ ID NO: 5464 - RNA, 23 nt, Homo sapiens
ugaggggcagagagcgagacuuu

SEQ ID NO: 5465 - RNA, 19 nt, Homo sapiens
aagcagcugccucugaggc

SEQ ID NO: 5466 - RNA, 24 nt, Homo sapiens
ugccugggucucuggccugcgcgu

SEQ ID NO: 5467 - RNA, 22 nt, Homo sapiens
ugcggggcuagggcuaacagca

SEQ ID NO: 5468 - RNA, 20 nt, Homo sapiens
ggggagcuguggaagcagua

SEQ ID NO: 5469 - RNA, 22 nt, Homo sapiens
ugugcgcagggagaccucuccc

SEQ ID NO: 5470 - RNA, 22 nt, Homo sapiens
aacccguagauccgaucuugug

SEQ ID NO: 5471 - RNA, 22 nt, Homo sapiens
cacccguagaaccgaccuugcg

SEQ ID NO: 5472 - RNA, 20 nt, Homo sapiens
ucugcaggguuugcuuugag

SEQ ID NO: 5473 - RNA, 17 nt, Homo sapiens
ucgccuccuccucuccc

SEQ ID NO: 5474 - RNA, 22 nt, Homo sapiens
uggguggucuggagauuugugc

SEQ ID NO: 5475 - RNA, 18 nt, Homo sapiens
cagggaggugaaugugau

SEQ ID NO: 5476 - RNA, 21 nt, Homo sapiens
cggcggggacggcgauugguc

SEQ ID NO: 5477 - RNA, 22 nt, Homo sapiens
aggugguccguggcgcguucgc

SEQ ID NO: 5478 - RNA, 23 nt, Homo sapiens
ugagcgccucgacgacagagccg

SEQ ID NO: 5479 - RNA, 20 nt, Homo sapiens
guccgcucggcgguggccca

SEQ ID NO: 5480 - RNA, 25 nt, Homo sapiens
ggcggagggaaguagguccguuggu

SEQ ID NO: 5481 - RNA, 22 nt, Homo sapiens
aggcggggcgccgcgggaccgc

SEQ ID NO: 5482 - RNA, 22 nt, Homo sapiens
ugcggggcuagggcuaacagca

SEQ ID NO: 5483 - RNA, 21 nt, Homo sapiens
uggaggagaaggaaggugaug

SEQ ID NO: 5484 - RNA, 21 nt, Homo sapiens
cgcgggugcuuacugacccuu

SEQ ID NO: 5485 - RNA, 22 nt, Homo sapiens
auccgcgcucugacucucugcc

SEQ ID NO: 5486 - RNA, 23 nt, Homo sapiens
cacccggcugugugcacaugugc

SEQ ID NO: 5487 - RNA, 20 nt, Homo sapiens
uaaagagcccuguggagaca

SEQ ID NO: 5488 - RNA, 22 nt, Homo sapiens
cagugcaaugaugaaagggcau

SEQ ID NO: 5489 - RNA, 23 nt, Homo sapiens
ucuggcuccgugucuucacuccc

SEQ ID NO: 5490 - RNA, 22 nt, Homo sapiens
uagcagcacauaaugguuugug

SEQ ID NO: 5491 - RNA, 22 nt, Homo sapiens
uagcagcacaucaugguuuaca

SEQ ID NO: 5492 - RNA, 22 nt, Homo sapiens
uagcagcacguaaauauuggcg

SEQ ID NO: 5493 - RNA, 23 nt, Homo sapiens
ugaguaccgccaugucuguuggg

SEQ ID NO: 5494 - RNA, 21 nt, Homo sapiens
uagcagcacagaaauauuggc

SEQ ID NO: 5495 - RNA, 22 nt, Homo sapiens
uggcucaguucagcaggaacag

SEQ ID NO: 5496 - RNA, 22 nt, Homo sapiens
aaggagcucacagucuauugag

SEQ ID NO: 5497 - RNA, 22 nt, Homo sapiens
cagcagcaauucauguuuugaa

SEQ ID NO: 5498 - RNA, 22 nt, Homo sapiens
agaggcuggccgugaugaauuc

SEQ ID NO: 5499 - RNA, 21 nt, Homo sapiens
cagcagcacacugugguuugu

SEQ ID NO: 5500 - RNA, 23 nt, Homo sapiens
uagcagcgggaacaguucugcag

SEQ ID NO: 5501 - RNA, 23 nt, Homo sapiens
gcgaggaccccucggggucugac

SEQ ID NO: 5502 - RNA, 20 nt, Homo sapiens
accaggaggcugaggccccu

SEQ ID NO: 5503 - RNA, 23 nt, Homo sapiens
aaggagcuuacaaucuagcuggg

SEQ ID NO: 5504 - RNA, 21 nt, Homo sapiens
uggaggagaaggaaggugaug

SEQ ID NO: 5505 - RNA, 22 nt, Homo sapiens
acuccagccccacagccucagc

SEQ ID NO: 5506 - RNA, 22 nt, Homo sapiens
ugugcgcagggagaccucuccc

SEQ ID NO: 5507 - RNA, 21 nt, Homo sapiens
uggacugcccugaucuggaga

SEQ ID NO: 5508 - RNA, 21 nt, Homo sapiens
cggcggggacggcgauugguc

SEQ ID NO: 5509 - RNA, 22 nt, Homo sapiens
agaggcuggccgugaugaauuc

SEQ ID NO: 5510 - RNA, 22 nt, Homo sapiens
agacccuggucugcacucuauc

SEQ ID NO: 5511 - RNA, 20 nt, Homo sapiens
guccgcucggcgguggccca

SEQ ID NO: 5512 - RNA, 22 nt, Homo sapiens
uccgagccugggucucccucuu

SEQ ID NO: 5513 - RNA, 22 nt, Homo sapiens
aggcggggcgccgcgggaccgc

SEQ ID NO: 5514 - RNA, 22 nt, Homo sapiens
ugcggggcuagggcuaacagca

SEQ ID NO: 5515 - RNA, 20 nt, Homo sapiens
gugucugggcggacagcugc

SEQ ID NO: 5516 - RNA, 22 nt, Homo sapiens
ucguaccgugaguaauaaugcg

SEQ ID NO: 5517 - RNA, 23 nt, Homo sapiens
guccaguuuucccaggaaucccu

SEQ ID NO: 5518 - RNA, 21 nt, Homo sapiens
auguaugugugcaugugcaug

SEQ ID NO: 5519 - RNA, 22 nt, Homo sapiens
augcugacauauuuacuagagg

SEQ ID NO: 5520 - RNA, 22 nt, Homo sapiens
aaauuauuguacaucggaugag

SEQ ID NO: 5521 - RNA, 22 nt, Homo sapiens
ugagccccugugccgcccccag

SEQ ID NO: 5522 - RNA, 17 nt, Homo sapiens
gugggggagaggcuguc

SEQ ID NO: 5523 - RNA, 22 nt, Homo sapiens
acucggcguggcgucggucgug

SEQ ID NO: 5524 - RNA, 18 nt, Homo sapiens
cagggaggugaaugugau

SEQ ID NO: 5525 - RNA, 22 nt, Homo sapiens
cucggcgcggggcgcgggcucc

SEQ ID NO: 5526 - RNA, 23 nt, Homo sapiens
ucuggcuccgugucuucacuccc

SEQ ID NO: 5527 - RNA, 23 nt, Homo sapiens
uaaggugcaucuagugcagauag

SEQ ID NO: 5528 - RNA, 21 nt, Homo sapiens
cggcggggacggcgauugguc

SEQ ID NO: 5529 - RNA, 22 nt, Homo sapiens
aagcugccaguugaagaacugu

SEQ ID NO: 5530 - RNA, 22 nt, Homo sapiens
ucaggcucaguccccucccgau

SEQ ID NO: 5531 - RNA, 21 nt, Homo sapiens
aagccugcccggcuccucggg

SEQ ID NO: 5532 - RNA, 25 nt, Homo sapiens
aggggugguguugggacagcuccgu

SEQ ID NO: 5533 - RNA, 22 nt, Homo sapiens
gucccucuccaaaugugucuug

SEQ ID NO: 5534 - RNA, 22 nt, Homo sapiens
aggcggggcgccgcgggaccgc

SEQ ID NO: 5535 - RNA, 22 nt, Homo sapiens
ugcggggcuagggcuaacagca

SEQ ID NO: 5536 - RNA, 21 nt, Homo sapiens
uggaggagaaggaaggugaug

SEQ ID NO: 5537 - RNA, 22 nt, Homo sapiens
acuccagccccacagccucagc

SEQ ID NO: 5538 - RNA, 20 nt, Homo sapiens
ggggagcuguggaagcagua

SEQ ID NO: 5539 - RNA, 21 nt, Homo sapiens
ugacaacuauggaugagcucu

SEQ ID NO: 5540 - RNA, 22 nt, Homo sapiens
agaaggaaauugaauucauuua

SEQ ID NO: 5541 - RNA, 18 nt, Homo sapiens
cagggaggugaaugugau

SEQ ID NO: 5542 - RNA, 21 nt, Homo sapiens
uccugcgcgucccagaugccc

SEQ ID NO: 5543 - RNA, 22 nt, Homo sapiens
uagguaguuuccuguuguuggg

SEQ ID NO: 5544 - RNA, 22 nt, Homo sapiens
ugucaguuugucaaauacccca

SEQ ID NO: 5545 - RNA, 21 nt, Homo sapiens
ugagaugaagcacuguagcuc

SEQ ID NO: 5546 - RNA, 21 nt, Homo sapiens
uaguagaccguauagcguacg

SEQ ID NO: 5547 - RNA, 22 nt, Homo sapiens
gcugacuccuaguccagggcuc

SEQ ID NO: 5548 - RNA, 21 nt, Homo sapiens
acuggacuuggagucagaagg

SEQ ID NO: 5549 - RNA, 22 nt, Homo sapiens
ugugcgcagggagaccucuccc

SEQ ID NO: 5550 - RNA, 21 nt, Homo sapiens
ccaccaccgugucugacacuu

SEQ ID NO: 5551 - RNA, 22 nt, Homo sapiens
cagugcaaugaugaaagggcau

SEQ ID NO: 5552 - RNA, 21 nt, Homo sapiens
caaagaggaaggucccauuac

SEQ ID NO: 5553 - RNA, 22 nt, Homo sapiens
ugagguaguagguuguauaguu

SEQ ID NO: 5554 - RNA, 22 nt, Homo sapiens
ugagguaguagguugugugguu

SEQ ID NO: 5555 - RNA, 22 nt, Homo sapiens
ugagguaguagguuguaugguu

SEQ ID NO: 5556 - RNA, 22 nt, Homo sapiens
agagguaguagguugcauaguu

SEQ ID NO: 5557 - RNA, 22 nt, Homo sapiens
ugagguaggagguuguauaguu

SEQ ID NO: 5558 - RNA, 22 nt, Homo sapiens
ugagguaguagauuguauaguu

SEQ ID NO: 5559 - RNA, 22 nt, Homo sapiens
ugagguaguaguuuguacaguu

SEQ ID NO: 5560 - RNA, 22 nt, Homo sapiens
ugagguaguaguuugugcuguu

SEQ ID NO: 5561 - RNA, 22 nt, Homo sapiens
ugagguaguaguuugugcuguu

SEQ ID NO: 5562 - RNA, 21 nt, Homo sapiens
ccccaccuccucucuccucag

SEQ ID NO: 5563 - RNA, 22 nt, Homo sapiens
ucguaccgugaguaauaaugcg

SEQ ID NO: 5564 - RNA, 18 nt, Homo sapiens
aucccaccucugccacca

SEQ ID NO: 5565 - RNA, 17 nt, Homo sapiens
ucgccuccuccucuccc

SEQ ID NO: 5566 - RNA, 21 nt, Homo sapiens
ugcaggaccaagaugagcccu

SEQ ID NO: 5567 - RNA, 22 nt, Homo sapiens
uuuucaacucuaaugggagaga

SEQ ID NO: 5568 - RNA, 23 nt, Homo sapiens
ucuggcuccgugucuucacuccc

SEQ ID NO: 5569 - RNA, 21 nt, Homo sapiens
uccugcgcgucccagaugccc

SEQ ID NO: 5570 - RNA, 22 nt, Homo sapiens
uguaaacauccuacacucagcu

SEQ ID NO: 5571 - RNA, 21 nt, Homo sapiens
ucacuccucuccucccgucuu

SEQ ID NO: 5572 - RNA, 21 nt, Homo sapiens
aaagcgcuucccuucagagug

SEQ ID NO: 5573 - RNA, 22 nt, Homo sapiens
ccucccacacccaaggcuugca

SEQ ID NO: 5574 - RNA, 25 nt, Homo sapiens
aggggugguguugggacagcuccgu

SEQ ID NO: 5575 - RNA, 22 nt, Homo sapiens
auccgcgcucugacucucugcc

SEQ ID NO: 5576 - RNA, 22 nt, Homo sapiens
ugagguaguaaguuguauuguu

SEQ ID NO: 5577 - RNA, 22 nt, Homo sapiens
aacuggcccucaaagucccgcu

SEQ ID NO: 5578 - RNA, 22 nt, Homo sapiens
ugucaguuugucaaauacccca

SEQ ID NO: 5579 - RNA, 22 nt, Homo sapiens
aaaagcuggguugagagggcga

SEQ ID NO: 5580 - RNA, 22 nt, Homo sapiens
aaaagcuggguugagagggcaa

SEQ ID NO: 5581 - RNA, 20 nt, Homo sapiens
aaaagcuggguugagagggu

SEQ ID NO: 5582 - RNA, 19 nt, Homo sapiens
aaaagcuggguugagagga

SEQ ID NO: 5583 - RNA, 22 nt, Homo sapiens
aguauucuguaccagggaaggu

SEQ ID NO: 5584 - RNA, 23 nt, Homo sapiens
uauggcuuuucauuccuauguga

SEQ ID NO: 5585 - RNA, 22 nt, Homo sapiens
aacacaccugguuaaccucuuu

SEQ ID NO: 5586 - RNA, 22 nt, Homo sapiens
aacacaccuauucaaggauuca

SEQ ID NO: 5587 - RNA, 21 nt, Homo sapiens
ugaguuggccaucugagugag

SEQ ID NO: 5588 - RNA, 21 nt, Homo sapiens
cggcggggacggcgauugguc

SEQ ID NO: 5589 - RNA, 22 nt, Homo sapiens
aggcggggcgccgcgggaccgc

SEQ ID NO: 5590 - RNA, 21 nt, Homo sapiens
uccugcgcgucccagaugccc

SEQ ID NO: 5591 - RNA, 21 nt, Homo sapiens
cggcggggacggcgauugguc

SEQ ID NO: 5592 - RNA, 23 nt, Homo sapiens
ugaguaccgccaugucuguuggg

SEQ ID NO: 5593 - RNA, 22 nt, Homo sapiens
cauugcacuugucucggucuga

SEQ ID NO: 5594 - RNA, 23 nt, Homo sapiens
ucccccaggugugauucugauuu

SEQ ID NO: 5595 - RNA, 23 nt, Homo sapiens
ugaggggcagagagcgagacuuu

SEQ ID NO: 5596 - RNA, 23 nt, Homo sapiens
aggaccugcgggacaagauucuu

SEQ ID NO: 5597 - RNA, 19 nt, Homo sapiens
ugagcugcuguaccaaaau

SEQ ID NO: 5598 - RNA, 24 nt, Homo sapiens
acugggggcuuucgggcucugcgu

SEQ ID NO: 5599 - RNA, 19 nt, Homo sapiens
aagcagcugccucugaggc

SEQ ID NO: 5600 - RNA, 22 nt, Homo sapiens
aggcggggcgccgcgggaccgc

SEQ ID NO: 5601 - RNA, 22 nt, Homo sapiens
ugcggggcuagggcuaacagca

SEQ ID NO: 5602 - RNA, 21 nt, Homo sapiens
uggaggagaaggaaggugaug

SEQ ID NO: 5603 - RNA, 22 nt, Homo sapiens
ugagccccugugccgcccccag

SEQ ID NO: 5604 - RNA, 22 nt, Homo sapiens
uggagugugacaaugguguuug

SEQ ID NO: 5605 - RNA, 18 nt, Homo sapiens
aucccaccucugccacca

SEQ ID NO: 5606 - RNA, 22 nt, Homo sapiens
uacccagagcaugcagugugaa

SEQ ID NO: 5607 - RNA, 22 nt, Homo sapiens
ugggucuuugcgggcgagauga

SEQ ID NO: 5608 - RNA, 22 nt, Homo sapiens
uagguaguuucauguuguuggg

SEQ ID NO: 5609 - RNA, 22 nt, Homo sapiens
aauugcacuuuagcaaugguga

SEQ ID NO: 5610 - RNA, 23 nt, Homo sapiens
ugaggggcagagagcgagacuuu

SEQ ID NO: 5611 - RNA, 21 nt, Homo sapiens
uugaaaggcuauuucuugguc

SEQ ID NO: 5612 - RNA, 22 nt, Homo sapiens
aacaucacagcaagucugugcu

SEQ ID NO: 5613 - RNA, 24 nt, Homo sapiens
uucuccaaaagaaagcacuuucug

SEQ ID NO: 5614 - RNA, 22 nt, Homo sapiens
aagugccuccuuuuagaguguu

SEQ ID NO: 5615 - RNA, 22 nt, Homo sapiens
ccucccacacccaaggcuugca

SEQ ID NO: 5616 - RNA, 21 nt, Homo sapiens
ucuuguguucucuagaucagu

SEQ ID NO: 5617 - RNA, 22 nt, Homo sapiens
ugcggggcuagggcuaacagca

SEQ ID NO: 5618 - RNA, 22 nt, Homo sapiens
acagcaggcacagacaggcagu

SEQ ID NO: 5619 - RNA, 22 nt, Homo sapiens
uggcucaguucagcaggaacag

SEQ ID NO: 5620 - RNA, 22 nt, Homo sapiens
uggcagugucuuagcugguugu

SEQ ID NO: 5621 - RNA, 22 nt, Homo sapiens
caaucacuaacuccacugccau

SEQ ID NO: 5622 - RNA, 23 nt, Homo sapiens
aggcaguguaguuagcugauugc

SEQ ID NO: 5623 - RNA, 23 nt, Homo sapiens
ucccccaggugugauucugauuu

SEQ ID NO: 5624 - RNA, 22 nt, Homo sapiens
gccugcugggguggaaccuggu

SEQ ID NO: 5625 - RNA, 22 nt, Homo sapiens
uggcaguguauuguuagcuggu

SEQ ID NO: 5626 - RNA, 22 nt, Homo sapiens
aggcaguguauuguuagcuggc

SEQ ID NO: 5627 - RNA, 22 nt, Homo sapiens
ucaggcucaguccccucccgau

SEQ ID NO: 5628 - RNA, 21 nt, Homo sapiens
aagccugcccggcuccucggg

SEQ ID NO: 5629 - RNA, 24 nt, Homo sapiens
acugggggcuuucgggcucugcgu

SEQ ID NO: 5630 - RNA, 24 nt, Homo sapiens
ugccugggucucuggccugcgcgu

SEQ ID NO: 5631 - RNA, 20 nt, Homo sapiens
ggggagcuguggaagcagua

SEQ ID NO: 5632 - RNA, 22 nt, Homo sapiens
uuuccggcucgcgugggugugu

SEQ ID NO: 5633 - RNA, 22 nt, Homo sapiens
ucaccagcccuguguucccuag

SEQ ID NO: 5634 - RNA, 23 nt, Homo sapiens
agcugguguugugaaucaggccg

SEQ ID NO: 5635 - RNA, 23 nt, Homo sapiens
ucuggcuccgugucuucacuccc

SEQ ID NO: 5636 - RNA, 21 nt, Homo sapiens
cggcggggacggcgauugguc

SEQ ID NO: 5637 - RNA, 23 nt, Homo sapiens
ugaguaccgccaugucuguuggg

SEQ ID NO: 5638 - RNA, 22 nt, Homo sapiens
ucugcccccuccgcugcugcca

SEQ ID NO: 5639 - RNA, 23 nt, Homo sapiens
agcuacauugucugcuggguuuc

SEQ ID NO: 5640 - RNA, 20 nt, Homo sapiens
acugccccaggugcugcugg

SEQ ID NO: 5641 - RNA, 21 nt, Homo sapiens
gccccugggccuauccuagaa

SEQ ID NO: 5642 - RNA, 23 nt, Homo sapiens
ugaggggcagagagcgagacuuu

SEQ ID NO: 5643 - RNA, 21 nt, Homo sapiens
cggggcagcucaguacaggau

SEQ ID NO: 5644 - RNA, 19 nt, Homo sapiens
aggcugcggaauucaggac

SEQ ID NO: 5645 - RNA, 22 nt, Homo sapiens
aggcggggcgccgcgggaccgc

SEQ ID NO: 5646 - RNA, 23 nt, Homo sapiens
acuuacagacaagagccuugcuc

SEQ ID NO: 5647 - RNA, 22 nt, Homo sapiens
uggagugugacaaugguguuug

SEQ ID NO: 5648 - RNA, 17 nt, Homo sapiens
ucccuguucgggcgcca

SEQ ID NO: 5649 - RNA, 18 nt, Homo sapiens
ugaggcaguagauugaau

SEQ ID NO: 5650 - RNA, 23 nt, Homo sapiens
uaagugcuuccauguuuuaguag

SEQ ID NO: 5651 - RNA, 23 nt, Homo sapiens
uaagugcuuccauguuugagugu

SEQ ID NO: 5652 - RNA, 21 nt, Homo sapiens
uggaggagaaggaaggugaug

SEQ ID NO: 5653 - RNA, 21 nt, Homo sapiens
aaggcagggcccccgcucccc

SEQ ID NO: 5654 - RNA, 22 nt, Homo sapiens
cuuggcaccuagcaagcacuca

SEQ ID NO: 5655 - RNA, 22 nt, Homo sapiens
aacuguuugcagaggaaacuga

SEQ ID NO: 5656 - RNA, 21 nt, Homo sapiens
auccuugcuaucugggugcua

SEQ ID NO: 5657 - RNA, 19 nt, Homo sapiens
ugucucugcugggguuucu

SEQ ID NO: 5658 - RNA, 21 nt, Homo sapiens
agggggaaaguucuauagucc

SEQ ID NO: 5659 - RNA, 23 nt, Homo sapiens
uuuggcacuagcacauuuuugcu

SEQ ID NO: 5660 - RNA, 27 nt, Homo sapiens
accuucuuguauaagcacugugcuaaa

SEQ ID NO: 5661 - RNA, 22 nt, Homo sapiens
acgcccuucccccccuucuuca

SEQ ID NO: 5662 - RNA, 24 nt, Homo sapiens
agccuggaagcuggagccugcagu

SEQ ID NO: 5663 - RNA, 18 nt, Homo sapiens
gcaugggugguucagugg

SEQ ID NO: 5664 - RNA, 22 nt, Homo sapiens
gcccgcguguggagccaggugu

SEQ ID NO: 5665 - RNA, 21 nt, Homo sapiens
cggcggggacggcgauugguc

SEQ ID NO: 5666 - RNA, 23 nt, Homo sapiens
caacggaaucccaaaagcagcug

SEQ ID NO: 5667 - RNA, 21 nt, Homo sapiens
aggcaagaugcuggcauagcu

SEQ ID NO: 5668 - RNA, 22 nt, Homo sapiens
caaccuggaggacuccaugcug

SEQ ID NO: 5669 - RNA, 22 nt, Homo sapiens
ugugacagauugauaacugaaa

SEQ ID NO: 5670 - RNA, 22 nt, Homo sapiens
aggcggggcgccgcgggaccgc

SEQ ID NO: 5671 - RNA, 21 nt, Homo sapiens
ccccaccuccucucuccucag

SEQ ID NO: 5672 - RNA, 22 nt, Homo sapiens
uguaacagcaacuccaugugga

SEQ ID NO: 5673 - RNA, 22 nt, Homo sapiens
aguggggaacccuuccaugagg

SEQ ID NO: 5674 - RNA, 22 nt, Homo sapiens
uggagugugacaaugguguuug

SEQ ID NO: 5675 - RNA, 24 nt, Homo sapiens
agccuggaagcuggagccugcagu

SEQ ID NO: 5676 - RNA, 21 nt, Homo sapiens
uaccacaggguagaaccacgg

SEQ ID NO: 5677 - RNA, 22 nt, Homo sapiens
ucucccaacccuuguaccagug

SEQ ID NO: 5678 - RNA, 22 nt, Homo sapiens
caaagaauucuccuuuugggcu

SEQ ID NO: 5679 - RNA, 23 nt, Homo sapiens
uaaggugcaucuagugcagauag

SEQ ID NO: 5680 - RNA, 20 nt, Homo sapiens
ccccagggcgacgcggcggg

SEQ ID NO: 5681 - RNA, 20 nt, Homo sapiens
agagguauagggcaugggaa

SEQ ID NO: 5682 - RNA, 22 nt, Homo sapiens
aagcugccaguugaagaacugu

SEQ ID NO: 5683 - RNA, 22 nt, Homo sapiens
gaggguuggguggaggcucucc

SEQ ID NO: 5684 - RNA, 21 nt, Homo sapiens
agggcccccccucaauccugu

SEQ ID NO: 5685 - RNA, 22 nt, Homo sapiens
uguaaacauccuacacucagcu

SEQ ID NO: 5686 - RNA, 22 nt, Homo sapiens
aaaagcuggguugagagggcga

SEQ ID NO: 5687 - RNA, 22 nt, Homo sapiens
aaaagcuggguugagagggcaa

SEQ ID NO: 5688 - RNA, 20 nt, Homo sapiens
aaaagcuggguugagagggu

SEQ ID NO: 5689 - RNA, 19 nt, Homo sapiens
aaaagcuggguugagagga

SEQ ID NO: 5690 - RNA, 23 nt, Homo sapiens
ucuuggaguaggucauugggugg

SEQ ID NO: 5691 - RNA, 22 nt, Homo sapiens
ucaggcucaguccccucccgau

SEQ ID NO: 5692 - RNA, 22 nt, Homo sapiens
caagaaccucaguugcuuuugu

SEQ ID NO: 5693 - RNA, 19 nt, Homo sapiens
ugagcugcuguaccaaaau

SEQ ID NO: 5694 - RNA, 21 nt, Homo sapiens
aguuaaugaauccuggaaagu

SEQ ID NO: 5695 - RNA, 22 nt, Homo sapiens
uauaccucaguuuuaucaggug

SEQ ID NO: 5696 - RNA, 20 nt, Homo sapiens
ggggagcuguggaagcagua

SEQ ID NO: 5697 - RNA, 24 nt, Homo sapiens
uggggagcugaggcucugggggug

SEQ ID NO: 5698 - RNA, 22 nt, Homo sapiens
cuccugagccauucugagccuc

SEQ ID NO: 5699 - RNA, 23 nt, Homo sapiens
ucuggcuccgugucuucacuccc

SEQ ID NO: 5700 - RNA, 22 nt, Homo sapiens
cucccacugcuucacuugacua

SEQ ID NO: 5701 - RNA, 22 nt, Homo sapiens
uggcucaguucagcaggaacag

SEQ ID NO: 5702 - RNA, 20 nt, Homo sapiens
gugcauugcuguugcauugc

SEQ ID NO: 5703 - RNA, 23 nt, Homo sapiens
agcucggucugaggccccucagu

SEQ ID NO: 5704 - RNA, 22 nt, Homo sapiens
gagugccuucuuuuggagcguu

SEQ ID NO: 5705 - RNA, 22 nt, Homo sapiens
aagugccuccuuuuagaguguu

SEQ ID NO: 5706 - RNA, 23 nt, Homo sapiens
agugccugagggaguaagagccc

SEQ ID NO: 5707 - RNA, 22 nt, Homo sapiens
uccgagccugggucucccucuu

SEQ ID NO: 5708 - RNA, 21 nt, Homo sapiens
ucccacguuguggcccagcag

SEQ ID NO: 5709 - RNA, 21 nt, Homo sapiens
gcaggaacuugugagucuccu

SEQ ID NO: 5710 - RNA, 22 nt, Homo sapiens
acccgucccguucguccccgga

SEQ ID NO: 5711 - RNA, 18 nt, Homo sapiens
cagggaggugaaugugau

SEQ ID NO: 5712 - RNA, 20 nt, Homo sapiens
ccucugggcccuuccuccag

SEQ ID NO: 5713 - RNA, 22 nt, Homo sapiens
ucucugggccugugucuuaggc

SEQ ID NO: 5714 - RNA, 22 nt, Homo sapiens
auucugcauuuuuagcaaguuc

SEQ ID NO: 5715 - RNA, 22 nt, Homo sapiens
aaaacuguaauuacuuuuguac

SEQ ID NO: 5716 - RNA, 22 nt, Homo sapiens
uauugcacucgucccggccucc

SEQ ID NO: 5717 - RNA, 22 nt, Homo sapiens
uuuccggcucgcgugggugugu

SEQ ID NO: 5718 - RNA, 22 nt, Homo sapiens
acgcccuucccccccuucuuca

SEQ ID NO: 5719 - RNA, 22 nt, Homo sapiens
ucggauccgucugagcuuggcu

SEQ ID NO: 5720 - RNA, 21 nt, Homo sapiens
cucccacaugcaggguuugca

SEQ ID NO: 5721 - RNA, 21 nt, Homo sapiens
cggcggggacggcgauugguc

SEQ ID NO: 5722 - RNA, 23 nt, Homo sapiens
ugagcgccucgacgacagagccg

SEQ ID NO: 5723 - RNA, 22 nt, Homo sapiens
uaaugccccuaaaaauccuuau

SEQ ID NO: 5724 - RNA, 23 nt, Homo sapiens
aaugacacgaucacucccguuga

SEQ ID NO: 5725 - RNA, 22 nt, Homo sapiens
uugggaucauuuugcauccaua

SEQ ID NO: 5726 - RNA, 21 nt, Homo sapiens
ucuuguguucucuagaucagu

SEQ ID NO: 5727 - RNA, 22 nt, Homo sapiens
aggcggggcgccgcgggaccgc

SEQ ID NO: 5728 - RNA, 23 nt, Homo sapiens
aggaagcccuggaggggcuggag

SEQ ID NO: 5729 - RNA, 22 nt, Homo sapiens
ugcggggcuagggcuaacagca

SEQ ID NO: 5730 - RNA, 23 nt, Homo sapiens
cugggaucuccggggucuugguu

SEQ ID NO: 5731 - RNA, 22 nt, Homo sapiens
uuagggcccuggcuccaucucc

SEQ ID NO: 5732 - RNA, 25 nt, Homo sapiens
aggggugguguugggacagcuccgu

SEQ ID NO: 5733 - RNA, 23 nt, Homo sapiens
ccugcagcgacuugauggcuucc

SEQ ID NO: 5734 - RNA, 18 nt, Homo sapiens
ucagcuggcccucauuuc

SEQ ID NO: 5735 - RNA, 23 nt, Homo sapiens
cucucaccacugcccucccacag

SEQ ID NO: 5736 - RNA, 22 nt, Homo sapiens
acaggugagguucuugggagcc

SEQ ID NO: 5737 - RNA, 20 nt, Homo sapiens
uaaagagcccuguggagaca

SEQ ID NO: 5738 - RNA, 21 nt, Homo sapiens
uggacugcccugaucuggaga

SEQ ID NO: 5739 - RNA, 24 nt, Homo sapiens
uugcagcugccugggagugacuuc

SEQ ID NO: 5740 - RNA, 22 nt, Homo sapiens
gugugcggaaaugcuucugcua

SEQ ID NO: 5741 - RNA, 23 nt, Homo sapiens
caaagugcuuacagugcagguag

SEQ ID NO: 5742 - RNA, 22 nt, Homo sapiens
cauugcacuugucucggucuga

SEQ ID NO: 5743 - RNA, 22 nt, Homo sapiens
uacugcagacguggcaaucaug

SEQ ID NO: 5744 - RNA, 21 nt, Homo sapiens
uacugcagacaguggcaauca

SEQ ID NO: 5745 - RNA, 21 nt, Homo sapiens
agaccuggcccagaccucagc

SEQ ID NO: 5746 - RNA, 19 nt, Homo sapiens
gugaggacucgggaggugg

SEQ ID NO: 5747 - RNA, 22 nt, Homo sapiens
ugcccuguggacucaguucugg

SEQ ID NO: 5748 - RNA, 21 nt, Homo sapiens
gcccuccgcccgugcaccccg

SEQ ID NO: 5749 - RNA, 21 nt, Homo sapiens
gcccuccgcccgugcaccccg

SEQ ID NO: 5750 - RNA, 23 nt, Homo sapiens
uaaggugcaucuagugcagauag

SEQ ID NO: 5751 - RNA, 20 nt, Homo sapiens
ccuccugcccuccuugcugu

SEQ ID NO: 5752 - RNA, 22 nt, Homo sapiens
cauugcacuugucucggucuga

SEQ ID NO: 5753 - RNA, 22 nt, Homo sapiens
aagugcugucauagcugagguc

SEQ ID NO: 5754 - RNA, 20 nt, Homo sapiens
aggguguuucucucaucucu

SEQ ID NO: 5755 - RNA, 25 nt, Homo sapiens
ggcggagggaaguagguccguuggu

SEQ ID NO: 5756 - RNA, 25 nt, Homo sapiens
ggcggagggaaguagguccguuggu

SEQ ID NO: 5757 - RNA, 22 nt, Homo sapiens
cugcccuggcccgagggaccga

SEQ ID NO: 5758 - RNA, 21 nt, Homo sapiens
ccgucgccgccacccgagccg

SEQ ID NO: 5759 - RNA, 21 nt, Homo sapiens
uggcagggaggcugggagggg

SEQ ID NO: 5760 - RNA, 18 nt, Homo sapiens
cagggaggugaaugugau

SEQ ID NO: 5761 - RNA, 23 nt, Homo sapiens
ucuggcuccgugucuucacuccc

SEQ ID NO: 5762 - RNA, 21 nt, Homo sapiens
cggcggggacggcgauugguc

SEQ ID NO: 5763 - RNA, 22 nt, Homo sapiens
cgcaggggccgggugcucaccg

SEQ ID NO: 5764 - RNA, 23 nt, Homo sapiens
cgcauccccuagggcauuggugu

SEQ ID NO: 5765 - RNA, 22 nt, Homo sapiens
aguggggaacccuuccaugagg

SEQ ID NO: 5766 - RNA, 22 nt, Homo sapiens
aggcggggcgccgcgggaccgc

SEQ ID NO: 5767 - RNA, 22 nt, Homo sapiens
ugcggggcuagggcuaacagca

SEQ ID NO: 5768 - RNA, 24 nt, Homo sapiens
uggggagcugaggcucugggggug

SEQ ID NO: 5769 - RNA, 22 nt, Homo sapiens
ccucuuccccuugucucuccag

SEQ ID NO: 5770 - RNA, 22 nt, Homo sapiens
uagcagcacauaaugguuugug

SEQ ID NO: 5771 - RNA, 18 nt, Homo sapiens
ugaggcaguagauugaau

SEQ ID NO: 5772 - RNA, 22 nt, Homo sapiens
uugggaucauuuugcauccaua

SEQ ID NO: 5773 - RNA, 21 nt, Homo sapiens
uuuccauaggugaugagucac

SEQ ID NO: 5774 - RNA, 23 nt, Homo sapiens
cugggaucuccggggucuugguu

SEQ ID NO: 5775 - RNA, 20 nt, Homo sapiens
guagaggagauggcgcaggg

SEQ ID NO: 5776 - RNA, 20 nt, Homo sapiens
guagaggagauggcgcaggg

SEQ ID NO: 5777 - RNA, 21 nt, Homo sapiens
aaggcagggcccccgcucccc

SEQ ID NO: 5778 - RNA, 21 nt, Homo sapiens
uaggacacauggucuacuucu

SEQ ID NO: 5779 - RNA, 22 nt, Homo sapiens
augggugaauuuguagaaggau

SEQ ID NO: 5780 - RNA, 21 nt, Homo sapiens
ugcaggaccaagaugagcccu

SEQ ID NO: 5781 - RNA, 22 nt, Homo sapiens
uggagagaaaggcaguuccuga

SEQ ID NO: 5782 - RNA, 22 nt, Homo sapiens
acagcaggcacagacaggcagu

SEQ ID NO: 5783 - RNA, 20 nt, Homo sapiens
ccucugggcccuuccuccag

SEQ ID NO: 5784 - RNA, 22 nt, Homo sapiens
ucucugggccugugucuuaggc

SEQ ID NO: 5785 - RNA, 22 nt, Homo sapiens
gccugcugggguggaaccuggu

SEQ ID NO: 5786 - RNA, 23 nt, Homo sapiens
acuucaccugguccacuagccgu

SEQ ID NO: 5787 - RNA, 25 nt, Homo sapiens
aggggugguguugggacagcuccgu

SEQ ID NO: 5788 - RNA, 22 nt, Homo sapiens
ggggguccccggugcucggauc

SEQ ID NO: 5789 - RNA, 20 nt, Homo sapiens
cggcucugggucugugggga

SEQ ID NO: 5790 - RNA, 21 nt, Homo sapiens
ccuggaaacacugagguugug

SEQ ID NO: 5791 - RNA, 20 nt, Homo sapiens
ggggagcuguggaagcagua

SEQ ID NO: 5792 - RNA, 22 nt, Homo sapiens
ugugcgcagggagaccucuccc

SEQ ID NO: 5793 - RNA, 22 nt, Homo sapiens
gugugcggaaaugcuucugcua

SEQ ID NO: 5794 - RNA, 22 nt, Homo sapiens
uggacggagaacugauaagggu

SEQ ID NO: 5795 - RNA, 21 nt, Homo sapiens
cggcggggacggcgauugguc

SEQ ID NO: 5796 - RNA, 22 nt, Homo sapiens
ucaggccaggcacaguggcuca

SEQ ID NO: 5797 - RNA, 21 nt, Homo sapiens
gguuugguccuagccuuucua

SEQ ID NO: 5798 - RNA, 22 nt, Homo sapiens
uagcuuaucagacugauguuga

SEQ ID NO: 5799 - RNA, 21 nt, Homo sapiens
uucacaguggcuaaguuccgc

SEQ ID NO: 5800 - RNA, 23 nt, Homo sapiens
uaagugcuuccauguuuuaguag

SEQ ID NO: 5801 - RNA, 23 nt, Homo sapiens
uaagugcuuccauguuugagugu

SEQ ID NO: 5802 - RNA, 23 nt, Homo sapiens
acuucaccugguccacuagccgu

SEQ ID NO: 5803 - RNA, 22 nt, Homo sapiens
aaacaaacauggugcacuucuu

SEQ ID NO: 5804 - RNA, 21 nt, Homo sapiens
aaagcgcuucccuucagagug

SEQ ID NO: 5805 - RNA, 22 nt, Homo sapiens
ugugacagauugauaacugaaa

SEQ ID NO: 5806 - RNA, 22 nt, Homo sapiens
aggcggggcgccgcgggaccgc

SEQ ID NO: 5807 - RNA, 23 nt, Homo sapiens
ugucacucggcucggcccacuac

SEQ ID NO: 5808 - RNA, 22 nt, Homo sapiens
ugcggggcuagggcuaacagca

SEQ ID NO: 5809 - RNA, 22 nt, Homo sapiens
uauugcacucgucccggccucc

SEQ ID NO: 5810 - RNA, 22 nt, Homo sapiens
acucggcguggcgucggucgug

SEQ ID NO: 5811 - RNA, 23 nt, Homo sapiens
cggcccgggcugcugcuguuccu

SEQ ID NO: 5812 - RNA, 23 nt, Homo sapiens
cggcccgggcugcugcuguuccu

SEQ ID NO: 5813 - RNA, 22 nt, Homo sapiens
uauugcacucgucccggccucc

SEQ ID NO: 5814 - RNA, 22 nt, Homo sapiens
ugugcgcagggagaccucuccc

SEQ ID NO: 5815 - RNA, 22 nt, Homo sapiens
agaggcuggccgugaugaauuc

SEQ ID NO: 5816 - RNA, 24 nt, Homo sapiens
agccuggaagcuggagccugcagu

SEQ ID NO: 5817 - RNA, 21 nt, Homo sapiens
ugagaugaagcacuguagcuc

SEQ ID NO: 5818 - RNA, 22 nt, Homo sapiens
cccugugcccggcccacuucug

SEQ ID NO: 5819 - RNA, 22 nt, Homo sapiens
aaaagcuggguugagagggcga

SEQ ID NO: 5820 - RNA, 22 nt, Homo sapiens
aaaagcuggguugagagggcaa

SEQ ID NO: 5821 - RNA, 20 nt, Homo sapiens
aaaagcuggguugagagggu

SEQ ID NO: 5822 - RNA, 19 nt, Homo sapiens
aaaagcuggguugagagga

SEQ ID NO: 5823 - RNA, 23 nt, Homo sapiens
ucuuggaguaggucauugggugg

SEQ ID NO: 5824 - RNA, 24 nt, Homo sapiens
uucuccaaaagaaagcacuuucug

SEQ ID NO: 5825 - RNA, 22 nt, Homo sapiens
aagugccuccuuuuagaguguu

SEQ ID NO: 5826 - RNA, 25 nt, Homo sapiens
aggggugguguugggacagcuccgu

SEQ ID NO: 5827 - RNA, 20 nt, Homo sapiens
ggggagcuguggaagcagua

SEQ ID NO: 5828 - RNA, 17 nt, Homo sapiens
ucgccuccuccucuccc

SEQ ID NO: 5829 - RNA, 21 nt, Homo sapiens
uccugcgcgucccagaugccc

SEQ ID NO: 5830 - RNA, 23 nt, Homo sapiens
ucuuggaguaggucauugggugg

SEQ ID NO: 5831 - RNA, 23 nt, Homo sapiens
gaacgcgcuucccuauagagggu

SEQ ID NO: 5832 - RNA, 19 nt, Homo sapiens
gggcgccugugaucccaac

SEQ ID NO: 5833 - RNA, 20 nt, Homo sapiens
aggguguuucucucaucucu

SEQ ID NO: 5834 - RNA, 21 nt, Homo sapiens
aauggcgccacuaggguugug

SEQ ID NO: 5835 - RNA, 21 nt, Homo sapiens
uacuuggaaaggcaucaguug

SEQ ID NO: 5836 - RNA, 17 nt, Homo sapiens
ucgccuccuccucuccc

SEQ ID NO: 5837 - RNA, 18 nt, Homo sapiens
cagggaggugaaugugau

SEQ ID NO: 5838 - RNA, 18 nt, Homo sapiens
cagggaggugaaugugau

SEQ ID NO: 5839 - RNA, 22 nt, Homo sapiens
cccugugcccggcccacuucug

SEQ ID NO: 5840 - RNA, 22 nt, Homo sapiens
agaucagaaggugauuguggcu

SEQ ID NO: 5841 - RNA, 21 nt, Homo sapiens
uggguuuacguugggagaacu

SEQ ID NO: 5842 - RNA, 21 nt, Homo sapiens
uggaggagaaggaaggugaug

SEQ ID NO: 5843 - RNA, 21 nt, Homo sapiens
ccccaccuccucucuccucag

SEQ ID NO: 5844 - RNA, 20 nt, Homo sapiens
ugagcccuguccucccgcag

SEQ ID NO: 5845 - RNA, 24 nt, Homo sapiens
ucccugagacccuuuaaccuguga

SEQ ID NO: 5846 - RNA, 22 nt, Homo sapiens
ucccugagacccuaacuuguga

SEQ ID NO: 5847 - RNA, 18 nt, Homo sapiens
aucccaccucugccacca

SEQ ID NO: 5848 - RNA, 23 nt, Homo sapiens
ccucagggcuguagaacagggcu

SEQ ID NO: 5849 - RNA, 23 nt, Homo sapiens
ucuggcuccgugucuucacuccc

SEQ ID NO: 5850 - RNA, 18 nt, Homo sapiens
ugaggcaguagauugaau

SEQ ID NO: 5851 - RNA, 23 nt, Homo sapiens
uaaggugcaucuagugcagauag

SEQ ID NO: 5852 - RNA, 23 nt, Homo sapiens
uaaggugcaucuagugcaguuag

SEQ ID NO: 5853 - RNA, 22 nt, Homo sapiens
ucugcccccuccgcugcugcca

SEQ ID NO: 5854 - RNA, 22 nt, Homo sapiens
uggcucaguucagcaggaacag

SEQ ID NO: 5855 - RNA, 22 nt, Homo sapiens
uguaaacauccuacacucagcu

SEQ ID NO: 5856 - RNA, 20 nt, Homo sapiens
acugccccaggugcugcugg

SEQ ID NO: 5857 - RNA, 21 nt, Homo sapiens
cggggcagcucaguacaggau

SEQ ID NO: 5858 - RNA, 22 nt, Homo sapiens
ccucccacacccaaggcuugca

SEQ ID NO: 5859 - RNA, 23 nt, Homo sapiens
agugccugagggaguaagagccc

SEQ ID NO: 5860 - RNA, 22 nt, Homo sapiens
gucccucuccaaaugugucuug

SEQ ID NO: 5861 - RNA, 23 nt, Homo sapiens
aaggagcuuacaaucuagcuggg

SEQ ID NO: 5862 - RNA, 20 nt, Homo sapiens
ggggagcuguggaagcagua

SEQ ID NO: 5863 - RNA, 21 nt, Homo sapiens
aaggcagggcccccgcucccc

SEQ ID NO: 5864 - RNA, 21 nt, Homo sapiens
uggcagggaggcugggagggg

SEQ ID NO: 5865 - RNA, 18 nt, Homo sapiens
aucccaccucugccacca

SEQ ID NO: 5866 - RNA, 22 nt, Homo sapiens
cuggacugagccgugcuacugg

SEQ ID NO: 5867 - RNA, 17 nt, Homo sapiens
ucccaccgcugccaccc

SEQ ID NO: 5868 - RNA, 21 nt, Homo sapiens
uggacugcccugaucuggaga

SEQ ID NO: 5869 - RNA, 23 nt, Homo sapiens
ucuggcuccgugucuucacuccc

SEQ ID NO: 5870 - RNA, 22 nt, Homo sapiens
uguaaacauccuacacucagcu

SEQ ID NO: 5871 - RNA, 22 nt, Homo sapiens
caaucacuaacuccacugccau

SEQ ID NO: 5872 - RNA, 21 nt, Homo sapiens
gcaguccaugggcauauacac

SEQ ID NO: 5873 - RNA, 23 nt, Homo sapiens
uacuccagagggcgucacucaug

SEQ ID NO: 5874 - RNA, 22 nt, Homo sapiens
ccucccacacccaaggcuugca

SEQ ID NO: 5875 - RNA, 22 nt, Homo sapiens
gucccucuccaaaugugucuug

SEQ ID NO: 5876 - RNA, 21 nt, Homo sapiens
aaggcagggcccccgcucccc

SEQ ID NO: 5877 - RNA, 22 nt, Homo sapiens
acagcaggcacagacaggcagu

SEQ ID NO: 5878 - RNA, 22 nt, Homo sapiens
gccugcugggguggaaccuggu

SEQ ID NO: 5879 - RNA, 22 nt, Homo sapiens
ugugcgcagggagaccucuccc

SEQ ID NO: 5880 - RNA, 23 nt, Homo sapiens
cgcauccccuagggcauuggugu

SEQ ID NO: 5881 - RNA, 23 nt, Homo sapiens
uauucauuuauccccagccuaca

SEQ ID NO: 5882 - RNA, 22 nt, Homo sapiens
ucaccagcccuguguucccuag

SEQ ID NO: 5883 - RNA, 23 nt, Homo sapiens
cucucaccacugcccucccacag

SEQ ID NO: 5884 - RNA, 17 nt, Homo sapiens
ucgccuccuccucuccc

SEQ ID NO: 5885 - RNA, 22 nt, Homo sapiens
uucuggaauucugugugaggga

SEQ ID NO: 5886 - RNA, 22 nt, Homo sapiens
aagcccuuaccccaaaaagcau

SEQ ID NO: 5887 - RNA, 23 nt, Homo sapiens
agcugguguugugaaucaggccg

SEQ ID NO: 5888 - RNA, 23 nt, Homo sapiens
ucccccaggugugauucugauuu

SEQ ID NO: 5889 - RNA, 22 nt, Homo sapiens
uuuugcgauguguuccuaauau

SEQ ID NO: 5890 - RNA, 21 nt, Homo sapiens
gcgacccauacuugguuucag

SEQ ID NO: 5891 - RNA, 19 nt, Homo sapiens
gggcgccugugaucccaac

SEQ ID NO: 5892 - RNA, 24 nt, Homo sapiens
acugggggcuuucgggcucugcgu

SEQ ID NO: 5893 - RNA, 23 nt, Homo sapiens
ugcaccaugguugucugagcaug

SEQ ID NO: 5894 - RNA, 21 nt, Homo sapiens
uggcagggaggcugggagggg

SEQ ID NO: 5895 - RNA, 22 nt, Homo sapiens
ccucuuccccuugucucuccag

SEQ ID NO: 5896 - RNA, 22 nt, Homo sapiens
caggauguggucaaguguuguu

SEQ ID NO: 5897 - RNA, 25 nt, Homo sapiens
gggcgacaaagcaagacucuuucuu

SEQ ID NO: 5898 - RNA, 20 nt, Homo sapiens
uaaagagcccuguggagaca

SEQ ID NO: 5899 - RNA, 22 nt, Homo sapiens
cagugcaaugaugaaagggcau

SEQ ID NO: 5900 - RNA, 23 nt, Homo sapiens
ucuggcuccgugucuucacuccc

SEQ ID NO: 5901 - RNA, 20 nt, Homo sapiens
ccucugggcccuuccuccag

SEQ ID NO: 5902 - RNA, 22 nt, Homo sapiens
ucucugggccugugucuuaggc

SEQ ID NO: 5903 - RNA, 22 nt, Homo sapiens
gugacaucacauauacggcagc

SEQ ID NO: 5904 - RNA, 22 nt, Homo sapiens
ugugacagauugauaacugaaa

SEQ ID NO: 5905 - RNA, 21 nt, Homo sapiens
gcgacccauacuugguuucag

SEQ ID NO: 5906 - RNA, 20 nt, Homo sapiens
cggcucugggucugugggga

SEQ ID NO: 5907 - RNA, 21 nt, Homo sapiens
gcaggaacuugugagucuccu

SEQ ID NO: 5908 - RNA, 21 nt, Homo sapiens
uugcucacuguucuucccuag

SEQ ID NO: 5909 - RNA, 18 nt, Homo sapiens
aucccaccucugccacca

SEQ ID NO: 5910 - RNA, 24 nt, Homo sapiens
uggcccugacugaagaccagcagu

SEQ ID NO: 5911 - RNA, 22 nt, Homo sapiens
cgcaggggccgggugcucaccg

SEQ ID NO: 5912 - RNA, 22 nt, Homo sapiens
aacuggccuacaaagucccagu

SEQ ID NO: 5913 - RNA, 22 nt, Homo sapiens
aacuggcccucaaagucccgcu

SEQ ID NO: 5914 - RNA, 22 nt, Homo sapiens
uguaacagcaacuccaugugga

SEQ ID NO: 5915 - RNA, 22 nt, Homo sapiens
cuggcccucucugcccuuccgu

SEQ ID NO: 5916 - RNA, 21 nt, Homo sapiens
gccccugggccuauccuagaa

SEQ ID NO: 5917 - RNA, 21 nt, Homo sapiens
cggggcagcucaguacaggau

SEQ ID NO: 5918 - RNA, 22 nt, Homo sapiens
cgucaacacuugcugguuuccu

SEQ ID NO: 5919 - RNA, 25 nt, Homo sapiens
aggggugguguugggacagcuccgu

SEQ ID NO: 5920 - RNA, 23 nt, Homo sapiens
ucugcucauaccccaugguuucu

SEQ ID NO: 5921 - RNA, 20 nt, Homo sapiens
ucugcaggguuugcuuugag

SEQ ID NO: 5922 - RNA, 22 nt, Homo sapiens
cgcaggggccgggugcucaccg

SEQ ID NO: 5923 - RNA, 22 nt, Homo sapiens
ucugcccccuccgcugcugcca

SEQ ID NO: 5924 - RNA, 20 nt, Homo sapiens
acugccccaggugcugcugg

SEQ ID NO: 5925 - RNA, 21 nt, Homo sapiens
cggggcagcucaguacaggau

SEQ ID NO: 5926 - RNA, 19 nt, Homo sapiens
ugucucugcugggguuucu

SEQ ID NO: 5927 - RNA, 19 nt, Homo sapiens
aggcugcggaauucaggac

SEQ ID NO: 5928 - RNA, 22 nt, Homo sapiens
ugugcgcagggagaccucuccc

SEQ ID NO: 5929 - RNA, 22 nt, Homo sapiens
ugugcgcagggagaccucuccc

SEQ ID NO: 5930 - RNA, 23 nt, Homo sapiens
aaaagugcuuacagugcagguag

SEQ ID NO: 5931 - RNA, 21 nt, Homo sapiens
uaaagugcugacagugcagau

SEQ ID NO: 5932 - RNA, 18 nt, Homo sapiens
ucagcuggcccucauuuc

SEQ ID NO: 5933 - RNA, 24 nt, Homo sapiens
uugcagcugccugggagugacuuc

SEQ ID NO: 5934 - RNA, 24 nt, Homo sapiens
uugcagcugccugggagugacuuc

SEQ ID NO: 5935 - RNA, 23 nt, Homo sapiens
caaagugcuuacagugcagguag

SEQ ID NO: 5936 - RNA, 22 nt, Homo sapiens
caaagaauucuccuuuugggcu

SEQ ID NO: 5937 - RNA, 22 nt, Homo sapiens
uagguaguuucauguuguuggg

SEQ ID NO: 5938 - RNA, 23 nt, Homo sapiens
uaaagugcuuauagugcagguag

SEQ ID NO: 5939 - RNA, 23 nt, Homo sapiens
caaagugcucauagugcagguag

SEQ ID NO: 5940 - RNA, 22 nt, Homo sapiens
acagcaggcacagacaggcagu

SEQ ID NO: 5941 - RNA, 23 nt, Homo sapiens
cgcauccccuagggcauuggugu

SEQ ID NO: 5942 - RNA, 22 nt, Homo sapiens
aauugcacuuuagcaaugguga

SEQ ID NO: 5943 - RNA, 22 nt, Homo sapiens
gccugcugggguggaaccuggu

SEQ ID NO: 5944 - RNA, 22 nt, Homo sapiens
aaagugcauccuuuuagagugu

SEQ ID NO: 5945 - RNA, 22 nt, Homo sapiens
aaagugcauccuuuuagagguu

SEQ ID NO: 5946 - RNA, 22 nt, Homo sapiens
aaagugcaucuuuuuagaggau

SEQ ID NO: 5947 - RNA, 22 nt, Homo sapiens
caaagugccucccuuuagagug

SEQ ID NO: 5948 - RNA, 23 nt, Homo sapiens
cucuugagggaagcacuuucugu

SEQ ID NO: 5949 - RNA, 22 nt, Homo sapiens
aaccagcaccccaacuuuggac

SEQ ID NO: 5950 - RNA, 22 nt, Homo sapiens
ugcggggcuagggcuaacagca

SEQ ID NO: 5951 - RNA, 20 nt, Homo sapiens
cggcucugggucugugggga

SEQ ID NO: 5952 - RNA, 23 nt, Homo sapiens
caaagugcuguucgugcagguag

SEQ ID NO: 5953 - RNA, 18 nt, Homo sapiens
cgggcguggugguggggg

SEQ ID NO: 5954 - RNA, 20 nt, Homo sapiens
guguguggaaaugcuucugc

SEQ ID NO: 5955 - RNA, 20 nt, Homo sapiens
ccccagggcgacgcggcggg

SEQ ID NO: 5956 - RNA, 22 nt, Homo sapiens
uguaaacauccuacacucagcu

SEQ ID NO: 5957 - RNA, 21 nt, Homo sapiens
gccccugggccuauccuagaa

SEQ ID NO: 5958 - RNA, 22 nt, Homo sapiens
gcugacuccuaguccagggcuc

SEQ ID NO: 5959 - RNA, 21 nt, Homo sapiens
acagucugcugagguuggagc

SEQ ID NO: 5960 - RNA, 23 nt, Homo sapiens
gcagcagagaauaggacuacguc

SEQ ID NO: 5961 - RNA, 22 nt, Homo sapiens
uggagugugacaaugguguuug

SEQ ID NO: 5962 - RNA, 22 nt, Homo sapiens
ucggccugaccacccaccccac

SEQ ID NO: 5963 - RNA, 22 nt, Homo sapiens
gcccgcguguggagccaggugu

SEQ ID NO: 5964 - RNA, 22 nt, Homo sapiens
uucccuuugucauccuaugccu

SEQ ID NO: 5965 - RNA, 22 nt, Homo sapiens
uucccuuugucauccuucgccu

SEQ ID NO: 5966 - RNA, 21 nt, Homo sapiens
auuugugcuuggcucugucac

SEQ ID NO: 5967 - RNA, 23 nt, Homo sapiens
gacacgggcgacagcugcggccc

SEQ ID NO: 5968 - RNA, 24 nt, Homo sapiens
ugccugggucucuggccugcgcgu

SEQ ID NO: 5969 - RNA, 22 nt, Homo sapiens
ugcggggcuagggcuaacagca

SEQ ID NO: 5970 - RNA, 23 nt, Homo sapiens
cacccggcugugugcacaugugc

SEQ ID NO: 5971 - RNA, 22 nt, Homo sapiens
ccucuuccccuugucucuccag

SEQ ID NO: 5972 - RNA, 17 nt, Homo sapiens
ucgccuccuccucuccc

SEQ ID NO: 5973 - RNA, 22 nt, Homo sapiens
ucuacaaaggaaagcgcuuucu

SEQ ID NO: 5974 - RNA, 23 nt, Homo sapiens
uggaguccaggaaucugcauuuu

SEQ ID NO: 5975 - RNA, 22 nt, Homo sapiens
ugugacugguugaccagagggg

SEQ ID NO: 5976 - RNA, 22 nt, Homo sapiens
cccugugcccggcccacuucug

SEQ ID NO: 5977 - RNA, 21 nt, Homo sapiens
uugugcuugaucuaaccaugu

SEQ ID NO: 5978 - RNA, 23 nt, Homo sapiens
uaagugcuuccauguuuuaguag

SEQ ID NO: 5979 - RNA, 23 nt, Homo sapiens
uaagugcuuccauguuugagugu

SEQ ID NO: 5980 - RNA, 21 nt, Homo sapiens
acuggacuuggagucagaagg

SEQ ID NO: 5981 - RNA, 22 nt, Homo sapiens
acuggacuuagggucagaaggc

SEQ ID NO: 5982 - RNA, 22 nt, Homo sapiens
uucacaaggaggugucauuuau

SEQ ID NO: 5983 - RNA, 20 nt, Homo sapiens
cuacaaagggaagcccuuuc

SEQ ID NO: 5984 - RNA, 22 nt, Homo sapiens
cuacaaagggaagcacuuucuc

SEQ ID NO: 5985 - RNA, 23 nt, Homo sapiens
ugugcuugcucgucccgcccgca

SEQ ID NO: 5986 - RNA, 22 nt, Homo sapiens
uuugugaccugguccacuaacc

SEQ ID NO: 5987 - RNA, 21 nt, Homo sapiens
uggaggagaaggaaggugaug

SEQ ID NO: 5988 - RNA, 22 nt, Homo sapiens
acuccagccccacagccucagc

SEQ ID NO: 5989 - RNA, 17 nt, Homo sapiens
gugggggagaggcuguc

SEQ ID NO: 5990 - RNA, 21 nt, Homo sapiens
cggcggggacggcgauugguc

SEQ ID NO: 5991 - RNA, 22 nt, Homo sapiens
uguaaacauccucgacuggaag

SEQ ID NO: 5992 - RNA, 22 nt, Homo sapiens
uguaaacauccccgacuggaag

SEQ ID NO: 5993 - RNA, 22 nt, Homo sapiens
uguaaacauccuugacuggaag

SEQ ID NO: 5994 - RNA, 22 nt, Homo sapiens
aggcggggcgccgcgggaccgc

SEQ ID NO: 5995 - RNA, 22 nt, Homo sapiens
ugcggggcuagggcuaacagca

SEQ ID NO: 5996 - RNA, 20 nt, Homo sapiens
cgugccacccuuuuccccag

SEQ ID NO: 5997 - RNA, 22 nt, Homo sapiens
ccucuuccccuugucucuccag

SEQ ID NO: 5998 - RNA, 22 nt, Homo sapiens
acucggcguggcgucggucgug

SEQ ID NO: 5999 - RNA, 21 nt, Homo sapiens
cggcggggacggcgauugguc

SEQ ID NO: 6000 - RNA, 20 nt, Homo sapiens
ccccagggcgacgcggcggg

SEQ ID NO: 6001 - RNA, 20 nt, Homo sapiens
ccuccugcccuccuugcugu

SEQ ID NO: 6002 - RNA, 22 nt, Homo sapiens
cauugcacuugucucggucuga

SEQ ID NO: 6003 - RNA, 21 nt, Homo sapiens
gccccugggccuauccuagaa

SEQ ID NO: 6004 - RNA, 22 nt, Homo sapiens
cgucaacacuugcugguuuccu

SEQ ID NO: 6005 - RNA, 20 nt, Homo sapiens
uaaggcacgcggugaaugcc

SEQ ID NO: 6006 - RNA, 20 nt, Homo sapiens
uaaggcacgcggugaaugcc

SEQ ID NO: 6007 - RNA, 22 nt, Homo sapiens
cucuagagggaagcacuuucug

SEQ ID NO: 6008 - RNA, 22 nt, Homo sapiens
cucuagagggaagcacuuucug

SEQ ID NO: 6009 - RNA, 21 nt, Homo sapiens
aaagcgcuucccuucagagug

SEQ ID NO: 6010 - RNA, 21 nt, Homo sapiens
aaagcgcuucccuucagagug

SEQ ID NO: 6011 - RNA, 21 nt, Homo sapiens
gaaagcgcuucucuuuagagg

SEQ ID NO: 6012 - RNA, 21 nt, Homo sapiens
gaaagcgcuucucuuuagagg

SEQ ID NO: 6013 - RNA, 22 nt, Homo sapiens
aaagugcauccuuuuagagugu

SEQ ID NO: 6014 - RNA, 22 nt, Homo sapiens
aaagugcauccuuuuagagugu

SEQ ID NO: 6015 - RNA, 22 nt, Homo sapiens
cucuagagggaagcgcuuucug

SEQ ID NO: 6016 - RNA, 22 nt, Homo sapiens
cucuagagggaagcgcuuucug

SEQ ID NO: 6017 - RNA, 22 nt, Homo sapiens
cucuagagggaagcgcuuucug

SEQ ID NO: 6018 - RNA, 22 nt, Homo sapiens
cucuagagggaagcgcuuucug

SEQ ID NO: 6019 - RNA, 22 nt, Homo sapiens
cucuagagggaagcacuuucug

SEQ ID NO: 6020 - RNA, 22 nt, Homo sapiens
cucuagagggaagcacuuucug

SEQ ID NO: 6021 - RNA, 22 nt, Homo sapiens
aaaaugguucccuuuagagugu

SEQ ID NO: 6022 - RNA, 22 nt, Homo sapiens
aaaaugguucccuuuagagugu

SEQ ID NO: 6023 - RNA, 23 nt, Homo sapiens
gaacgcgcuucccuauagagggu

SEQ ID NO: 6024 - RNA, 23 nt, Homo sapiens
gaacgcgcuucccuauagagggu

SEQ ID NO: 6025 - RNA, 22 nt, Homo sapiens
cucuagagggaagcacuuucug

SEQ ID NO: 6026 - RNA, 22 nt, Homo sapiens
cucuagagggaagcacuuucug

SEQ ID NO: 6027 - RNA, 21 nt, Homo sapiens
agggggaaaguucuauagucc

SEQ ID NO: 6028 - RNA, 19 nt, Homo sapiens
aguguggcuuucuuagagc

SEQ ID NO: 6029 - RNA, 22 nt, Homo sapiens
aggcggggcgccgcgggaccgc

SEQ ID NO: 6030 - RNA, 20 nt, Homo sapiens
guagaggagauggcgcaggg

SEQ ID NO: 6031 - RNA, 22 nt, Homo sapiens
uggagugugacaaugguguuug

SEQ ID NO: 6032 - RNA, 18 nt, Homo sapiens
cgggcguggugguggggg

SEQ ID NO: 6033 - RNA, 21 nt, Homo sapiens
cggcggggacggcgauugguc

SEQ ID NO: 6034 - RNA, 21 nt, Homo sapiens
acuggacuuggagucagaagg

SEQ ID NO: 6035 - RNA, 22 nt, Homo sapiens
aggcggggcgccgcgggaccgc

SEQ ID NO: 6036 - RNA, 22 nt, Homo sapiens
ugcggggcuagggcuaacagca

SEQ ID NO: 6037 - RNA, 23 nt, Homo sapiens
ucaaaugcucagacuccuguggu

SEQ ID NO: 6038 - RNA, 23 nt, Homo sapiens
ccugcagcgacuugauggcuucc

SEQ ID NO: 6039 - RNA, 20 nt, Homo sapiens
ucugcaggguuugcuuugag

SEQ ID NO: 6040 - RNA, 24 nt, Homo sapiens
uugcagcugccugggagugacuuc

SEQ ID NO: 6041 - RNA, 22 nt, Homo sapiens
uguaacagcaacuccaugugga

SEQ ID NO: 6042 - RNA, 22 nt, Homo sapiens
gaaguuguucgugguggauucg

SEQ ID NO: 6043 - RNA, 23 nt, Homo sapiens
agugccugagggaguaagagccc

SEQ ID NO: 6044 - RNA, 23 nt, Homo sapiens
gcgaggaccccucggggucugac

SEQ ID NO: 6045 - RNA, 22 nt, Homo sapiens
ucggccugaccacccaccccac

SEQ ID NO: 6046 - RNA, 22 nt, Homo sapiens
augggugaauuuguagaaggau

SEQ ID NO: 6047 - RNA, 21 nt, Homo sapiens
cggcggggacggcgauugguc

SEQ ID NO: 6048 - RNA, 22 nt, Homo sapiens
cauugcacuugucucggucuga

SEQ ID NO: 6049 - RNA, 22 nt, Homo sapiens
aggcggggcgccgcgggaccgc

SEQ ID NO: 6050 - RNA, 22 nt, Homo sapiens
ugcggggcuagggcuaacagca

SEQ ID NO: 6051 - RNA, 21 nt, Homo sapiens
uggaggagaaggaaggugaug

SEQ ID NO: 6052 - RNA, 21 nt, Homo sapiens
cccggagccaggaugcagcuc

SEQ ID NO: 6053 - RNA, 21 nt, Homo sapiens
ccccaccuccucucuccucag

SEQ ID NO: 6054 - RNA, 22 nt, Homo sapiens
ugugagguuggcauuguugucu

SEQ ID NO: 6055 - RNA, 23 nt, Homo sapiens
ucuggcuccgugucuucacuccc

SEQ ID NO: 6056 - RNA, 23 nt, Homo sapiens
cggcccgggcugcugcuguuccu

SEQ ID NO: 6057 - RNA, 21 nt, Homo sapiens
gccccugggccuauccuagaa

SEQ ID NO: 6058 - RNA, 22 nt, Homo sapiens
aauugcacgguauccaucugua

SEQ ID NO: 6059 - RNA, 23 nt, Homo sapiens
ugaggggcagagagcgagacuuu

SEQ ID NO: 6060 - RNA, 22 nt, Homo sapiens
uggugggcacagaaucuggacu

SEQ ID NO: 6061 - RNA, 21 nt, Homo sapiens
aggguaagcugaaccucugau

SEQ ID NO: 6062 - RNA, 22 nt, Homo sapiens
ggggguccccggugcucggauc

SEQ ID NO: 6063 - RNA, 22 nt, Homo sapiens
uggugggccgcagaacaugugc

SEQ ID NO: 6064 - RNA, 21 nt, Homo sapiens
ucacagugaaccggucucuuu

SEQ ID NO: 6065 - RNA, 24 nt, Homo sapiens
uugcagcugccugggagugacuuc

SEQ ID NO: 6066 - RNA, 21 nt, Homo sapiens
uccugcgcgucccagaugccc

SEQ ID NO: 6067 - RNA, 23 nt, Homo sapiens
ugaguaccgccaugucuguuggg

SEQ ID NO: 6068 - RNA, 25 nt, Homo sapiens
cccccacaaccgcgcuugacuagcu

SEQ ID NO: 6069 - RNA, 22 nt, Homo sapiens
uggcucaguucagcaggaacag

SEQ ID NO: 6070 - RNA, 21 nt, Homo sapiens
aagccugcccggcuccucggg

SEQ ID NO: 6071 - RNA, 19 nt, Homo sapiens
aggcugcggaauucaggac

SEQ ID NO: 6072 - RNA, 22 nt, Homo sapiens
ugcggggcuagggcuaacagca

SEQ ID NO: 6073 - RNA, 23 nt, Homo sapiens
caagucuuauuugagcaccuguu

SEQ ID NO: 6074 - RNA, 23 nt, Homo sapiens
uggugcggagagggcccacagug

SEQ ID NO: 6075 - RNA, 23 nt, Homo sapiens
gagggucuugggagggaugugac

SEQ ID NO: 6076 - RNA, 21 nt, Homo sapiens
aagugaucuaaaggccuacau

SEQ ID NO: 6077 - RNA, 21 nt, Homo sapiens
gcccuccgcccgugcaccccg

SEQ ID NO: 6078 - RNA, 23 nt, Homo sapiens
ucuggcuccgugucuucacuccc

SEQ ID NO: 6079 - RNA, 21 nt, Homo sapiens
caucccuugcaugguggaggg

SEQ ID NO: 6080 - RNA, 23 nt, Homo sapiens
uaaggugcaucuagugcagauag

SEQ ID NO: 6081 - RNA, 20 nt, Homo sapiens
ccccagggcgacgcggcggg

SEQ ID NO: 6082 - RNA, 22 nt, Homo sapiens
ugggucuuugcgggcgagauga

SEQ ID NO: 6083 - RNA, 21 nt, Homo sapiens
uugugcuugaucuaaccaugu

SEQ ID NO: 6084 - RNA, 22 nt, Homo sapiens
cauugcacuugucucggucuga

SEQ ID NO: 6085 - RNA, 22 nt, Homo sapiens
uuauaaagcaaugagacugauu

SEQ ID NO: 6086 - RNA, 22 nt, Homo sapiens
uuauaaagcaaugagacugauu

SEQ ID NO: 6087 - RNA, 22 nt, Homo sapiens
caaaguuuaagauccuugaagu

SEQ ID NO: 6088 - RNA, 23 nt, Homo sapiens
uaaaucccauggugccuucuccu

SEQ ID NO: 6089 - RNA, 25 nt, Homo sapiens
ggcggagggaaguagguccguuggu

SEQ ID NO: 6090 - RNA, 20 nt, Homo sapiens
cggcucugggucugugggga

SEQ ID NO: 6091 - RNA, 22 nt, Homo sapiens
cugcccuggcccgagggaccga

SEQ ID NO: 6092 - RNA, 22 nt, Homo sapiens
uggauuucuuugugaaucacca

SEQ ID NO: 6093 - RNA, 24 nt, Homo sapiens
agccuggaagcuggagccugcagu

SEQ ID NO: 6094 - RNA, 22 nt, Homo sapiens
agacuucccauuugaagguggc

SEQ ID NO: 6095 - RNA, 21 nt, Homo sapiens
uggcagggaggcugggagggg

SEQ ID NO: 6096 - RNA, 22 nt, Homo sapiens
gcccgcguguggagccaggugu

SEQ ID NO: 6097 - RNA, 23 nt, Homo sapiens
uaaggugcaucuagugcagauag

SEQ ID NO: 6098 - RNA, 22 nt, Homo sapiens
uucccuuugucauccuaugccu

SEQ ID NO: 6099 - RNA, 22 nt, Homo sapiens
uucccuuugucauccuucgccu

SEQ ID NO: 6100 - RNA, 17 nt, Homo sapiens
uaauugcuuccauguuu

SEQ ID NO: 6101 - RNA, 22 nt, Homo sapiens
uucucaaggaggugucguuuau

SEQ ID NO: 6102 - RNA, 22 nt, Homo sapiens
ugcggggcuagggcuaacagca

SEQ ID NO: 6103 - RNA, 22 nt, Homo sapiens
cugcccuggcccgagggaccga

SEQ ID NO: 6104 - RNA, 24 nt, Homo sapiens
ccagacagaauucuaugcacuuuc

SEQ ID NO: 6105 - RNA, 18 nt, Homo sapiens
ugaggcaguagauugaau

SEQ ID NO: 6106 - RNA, 22 nt, Homo sapiens
uggagagaaaggcaguuccuga

SEQ ID NO: 6107 - RNA, 22 nt, Homo sapiens
ucgugucuuguguugcagccgg

SEQ ID NO: 6108 - RNA, 21 nt, Homo sapiens
cggcggggacggcgauugguc

SEQ ID NO: 6109 - RNA, 22 nt, Homo sapiens
cauugcacuugucucggucuga

SEQ ID NO: 6110 - RNA, 24 nt, Homo sapiens
agcagaagcagggagguucuccca

SEQ ID NO: 6111 - RNA, 23 nt, Homo sapiens
ugucugcccgcaugccugccucu

SEQ ID NO: 6112 - RNA, 21 nt, Homo sapiens
acagucugcugagguuggagc

SEQ ID NO: 6113 - RNA, 21 nt, Homo sapiens
agggggaaaguucuauagucc

SEQ ID NO: 6114 - RNA, 19 nt, Homo sapiens
gugucugcuuccuguggga

SEQ ID NO: 6115 - RNA, 22 nt, Homo sapiens
gucccucuccaaaugugucuug

SEQ ID NO: 6116 - RNA, 25 nt, Homo sapiens
ggcggagggaaguagguccguuggu

SEQ ID NO: 6117 - RNA, 22 nt, Homo sapiens
aggcggggcgccgcgggaccgc

SEQ ID NO: 6118 - RNA, 21 nt, Homo sapiens
uacucaaaaagcugucaguca

SEQ ID NO: 6119 - RNA, 24 nt, Homo sapiens
uggggagcugaggcucugggggug

SEQ ID NO: 6120 - RNA, 22 nt, Homo sapiens
cuccugagccauucugagccuc

SEQ ID NO: 6121 - RNA, 22 nt, Homo sapiens
ucaccagcccuguguucccuag

SEQ ID NO: 6122 - RNA, 23 nt, Homo sapiens
agcugguguugugaaucaggccg

SEQ ID NO: 6123 - RNA, 22 nt, Homo sapiens
ugggucuuugcgggcgagauga

SEQ ID NO: 6124 - RNA, 22 nt, Homo sapiens
aacuggcccucaaagucccgcu

SEQ ID NO: 6125 - RNA, 22 nt, Homo sapiens
uagcaccaucugaaaucgguua

SEQ ID NO: 6126 - RNA, 23 nt, Homo sapiens
uagcaccauuugaaaucaguguu

SEQ ID NO: 6127 - RNA, 22 nt, Homo sapiens
uagcaccauuugaaaucgguua

SEQ ID NO: 6128 - RNA, 23 nt, Homo sapiens
ucaagagcaauaacgaaaaaugu

SEQ ID NO: 6129 - RNA, 23 nt, Homo sapiens
gaagugcuucgauuuuggggugu

SEQ ID NO: 6130 - RNA, 22 nt, Homo sapiens
uuauaauacaaccugauaagug

SEQ ID NO: 6131 - RNA, 22 nt, Homo sapiens
ugaguauuacauggccaaucuc

SEQ ID NO: 6132 - RNA, 23 nt, Homo sapiens
uaauccuugcuaccugggugaga

SEQ ID NO: 6133 - RNA, 22 nt, Homo sapiens
aauccuuugucccugggugaga

SEQ ID NO: 6134 - RNA, 22 nt, Homo sapiens
uacucaggagaguggcaaucac

SEQ ID NO: 6135 - RNA, 22 nt, Homo sapiens
uggugggcacagaaucuggacu

SEQ ID NO: 6136 - RNA, 22 nt, Homo sapiens
agucauuggaggguuugagcag

SEQ ID NO: 6137 - RNA, 22 nt, Homo sapiens
gugagucucuaagaaaagagga

SEQ ID NO: 6138 - RNA, 21 nt, Homo sapiens
uacucaaaaagcugucaguca

SEQ ID NO: 6139 - RNA, 22 nt, Homo sapiens
aacccguagauccgaacuugug

SEQ ID NO: 6140 - RNA, 18 nt, Homo sapiens
ugcuuccuuucagagggu

SEQ ID NO: 6141 - RNA, 22 nt, Homo sapiens
aucuggagguaagaagcacuuu

SEQ ID NO: 6142 - RNA, 19 nt, Homo sapiens
uggauuuuuggaucaggga

SEQ ID NO: 6143 - RNA, 22 nt, Homo sapiens
caaagaauucuccuuuugggcu

SEQ ID NO: 6144 - RNA, 22 nt, Homo sapiens
caaaaaucucaauuacuuuugc

SEQ ID NO: 6145 - RNA, 21 nt, Homo sapiens
uuuccauaggugaugagucac

SEQ ID NO: 6146 - RNA, 22 nt, Homo sapiens
ugcaacuuaccugagucauuga

SEQ ID NO: 6147 - RNA, 23 nt, Homo sapiens
ccugcagcgacuugauggcuucc

SEQ ID NO: 6148 - RNA, 18 nt, Homo sapiens
gucccuguucaggcgcca

SEQ ID NO: 6149 - RNA, 18 nt, Homo sapiens
cagggaggugaaugugau

SEQ ID NO: 6150 - RNA, 23 nt, Homo sapiens
ucuggcuccgugucuucacuccc

SEQ ID NO: 6151 - RNA, 23 nt, Homo sapiens
caaagugcuuacagugcagguag

SEQ ID NO: 6152 - RNA, 22 nt, Homo sapiens
cccugugcccggcccacuucug

SEQ ID NO: 6153 - RNA, 20 nt, Homo sapiens
ccuccugcccuccuugcugu

SEQ ID NO: 6154 - RNA, 22 nt, Homo sapiens
acagcaggcacagacaggcagu

SEQ ID NO: 6155 - RNA, 22 nt, Homo sapiens
acacagggcuguugugaagacu

SEQ ID NO: 6156 - RNA, 23 nt, Homo sapiens
gcaaagcacacggccugcagaga

SEQ ID NO: 6157 - RNA, 22 nt, Homo sapiens
gccugcugggguggaaccuggu

SEQ ID NO: 6158 - RNA, 22 nt, Homo sapiens
gugacaucacauauacggcagc

SEQ ID NO: 6159 - RNA, 20 nt, Homo sapiens
cugcaaagggaagcccuuuc

SEQ ID NO: 6160 - RNA, 20 nt, Homo sapiens
cugcaaagggaagcccuuuc

SEQ ID NO: 6161 - RNA, 19 nt, Homo sapiens
aagcagcugccucugaggc

SEQ ID NO: 6162 - RNA, 21 nt, Homo sapiens
guggcugcacucacuuccuuc

SEQ ID NO: 6163 - RNA, 23 nt, Homo sapiens
uggaagacuagugauuuuguugu

SEQ ID NO: 6164 - RNA, 21 nt, Homo sapiens
uggaggagaaggaaggugaug

SEQ ID NO: 6165 - RNA, 23 nt, Homo sapiens
ucugcucauaccccaugguuucu

SEQ ID NO: 6166 - RNA, 21 nt, Homo sapiens
cugacuguugccguccuccag

SEQ ID NO: 6167 - RNA, 22 nt, Homo sapiens
uacucaggagaguggcaaucac

SEQ ID NO: 6168 - RNA, 21 nt, Homo sapiens
acucuagcugccaaaggcgcu

SEQ ID NO: 6169 - RNA, 22 nt, Homo sapiens
ugagaacugaauuccauggguu

SEQ ID NO: 6170 - RNA, 22 nt, Homo sapiens
ugagaacugaauuccauaggcu

SEQ ID NO: 6171 - RNA, 22 nt, Homo sapiens
ucaggcucaguccccucccgau

SEQ ID NO: 6172 - RNA, 22 nt, Homo sapiens
ugaaacauacacgggaaaccuc

SEQ ID NO: 6173 - RNA, 21 nt, Homo sapiens
aagccugcccggcuccucggg

SEQ ID NO: 6174 - RNA, 21 nt, Homo sapiens
uggguuuacguugggagaacu

SEQ ID NO: 6175 - RNA, 20 nt, Homo sapiens
accaggaggcugaggccccu

SEQ ID NO: 6176 - RNA, 26 nt, Homo sapiens
gaugaugauggcagcaaauucugaaa

SEQ ID NO: 6177 - RNA, 22 nt, Homo sapiens
uggagugugacaaugguguuug

SEQ ID NO: 6178 - RNA, 22 nt, Homo sapiens
cuuggcaccuagcaagcacuca

SEQ ID NO: 6179 - RNA, 22 nt, Homo sapiens
uaguacugugcauaucaucuau

SEQ ID NO: 6180 - RNA, 22 nt, Homo sapiens
ucugggcaacaaagugagaccu

SEQ ID NO: 6181 - RNA, 21 nt, Homo sapiens
aggcaagaugcuggcauagcu

SEQ ID NO: 6182 - RNA, 22 nt, Homo sapiens
aaacaaacauggugcacuucuu

SEQ ID NO: 6183 - RNA, 25 nt, Homo sapiens
gcugggcagggcuucugagcuccuu

SEQ ID NO: 6184 - RNA, 23 nt, Homo sapiens
uccaguaccacgugucagggcca

SEQ ID NO: 6185 - RNA, 23 nt, Homo sapiens
uuuggcacuagcacauuuuugcu

SEQ ID NO: 6186 - RNA, 20 nt, Homo sapiens
accaggaggcugaggccccu

SEQ ID NO: 6187 - RNA, 18 nt, Homo sapiens
cagggaggugaaugugau

SEQ ID NO: 6188 - RNA, 22 nt, Homo sapiens
aauugcacgguauccaucugua

SEQ ID NO: 6189 - RNA, 25 nt, Homo sapiens
aggggugguguugggacagcuccgu

SEQ ID NO: 6190 - RNA, 22 nt, Homo sapiens
uaacugguugaacaacugaacc

SEQ ID NO: 6191 - RNA, 21 nt, Homo sapiens
uaccacaggguagaaccacgg

SEQ ID NO: 6192 - RNA, 22 nt, Homo sapiens
caaagaauucuccuuuugggcu

SEQ ID NO: 6193 - RNA, 22 nt, Homo sapiens
acaguagagggaggaaucgcag

SEQ ID NO: 6194 - RNA, 22 nt, Homo sapiens
uguaacagcaacuccaugugga

SEQ ID NO: 6195 - RNA, 25 nt, Homo sapiens
agggaucgcgggcggguggcggccu

SEQ ID NO: 6196 - RNA, 17 nt, Homo sapiens
ucgccuccuccucuccc

SEQ ID NO: 6197 - RNA, 22 nt, Homo sapiens
ucucccaacccuuguaccagug

SEQ ID NO: 6198 - RNA, 22 nt, Homo sapiens
uuggggaaacggccgcugagug

SEQ ID NO: 6199 - RNA, 21 nt, Homo sapiens
uggcagggaggcugggagggg

SEQ ID NO: 6200 - RNA, 20 nt, Homo sapiens
accaggaggcugaggccccu

SEQ ID NO: 6201 - RNA, 22 nt, Homo sapiens
ucugggcaacaaagugagaccu

SEQ ID NO: 6202 - RNA, 23 nt, Homo sapiens
ucuggcuccgugucuucacuccc

SEQ ID NO: 6203 - RNA, 25 nt, Homo sapiens
gcugggcagggcuucugagcuccuu

SEQ ID NO: 6204 - RNA, 23 nt, Homo sapiens
uacccuguagauccgaauuugug

SEQ ID NO: 6205 - RNA, 23 nt, Homo sapiens
uacccuguagaaccgaauuugug

SEQ ID NO: 6206 - RNA, 22 nt, Homo sapiens
ucaccagcccuguguucccuag

SEQ ID NO: 6207 - RNA, 21 nt, Homo sapiens
ucacagugaaccggucucuuu

SEQ ID NO: 6208 - RNA, 23 nt, Homo sapiens
agcugguguugugaaucaggccg

SEQ ID NO: 6209 - RNA, 22 nt, Homo sapiens
gaaagcgcuucccuuugcugga

SEQ ID NO: 6210 - RNA, 22 nt, Homo sapiens
caaagcgcuccccuuuagaggu

SEQ ID NO: 6211 - RNA, 23 nt, Homo sapiens
caaagcgcuucucuuuagagugu

SEQ ID NO: 6212 - RNA, 21 nt, Homo sapiens
caaagcgcuucccuuuggagc

SEQ ID NO: 6213 - RNA, 21 nt, Homo sapiens
gaaagcgcuucucuuuagagg

SEQ ID NO: 6214 - RNA, 21 nt, Homo sapiens
aaggcagggcccccgcucccc

SEQ ID NO: 6215 - RNA, 23 nt, Homo sapiens
ucuuugguuaucuagcuguauga

SEQ ID NO: 6216 - RNA, 23 nt, Homo sapiens
uggugcggagagggcccacagug

SEQ ID NO: 6217 - RNA, 22 nt, Homo sapiens
uagcaaaaacugcaguuacuuu

SEQ ID NO: 6218 - RNA, 18 nt, Homo sapiens
cagggaggugaaugugau

SEQ ID NO: 6219 - RNA, 22 nt, Homo sapiens
ggagacgcggcccuguuggagu

SEQ ID NO: 6220 - RNA, 23 nt, Homo sapiens
ucuggcuccgugucuucacuccc

SEQ ID NO: 6221 - RNA, 21 nt, Homo sapiens
uccugcgcgucccagaugccc

SEQ ID NO: 6222 - RNA, 22 nt, Homo sapiens
uagcagcacauaaugguuugug

SEQ ID NO: 6223 - RNA, 22 nt, Homo sapiens
uagcagcacaucaugguuuaca

SEQ ID NO: 6224 - RNA, 22 nt, Homo sapiens
uagcagcacguaaauauuggcg

SEQ ID NO: 6225 - RNA, 22 nt, Homo sapiens
cccugugcccggcccacuucug

SEQ ID NO: 6226 - RNA, 22 nt, Homo sapiens
uagcuuaucagacugauguuga

SEQ ID NO: 6227 - RNA, 21 nt, Homo sapiens
cagcagcacacugugguuugu

SEQ ID NO: 6228 - RNA, 22 nt, Homo sapiens
augggugaauuuguagaaggau

SEQ ID NO: 6229 - RNA, 18 nt, Homo sapiens
gucccuguucaggcgcca

SEQ ID NO: 6230 - RNA, 17 nt, Homo sapiens
ucccuguucgggcgcca

SEQ ID NO: 6231 - RNA, 21 nt, Homo sapiens
cggcggggacggcgauugguc

SEQ ID NO: 6232 - RNA, 22 nt, Homo sapiens
aacuggcccucaaagucccgcu

SEQ ID NO: 6233 - RNA, 22 nt, Homo sapiens
uguaaacauccuacacucagcu

SEQ ID NO: 6234 - RNA, 22 nt, Homo sapiens
aauugcacuuuagcaaugguga

SEQ ID NO: 6235 - RNA, 22 nt, Homo sapiens
agaggcuggccgugaugaauuc

SEQ ID NO: 6236 - RNA, 22 nt, Homo sapiens
gugacaucacauauacggcagc

SEQ ID NO: 6237 - RNA, 22 nt, Homo sapiens
aacaucacagcaagucugugcu

SEQ ID NO: 6238 - RNA, 23 nt, Homo sapiens
uaauccuugcuaccugggugaga

SEQ ID NO: 6239 - RNA, 22 nt, Homo sapiens
uggugggcacagaaucuggacu

SEQ ID NO: 6240 - RNA, 22 nt, Homo sapiens
aggcggggcgccgcgggaccgc

SEQ ID NO: 6241 - RNA, 21 nt, Homo sapiens
uggaggagaaggaaggugaug

SEQ ID NO: 6242 - RNA, 22 nt, Homo sapiens
caaagugccucccuuuagagug

SEQ ID NO: 6243 - RNA, 20 nt, Homo sapiens
guguguggaaaugcuucugc

SEQ ID NO: 6244 - RNA, 19 nt, Homo sapiens
ugucucugcugggguuucu

SEQ ID NO: 6245 - RNA, 17 nt, Homo sapiens
ucccaccgcugccaccc

SEQ ID NO: 6246 - RNA, 22 nt, Homo sapiens
uccuucauuccaccggagucug

SEQ ID NO: 6247 - RNA, 23 nt, Homo sapiens
aggaagcccuggaggggcuggag

SEQ ID NO: 6248 - RNA, 22 nt, Homo sapiens
caaagaauucuccuuuugggcu

SEQ ID NO: 6249 - RNA, 21 nt, Homo sapiens
gugccagcugcagugggggag

SEQ ID NO: 6250 - RNA, 22 nt, Homo sapiens
ugagccccugugccgcccccag

SEQ ID NO: 6251 - RNA, 22 nt, Homo sapiens
uuuagagacggggucuugcucu

SEQ ID NO: 6252 - RNA, 23 nt, Homo sapiens
caacggaaucccaaaagcagcug

SEQ ID NO: 6253 - RNA, 22 nt, Homo sapiens
aauugcacgguauccaucugua

SEQ ID NO: 6254 - RNA, 21 nt, Homo sapiens
gaaggcgcuucccuuuggagu

SEQ ID NO: 6255 - RNA, 22 nt, Homo sapiens
gaaggcgcuucccuuuagagcg

SEQ ID NO: 6256 - RNA, 21 nt, Homo sapiens
uccgguucucagggcuccacc

SEQ ID NO: 6257 - RNA, 22 nt, Homo sapiens
ugugcgcagggagaccucuccc

SEQ ID NO: 6258 - RNA, 23 nt, Homo sapiens
cacccggcugugugcacaugugc

SEQ ID NO: 6259 - RNA, 23 nt, Homo sapiens
ccugcagcgacuugauggcuucc

SEQ ID NO: 6260 - RNA, 20 nt, Homo sapiens
ucugcaggguuugcuuugag

SEQ ID NO: 6261 - RNA, 21 nt, Homo sapiens
ucacagugaaccggucucuuu

SEQ ID NO: 6262 - RNA, 17 nt, Homo sapiens
ucgccuccuccucuccc

SEQ ID NO: 6263 - RNA, 24 nt, Homo sapiens
uugcagcugccugggagugacuuc

SEQ ID NO: 6264 - RNA, 20 nt, Homo sapiens
ccuccugcccuccuugcugu

SEQ ID NO: 6265 - RNA, 22 nt, Homo sapiens
uaugugggaugguaaaccgcuu

SEQ ID NO: 6266 - RNA, 22 nt, Homo sapiens
uguaaacauccuacacucagcu

SEQ ID NO: 6267 - RNA, 22 nt, Homo sapiens
aauugcacuuuagcaaugguga

SEQ ID NO: 6268 - RNA, 21 nt, Homo sapiens
aacaggugacugguuagacaa

SEQ ID NO: 6269 - RNA, 19 nt, Homo sapiens
gugucugcuuccuguggga

SEQ ID NO: 6270 - RNA, 22 nt, Homo sapiens
aaaccuguguuguucaagaguc

SEQ ID NO: 6271 - RNA, 22 nt, Homo sapiens
uggaauguaaagaaguauguau

SEQ ID NO: 6272 - RNA, 21 nt, Homo sapiens
uccuucugcuccgucccccag

SEQ ID NO: 6273 - RNA, 18 nt, Homo sapiens
gucccuguucaggcgcca

SEQ ID NO: 6274 - RNA, 17 nt, Homo sapiens
ucccuguucgggcgcca

SEQ ID NO: 6275 - RNA, 22 nt, Homo sapiens
uuuagagacggggucuugcucu

SEQ ID NO: 6276 - RNA, 22 nt, Homo sapiens
uggaauguaaggaagugugugg

SEQ ID NO: 6277 - RNA, 22 nt, Homo sapiens
gaggguuggguggaggcucucc

SEQ ID NO: 6278 - RNA, 24 nt, Homo sapiens
agcagaagcagggagguucuccca

SEQ ID NO: 6279 - RNA, 22 nt, Homo sapiens
aauugcacgguauccaucugua

SEQ ID NO: 6280 - RNA, 23 nt, Homo sapiens
ucuuggaguaggucauugggugg

SEQ ID NO: 6281 - RNA, 22 nt, Homo sapiens
aggcaguguauuguuagcuggc

SEQ ID NO: 6282 - RNA, 20 nt, Homo sapiens
aggaauguuccuucuuugcc

SEQ ID NO: 6283 - RNA, 23 nt, Homo sapiens
uacccuguagauccgaauuugug

SEQ ID NO: 6284 - RNA, 23 nt, Homo sapiens
uacccuguagaaccgaauuugug

SEQ ID NO: 6285 - RNA, 23 nt, Homo sapiens
ccugcagcgacuugauggcuucc

SEQ ID NO: 6286 - RNA, 21 nt, Homo sapiens
ccuguugaaguguaaucccca

SEQ ID NO: 6287 - RNA, 25 nt, Homo sapiens
ugggaacggguuccggcagacgcug

SEQ ID NO: 6288 - RNA, 22 nt, Homo sapiens
ucagugcaucacagaacuuugu

SEQ ID NO: 6289 - RNA, 23 nt, Homo sapiens
caaagugcuuacagugcagguag

SEQ ID NO: 6290 - RNA, 22 nt, Homo sapiens
cccugugcccggcccacuucug

SEQ ID NO: 6291 - RNA, 22 nt, Homo sapiens
uaaucucagcuggcaacuguga

SEQ ID NO: 6292 - RNA, 22 nt, Homo sapiens
acacagggcuguugugaagacu

SEQ ID NO: 6293 - RNA, 23 nt, Homo sapiens
aucaacagacauuaauugggcgc

SEQ ID NO: 6294 - RNA, 22 nt, Homo sapiens
uuuugcgauguguuccuaauau

SEQ ID NO: 6295 - RNA, 22 nt, Homo sapiens
uacugcagacguggcaaucaug

SEQ ID NO: 6296 - RNA, 21 nt, Homo sapiens
uacugcagacaguggcaauca

SEQ ID NO: 6297 - RNA, 21 nt, Homo sapiens
gugucuuuugcucugcaguca

SEQ ID NO: 6298 - RNA, 19 nt, Homo sapiens
gugucugcuuccuguggga

SEQ ID NO: 6299 - RNA, 23 nt, Homo sapiens
aucgcugcgguugcgagcgcugu

SEQ ID NO: 6300 - RNA, 22 nt, Homo sapiens
uggugguuuacaaaguaauuca

SEQ ID NO: 6301 - RNA, 26 nt, Homo sapiens
aaguaguugguuuguaugagaugguu

SEQ ID NO: 6302 - RNA, 21 nt, Homo sapiens
aguuaggauuaggucguggaa

SEQ ID NO: 6303 - RNA, 19 nt, Homo sapiens
auggauaaggcuuuggcuu

SEQ ID NO: 6304 - RNA, 19 nt, Homo sapiens
uggauuuuuggaucaggga

SEQ ID NO: 6305 - RNA, 23 nt, Homo sapiens
ugugcaaaucuaugcaaaacuga

SEQ ID NO: 6306 - RNA, 23 nt, Homo sapiens
ugugcaaauccaugcaaaacuga

SEQ ID NO: 6307 - RNA, 22 nt, Homo sapiens
aaacaaacauggugcacuucuu

SEQ ID NO: 6308 - RNA, 21 nt, Homo sapiens
uuuugcaccuuuuggagugaa

SEQ ID NO: 6309 - RNA, 23 nt, Homo sapiens
ucggggaucaucaugucacgaga

SEQ ID NO: 6310 - RNA, 22 nt, Homo sapiens
caaaaaucucaauuacuuuugc

SEQ ID NO: 6311 - RNA, 23 nt, Homo sapiens
guuugcacgggugggccuugucu

SEQ ID NO: 6312 - RNA, 23 nt, Homo sapiens
uaaaucccauggugccuucuccu

SEQ ID NO: 6313 - RNA, 22 nt, Homo sapiens
auccgcgcucugacucucugcc

SEQ ID NO: 6314 - RNA, 22 nt, Homo sapiens
cuccugagccauucugagccuc

SEQ ID NO: 6315 - RNA, 22 nt, Homo sapiens
uaacagucuacagccauggucg

SEQ ID NO: 6316 - RNA, 21 nt, Homo sapiens
aagugaucuaaaggccuacau

SEQ ID NO: 6317 - RNA, 21 nt, Homo sapiens
uaacagucuccagucacggcc

SEQ ID NO: 6318 - RNA, 20 nt, Homo sapiens
ccucugggcccuuccuccag

SEQ ID NO: 6319 - RNA, 22 nt, Homo sapiens
ucucugggccugugucuuaggc

SEQ ID NO: 6320 - RNA, 21 nt, Homo sapiens
gugcauuguaguugcauugca

SEQ ID NO: 6321 - RNA, 22 nt, Homo sapiens
aacuguuugcagaggaaacuga

SEQ ID NO: 6322 - RNA, 22 nt, Homo sapiens
uucucaaggaggugucguuuau

SEQ ID NO: 6323 - RNA, 23 nt, Homo sapiens
cucuugagggaagcacuuucugu

SEQ ID NO: 6324 - RNA, 22 nt, Homo sapiens
ggagaaauuauccuuggugugu

SEQ ID NO: 6325 - RNA, 23 nt, Homo sapiens
uacccuguagauccgaauuugug

SEQ ID NO: 6326 - RNA, 23 nt, Homo sapiens
uacccuguagaaccgaauuugug

SEQ ID NO: 6327 - RNA, 18 nt, Homo sapiens
ucagcuggcccucauuuc

SEQ ID NO: 6328 - RNA, 19 nt, Homo sapiens
gugaggacucgggaggugg

SEQ ID NO: 6329 - RNA, 23 nt, Homo sapiens
aggaugagcaaagaaaguagauu

SEQ ID NO: 6330 - RNA, 22 nt, Homo sapiens
cggaugagcaaagaaagugguu

SEQ ID NO: 6331 - RNA, 21 nt, Homo sapiens
uaccacaggguagaaccacgg

SEQ ID NO: 6332 - RNA, 23 nt, Homo sapiens
ucuggcuccgugucuucacuccc

SEQ ID NO: 6333 - RNA, 22 nt, Homo sapiens
cucuagagggaagcacuuucug

SEQ ID NO: 6334 - RNA, 21 nt, Homo sapiens
cucccacaugcaggguuugca

SEQ ID NO: 6335 - RNA, 21 nt, Homo sapiens
cggcggggacggcgauugguc

SEQ ID NO: 6336 - RNA, 22 nt, Homo sapiens
ucugcccccuccgcugcugcca

SEQ ID NO: 6337 - RNA, 22 nt, Homo sapiens
uguaacagcaacuccaugugga

SEQ ID NO: 6338 - RNA, 21 nt, Homo sapiens
auuugugcuuggcucugucac

SEQ ID NO: 6339 - RNA, 22 nt, Homo sapiens
uguaaacauccuacacucagcu

SEQ ID NO: 6340 - RNA, 20 nt, Homo sapiens
acugccccaggugcugcugg

SEQ ID NO: 6341 - RNA, 23 nt, Homo sapiens
ucccuguccuccaggagcucacg

SEQ ID NO: 6342 - RNA, 23 nt, Homo sapiens
ucccccaggugugauucugauuu

SEQ ID NO: 6343 - RNA, 21 nt, Homo sapiens
cggggcagcucaguacaggau

SEQ ID NO: 6344 - RNA, 22 nt, Homo sapiens
aguggggaacccuuccaugagg

SEQ ID NO: 6345 - RNA, 23 nt, Homo sapiens
aggaccugcgggacaagauucuu

SEQ ID NO: 6346 - RNA, 18 nt, Homo sapiens
uucacagggaggugucau

SEQ ID NO: 6347 - RNA, 22 nt, Homo sapiens
ccucccacacccaaggcuugca

SEQ ID NO: 6348 - RNA, 23 nt, Homo sapiens
ugugcuugcucgucccgcccgca

SEQ ID NO: 6349 - RNA, 24 nt, Homo sapiens
acugggggcuuucgggcucugcgu

SEQ ID NO: 6350 - RNA, 22 nt, Homo sapiens
aggcggggcgccgcgggaccgc

SEQ ID NO: 6351 - RNA, 22 nt, Homo sapiens
ugcggggcuagggcuaacagca

SEQ ID NO: 6352 - RNA, 21 nt, Homo sapiens
uacucaaaaagcugucaguca

SEQ ID NO: 6353 - RNA, 24 nt, Homo sapiens
uggggagcugaggcucugggggug

SEQ ID NO: 6354 - RNA, 21 nt, Homo sapiens
uggacugcccugaucuggaga

SEQ ID NO: 6355 - RNA, 22 nt, Homo sapiens
ucugcccccuccgcugcugcca

SEQ ID NO: 6356 - RNA, 22 nt, Homo sapiens
cugugcgugugacagcggcuga

SEQ ID NO: 6357 - RNA, 21 nt, Homo sapiens
caagucacuagugguuccguu

SEQ ID NO: 6358 - RNA, 21 nt, Homo sapiens
auguaugugugcaugugcaug

SEQ ID NO: 6359 - RNA, 20 nt, Homo sapiens
acugccccaggugcugcugg

SEQ ID NO: 6360 - RNA, 22 nt, Homo sapiens
caaucacuaacuccacugccau

SEQ ID NO: 6361 - RNA, 23 nt, Homo sapiens
ugaggggcagagagcgagacuuu

SEQ ID NO: 6362 - RNA, 21 nt, Homo sapiens
cggggcagcucaguacaggau

SEQ ID NO: 6363 - RNA, 18 nt, Homo sapiens
cagggaggugaaugugau

SEQ ID NO: 6364 - RNA, 22 nt, Homo sapiens
ggagacgcggcccuguuggagu

SEQ ID NO: 6365 - RNA, 23 nt, Homo sapiens
ucuggcuccgugucuucacuccc

SEQ ID NO: 6366 - RNA, 22 nt, Homo sapiens
uggagagaaaggcaguuccuga

SEQ ID NO: 6367 - RNA, 22 nt, Homo sapiens
cccugugcccggcccacuucug

SEQ ID NO: 6368 - RNA, 22 nt, Homo sapiens
uucccuuugucauccuaugccu

SEQ ID NO: 6369 - RNA, 22 nt, Homo sapiens
uucccuuugucauccuucgccu

SEQ ID NO: 6370 - RNA, 22 nt, Homo sapiens
caaccuggaggacuccaugcug

SEQ ID NO: 6371 - RNA, 24 nt, Homo sapiens
gaccuggacauguuugugcccagu

SEQ ID NO: 6372 - RNA, 22 nt, Homo sapiens
ugagaccucuggguucugagcu

SEQ ID NO: 6373 - RNA, 22 nt, Homo sapiens
cugcccuggcccgagggaccga

SEQ ID NO: 6374 - RNA, 23 nt, Homo sapiens
caagucuuauuugagcaccuguu

SEQ ID NO: 6375 - RNA, 21 nt, Homo sapiens
cuuuuugcggucugggcuugc

SEQ ID NO: 6376 - RNA, 22 nt, Homo sapiens
aacuguuugcagaggaaacuga

SEQ ID NO: 6377 - RNA, 24 nt, Homo sapiens
uuuggcaaugguagaacucacacu

SEQ ID NO: 6378 - RNA, 21 nt, Homo sapiens
uagcagcacagaaauauuggc

SEQ ID NO: 6379 - RNA, 22 nt, Homo sapiens
ugucaguuugucaaauacccca

SEQ ID NO: 6380 - RNA, 23 nt, Homo sapiens
gcaaagcacacggccugcagaga

SEQ ID NO: 6381 - RNA, 22 nt, Homo sapiens
aacaauauccuggugcugagug

SEQ ID NO: 6382 - RNA, 22 nt, Homo sapiens
aggcaguguauuguuagcuggc

SEQ ID NO: 6383 - RNA, 21 nt, Homo sapiens
gcgacccauacuugguuucag

SEQ ID NO: 6384 - RNA, 19 nt, Homo sapiens
ucuaggcugguacugcuga

SEQ ID NO: 6385 - RNA, 26 nt, Homo sapiens
gaugaugauggcagcaaauucugaaa

SEQ ID NO: 6386 - RNA, 21 nt, Homo sapiens
ucacagugaaccggucucuuu

SEQ ID NO: 6387 - RNA, 21 nt, Homo sapiens
cuuuuugcggucugggcuugc

SEQ ID NO: 6388 - RNA, 21 nt, Homo sapiens
uaccacaggguagaaccacgg

SEQ ID NO: 6389 - RNA, 22 nt, Homo sapiens
uaacacugucugguaaagaugg

SEQ ID NO: 6390 - RNA, 21 nt, Homo sapiens
ccaguccugugccugccgccu

SEQ ID NO: 6391 - RNA, 23 nt, Homo sapiens
ugaguaccgccaugucuguuggg

SEQ ID NO: 6392 - RNA, 22 nt, Homo sapiens
uaacacugucugguaacgaugu

SEQ ID NO: 6393 - RNA, 21 nt, Homo sapiens
uucaaguaauucaggauaggu

SEQ ID NO: 6394 - RNA, 21 nt, Homo sapiens
uucacaguggcuaaguuccgc

SEQ ID NO: 6395 - RNA, 21 nt, Homo sapiens
uucacaguggcuaaguucugc

SEQ ID NO: 6396 - RNA, 23 nt, Homo sapiens
gcaaagcacacggccugcagaga

SEQ ID NO: 6397 - RNA, 21 nt, Homo sapiens
cagcagcacacugugguuugu

SEQ ID NO: 6398 - RNA, 20 nt, Homo sapiens
cugcaaagggaagcccuuuc

SEQ ID NO: 6399 - RNA, 20 nt, Homo sapiens
cugcaaagggaagcccuuuc

SEQ ID NO: 6400 - RNA, 22 nt, Homo sapiens
caaaaaccacaguuucuuuugc

SEQ ID NO: 6401 - RNA, 22 nt, Homo sapiens
uagcaaaaacugcaguuacuuu

SEQ ID NO: 6402 - RNA, 19 nt, Homo sapiens
ugagcugcuguaccaaaau

SEQ ID NO: 6403 - RNA, 20 nt, Homo sapiens
guccgcucggcgguggccca

SEQ ID NO: 6404 - RNA, 21 nt, Homo sapiens
cuucuugugcucuaggauugu

SEQ ID NO: 6405 - RNA, 22 nt, Homo sapiens
ugagaaccacgucugcucugag

SEQ ID NO: 6406 - RNA, 21 nt, Homo sapiens
cacaagguauugguauuaccu

SEQ ID NO: 6407 - RNA, 19 nt, Homo sapiens
aagcagcugccucugaggc

SEQ ID NO: 6408 - RNA, 22 nt, Homo sapiens
agaguugagucuggacgucccg

SEQ ID NO: 6409 - RNA, 22 nt, Homo sapiens
cucuagagggaagcacuuucug

SEQ ID NO: 6410 - RNA, 22 nt, Homo sapiens
gcugacuccuaguccagggcuc

SEQ ID NO: 6411 - RNA, 22 nt, Homo sapiens
cacgcucaugcacacacccaca

SEQ ID NO: 6412 - RNA, 23 nt, Homo sapiens
ccugcagcgacuugauggcuucc

SEQ ID NO: 6413 - RNA, 20 nt, Homo sapiens
ucugcaggguuugcuuugag

SEQ ID NO: 6414 - RNA, 21 nt, Homo sapiens
agugaaugauggguucugacc

SEQ ID NO: 6415 - RNA, 22 nt, Homo sapiens
acaggugagguucuugggagcc

SEQ ID NO: 6416 - RNA, 23 nt, Homo sapiens
cggcccgggcugcugcuguuccu

SEQ ID NO: 6417 - RNA, 21 nt, Homo sapiens
ccaguccugugccugccgccu

SEQ ID NO: 6418 - RNA, 21 nt, Homo sapiens
agcuacaucuggcuacugggu

SEQ ID NO: 6419 - RNA, 22 nt, Homo sapiens
aauugcacgguauccaucugua

SEQ ID NO: 6420 - RNA, 23 nt, Homo sapiens
acuucaccugguccacuagccgu

SEQ ID NO: 6421 - RNA, 20 nt, Homo sapiens
cugcaaagggaagcccuuuc

SEQ ID NO: 6422 - RNA, 20 nt, Homo sapiens
cugcaaagggaagcccuuuc

SEQ ID NO: 6423 - RNA, 22 nt, Homo sapiens
aaccagcaccccaacuuuggac

SEQ ID NO: 6424 - RNA, 22 nt, Homo sapiens
gguggcccggccgugccugagg

SEQ ID NO: 6425 - RNA, 22 nt, Homo sapiens
uguaaacauccucgacuggaag

SEQ ID NO: 6426 - RNA, 22 nt, Homo sapiens
uguaaacauccccgacuggaag

SEQ ID NO: 6427 - RNA, 22 nt, Homo sapiens
uguaaacauccuugacuggaag

SEQ ID NO: 6428 - RNA, 20 nt, Homo sapiens
ugagcccuguccucccgcag

SEQ ID NO: 6429 - RNA, 25 nt, Homo sapiens
ugggaacggguuccggcagacgcug

SEQ ID NO: 6430 - RNA, 22 nt, Homo sapiens
ucucccaacccuuguaccagug

SEQ ID NO: 6431 - RNA, 22 nt, Homo sapiens
cauugcacuugucucggucuga

SEQ ID NO: 6432 - RNA, 21 nt, Homo sapiens
agggcccccccucaauccugu

SEQ ID NO: 6433 - RNA, 22 nt, Homo sapiens
uguaaacauccuacacucagcu

SEQ ID NO: 6434 - RNA, 23 nt, Homo sapiens
ugagcgccucgacgacagagccg

SEQ ID NO: 6435 - RNA, 23 nt, Homo sapiens
uagcagcgggaacaguucugcag

SEQ ID NO: 6436 - RNA, 22 nt, Homo sapiens
cgucaacacuugcugguuuccu

SEQ ID NO: 6437 - RNA, 21 nt, Homo sapiens
uuggccacaauggguuagaac

SEQ ID NO: 6438 - RNA, 23 nt, Homo sapiens
aucgcugcgguugcgagcgcugu

SEQ ID NO: 6439 - RNA, 19 nt, Homo sapiens
aguguggcuuucuuagagc

SEQ ID NO: 6440 - RNA, 22 nt, Homo sapiens
ugcggggcuagggcuaacagca

SEQ ID NO: 6441 - RNA, 21 nt, Homo sapiens
uggaggagaaggaaggugaug

SEQ ID NO: 6442 - RNA, 22 nt, Homo sapiens
ugagccccugugccgcccccag

SEQ ID NO: 6443 - RNA, 22 nt, Homo sapiens
ugugagguuggcauuguugucu

SEQ ID NO: 6444 - RNA, 19 nt, Homo sapiens
gaugaugcugcugaugcug

SEQ ID NO: 6445 - RNA, 22 nt, Homo sapiens
cgcaggggccgggugcucaccg

SEQ ID NO: 6446 - RNA, 22 nt, Homo sapiens
ucaggccaggcacaguggcuca

SEQ ID NO: 6447 - RNA, 22 nt, Homo sapiens
ucaggccaggcacaguggcuca

SEQ ID NO: 6448 - RNA, 22 nt, Homo sapiens
acagcaggcacagacaggcagu

SEQ ID NO: 6449 - RNA, 22 nt, Homo sapiens
uggcagugucuuagcugguugu

SEQ ID NO: 6450 - RNA, 23 nt, Homo sapiens
ucccccaggugugauucugauuu

SEQ ID NO: 6451 - RNA, 22 nt, Homo sapiens
gccugcugggguggaaccuggu

SEQ ID NO: 6452 - RNA, 25 nt, Homo sapiens
aggggugguguugggacagcuccgu

SEQ ID NO: 6453 - RNA, 24 nt, Homo sapiens
acugggggcuuucgggcucugcgu

SEQ ID NO: 6454 - RNA, 19 nt, Homo sapiens
ucuaggcugguacugcuga

SEQ ID NO: 6455 - RNA, 21 nt, Homo sapiens
guggcugcacucacuuccuuc

SEQ ID NO: 6456 - RNA, 20 nt, Homo sapiens
ggggagcuguggaagcagua

SEQ ID NO: 6457 - RNA, 22 nt, Homo sapiens
ugugcgcagggagaccucuccc

SEQ ID NO: 6458 - RNA, 20 nt, Homo sapiens
ccucugggcccuuccuccag

SEQ ID NO: 6459 - RNA, 22 nt, Homo sapiens
ucucugggccugugucuuaggc

SEQ ID NO: 6460 - RNA, 22 nt, Homo sapiens
gugacaucacauauacggcagc

SEQ ID NO: 6461 - RNA, 22 nt, Homo sapiens
caaucacuaacuccacugccau

SEQ ID NO: 6462 - RNA, 22 nt, Homo sapiens
uggagagaaaggcaguuccuga

SEQ ID NO: 6463 - RNA, 22 nt, Homo sapiens
ugugcgcagggagaccucuccc

SEQ ID NO: 6464 - RNA, 22 nt, Homo sapiens
uggagagaaaggcaguuccuga

SEQ ID NO: 6465 - RNA, 23 nt, Homo sapiens
aggaccugcgggacaagauucuu

SEQ ID NO: 6466 - RNA, 22 nt, Homo sapiens
cccugugcccggcccacuucug

SEQ ID NO: 6467 - RNA, 23 nt, Homo sapiens
ugugcuugcucgucccgcccgca

SEQ ID NO: 6468 - RNA, 21 nt, Homo sapiens
ucgaggagcucacagucuagu

SEQ ID NO: 6469 - RNA, 23 nt, Homo sapiens
cuggagauauggaagagcugugu

SEQ ID NO: 6470 - RNA, 20 nt, Homo sapiens
auggagauagauauagaaau

SEQ ID NO: 6471 - RNA, 22 nt, Homo sapiens
ugagccccugugccgcccccag

SEQ ID NO: 6472 - RNA, 20 nt, Homo sapiens
cggcucugggucugugggga

SEQ ID NO: 6473 - RNA, 20 nt, Homo sapiens
uaaggcacgcggugaaugcc

SEQ ID NO: 6474 - RNA, 21 nt, Homo sapiens
uaaggcacccuucugaguaga

SEQ ID NO: 6475 - RNA, 17 nt, Homo sapiens
gugggggagaggcuguc

SEQ ID NO: 6476 - RNA, 21 nt, Homo sapiens
gcccuccgcccgugcaccccg

SEQ ID NO: 6477 - RNA, 23 nt, Homo sapiens
ucuggcuccgugucuucacuccc

SEQ ID NO: 6478 - RNA, 23 nt, Homo sapiens
ucuggcuccgugucuucacuccc

SEQ ID NO: 6479 - RNA, 21 nt, Homo sapiens
cggcggggacggcgauugguc

SEQ ID NO: 6480 - RNA, 21 nt, Homo sapiens
cggcggggacggcgauugguc

SEQ ID NO: 6481 - RNA, 21 nt, Homo sapiens
gccccugggccuauccuagaa

SEQ ID NO: 6482 - RNA, 23 nt, Homo sapiens
ugaggggcagagagcgagacuuu

SEQ ID NO: 6483 - RNA, 19 nt, Homo sapiens
ugggcguaucuguaugcua

SEQ ID NO: 6484 - RNA, 25 nt, Homo sapiens
aggggugguguugggacagcuccgu

SEQ ID NO: 6485 - RNA, 22 nt, Homo sapiens
aggcggggcgccgcgggaccgc

SEQ ID NO: 6486 - RNA, 22 nt, Homo sapiens
aggcggggcgccgcgggaccgc

SEQ ID NO: 6487 - RNA, 22 nt, Homo sapiens
ugcggggcuagggcuaacagca

SEQ ID NO: 6488 - RNA, 20 nt, Homo sapiens
ggggagcuguggaagcagua

SEQ ID NO: 6489 - RNA, 24 nt, Homo sapiens
gaccuggacauguuugugcccagu

SEQ ID NO: 6490 - RNA, 22 nt, Homo sapiens
aaaagcuggguugagagggcga

SEQ ID NO: 6491 - RNA, 22 nt, Homo sapiens
aaaagcuggguugagagggcaa

SEQ ID NO: 6492 - RNA, 20 nt, Homo sapiens
aaaagcuggguugagagggu

SEQ ID NO: 6493 - RNA, 19 nt, Homo sapiens
aaaagcuggguugagagga

SEQ ID NO: 6494 - RNA, 22 nt, Homo sapiens
ccucccacacccaaggcuugca

SEQ ID NO: 6495 - RNA, 22 nt, Homo sapiens
ucagugcacuacagaacuuugu

SEQ ID NO: 6496 - RNA, 22 nt, Homo sapiens
ucagugcaucacagaacuuugu

SEQ ID NO: 6497 - RNA, 21 nt, Homo sapiens
ucagugcaugacagaacuugg

SEQ ID NO: 6498 - RNA, 22 nt, Homo sapiens
uacccauugcauaucggaguug

SEQ ID NO: 6499 - RNA, 20 nt, Homo sapiens
auuccuagaaauuguucaua

SEQ ID NO: 6500 - RNA, 22 nt, Homo sapiens
ggagacgcggcccuguuggagu

SEQ ID NO: 6501 - RNA, 18 nt, Homo sapiens
ugcuuccuuucagagggu

SEQ ID NO: 6502 - RNA, 22 nt, Homo sapiens
aucuggagguaagaagcacuuu

SEQ ID NO: 6503 - RNA, 23 nt, Homo sapiens
aggaagcccuggaggggcuggag

SEQ ID NO: 6504 - RNA, 22 nt, Homo sapiens
cccugugcccggcccacuucug

SEQ ID NO: 6505 - RNA, 17 nt, Homo sapiens
ucccuguucgggcgcca

SEQ ID NO: 6506 - RNA, 23 nt, Homo sapiens
aaugacacgaucacucccguuga

SEQ ID NO: 6507 - RNA, 20 nt, Homo sapiens
ccccagggcgacgcggcggg

SEQ ID NO: 6508 - RNA, 21 nt, Homo sapiens
uaaagugcugacagugcagau

SEQ ID NO: 6509 - RNA, 23 nt, Homo sapiens
cggcccgggcugcugcuguuccu

SEQ ID NO: 6510 - RNA, 21 nt, Homo sapiens
agggcccccccucaauccugu

SEQ ID NO: 6511 - RNA, 21 nt, Homo sapiens
cggcggggacggcgauugguc

SEQ ID NO: 6512 - RNA, 22 nt, Homo sapiens
aggcggggcgccgcgggaccgc

SEQ ID NO: 6513 - RNA, 21 nt, Homo sapiens
uaaagugcugacagugcagau

SEQ ID NO: 6514 - RNA, 21 nt, Homo sapiens
cccggagccaggaugcagcuc

SEQ ID NO: 6515 - RNA, 22 nt, Homo sapiens
ucugggcaacaaagugagaccu

SEQ ID NO: 6516 - RNA, 23 nt, Homo sapiens
cggcccgggcugcugcuguuccu

SEQ ID NO: 6517 - RNA, 22 nt, Homo sapiens
uagcagcacauaaugguuugug

SEQ ID NO: 6518 - RNA, 22 nt, Homo sapiens
uagcagcacaucaugguuuaca

SEQ ID NO: 6519 - RNA, 22 nt, Homo sapiens
uagcagcacguaaauauuggcg

SEQ ID NO: 6520 - RNA, 20 nt, Homo sapiens
ccccagggcgacgcggcggg

SEQ ID NO: 6521 - RNA, 21 nt, Homo sapiens
uagcagcacagaaauauuggc

SEQ ID NO: 6522 - RNA, 22 nt, Homo sapiens
aagcugccaguugaagaacugu

SEQ ID NO: 6523 - RNA, 21 nt, Homo sapiens
agggcccccccucaauccugu

SEQ ID NO: 6524 - RNA, 21 nt, Homo sapiens
gccccugggccuauccuagaa

SEQ ID NO: 6525 - RNA, 22 nt, Homo sapiens
uggcagugucuuagcugguugu

SEQ ID NO: 6526 - RNA, 23 nt, Homo sapiens
aggcaguguaguuagcugauugc

SEQ ID NO: 6527 - RNA, 22 nt, Homo sapiens
cagcagcaauucauguuuugaa

SEQ ID NO: 6528 - RNA, 21 nt, Homo sapiens
ugucuugcaggccgucaugca

SEQ ID NO: 6529 - RNA, 22 nt, Homo sapiens
uggcaguguauuguuagcuggu

SEQ ID NO: 6530 - RNA, 22 nt, Homo sapiens
aggcaguguauuguuagcuggc

SEQ ID NO: 6531 - RNA, 21 nt, Homo sapiens
cagcagcacacugugguuugu

SEQ ID NO: 6532 - RNA, 25 nt, Homo sapiens
gcugggcagggcuucugagcuccuu

SEQ ID NO: 6533 - RNA, 19 nt, Homo sapiens
aagcagcugccucugaggc

SEQ ID NO: 6534 - RNA, 22 nt, Homo sapiens
ugcggggcuagggcuaacagca

SEQ ID NO: 6535 - RNA, 22 nt, Homo sapiens
ugugcgcagggagaccucuccc

SEQ ID NO: 6536 - RNA, 21 nt, Homo sapiens
cuagacugaagcuccuugagg

SEQ ID NO: 6537 - RNA, 22 nt, Homo sapiens
ucugcccccuccgcugcugcca

SEQ ID NO: 6538 - RNA, 21 nt, Homo sapiens
agggcccccccucaauccugu

SEQ ID NO: 6539 - RNA, 20 nt, Homo sapiens
acugccccaggugcugcugg

SEQ ID NO: 6540 - RNA, 23 nt, Homo sapiens
ucccccaggugugauucugauuu

SEQ ID NO: 6541 - RNA, 21 nt, Homo sapiens
cggggcagcucaguacaggau

SEQ ID NO: 6542 - RNA, 23 nt, Homo sapiens
uacuccagagggcgucacucaug

SEQ ID NO: 6543 - RNA, 23 nt, Homo sapiens
agugccugagggaguaagagccc

SEQ ID NO: 6544 - RNA, 22 nt, Homo sapiens
ggggguccccggugcucggauc

SEQ ID NO: 6545 - RNA, 24 nt, Homo sapiens
acugggggcuuucgggcucugcgu

SEQ ID NO: 6546 - RNA, 24 nt, Homo sapiens
ugccugggucucuggccugcgcgu

SEQ ID NO: 6547 - RNA, 22 nt, Homo sapiens
ugcggggcuagggcuaacagca

SEQ ID NO: 6548 - RNA, 21 nt, Homo sapiens
uggcagggaggcugggagggg

SEQ ID NO: 6549 - RNA, 18 nt, Homo sapiens
cagggaggugaaugugau

SEQ ID NO: 6550 - RNA, 21 nt, Homo sapiens
uucacaguggcuaaguuccgc

SEQ ID NO: 6551 - RNA, 21 nt, Homo sapiens
uucacaguggcuaaguucugc

SEQ ID NO: 6552 - RNA, 22 nt, Homo sapiens
gucccucuccaaaugugucuug

SEQ ID NO: 6553 - RNA, 24 nt, Homo sapiens
uucuccaaaagaaagcacuuucug

SEQ ID NO: 6554 - RNA, 22 nt, Homo sapiens
aagugccuccuuuuagaguguu

SEQ ID NO: 6555 - RNA, 22 nt, Homo sapiens
ucugcccccuccgcugcugcca

SEQ ID NO: 6556 - RNA, 20 nt, Homo sapiens
acugccccaggugcugcugg

SEQ ID NO: 6557 - RNA, 21 nt, Homo sapiens
cggggcagcucaguacaggau

SEQ ID NO: 6558 - RNA, 21 nt, Homo sapiens
ccgucgccgccacccgagccg

SEQ ID NO: 6559 - RNA, 22 nt, Homo sapiens
ugggucuuugcgggcgagauga

SEQ ID NO: 6560 - RNA, 22 nt, Homo sapiens
uuuccggcucgcgugggugugu

SEQ ID NO: 6561 - RNA, 18 nt, Homo sapiens
cgggcguggugguggggg

SEQ ID NO: 6562 - RNA, 18 nt, Homo sapiens
uccagugcccuccucucc

SEQ ID NO: 6563 - RNA, 22 nt, Homo sapiens
aacuggcccucaaagucccgcu

SEQ ID NO: 6564 - RNA, 22 nt, Homo sapiens
cugugcgugugacagcggcuga

SEQ ID NO: 6565 - RNA, 21 nt, Homo sapiens
ugauuguccaaacgcaauucu

SEQ ID NO: 6566 - RNA, 25 nt, Homo sapiens
aggggugguguugggacagcuccgu

SEQ ID NO: 6567 - RNA, 20 nt, Homo sapiens
ggggagcuguggaagcagua

SEQ ID NO: 6568 - RNA, 23 nt, Homo sapiens
uucauuugguauaaaccgcgauu

SEQ ID NO: 6569 - RNA, 19 nt, Homo sapiens
gagccaguuggacaggagc

SEQ ID NO: 6570 - RNA, 22 nt, Homo sapiens
cacuggcuccuuucuggguaga

SEQ ID NO: 6571 - RNA, 21 nt, Homo sapiens
uccugcgcgucccagaugccc

SEQ ID NO: 6572 - RNA, 21 nt, Homo sapiens
cggcggggacggcgauugguc

SEQ ID NO: 6573 - RNA, 21 nt, Homo sapiens
aagccugcccggcuccucggg

SEQ ID NO: 6574 - RNA, 22 nt, Homo sapiens
aggcggggcgccgcgggaccgc

SEQ ID NO: 6575 - RNA, 22 nt, Homo sapiens
uggugggcacagaaucuggacu

SEQ ID NO: 6576 - RNA, 22 nt, Homo sapiens
uggugggccgcagaacaugugc

SEQ ID NO: 6577 - RNA, 22 nt, Homo sapiens
uagcaccaucugaaaucgguua

SEQ ID NO: 6578 - RNA, 22 nt, Homo sapiens
ugagccccugugccgcccccag

SEQ ID NO: 6579 - RNA, 21 nt, Homo sapiens
cugacuguugccguccuccag

SEQ ID NO: 6580 - RNA, 22 nt, Homo sapiens
acuccagccccacagccucagc

SEQ ID NO: 6581 - RNA, 19 nt, Homo sapiens
aggcugcggaauucaggac

SEQ ID NO: 6582 - RNA, 24 nt, Homo sapiens
uggggagcugaggcucugggggug

SEQ ID NO: 6583 - RNA, 21 nt, Homo sapiens
ccccaccuccucucuccucag

SEQ ID NO: 6584 - RNA, 23 nt, Homo sapiens
caaagugcucauagugcagguag

SEQ ID NO: 6585 - RNA, 22 nt, Homo sapiens
aaggagcucacagucuauugag

SEQ ID NO: 6586 - RNA, 22 nt, Homo sapiens
uccgagccugggucucccucuu

SEQ ID NO: 6587 - RNA, 23 nt, Homo sapiens
aaggagcuuacaaucuagcuggg

SEQ ID NO: 6588 - RNA, 22 nt, Homo sapiens
ugagaacugaauuccauggguu

SEQ ID NO: 6589 - RNA, 21 nt, Homo sapiens
ccaguccugugccugccgccu

SEQ ID NO: 6590 - RNA, 22 nt, Homo sapiens
uauggcacugguagaauucacu

SEQ ID NO: 6591 - RNA, 22 nt, Homo sapiens
uauugcacucgucccggccucc

SEQ ID NO: 6592 - RNA, 23 nt, Homo sapiens
uaaggugcaucuagugcagauag

SEQ ID NO: 6593 - RNA, 21 nt, Homo sapiens
gguuugguccuagccuuucua

SEQ ID NO: 6594 - RNA, 21 nt, Homo sapiens
uucacaguggcuaaguuccgc

SEQ ID NO: 6595 - RNA, 21 nt, Homo sapiens
uucacaguggcuaaguucugc

SEQ ID NO: 6596 - RNA, 23 nt, Homo sapiens
gaagugcuucgauuuuggggugu

SEQ ID NO: 6597 - RNA, 22 nt, Homo sapiens
aggcaguguauuguuagcuggc

SEQ ID NO: 6598 - RNA, 22 nt, Homo sapiens
cgucaacacuugcugguuuccu

SEQ ID NO: 6599 - RNA, 18 nt, Homo sapiens
ugcuuccuuucagagggu

SEQ ID NO: 6600 - RNA, 22 nt, Homo sapiens
aucuggagguaagaagcacuuu

SEQ ID NO: 6601 - RNA, 22 nt, Homo sapiens
caaaguuuaagauccuugaagu

SEQ ID NO: 6602 - RNA, 23 nt, Homo sapiens
ugagugugugugugugagugugu

SEQ ID NO: 6603 - RNA, 22 nt, Homo sapiens
agucauuggaggguuugagcag

SEQ ID NO: 6604 - RNA, 19 nt, Homo sapiens
aguguggcuuucuuagagc

SEQ ID NO: 6605 - RNA, 23 nt, Homo sapiens
ggcagguucucacccucucuagg

SEQ ID NO: 6606 - RNA, 21 nt, Homo sapiens
uggaggagaaggaaggugaug

SEQ ID NO: 6607 - RNA, 21 nt, Homo sapiens
ccuggaaacacugagguugug

SEQ ID NO: 6608 - RNA, 18 nt, Homo sapiens
cgggcguggugguggggg

SEQ ID NO: 6609 - RNA, 21 nt, Homo sapiens
uccuucugcuccgucccccag

SEQ ID NO: 6610 - RNA, 22 nt, Homo sapiens
aacuggcccucaaagucccgcu

SEQ ID NO: 6611 - RNA, 23 nt, Homo sapiens
agugccugagggaguaagagccc

SEQ ID NO: 6612 - RNA, 23 nt, Homo sapiens
ugaguaccgccaugucuguuggg

SEQ ID NO: 6613 - RNA, 22 nt, Homo sapiens
gguggcccggccgugccugagg

SEQ ID NO: 6614 - RNA, 23 nt, Homo sapiens
ugucacucggcucggcccacuac

SEQ ID NO: 6615 - RNA, 20 nt, Homo sapiens
uaaagagcccuguggagaca

SEQ ID NO: 6616 - RNA, 20 nt, Homo sapiens
guagaggagauggcgcaggg

SEQ ID NO: 6617 - RNA, 22 nt, Homo sapiens
aaaaccgucuaguuacaguugu

SEQ ID NO: 6618 - RNA, 23 nt, Homo sapiens
uuaaugcuaaucgugauaggggu

SEQ ID NO: 6619 - RNA, 22 nt, Homo sapiens
ugagccccugugccgcccccag

SEQ ID NO: 6620 - RNA, 21 nt, Homo sapiens
gccccugggccuauccuagaa

SEQ ID NO: 6621 - RNA, 22 nt, Homo sapiens
uucaccaccuucuccacccagc

SEQ ID NO: 6622 - RNA, 23 nt, Homo sapiens
acuugggcacugaaacaaugucc

SEQ ID NO: 6623 - RNA, 22 nt, Homo sapiens
ucaggccaggcacaguggcuca

SEQ ID NO: 6624 - RNA, 19 nt, Homo sapiens
ugggcguaucuguaugcua

SEQ ID NO: 6625 - RNA, 18 nt, Homo sapiens
cagggaggugaaugugau

SEQ ID NO: 6626 - RNA, 22 nt, Homo sapiens
uucccuuugucauccuaugccu

SEQ ID NO: 6627 - RNA, 22 nt, Homo sapiens
uucccuuugucauccuucgccu

SEQ ID NO: 6628 - RNA, 23 nt, Homo sapiens
uaagugcuuccauguuuuaguag

SEQ ID NO: 6629 - RNA, 23 nt, Homo sapiens
uaagugcuuccauguuugagugu

SEQ ID NO: 6630 - RNA, 23 nt, Homo sapiens
ucccuguccuccaggagcucacg

SEQ ID NO: 6631 - RNA, 21 nt, Homo sapiens
cccggagccaggaugcagcuc

SEQ ID NO: 6632 - RNA, 23 nt, Homo sapiens
aggaagcccuggaggggcuggag

SEQ ID NO: 6633 - RNA, 22 nt, Homo sapiens
ugagccccugugccgcccccag

SEQ ID NO: 6634 - RNA, 20 nt, Homo sapiens
ucugcaggguuugcuuugag

SEQ ID NO: 6635 - RNA, 17 nt, Homo sapiens
ucccaccgcugccaccc

SEQ ID NO: 6636 - RNA, 21 nt, Homo sapiens
uccugcgcgucccagaugccc

SEQ ID NO: 6637 - RNA, 22 nt, Homo sapiens
cgucaacacuugcugguuuccu

SEQ ID NO: 6638 - RNA, 21 nt, Homo sapiens
cggcggggacggcgauugguc

SEQ ID NO: 6639 - RNA, 22 nt, Homo sapiens
aggcggggcgccgcgggaccgc

SEQ ID NO: 6640 - RNA, 23 nt, Homo sapiens
ugaggggcagagagcgagacuuu

SEQ ID NO: 6641 - RNA, 21 nt, Homo sapiens
ucacagugaaccggucucuuu

SEQ ID NO: 6642 - RNA, 23 nt, Homo sapiens
ugucugcccgcaugccugccucu

SEQ ID NO: 6643 - RNA, 22 nt, Homo sapiens
uagcagcacauaaugguuugug

SEQ ID NO: 6644 - RNA, 22 nt, Homo sapiens
uggcaguguauuguuagcuggu

SEQ ID NO: 6645 - RNA, 23 nt, Homo sapiens
agguuacccgagcaacuuugcau

SEQ ID NO: 6646 - RNA, 22 nt, Homo sapiens
uacccagagcaugcagugugaa

SEQ ID NO: 6647 - RNA, 21 nt, Homo sapiens
cgcgggugcuuacugacccuu

SEQ ID NO: 6648 - RNA, 22 nt, Homo sapiens
aucacacaaaggcaacuuuugu

SEQ ID NO: 6649 - RNA, 23 nt, Homo sapiens
ucucacacagaaaucgcacccgu

SEQ ID NO: 6650 - RNA, 22 nt, Homo sapiens
aguggggaacccuuccaugagg

SEQ ID NO: 6651 - RNA, 22 nt, Homo sapiens
uggagugugacaaugguguuug

SEQ ID NO: 6652 - RNA, 21 nt, Homo sapiens
cccggagccaggaugcagcuc

SEQ ID NO: 6653 - RNA, 17 nt, Homo sapiens
ucgccuccuccucuccc

SEQ ID NO: 6654 - RNA, 21 nt, Homo sapiens
ugacaacuauggaugagcucu

SEQ ID NO: 6655 - RNA, 22 nt, Homo sapiens
uggagugugacaaugguguuug

SEQ ID NO: 6656 - RNA, 24 nt, Homo sapiens
ucccugagacccuuuaaccuguga

SEQ ID NO: 6657 - RNA, 22 nt, Homo sapiens
ucccugagacccuaacuuguga

SEQ ID NO: 6658 - RNA, 23 nt, Homo sapiens
ccucagggcuguagaacagggcu

SEQ ID NO: 6659 - RNA, 22 nt, Homo sapiens
acucggcguggcgucggucgug

SEQ ID NO: 6660 - RNA, 23 nt, Homo sapiens
ucuggcuccgugucuucacuccc

SEQ ID NO: 6661 - RNA, 21 nt, Homo sapiens
ucgaggagcucacagucuagu

SEQ ID NO: 6662 - RNA, 22 nt, Homo sapiens
aacuggcccucaaagucccgcu

SEQ ID NO: 6663 - RNA, 21 nt, Homo sapiens
aggggugcuaucugugauuga

SEQ ID NO: 6664 - RNA, 20 nt, Homo sapiens
ggggagcuguggaagcagua

SEQ ID NO: 6665 - RNA, 22 nt, Homo sapiens
aaggagcucacagucuauugag

SEQ ID NO: 6666 - RNA, 22 nt, Homo sapiens
caaaguuuaagauccuugaagu

SEQ ID NO: 6667 - RNA, 23 nt, Homo sapiens
aaggagcuuacaaucuagcuggg

SEQ ID NO: 6668 - RNA, 21 nt, Homo sapiens
cucccacaugcaggguuugca

SEQ ID NO: 6669 - RNA, 22 nt, Homo sapiens
uggcaguguauuguuagcuggu

SEQ ID NO: 6670 - RNA, 22 nt, Homo sapiens
ccucccacacccaaggcuugca

SEQ ID NO: 6671 - RNA, 22 nt, Homo sapiens
uaaugccccuaaaaauccuuau

SEQ ID NO: 6672 - RNA, 21 nt, Homo sapiens
guucaaauccagaucuauaac

SEQ ID NO: 6673 - RNA, 27 nt, Homo sapiens
auugaucaucgacacuucgaacgcaau

SEQ ID NO: 6674 - RNA, 27 nt, Homo sapiens
auugaucaucgacacuucgaacgcaau

SEQ ID NO: 6675 - RNA, 22 nt, Homo sapiens
caaaguuuaagauccuugaagu

SEQ ID NO: 6676 - RNA, 18 nt, Homo sapiens
ugaggcaguagauugaau

SEQ ID NO: 6677 - RNA, 21 nt, Homo sapiens
gcccuccgcccgugcaccccg

SEQ ID NO: 6678 - RNA, 25 nt, Homo sapiens
ggcggagggaaguagguccguuggu

SEQ ID NO: 6679 - RNA, 20 nt, Homo sapiens
guguguggaaaugcuucugc

SEQ ID NO: 6680 - RNA, 21 nt, Homo sapiens
uucacaguggcuaaguuccgc

SEQ ID NO: 6681 - RNA, 22 nt, Homo sapiens
aacuggaucaauuauaggagug

SEQ ID NO: 6682 - RNA, 18 nt, Homo sapiens
cagggaggugaaugugau

SEQ ID NO: 6683 - RNA, 21 nt, Homo sapiens
uggaggagaaggaaggugaug

SEQ ID NO: 6684 - RNA, 20 nt, Homo sapiens
guagaggagauggcgcaggg

SEQ ID NO: 6685 - RNA, 20 nt, Homo sapiens
ugagcccuguccucccgcag

SEQ ID NO: 6686 - RNA, 22 nt, Homo sapiens
uucuggaauucugugugaggga

SEQ ID NO: 6687 - RNA, 22 nt, Homo sapiens
aagcccuuaccccaaaaagcau

SEQ ID NO: 6688 - RNA, 22 nt, Homo sapiens
uacucaggagaguggcaaucac

SEQ ID NO: 6689 - RNA, 18 nt, Homo sapiens
cagggaggugaaugugau

SEQ ID NO: 6690 - RNA, 22 nt, Homo sapiens
gucccucuccaaaugugucuug

SEQ ID NO: 6691 - RNA, 21 nt, Homo sapiens
agagaagaagaucagccugca

SEQ ID NO: 6692 - RNA, 22 nt, Homo sapiens
ucuucucuguuuuggccaugug

SEQ ID NO: 6693 - RNA, 22 nt, Homo sapiens
uggagugugacaaugguguuug

SEQ ID NO: 6694 - RNA, 23 nt, Homo sapiens
ucuggcuccgugucuucacuccc

SEQ ID NO: 6695 - RNA, 22 nt, Homo sapiens
uagcuuaucagacugauguuga

SEQ ID NO: 6696 - RNA, 21 nt, Homo sapiens
ugagcuaaaugugugcuggga

SEQ ID NO: 6697 - RNA, 23 nt, Homo sapiens
ucuggcuccgugucuucacuccc

SEQ ID NO: 6698 - RNA, 22 nt, Homo sapiens
agaggcuggccgugaugaauuc

SEQ ID NO: 6699 - RNA, 23 nt, Homo sapiens
ucuggcuccgugucuucacuccc

SEQ ID NO: 6700 - RNA, 21 nt, Homo sapiens
cggcggggacggcgauugguc

SEQ ID NO: 6701 - RNA, 23 nt, Homo sapiens
ugaggggcagagagcgagacuuu

SEQ ID NO: 6702 - RNA, 22 nt, Homo sapiens
aggcggggcgccgcgggaccgc

SEQ ID NO: 6703 - RNA, 22 nt, Homo sapiens
ugcggggcuagggcuaacagca

SEQ ID NO: 6704 - RNA, 23 nt, Homo sapiens
acuuacagacaagagccuugcuc

SEQ ID NO: 6705 - RNA, 22 nt, Homo sapiens
aagcugccaguugaagaacugu

SEQ ID NO: 6706 - RNA, 23 nt, Homo sapiens
gaacgcgcuucccuauagagggu

SEQ ID NO: 6707 - RNA, 19 nt, Homo sapiens
aggcugcggaauucaggac

SEQ ID NO: 6708 - RNA, 21 nt, Homo sapiens
uucacaguggcuaaguuccgc

SEQ ID NO: 6709 - RNA, 21 nt, Homo sapiens
uucacaguggcuaaguucugc

SEQ ID NO: 6710 - RNA, 22 nt, Homo sapiens
augggugaauuuguagaaggau

SEQ ID NO: 6711 - RNA, 18 nt, Homo sapiens
cagggaggugaaugugau

SEQ ID NO: 6712 - RNA, 22 nt, Homo sapiens
gucauacacggcucuccucucu

SEQ ID NO: 6713 - RNA, 21 nt, Homo sapiens
uaggacacauggucuacuucu

SEQ ID NO: 6714 - RNA, 27 nt, Homo sapiens
accuucuuguauaagcacugugcuaaa

SEQ ID NO: 6715 - RNA, 21 nt, Homo sapiens
gcccuccgcccgugcaccccg

SEQ ID NO: 6716 - RNA, 19 nt, Homo sapiens
aggcugcggaauucaggac

SEQ ID NO: 6717 - RNA, 20 nt, Homo sapiens
ggggagcuguggaagcagua

SEQ ID NO: 6718 - RNA, 27 nt, Homo sapiens
accuucuuguauaagcacugugcuaaa

SEQ ID NO: 6719 - RNA, 22 nt, Homo sapiens
caggauguggucaaguguuguu

SEQ ID NO: 6720 - RNA, 22 nt, Homo sapiens
agaguugagucuggacgucccg

SEQ ID NO: 6721 - RNA, 21 nt, Homo sapiens
aauaauacaugguugaucuuu

SEQ ID NO: 6722 - RNA, 21 nt, Homo sapiens
cccggagccaggaugcagcuc

SEQ ID NO: 6723 - RNA, 22 nt, Homo sapiens
ucaccagcccuguguucccuag

SEQ ID NO: 6724 - RNA, 20 nt, Homo sapiens
cuuccucgucugucugcccc

SEQ ID NO: 6725 - RNA, 22 nt, Homo sapiens
ucggauccgucugagcuuggcu

SEQ ID NO: 6726 - RNA, 23 nt, Homo sapiens
agcugguguugugaaucaggccg

SEQ ID NO: 6727 - RNA, 23 nt, Homo sapiens
ucuggcuccgugucuucacuccc

SEQ ID NO: 6728 - RNA, 22 nt, Homo sapiens
uugggaucauuuugcauccaua

SEQ ID NO: 6729 - RNA, 19 nt, Homo sapiens
gagccaguuggacaggagc

SEQ ID NO: 6730 - RNA, 23 nt, Homo sapiens
acuugggcacugaaacaaugucc

SEQ ID NO: 6731 - RNA, 23 nt, Homo sapiens
aggaagcccuggaggggcuggag

SEQ ID NO: 6732 - RNA, 21 nt, Homo sapiens
uggaggagaaggaaggugaug

SEQ ID NO: 6733 - RNA, 23 nt, Homo sapiens
cugggaucuccggggucuugguu

SEQ ID NO: 6734 - RNA, 22 nt, Homo sapiens
cacuggcuccuuucuggguaga

SEQ ID NO: 6735 - RNA, 22 nt, Homo sapiens
caaagugccucccuuuagagug

SEQ ID NO: 6736 - RNA, 21 nt, Homo sapiens
ccaccaccgugucugacacuu

SEQ ID NO: 6737 - RNA, 22 nt, Homo sapiens
ucugggcaacaaagugagaccu

SEQ ID NO: 6738 - RNA, 21 nt, Homo sapiens
cugaccuaugaauugacagcc

SEQ ID NO: 6739 - RNA, 21 nt, Homo sapiens
augaccuaugaauugacagac

SEQ ID NO: 6740 - RNA, 25 nt, Homo sapiens
gcugggcagggcuucugagcuccuu

SEQ ID NO: 6741 - RNA, 24 nt, Homo sapiens
uucuccaaaagaaagcacuuucug

SEQ ID NO: 6742 - RNA, 22 nt, Homo sapiens
aagugccuccuuuuagaguguu

SEQ ID NO: 6743 - RNA, 24 nt, Homo sapiens
uggcccugacugaagaccagcagu

SEQ ID NO: 6744 - RNA, 22 nt, Homo sapiens
aggugguccguggcgcguucgc

SEQ ID NO: 6745 - RNA, 22 nt, Homo sapiens
uggcagugucuuagcugguugu

SEQ ID NO: 6746 - RNA, 22 nt, Homo sapiens
ugcggggcuagggcuaacagca

SEQ ID NO: 6747 - RNA, 22 nt, Homo sapiens
ugcaacuuaccugagucauuga

SEQ ID NO: 6748 - RNA, 22 nt, Homo sapiens
cucuagagggaagcacuuucug

SEQ ID NO: 6749 - RNA, 23 nt, Homo sapiens
ucccuguccuccaggagcucacg

SEQ ID NO: 6750 - RNA, 22 nt, Homo sapiens
cagugguuuuacccuaugguag

SEQ ID NO: 6751 - RNA, 20 nt, Homo sapiens
guguguggaaaugcuucugc

SEQ ID NO: 6752 - RNA, 21 nt, Homo sapiens
ucuuguguucucuagaucagu

SEQ ID NO: 6753 - RNA, 24 nt, Homo sapiens
ugccugggucucuggccugcgcgu

SEQ ID NO: 6754 - RNA, 21 nt, Homo sapiens
uaaagugcugacagugcagau

SEQ ID NO: 6755 - RNA, 23 nt, Homo sapiens
cagugcaaugauauugucaaagc

SEQ ID NO: 6756 - RNA, 22 nt, Homo sapiens
aggcaguguauuguuagcuggc

SEQ ID NO: 6757 - RNA, 18 nt, Homo sapiens
aucccaccucugccacca

SEQ ID NO: 6758 - RNA, 22 nt, Homo sapiens
ccucccacacccaaggcuugca

SEQ ID NO: 6759 - RNA, 23 nt, Homo sapiens
ugucacucggcucggcccacuac

SEQ ID NO: 6760 - RNA, 21 nt, Homo sapiens
uaaagugcugacagugcagau

SEQ ID NO: 6761 - RNA, 23 nt, Homo sapiens
cagugcaaugauauugucaaagc

SEQ ID NO: 6762 - RNA, 18 nt, Homo sapiens
gucccuguucaggcgcca

SEQ ID NO: 6763 - RNA, 20 nt, Homo sapiens
ccccagggcgacgcggcggg

SEQ ID NO: 6764 - RNA, 17 nt, Homo sapiens
gugggggagaggcuguc

SEQ ID NO: 6765 - RNA, 22 nt, Homo sapiens
uagguaguuuccuguuguuggg

SEQ ID NO: 6766 - RNA, 21 nt, Homo sapiens
cacaagguauugguauuaccu

SEQ ID NO: 6767 - RNA, 22 nt, Homo sapiens
ugagguaguaguuuguacaguu

SEQ ID NO: 6768 - RNA, 17 nt, Homo sapiens
ucgccuccuccucuccc

SEQ ID NO: 6769 - RNA, 22 nt, Homo sapiens
uacgucaucguugucaucguca

SEQ ID NO: 6770 - RNA, 21 nt, Homo sapiens
uccugcgcgucccagaugccc

SEQ ID NO: 6771 - RNA, 21 nt, Homo sapiens
gaaggcgcuucccuuuggagu

SEQ ID NO: 6772 - RNA, 22 nt, Homo sapiens
gaaggcgcuucccuuuagagcg

SEQ ID NO: 6773 - RNA, 20 nt, Homo sapiens
gugucugggcggacagcugc

SEQ ID NO: 6774 - RNA, 22 nt, Homo sapiens
ucggccugaccacccaccccac

SEQ ID NO: 6775 - RNA, 23 nt, Homo sapiens
acuccauuuguuuugaugaugga

SEQ ID NO: 6776 - RNA, 23 nt, Homo sapiens
agcuacauugucugcuggguuuc

SEQ ID NO: 6777 - RNA, 19 nt, Homo sapiens
aggcugcggaauucaggac

SEQ ID NO: 6778 - RNA, 22 nt, Homo sapiens
aaaagcuggguugagagggcga

SEQ ID NO: 6779 - RNA, 22 nt, Homo sapiens
aaaagcuggguugagagggcaa

SEQ ID NO: 6780 - RNA, 20 nt, Homo sapiens
aaaagcuggguugagagggu

SEQ ID NO: 6781 - RNA, 19 nt, Homo sapiens
aaaagcuggguugagagga

SEQ ID NO: 6782 - RNA, 20 nt, Homo sapiens
ggggagcuguggaagcagua

SEQ ID NO: 6783 - RNA, 23 nt, Homo sapiens
uggugcggagagggcccacagug

SEQ ID NO: 6784 - RNA, 22 nt, Homo sapiens
uauguaauaugguccacaucuu

SEQ ID NO: 6785 - RNA, 21 nt, Homo sapiens
uggguuuacguugggagaacu

SEQ ID NO: 6786 - RNA, 21 nt, Homo sapiens
cucccacaugcaggguuugca

SEQ ID NO: 6787 - RNA, 20 nt, Homo sapiens
ccucugggcccuuccuccag

SEQ ID NO: 6788 - RNA, 22 nt, Homo sapiens
ucucugggccugugucuuaggc

SEQ ID NO: 6789 - RNA, 23 nt, Homo sapiens
agcuacauugucugcuggguuuc

SEQ ID NO: 6790 - RNA, 21 nt, Homo sapiens
uaaagugcugacagugcagau

SEQ ID NO: 6791 - RNA, 23 nt, Homo sapiens
cagugcaaugauauugucaaagc

SEQ ID NO: 6792 - RNA, 18 nt, Homo sapiens
cagggaggugaaugugau

SEQ ID NO: 6793 - RNA, 20 nt, Homo sapiens
ugagcccuguccucccgcag

SEQ ID NO: 6794 - RNA, 21 nt, Homo sapiens
gaaggcgcuucccuuuggagu

SEQ ID NO: 6795 - RNA, 22 nt, Homo sapiens
gaaggcgcuucccuuuagagcg

SEQ ID NO: 6796 - RNA, 22 nt, Homo sapiens
uggagagaaaggcaguuccuga

SEQ ID NO: 6797 - RNA, 21 nt, Homo sapiens
cuuuuugcggucugggcuugc

SEQ ID NO: 6798 - RNA, 22 nt, Homo sapiens
uguaacagcaacuccaugugga

SEQ ID NO: 6799 - RNA, 23 nt, Homo sapiens
caacggaaucccaaaagcagcug

SEQ ID NO: 6800 - RNA, 22 nt, Homo sapiens
auccgcgcucugacucucugcc

SEQ ID NO: 6801 - RNA, 24 nt, Homo sapiens
uuuggcaaugguagaacucacacu

SEQ ID NO: 6802 - RNA, 21 nt, Homo sapiens
aaggcagggcccccgcucccc

SEQ ID NO: 6803 - RNA, 21 nt, Homo sapiens
ucguggccuggucuccauuau

SEQ ID NO: 6804 - RNA, 21 nt, Homo sapiens
ucguggccuggucuccauuau

SEQ ID NO: 6805 - RNA, 18 nt, Homo sapiens
cgggcguggugguggggg

SEQ ID NO: 6806 - RNA, 21 nt, Homo sapiens
cggcggggacggcgauugguc

SEQ ID NO: 6807 - RNA, 22 nt, Homo sapiens
aggcggggcgccgcgggaccgc

SEQ ID NO: 6808 - RNA, 22 nt, Homo sapiens
ugcggggcuagggcuaacagca

SEQ ID NO: 6809 - RNA, 17 nt, Homo sapiens
ucgccuccuccucuccc

SEQ ID NO: 6810 - RNA, 22 nt, Homo sapiens
gaugagcucauuguaauaugag

SEQ ID NO: 6811 - RNA, 20 nt, Homo sapiens
accaggaggcugaggccccu

SEQ ID NO: 6812 - RNA, 21 nt, Homo sapiens
uggaggagaaggaaggugaug

SEQ ID NO: 6813 - RNA, 22 nt, Homo sapiens
uguaaacauccuacacucagcu

SEQ ID NO: 6814 - RNA, 18 nt, Homo sapiens
cagggaggugaaugugau

SEQ ID NO: 6815 - RNA, 20 nt, Homo sapiens
ucugcaggguuugcuuugag

SEQ ID NO: 6816 - RNA, 22 nt, Homo sapiens
aaaucucugcaggcaaauguga

SEQ ID NO: 6817 - RNA, 17 nt, Homo sapiens
gugggggagaggcuguc

SEQ ID NO: 6818 - RNA, 22 nt, Homo sapiens
uuagggcccuggcuccaucucc

SEQ ID NO: 6819 - RNA, 18 nt, Homo sapiens
cagggaggugaaugugau

SEQ ID NO: 6820 - RNA, 23 nt, Homo sapiens
ucuggcuccgugucuucacuccc

SEQ ID NO: 6821 - RNA, 23 nt, Homo sapiens
cggcccgggcugcugcuguuccu

SEQ ID NO: 6822 - RNA, 22 nt, Homo sapiens
uggagagaaaggcaguuccuga

SEQ ID NO: 6823 - RNA, 21 nt, Homo sapiens
agggcccccccucaauccugu

SEQ ID NO: 6824 - RNA, 23 nt, Homo sapiens
ugaggggcagagagcgagacuuu

SEQ ID NO: 6825 - RNA, 20 nt, Homo sapiens
guccgcucggcgguggccca

SEQ ID NO: 6826 - RNA, 21 nt, Homo sapiens
uggaggagaaggaaggugaug

SEQ ID NO: 6827 - RNA, 22 nt, Homo sapiens
ugggucuuugcgggcgagauga

SEQ ID NO: 6828 - RNA, 21 nt, Homo sapiens
ugucuugcaggccgucaugca

SEQ ID NO: 6829 - RNA, 22 nt, Homo sapiens
ucagcaaacauuuauugugugc

SEQ ID NO: 6830 - RNA, 22 nt, Homo sapiens
caaucacuaacuccacugccau

SEQ ID NO: 6831 - RNA, 23 nt, Homo sapiens
aggaugagcaaagaaaguagauu

SEQ ID NO: 6832 - RNA, 22 nt, Homo sapiens
cggaugagcaaagaaagugguu

SEQ ID NO: 6833 - RNA, 17 nt, Homo sapiens
ucucgcuggggccucca

SEQ ID NO: 6834 - RNA, 21 nt, Homo sapiens
uggcagggaggcugggagggg

SEQ ID NO: 6835 - RNA, 22 nt, Homo sapiens
aauugcacgguauccaucugua

SEQ ID NO: 6836 - RNA, 21 nt, Homo sapiens
agggggaaaguucuauagucc

SEQ ID NO: 6837 - RNA, 22 nt, Homo sapiens
ugagccccugugccgcccccag

SEQ ID NO: 6838 - RNA, 20 nt, Homo sapiens
ugagcccuguccucccgcag

SEQ ID NO: 6839 - RNA, 22 nt, Homo sapiens
uucuggaauucugugugaggga

SEQ ID NO: 6840 - RNA, 22 nt, Homo sapiens
aagcccuuaccccaaaaagcau

SEQ ID NO: 6841 - RNA, 23 nt, Homo sapiens
ucuggcuccgugucuucacuccc

SEQ ID NO: 6842 - RNA, 22 nt, Homo sapiens
aaaagcuggguugagagggcga

SEQ ID NO: 6843 - RNA, 22 nt, Homo sapiens
aaaagcuggguugagagggcaa

SEQ ID NO: 6844 - RNA, 20 nt, Homo sapiens
aaaagcuggguugagagggu

SEQ ID NO: 6845 - RNA, 19 nt, Homo sapiens
aaaagcuggguugagagga

SEQ ID NO: 6846 - RNA, 23 nt, Homo sapiens
ugaggggcagagagcgagacuuu

SEQ ID NO: 6847 - RNA, 23 nt, Homo sapiens
ucuuggaguaggucauugggugg

SEQ ID NO: 6848 - RNA, 18 nt, Homo sapiens
ugcuuccuuucagagggu

SEQ ID NO: 6849 - RNA, 22 nt, Homo sapiens
aucuggagguaagaagcacuuu

SEQ ID NO: 6850 - RNA, 22 nt, Homo sapiens
aucuggagguaagaagcacuuu

SEQ ID NO: 6851 - RNA, 23 nt, Homo sapiens
uggaagacuagugauuuuguugu

SEQ ID NO: 6852 - RNA, 22 nt, Homo sapiens
uuugugaccugguccacuaacc

SEQ ID NO: 6853 - RNA, 21 nt, Homo sapiens
aggguaagcugaaccucugau

SEQ ID NO: 6854 - RNA, 23 nt, Homo sapiens
ugagcgccucgacgacagagccg

SEQ ID NO: 6855 - RNA, 23 nt, Homo sapiens
ucuggcuccgugucuucacuccc

SEQ ID NO: 6856 - RNA, 23 nt, Homo sapiens
cggcccgggcugcugcuguuccu

SEQ ID NO: 6857 - RNA, 20 nt, Homo sapiens
guagaggagauggcgcaggg

SEQ ID NO: 6858 - RNA, 21 nt, Homo sapiens
cugaccuaugaauugacagcc

SEQ ID NO: 6859 - RNA, 22 nt, Homo sapiens
gugaaauguuuaggaccacuag

SEQ ID NO: 6860 - RNA, 21 nt, Homo sapiens
augaccuaugaauugacagac

SEQ ID NO: 6861 - RNA, 21 nt, Homo sapiens
uagauaaaauauugguaccug

SEQ ID NO: 6862 - RNA, 21 nt, Homo sapiens
uggcagggaggcugggagggg

SEQ ID NO: 6863 - RNA, 22 nt, Homo sapiens
uuauaaagcaaugagacugauu

SEQ ID NO: 6864 - RNA, 22 nt, Homo sapiens
aagacgggaggaaagaagggag

SEQ ID NO: 6865 - RNA, 22 nt, Homo sapiens
gaaguuguucgugguggauucg

SEQ ID NO: 6866 - RNA, 22 nt, Homo sapiens
ccucccacacccaaggcuugca

SEQ ID NO: 6867 - RNA, 18 nt, Homo sapiens
ugcuuccuuucagagggu

SEQ ID NO: 6868 - RNA, 22 nt, Homo sapiens
aucuggagguaagaagcacuuu

SEQ ID NO: 6869 - RNA, 22 nt, Homo sapiens
auaauacaugguuaaccucuuu

SEQ ID NO: 6870 - RNA, 22 nt, Homo sapiens
uucacaaggaggugucauuuau

SEQ ID NO: 6871 - RNA, 22 nt, Homo sapiens
aggcauugacuucucacuagcu

SEQ ID NO: 6872 - RNA, 24 nt, Homo sapiens
aaagacauaggauagagucaccuc

SEQ ID NO: 6873 - RNA, 21 nt, Homo sapiens
auauaugaugacuuagcuuuu

SEQ ID NO: 6874 - RNA, 25 nt, Homo sapiens
cccccacaaccgcgcuugacuagcu

SEQ ID NO: 6875 - RNA, 22 nt, Homo sapiens
ggagacgcggcccuguuggagu

SEQ ID NO: 6876 - RNA, 22 nt, Homo sapiens
uuuugcaauauguuccugaaua

SEQ ID NO: 6877 - RNA, 20 nt, Homo sapiens
cugcaaagggaagcccuuuc

SEQ ID NO: 6878 - RNA, 20 nt, Homo sapiens
cugcaaagggaagcccuuuc

SEQ ID NO: 6879 - RNA, 20 nt, Homo sapiens
cugcaaagggaagcccuuuc

SEQ ID NO: 6880 - RNA, 20 nt, Homo sapiens
cugcaaagggaagcccuuuc

SEQ ID NO: 6881 - RNA, 23 nt, Homo sapiens
ucuggcuccgugucuucacuccc

SEQ ID NO: 6882 - RNA, 22 nt, Homo sapiens
caaagaauucuccuuuugggcu

SEQ ID NO: 6883 - RNA, 23 nt, Homo sapiens
cagugcaaugauauugucaaagc

SEQ ID NO: 6884 - RNA, 21 nt, Homo sapiens
ucuaguaagaguggcagucga

SEQ ID NO: 6885 - RNA, 23 nt, Homo sapiens
ccugcagcgacuugauggcuucc

SEQ ID NO: 6886 - RNA, 23 nt, Homo sapiens
ugaggggcagagagcgagacuuu

SEQ ID NO: 6887 - RNA, 25 nt, Homo sapiens
ggcggagggaaguagguccguuggu

SEQ ID NO: 6888 - RNA, 21 nt, Homo sapiens
uggaggagaaggaaggugaug

SEQ ID NO: 6889 - RNA, 22 nt, Homo sapiens
agaaggaaauugaauucauuua

SEQ ID NO: 6890 - RNA, 18 nt, Homo sapiens
ugcuuccuuucagagggu

SEQ ID NO: 6891 - RNA, 22 nt, Homo sapiens
aucuggagguaagaagcacuuu

SEQ ID NO: 6892 - RNA, 23 nt, Homo sapiens
ucaagagcaauaacgaaaaaugu

SEQ ID NO: 6893 - RNA, 23 nt, Homo sapiens
ugagugugugugugugagugugu

SEQ ID NO: 6894 - RNA, 25 nt, Homo sapiens
aggggugguguugggacagcuccgu

SEQ ID NO: 6895 - RNA, 22 nt, Homo sapiens
ugagccccugugccgcccccag

SEQ ID NO: 6896 - RNA, 23 nt, Homo sapiens
ucuggcuccgugucuucacuccc

SEQ ID NO: 6897 - RNA, 22 nt, Homo sapiens
cccugugcccggcccacuucug

SEQ ID NO: 6898 - RNA, 20 nt, Homo sapiens
ccucugggcccuuccuccag

SEQ ID NO: 6899 - RNA, 22 nt, Homo sapiens
ucucugggccugugucuuaggc

SEQ ID NO: 6900 - RNA, 21 nt, Homo sapiens
uugaaaggcuauuucuugguc

SEQ ID NO: 6901 - RNA, 22 nt, Homo sapiens
uccuucauuccaccggagucug

SEQ ID NO: 6902 - RNA, 24 nt, Homo sapiens
agccugauuaaacacaugcucuga

SEQ ID NO: 6903 - RNA, 21 nt, Homo sapiens
cggcggggacggcgauugguc

SEQ ID NO: 6904 - RNA, 22 nt, Homo sapiens
aggcggggcgccgcgggaccgc

SEQ ID NO: 6905 - RNA, 22 nt, Homo sapiens
ugcggggcuagggcuaacagca

SEQ ID NO: 6906 - RNA, 22 nt, Homo sapiens
acuccagccccacagccucagc

SEQ ID NO: 6907 - RNA, 21 nt, Homo sapiens
ccgucgccgccacccgagccg

SEQ ID NO: 6908 - RNA, 22 nt, Homo sapiens
uggguggucuggagauuugugc

SEQ ID NO: 6909 - RNA, 22 nt, Homo sapiens
caaucacuaacuccacugccau

SEQ ID NO: 6910 - RNA, 24 nt, Homo sapiens
agccuggaagcuggagccugcagu

SEQ ID NO: 6911 - RNA, 22 nt, Homo sapiens
uggagagaaaggcaguuccuga

SEQ ID NO: 6912 - RNA, 21 nt, Homo sapiens
uggcagggaggcugggagggg

SEQ ID NO: 6913 - RNA, 22 nt, Homo sapiens
acagcaggcacagacaggcagu

SEQ ID NO: 6914 - RNA, 22 nt, Homo sapiens
gccugcugggguggaaccuggu

SEQ ID NO: 6915 - RNA, 23 nt, Homo sapiens
caaagugcuuacagugcagguag

SEQ ID NO: 6916 - RNA, 23 nt, Homo sapiens
cccaguguucagacuaccuguuc

SEQ ID NO: 6917 - RNA, 23 nt, Homo sapiens
cccaguguuuagacuaucuguuc

SEQ ID NO: 6918 - RNA, 23 nt, Homo sapiens
ucuggcuccgugucuucacuccc

SEQ ID NO: 6919 - RNA, 21 nt, Homo sapiens
ugagaugaagcacuguagcuc

SEQ ID NO: 6920 - RNA, 23 nt, Homo sapiens
cgggucggaguuagcucaagcgg

SEQ ID NO: 6921 - RNA, 22 nt, Homo sapiens
caaucacuaacuccacugccau

SEQ ID NO: 6922 - RNA, 23 nt, Homo sapiens
cggcccgggcugcugcuguuccu

SEQ ID NO: 6923 - RNA, 20 nt, Homo sapiens
ggggagcuguggaagcagua

SEQ ID NO: 6924 - RNA, 17 nt, Homo sapiens
ucauauugcuucuuucu

SEQ ID NO: 6925 - RNA, 20 nt, Homo sapiens
ggggagcuguggaagcagua

SEQ ID NO: 6926 - RNA, 21 nt, Homo sapiens
gcccuccgcccgugcaccccg

SEQ ID NO: 6927 - RNA, 21 nt, Homo sapiens
aaaacggugagauuuuguuuu

SEQ ID NO: 6928 - RNA, 23 nt, Homo sapiens
ucccccaggugugauucugauuu

SEQ ID NO: 6929 - RNA, 24 nt, Homo sapiens
acugggggcuuucgggcucugcgu

SEQ ID NO: 6930 - RNA, 22 nt, Homo sapiens
cauugcacuugucucggucuga

SEQ ID NO: 6931 - RNA, 20 nt, Homo sapiens
cggcucugggucugugggga

SEQ ID NO: 6932 - RNA, 22 nt, Homo sapiens
ucugggcaacaaagugagaccu

SEQ ID NO: 6933 - RNA, 25 nt, Homo sapiens
gcugggcagggcuucugagcuccuu

SEQ ID NO: 6934 - RNA, 23 nt, Homo sapiens
aaggagcuuacaaucuagcuggg

SEQ ID NO: 6935 - RNA, 23 nt, Homo sapiens
cucuugagggaagcacuuucugu

SEQ ID NO: 6936 - RNA, 23 nt, Homo sapiens
ucuggcuccgugucuucacuccc

SEQ ID NO: 6937 - RNA, 21 nt, Homo sapiens
uccugcgcgucccagaugccc

SEQ ID NO: 6938 - RNA, 21 nt, Homo sapiens
cggcggggacggcgauugguc

SEQ ID NO: 6939 - RNA, 23 nt, Homo sapiens
aggaccugcgggacaagauucuu

SEQ ID NO: 6940 - RNA, 22 nt, Homo sapiens
aggcggggcgccgcgggaccgc

SEQ ID NO: 6941 - RNA, 24 nt, Homo sapiens
uggggagcugaggcucugggggug

SEQ ID NO: 6942 - RNA, 21 nt, Homo sapiens
guggcugcacucacuuccuuc

SEQ ID NO: 6943 - RNA, 21 nt, Homo sapiens
gcccuccgcccgugcaccccg

SEQ ID NO: 6944 - RNA, 20 nt, Homo sapiens
ggggagcuguggaagcagua

SEQ ID NO: 6945 - RNA, 21 nt, Homo sapiens
gcccuccgcccgugcaccccg

SEQ ID NO: 6946 - RNA, 22 nt, Homo sapiens
aauugcacuuuagcaaugguga

SEQ ID NO: 6947 - RNA, 22 nt, Homo sapiens
uagcaccaucugaaaucgguua

SEQ ID NO: 6948 - RNA, 23 nt, Homo sapiens
uagcaccauuugaaaucaguguu

SEQ ID NO: 6949 - RNA, 22 nt, Homo sapiens
uagcaccauuugaaaucgguua

SEQ ID NO: 6950 - RNA, 22 nt, Homo sapiens
gaauguugcucggugaaccccu

SEQ ID NO: 6951 - RNA, 18 nt, Homo sapiens
ucagcuggcccucauuuc

SEQ ID NO: 6952 - RNA, 25 nt, Homo sapiens
cccccacaaccgcgcuugacuagcu

SEQ ID NO: 6953 - RNA, 22 nt, Homo sapiens
uugugucaauaugcgaugaugu

SEQ ID NO: 6954 - RNA, 22 nt, Homo sapiens
ugugucacucgaugaccacugu

SEQ ID NO: 6955 - RNA, 21 nt, Homo sapiens
uggcagggaggcugggagggg

SEQ ID NO: 6956 - RNA, 21 nt, Homo sapiens
cggcggggacggcgauugguc

SEQ ID NO: 6957 - RNA, 23 nt, Homo sapiens
ugaggggcagagagcgagacuuu

SEQ ID NO: 6958 - RNA, 22 nt, Homo sapiens
aggcggggcgccgcgggaccgc

SEQ ID NO: 6959 - RNA, 22 nt, Homo sapiens
ugcggggcuagggcuaacagca

SEQ ID NO: 6960 - RNA, 24 nt, Homo sapiens
agccuggaagcuggagccugcagu

SEQ ID NO: 6961 - RNA, 22 nt, Homo sapiens
cccugugcccggcccacuucug

SEQ ID NO: 6962 - RNA, 22 nt, Homo sapiens
ugagccccugugccgcccccag

SEQ ID NO: 6963 - RNA, 22 nt, Homo sapiens
ucucccaacccuuguaccagug

SEQ ID NO: 6964 - RNA, 21 nt, Homo sapiens
cggcggggacggcgauugguc

SEQ ID NO: 6965 - RNA, 21 nt, Homo sapiens
uucacaguggcuaaguuccgc

SEQ ID NO: 6966 - RNA, 21 nt, Homo sapiens
uucacaguggcuaaguucugc

SEQ ID NO: 6967 - RNA, 21 nt, Homo sapiens
aggggugcuaucugugauuga

SEQ ID NO: 6968 - RNA, 22 nt, Homo sapiens
aggcggggcgccgcgggaccgc

SEQ ID NO: 6969 - RNA, 21 nt, Homo sapiens
gugcauuguaguugcauugca

SEQ ID NO: 6970 - RNA, 20 nt, Homo sapiens
gugcauugcuguugcauugc

SEQ ID NO: 6971 - RNA, 21 nt, Homo sapiens
uccuucugcuccgucccccag

SEQ ID NO: 6972 - RNA, 22 nt, Homo sapiens
cauugcacuugucucggucuga

SEQ ID NO: 6973 - RNA, 21 nt, Homo sapiens
uggcagggaggcugggagggg

SEQ ID NO: 6974 - RNA, 22 nt, Homo sapiens
agacccuggucugcacucuauc

SEQ ID NO: 6975 - RNA, 22 nt, Homo sapiens
acccgucccguucguccccgga

SEQ ID NO: 6976 - RNA, 21 nt, Homo sapiens
uaccacaggguagaaccacgg

SEQ ID NO: 6977 - RNA, 21 nt, Homo sapiens
agggcccccccucaauccugu

SEQ ID NO: 6978 - RNA, 20 nt, Homo sapiens
gugucugggcggacagcugc

SEQ ID NO: 6979 - RNA, 23 nt, Homo sapiens
cggcccgggcugcugcuguuccu

SEQ ID NO: 6980 - RNA, 23 nt, Homo sapiens
cggcccgggcugcugcuguuccu

SEQ ID NO: 6981 - RNA, 21 nt, Homo sapiens
agggcccccccucaauccugu

SEQ ID NO: 6982 - RNA, 22 nt, Homo sapiens
ugagccccugugccgcccccag

SEQ ID NO: 6983 - RNA, 23 nt, Homo sapiens
uaaggugcaucuagugcaguuag

SEQ ID NO: 6984 - RNA, 24 nt, Homo sapiens
ccagacagaauucuaugcacuuuc

SEQ ID NO: 6985 - RNA, 23 nt, Homo sapiens
ucuggcuccgugucuucacuccc

SEQ ID NO: 6986 - RNA, 21 nt, Homo sapiens
cugaccuaugaauugacagcc

SEQ ID NO: 6987 - RNA, 21 nt, Homo sapiens
augaccuaugaauugacagac

SEQ ID NO: 6988 - RNA, 21 nt, Homo sapiens
agggcccccccucaauccugu

SEQ ID NO: 6989 - RNA, 22 nt, Homo sapiens
uagcaccaucugaaaucgguua

SEQ ID NO: 6990 - RNA, 22 nt, Homo sapiens
uagcaccaucugaaaucgguua

SEQ ID NO: 6991 - RNA, 23 nt, Homo sapiens
uagcaccauuugaaaucaguguu

SEQ ID NO: 6992 - RNA, 22 nt, Homo sapiens
uagcaccauuugaaaucgguua

SEQ ID NO: 6993 - RNA, 21 nt, Homo sapiens
ggcuagcaacagcgcuuaccu

SEQ ID NO: 6994 - RNA, 19 nt, Homo sapiens
gugucugcuuccuguggga

SEQ ID NO: 6995 - RNA, 24 nt, Homo sapiens
ugccugggucucuggccugcgcgu

SEQ ID NO: 6996 - RNA, 22 nt, Homo sapiens
ugcggggcuagggcuaacagca

SEQ ID NO: 6997 - RNA, 21 nt, Homo sapiens
gcaggaacuugugagucuccu

SEQ ID NO: 6998 - RNA, 21 nt, Homo sapiens
uacuuggaaaggcaucaguug

SEQ ID NO: 6999 - RNA, 22 nt, Homo sapiens
aaauuauuguacaucggaugag

SEQ ID NO: 7000 - RNA, 24 nt, Homo sapiens
ugccugggucucuggccugcgcgu

SEQ ID NO: 7001 - RNA, 17 nt, Homo sapiens
gugggggagaggcuguc

SEQ ID NO: 7002 - RNA, 23 nt, Homo sapiens
gcaaagcacacggccugcagaga

SEQ ID NO: 7003 - RNA, 17 nt, Homo sapiens
ucgccuccuccucuccc

SEQ ID NO: 7004 - RNA, 23 nt, Homo sapiens
cggcccgggcugcugcuguuccu

SEQ ID NO: 7005 - RNA, 22 nt, Homo sapiens
cagugcaaugaugaaagggcau

SEQ ID NO: 7006 - RNA, 22 nt, Homo sapiens
aaaagcuggguugagagggcga

SEQ ID NO: 7007 - RNA, 22 nt, Homo sapiens
aaaagcuggguugagagggcaa

SEQ ID NO: 7008 - RNA, 20 nt, Homo sapiens
aaaagcuggguugagagggu

SEQ ID NO: 7009 - RNA, 19 nt, Homo sapiens
aaaagcuggguugagagga

SEQ ID NO: 7010 - RNA, 18 nt, Homo sapiens
cagggaggugaaugugau

SEQ ID NO: 7011 - RNA, 22 nt, Homo sapiens
aaggagcucacagucuauugag

SEQ ID NO: 7012 - RNA, 23 nt, Homo sapiens
aaggagcuuacaaucuagcuggg

SEQ ID NO: 7013 - RNA, 22 nt, Homo sapiens
aacacaccugguuaaccucuuu

SEQ ID NO: 7014 - RNA, 22 nt, Homo sapiens
aacacaccuauucaaggauuca

SEQ ID NO: 7015 - RNA, 22 nt, Homo sapiens
cgucaacacuugcugguuuccu

SEQ ID NO: 7016 - RNA, 22 nt, Homo sapiens
aggcauugacuucucacuagcu

SEQ ID NO: 7017 - RNA, 22 nt, Homo sapiens
uggagagaaaggcaguuccuga

SEQ ID NO: 7018 - RNA, 21 nt, Homo sapiens
ucacagugaaccggucucuuu

SEQ ID NO: 7019 - RNA, 23 nt, Homo sapiens
aucccuugcaggggcuguugggu

SEQ ID NO: 7020 - RNA, 22 nt, Homo sapiens
ugagccccugugccgcccccag

SEQ ID NO: 7021 - RNA, 23 nt, Homo sapiens
cggcccgggcugcugcuguuccu

SEQ ID NO: 7022 - RNA, 20 nt, Homo sapiens
agaccauggguucucauugu

SEQ ID NO: 7023 - RNA, 20 nt, Homo sapiens
accaggaggcugaggccccu

SEQ ID NO: 7024 - RNA, 22 nt, Homo sapiens
uggugguuuacaaaguaauuca

SEQ ID NO: 7025 - RNA, 26 nt, Homo sapiens
aaguaguugguuuguaugagaugguu

SEQ ID NO: 7026 - RNA, 21 nt, Homo sapiens
aaacuacugaaaaucaaagau

SEQ ID NO: 7027 - RNA, 22 nt, Homo sapiens
gaaagcgcuucccuuugcugga

SEQ ID NO: 7028 - RNA, 22 nt, Homo sapiens
caaagcgcuccccuuuagaggu

SEQ ID NO: 7029 - RNA, 23 nt, Homo sapiens
caaagcgcuucucuuuagagugu

SEQ ID NO: 7030 - RNA, 21 nt, Homo sapiens
caaagcgcuucccuuuggagc

SEQ ID NO: 7031 - RNA, 21 nt, Homo sapiens
gaaagcgcuucucuuuagagg

SEQ ID NO: 7032 - RNA, 22 nt, Homo sapiens
caaagugccucccuuuagagug

SEQ ID NO: 7033 - RNA, 22 nt, Homo sapiens
uuggggaaacggccgcugagug

SEQ ID NO: 7034 - RNA, 22 nt, Homo sapiens
uagcuuaucagacugauguuga

SEQ ID NO: 7035 - RNA, 22 nt, Homo sapiens
gagcuuauucauaaaagugcag

SEQ ID NO: 7036 - RNA, 23 nt, Homo sapiens
agcuacauugucugcuggguuuc

SEQ ID NO: 7037 - RNA, 23 nt, Homo sapiens
ucuggcuccgugucuucacuccc

SEQ ID NO: 7038 - RNA, 21 nt, Homo sapiens
cggcggggacggcgauugguc

SEQ ID NO: 7039 - RNA, 25 nt, Homo sapiens
aggggugguguugggacagcuccgu

SEQ ID NO: 7040 - RNA, 22 nt, Homo sapiens
aggcggggcgccgcgggaccgc

SEQ ID NO: 7041 - RNA, 21 nt, Homo sapiens
uucacaguggcuaaguucugc

SEQ ID NO: 7042 - RNA, 20 nt, Homo sapiens
agagguauagggcaugggaa

SEQ ID NO: 7043 - RNA, 22 nt, Homo sapiens
uauaccucaguuuuaucaggug

SEQ ID NO: 7044 - RNA, 22 nt, Homo sapiens
acccgucccguucguccccgga

SEQ ID NO: 7045 - RNA, 23 nt, Homo sapiens
ucuggcuccgugucuucacuccc

SEQ ID NO: 7046 - RNA, 25 nt, Homo sapiens
cccccacaaccgcgcuugacuagcu

SEQ ID NO: 7047 - RNA, 23 nt, Homo sapiens
ugagcgccucgacgacagagccg

SEQ ID NO: 7048 - RNA, 21 nt, Homo sapiens
aaagcgcuucccuucagagug

SEQ ID NO: 7049 - RNA, 21 nt, Homo sapiens
uggaggagaaggaaggugaug

SEQ ID NO: 7050 - RNA, 22 nt, Homo sapiens
cuccugagccauucugagccuc

SEQ ID NO: 7051 - RNA, 19 nt, Homo sapiens
gugaggacucgggaggugg

SEQ ID NO: 7052 - RNA, 22 nt, Homo sapiens
uggagagaaaggcaguuccuga

SEQ ID NO: 7053 - RNA, 22 nt, Homo sapiens
uggcucaguucagcaggaacag

SEQ ID NO: 7054 - RNA, 22 nt, Homo sapiens
uggcagugucuuagcugguugu

SEQ ID NO: 7055 - RNA, 23 nt, Homo sapiens
aggcaguguaguuagcugauugc

SEQ ID NO: 7056 - RNA, 22 nt, Homo sapiens
uggcaguguauuguuagcuggu

SEQ ID NO: 7057 - RNA, 22 nt, Homo sapiens
aggcaguguauuguuagcuggc

SEQ ID NO: 7058 - RNA, 22 nt, Homo sapiens
ucaggcucaguccccucccgau

SEQ ID NO: 7059 - RNA, 19 nt, Homo sapiens
ucuaggcugguacugcuga

SEQ ID NO: 7060 - RNA, 20 nt, Homo sapiens
gugucugggcggacagcugc

SEQ ID NO: 7061 - RNA, 22 nt, Homo sapiens
gcccgcguguggagccaggugu

SEQ ID NO: 7062 - RNA, 21 nt, Homo sapiens
ugacaacuauggaugagcucu

SEQ ID NO: 7063 - RNA, 21 nt, Homo sapiens
agggcccccccucaauccugu

SEQ ID NO: 7064 - RNA, 23 nt, Homo sapiens
agcucggucugaggccccucagu

SEQ ID NO: 7065 - RNA, 20 nt, Homo sapiens
cggcucugggucugugggga

SEQ ID NO: 7066 - RNA, 21 nt, Homo sapiens
uggcagggaggcugggagggg

SEQ ID NO: 7067 - RNA, 24 nt, Homo sapiens
ucccugagacccuuuaaccuguga

SEQ ID NO: 7068 - RNA, 22 nt, Homo sapiens
ucccugagacccuaacuuguga

SEQ ID NO: 7069 - RNA, 23 nt, Homo sapiens
ccucagggcuguagaacagggcu

SEQ ID NO: 7070 - RNA, 25 nt, Homo sapiens
gggcgacaaagcaagacucuuucuu

SEQ ID NO: 7071 - RNA, 22 nt, Homo sapiens
uggacggagaacugauaagggu

SEQ ID NO: 7072 - RNA, 22 nt, Homo sapiens
uagguaguuuccuguuguuggg

SEQ ID NO: 7073 - RNA, 22 nt, Homo sapiens
agaguugagucuggacgucccg

SEQ ID NO: 7074 - RNA, 23 nt, Homo sapiens
uaagugcuuccauguuuugguga

SEQ ID NO: 7075 - RNA, 23 nt, Homo sapiens
uaagugcuuccauguuuuaguag

SEQ ID NO: 7076 - RNA, 23 nt, Homo sapiens
uaagugcuuccauguuucagugg

SEQ ID NO: 7077 - RNA, 23 nt, Homo sapiens
uaagugcuuccauguuugagugu

SEQ ID NO: 7078 - RNA, 17 nt, Homo sapiens
uaagugcuuccaugcuu

SEQ ID NO: 7079 - RNA, 23 nt, Homo sapiens
aaagugcugcgacauuugagcgu

SEQ ID NO: 7080 - RNA, 23 nt, Homo sapiens
gaagugcuucgauuuuggggugu

SEQ ID NO: 7081 - RNA, 22 nt, Homo sapiens
uacucaggagaguggcaaucac

SEQ ID NO: 7082 - RNA, 22 nt, Homo sapiens
aagugcugucauagcugagguc

SEQ ID NO: 7083 - RNA, 22 nt, Homo sapiens
aaagugcuucccuuuggacugu

SEQ ID NO: 7084 - RNA, 21 nt, Homo sapiens
aaagugcuuccuuuuagaggg

SEQ ID NO: 7085 - RNA, 22 nt, Homo sapiens
aaagugcuuccuuuuagagggu

SEQ ID NO: 7086 - RNA, 22 nt, Homo sapiens
aaagugcuucucuuuggugggu

SEQ ID NO: 7087 - RNA, 21 nt, Homo sapiens
aaagugcuuccuuuuugaggg

SEQ ID NO: 7088 - RNA, 21 nt, Homo sapiens
agggggaaaguucuauagucc

SEQ ID NO: 7089 - RNA, 22 nt, Homo sapiens
uggagugugacaaugguguuug

SEQ ID NO: 7090 - RNA, 22 nt, Homo sapiens
acccgucccguucguccccgga

SEQ ID NO: 7091 - RNA, 17 nt, Homo sapiens
ucccaccgcugccaccc

SEQ ID NO: 7092 - RNA, 22 nt, Homo sapiens
uagguaguuuccuguuguuggg

SEQ ID NO: 7093 - RNA, 22 nt, Homo sapiens
uucccuuugucauccuaugccu

SEQ ID NO: 7094 - RNA, 22 nt, Homo sapiens
uucccuuugucauccuucgccu

SEQ ID NO: 7095 - RNA, 22 nt, Homo sapiens
aaggagcucacagucuauugag

SEQ ID NO: 7096 - RNA, 22 nt, Homo sapiens
uggugggcacagaaucuggacu

SEQ ID NO: 7097 - RNA, 21 nt, Homo sapiens
guucaaauccagaucuauaac

SEQ ID NO: 7098 - RNA, 19 nt, Homo sapiens
ucuaggcugguacugcuga

SEQ ID NO: 7099 - RNA, 22 nt, Homo sapiens
uggugggccgcagaacaugugc

SEQ ID NO: 7100 - RNA, 20 nt, Homo sapiens
accaggaggcugaggccccu

SEQ ID NO: 7101 - RNA, 23 nt, Homo sapiens
aaggagcuuacaaucuagcuggg

SEQ ID NO: 7102 - RNA, 21 nt, Homo sapiens
ccuggaaacacugagguugug

SEQ ID NO: 7103 - RNA, 22 nt, Homo sapiens
uauugcacucgucccggccucc

SEQ ID NO: 7104 - RNA, 21 nt, Homo sapiens
auauaugaugacuuagcuuuu

SEQ ID NO: 7105 - RNA, 22 nt, Homo sapiens
uaacacugucugguaaagaugg

SEQ ID NO: 7106 - RNA, 22 nt, Homo sapiens
cauugcacuugucucggucuga

SEQ ID NO: 7107 - RNA, 21 nt, Homo sapiens
gaacggcuucauacaggaguu

SEQ ID NO: 7108 - RNA, 21 nt, Homo sapiens
guggcugcacucacuuccuuc

SEQ ID NO: 7109 - RNA, 22 nt, Homo sapiens
uaugucugcugaccaucaccuu

SEQ ID NO: 7110 - RNA, 20 nt, Homo sapiens
accaggaggcugaggccccu

SEQ ID NO: 7111 - RNA, 23 nt, Homo sapiens
aaacucuacuuguccuucugagu

SEQ ID NO: 7112 - RNA, 21 nt, Homo sapiens
ucguggccuggucuccauuau

SEQ ID NO: 7113 - RNA, 22 nt, Homo sapiens
uucuggaauucugugugaggga

SEQ ID NO: 7114 - RNA, 18 nt, Homo sapiens
cagggaggugaaugugau

SEQ ID NO: 7115 - RNA, 22 nt, Homo sapiens
gcccgcguguggagccaggugu

SEQ ID NO: 7116 - RNA, 23 nt, Homo sapiens
ucuggcuccgugucuucacuccc

SEQ ID NO: 7117 - RNA, 21 nt, Homo sapiens
cggcggggacggcgauugguc

SEQ ID NO: 7118 - RNA, 22 nt, Homo sapiens
cccugugcccggcccacuucug

SEQ ID NO: 7119 - RNA, 22 nt, Homo sapiens
uguaacagcaacuccaugugga

SEQ ID NO: 7120 - RNA, 23 nt, Homo sapiens
agcuacauugucugcuggguuuc

SEQ ID NO: 7121 - RNA, 22 nt, Homo sapiens
uugcauauguaggaugucccau

SEQ ID NO: 7122 - RNA, 21 nt, Homo sapiens
uuggccacaauggguuagaac

SEQ ID NO: 7123 - RNA, 22 nt, Homo sapiens
ggggguccccggugcucggauc

SEQ ID NO: 7124 - RNA, 24 nt, Homo sapiens
ugccugggucucuggccugcgcgu

SEQ ID NO: 7125 - RNA, 22 nt, Homo sapiens
aggcggggcgccgcgggaccgc

SEQ ID NO: 7126 - RNA, 20 nt, Homo sapiens
accaggaggcugaggccccu

SEQ ID NO: 7127 - RNA, 22 nt, Homo sapiens
ugcggggcuagggcuaacagca

SEQ ID NO: 7128 - RNA, 20 nt, Homo sapiens
ccuccugcccuccuugcugu

SEQ ID NO: 7129 - RNA, 24 nt, Homo sapiens
acaaagugcuucccuuuagagugu

SEQ ID NO: 7130 - RNA, 22 nt, Homo sapiens
acaaagugcuucccuuuagagu

SEQ ID NO: 7131 - RNA, 22 nt, Homo sapiens
cagugcaaugaugaaagggcau

SEQ ID NO: 7132 - RNA, 23 nt, Homo sapiens
aaggagcuuacaaucuagcuggg

SEQ ID NO: 7133 - RNA, 20 nt, Homo sapiens
agagguauagggcaugggaa

SEQ ID NO: 7134 - RNA, 22 nt, Homo sapiens
augguacccuggcauacugagu

SEQ ID NO: 7135 - RNA, 23 nt, Homo sapiens
uaaggugcaucuagugcagauag

SEQ ID NO: 7136 - RNA, 22 nt, Homo sapiens
cugcccuggcccgagggaccga

SEQ ID NO: 7137 - RNA, 19 nt, Homo sapiens
aggcugcggaauucaggac

SEQ ID NO: 7138 - RNA, 23 nt, Homo sapiens
ugaggggcagagagcgagacuuu

SEQ ID NO: 7139 - RNA, 20 nt, Homo sapiens
ggggagcuguggaagcagua

SEQ ID NO: 7140 - RNA, 22 nt, Homo sapiens
gaaguuguucgugguggauucg

SEQ ID NO: 7141 - RNA, 22 nt, Homo sapiens
ugugacagauugauaacugaaa

SEQ ID NO: 7142 - RNA, 23 nt, Homo sapiens
ugucacucggcucggcccacuac

SEQ ID NO: 7143 - RNA, 22 nt, Homo sapiens
ucugcccccuccgcugcugcca

SEQ ID NO: 7144 - RNA, 20 nt, Homo sapiens
acugccccaggugcugcugg

SEQ ID NO: 7145 - RNA, 21 nt, Homo sapiens
cggggcagcucaguacaggau

SEQ ID NO: 7146 - RNA, 22 nt, Homo sapiens
cccugugcccggcccacuucug

SEQ ID NO: 7147 - RNA, 21 nt, Homo sapiens
gugccagcugcagugggggag

SEQ ID NO: 7148 - RNA, 23 nt, Homo sapiens
cuggagauauggaagagcugugu

SEQ ID NO: 7149 - RNA, 22 nt, Homo sapiens
uucuggaauucugugugaggga

SEQ ID NO: 7150 - RNA, 22 nt, Homo sapiens
aagcccuuaccccaaaaagcau

SEQ ID NO: 7151 - RNA, 21 nt, Homo sapiens
ugagaugaagcacuguagcuc

SEQ ID NO: 7152 - RNA, 22 nt, Homo sapiens
ucgugucuuguguugcagccgg

SEQ ID NO: 7153 - RNA, 22 nt, Homo sapiens
cauugcacuugucucggucuga

SEQ ID NO: 7154 - RNA, 20 nt, Homo sapiens
auggagauagauauagaaau

SEQ ID NO: 7155 - RNA, 22 nt, Homo sapiens
gguggcccggccgugccugagg

SEQ ID NO: 7156 - RNA, 22 nt, Homo sapiens
acuccagccccacagccucagc

SEQ ID NO: 7157 - RNA, 22 nt, Homo sapiens
ucggccugaccacccaccccac

SEQ ID NO: 7158 - RNA, 22 nt, Homo sapiens
acucggcguggcgucggucgug

SEQ ID NO: 7159 - RNA, 19 nt, Homo sapiens
gaugaugcugcugaugcug

SEQ ID NO: 7160 - RNA, 22 nt, Homo sapiens
ggagacgcggcccuguuggagu

SEQ ID NO: 7161 - RNA, 22 nt, Homo sapiens
cucggcgcggggcgcgggcucc

SEQ ID NO: 7162 - RNA, 23 nt, Homo sapiens
ucuggcuccgugucuucacuccc

SEQ ID NO: 7163 - RNA, 23 nt, Homo sapiens
uaaggugcaucuagugcagauag

SEQ ID NO: 7164 - RNA, 23 nt, Homo sapiens
gaacgcgcuucccuauagagggu

SEQ ID NO: 7165 - RNA, 22 nt, Homo sapiens
aggcagcgggguguaguggaua

SEQ ID NO: 7166 - RNA, 26 nt, Homo sapiens
gaugaugauggcagcaaauucugaaa

SEQ ID NO: 7167 - RNA, 21 nt, Homo sapiens
cccggagccaggaugcagcuc

SEQ ID NO: 7168 - RNA, 23 nt, Homo sapiens
ucuggcuccgugucuucacuccc

SEQ ID NO: 7169 - RNA, 23 nt, Homo sapiens
caacggaaucccaaaagcagcug

SEQ ID NO: 7170 - RNA, 21 nt, Homo sapiens
gugcauuguaguugcauugca

SEQ ID NO: 7171 - RNA, 22 nt, Homo sapiens
cauugcacuugucucggucuga

SEQ ID NO: 7172 - RNA, 24 nt, Homo sapiens
ugccugggucucuggccugcgcgu

SEQ ID NO: 7173 - RNA, 17 nt, Homo sapiens
gugggggagaggcuguc

SEQ ID NO: 7174 - RNA, 22 nt, Homo sapiens
cagugguuuuacccuaugguag

SEQ ID NO: 7175 - RNA, 22 nt, Homo sapiens
cucuagagggaagcacuuucug

SEQ ID NO: 7176 - RNA, 21 nt, Homo sapiens
cggcggggacggcgauugguc

SEQ ID NO: 7177 - RNA, 22 nt, Homo sapiens
cccugugcccggcccacuucug

SEQ ID NO: 7178 - RNA, 22 nt, Homo sapiens
uucccuuugucauccuaugccu

SEQ ID NO: 7179 - RNA, 22 nt, Homo sapiens
uucccuuugucauccuucgccu

SEQ ID NO: 7180 - RNA, 21 nt, Homo sapiens
ugacaacuauggaugagcucu

SEQ ID NO: 7181 - RNA, 22 nt, Homo sapiens
agaucagaaggugauuguggcu

SEQ ID NO: 7182 - RNA, 22 nt, Homo sapiens
uuauaaagcaaugagacugauu

SEQ ID NO: 7183 - RNA, 21 nt, Homo sapiens
cagcagcacacugugguuugu

SEQ ID NO: 7184 - RNA, 21 nt, Homo sapiens
uuggccacaauggguuagaac

SEQ ID NO: 7185 - RNA, 24 nt, Homo sapiens
ugccugggucucuggccugcgcgu

SEQ ID NO: 7186 - RNA, 22 nt, Homo sapiens
aggcggggcgccgcgggaccgc

SEQ ID NO: 7187 - RNA, 22 nt, Homo sapiens
ugcggggcuagggcuaacagca

SEQ ID NO: 7188 - RNA, 21 nt, Homo sapiens
gcaggaacuugugagucuccu

SEQ ID NO: 7189 - RNA, 20 nt, Homo sapiens
ggggagcuguggaagcagua

SEQ ID NO: 7190 - RNA, 24 nt, Homo sapiens
uggggagcugaggcucugggggug

SEQ ID NO: 7191 - RNA, 21 nt, Homo sapiens
acagucugcugagguuggagc

SEQ ID NO: 7192 - RNA, 17 nt, Homo sapiens
ucgccuccuccucuccc

SEQ ID NO: 7193 - RNA, 19 nt, Homo sapiens
gggcgccugugaucccaac

SEQ ID NO: 7194 - RNA, 24 nt, Homo sapiens
uggcccugacugaagaccagcagu

SEQ ID NO: 7195 - RNA, 22 nt, Homo sapiens
gguggcccggccgugccugagg

SEQ ID NO: 7196 - RNA, 18 nt, Homo sapiens
gucccuguucaggcgcca

SEQ ID NO: 7197 - RNA, 23 nt, Homo sapiens
ucccuguccuccaggagcucacg

SEQ ID NO: 7198 - RNA, 22 nt, Homo sapiens
acaggugagguucuugggagcc

SEQ ID NO: 7199 - RNA, 18 nt, Homo sapiens
gucccuguucaggcgcca

SEQ ID NO: 7200 - RNA, 22 nt, Homo sapiens
ugugacagauugauaacugaaa

SEQ ID NO: 7201 - RNA, 21 nt, Homo sapiens
aauauuauacagucaaccucu

SEQ ID NO: 7202 - RNA, 21 nt, Homo sapiens
augauccaggaaccugccucu

SEQ ID NO: 7203 - RNA, 21 nt, Homo sapiens
uugcucacuguucuucccuag

SEQ ID NO: 7204 - RNA, 21 nt, Homo sapiens
uggaggagaaggaaggugaug

SEQ ID NO: 7205 - RNA, 23 nt, Homo sapiens
ucugcucauaccccaugguuucu

SEQ ID NO: 7206 - RNA, 21 nt, Homo sapiens
gugccagcugcagugggggag

SEQ ID NO: 7207 - RNA, 22 nt, Homo sapiens
aagacgggaggaaagaagggag

SEQ ID NO: 7208 - RNA, 22 nt, Homo sapiens
ugcaacuuaccugagucauuga

SEQ ID NO: 7209 - RNA, 21 nt, Homo sapiens
uggcagggaggcugggagggg

SEQ ID NO: 7210 - RNA, 22 nt, Homo sapiens
ugagccccugugccgcccccag

SEQ ID NO: 7211 - RNA, 22 nt, Homo sapiens
uggagugugacaaugguguuug

SEQ ID NO: 7212 - RNA, 18 nt, Homo sapiens
cagggaggugaaugugau

SEQ ID NO: 7213 - RNA, 23 nt, Homo sapiens
ucuggcuccgugucuucacuccc

SEQ ID NO: 7214 - RNA, 27 nt, Homo sapiens
accuucuuguauaagcacugugcuaaa

SEQ ID NO: 7215 - RNA, 21 nt, Homo sapiens
agagaagaagaucagccugca

SEQ ID NO: 7216 - RNA, 21 nt, Homo sapiens
agugaaugauggguucugacc

SEQ ID NO: 7217 - RNA, 22 nt, Homo sapiens
cugaagcucagagggcucugau

SEQ ID NO: 7218 - RNA, 21 nt, Homo sapiens
ucgaggagcucacagucuagu

SEQ ID NO: 7219 - RNA, 21 nt, Homo sapiens
ucacuccucuccucccgucuu

SEQ ID NO: 7220 - RNA, 22 nt, Homo sapiens
ucaggcucaguccccucccgau

SEQ ID NO: 7221 - RNA, 23 nt, Homo sapiens
cacucagccuugagggcacuuuc

SEQ ID NO: 7222 - RNA, 18 nt, Homo sapiens
uucacagggaggugucau

SEQ ID NO: 7223 - RNA, 22 nt, Homo sapiens
gaaagcgcuucccuuugcugga

SEQ ID NO: 7224 - RNA, 22 nt, Homo sapiens
caaagcgcuccccuuuagaggu

SEQ ID NO: 7225 - RNA, 23 nt, Homo sapiens
caaagcgcuucucuuuagagugu

SEQ ID NO: 7226 - RNA, 21 nt, Homo sapiens
caaagcgcuucccuuuggagc

SEQ ID NO: 7227 - RNA, 21 nt, Homo sapiens
aaagcgcuucccuucagagug

SEQ ID NO: 7228 - RNA, 21 nt, Homo sapiens
gaaagcgcuucucuuuagagg

SEQ ID NO: 7229 - RNA, 22 nt, Homo sapiens
gugagucucuaagaaaagagga

SEQ ID NO: 7230 - RNA, 17 nt, Homo sapiens
ucucgcuggggccucca

SEQ ID NO: 7231 - RNA, 20 nt, Homo sapiens
cggcucugggucugugggga

SEQ ID NO: 7232 - RNA, 21 nt, Homo sapiens
uggaggagaaggaaggugaug

SEQ ID NO: 7233 - RNA, 22 nt, Homo sapiens
uucccuuugucauccuaugccu

SEQ ID NO: 7234 - RNA, 22 nt, Homo sapiens
uucccuuugucauccuucgccu

SEQ ID NO: 7235 - RNA, 22 nt, Homo sapiens
uggagagaaaggcaguuccuga

SEQ ID NO: 7236 - RNA, 23 nt, Homo sapiens
ugagcgccucgacgacagagccg

SEQ ID NO: 7237 - RNA, 22 nt, Homo sapiens
ugaaacauacacgggaaaccuc

SEQ ID NO: 7238 - RNA, 23 nt, Homo sapiens
aaacucuacuuguccuucugagu

SEQ ID NO: 7239 - RNA, 23 nt, Homo sapiens
agguuguccguggugaguucgca

SEQ ID NO: 7240 - RNA, 22 nt, Homo sapiens
uacccagagcaugcagugugaa

SEQ ID NO: 7241 - RNA, 20 nt, Homo sapiens
ccucugggcccuuccuccag

SEQ ID NO: 7242 - RNA, 22 nt, Homo sapiens
ucucugggccugugucuuaggc

SEQ ID NO: 7243 - RNA, 22 nt, Homo sapiens
acuccagccccacagccucagc

SEQ ID NO: 7244 - RNA, 22 nt, Homo sapiens
aagauguggaaaaauuggaauc

SEQ ID NO: 7245 - RNA, 21 nt, Homo sapiens
uggaggagaaggaaggugaug

SEQ ID NO: 7246 - RNA, 21 nt, Homo sapiens
cggcggggacggcgauugguc

SEQ ID NO: 7247 - RNA, 22 nt, Homo sapiens
aggcggggcgccgcgggaccgc

SEQ ID NO: 7248 - RNA, 23 nt, Homo sapiens
uggugcggagagggcccacagug

SEQ ID NO: 7249 - RNA, 21 nt, Homo sapiens
cggcggggacggcgauugguc

SEQ ID NO: 7250 - RNA, 22 nt, Homo sapiens
aggcggggcgccgcgggaccgc

SEQ ID NO: 7251 - RNA, 23 nt, Homo sapiens
uggugcggagagggcccacagug

SEQ ID NO: 7252 - RNA, 22 nt, Homo sapiens
ucuucucuguuuuggccaugug

SEQ ID NO: 7253 - RNA, 21 nt, Homo sapiens
ucacagugaaccggucucuuu

SEQ ID NO: 7254 - RNA, 22 nt, Homo sapiens
cucccacugcuucacuugacua

SEQ ID NO: 7255 - RNA, 22 nt, Homo sapiens
cugugcgugugacagcggcuga

SEQ ID NO: 7256 - RNA, 22 nt, Homo sapiens
uggcucaguucagcaggaacag

SEQ ID NO: 7257 - RNA, 22 nt, Homo sapiens
auucugcauuuuuagcaaguuc

SEQ ID NO: 7258 - RNA, 22 nt, Homo sapiens
ugagaaccacgucugcucugag

SEQ ID NO: 7259 - RNA, 25 nt, Homo sapiens
cccccacaaccgcgcuugacuagcu

SEQ ID NO: 7260 - RNA, 25 nt, Homo sapiens
ggcggagggaaguagguccguuggu

SEQ ID NO: 7261 - RNA, 22 nt, Homo sapiens
aauugcacgguauccaucugua

SEQ ID NO: 7262 - RNA, 25 nt, Homo sapiens
aggggugguguugggacagcuccgu

SEQ ID NO: 7263 - RNA, 22 nt, Homo sapiens
uguaacagcaacuccaugugga

SEQ ID NO: 7264 - RNA, 23 nt, Homo sapiens
ugagugugugugugugagugugu

SEQ ID NO: 7265 - RNA, 22 nt, Homo sapiens
aggcagcgggguguaguggaua

SEQ ID NO: 7266 - RNA, 20 nt, Homo sapiens
ccccagggcgacgcggcggg

SEQ ID NO: 7267 - RNA, 25 nt, Homo sapiens
cuagugagggacagaaccaggauuc

SEQ ID NO: 7268 - RNA, 22 nt, Homo sapiens
acucggcguggcgucggucgug

SEQ ID NO: 7269 - RNA, 23 nt, Homo sapiens
ugaguaccgccaugucuguuggg

SEQ ID NO: 7270 - RNA, 21 nt, Homo sapiens
agggcccccccucaauccugu

SEQ ID NO: 7271 - RNA, 22 nt, Homo sapiens
uccagcaucagugauuuuguug

SEQ ID NO: 7272 - RNA, 23 nt, Homo sapiens
ugagcgccucgacgacagagccg

SEQ ID NO: 7273 - RNA, 25 nt, Homo sapiens
aggggugguguugggacagcuccgu

SEQ ID NO: 7274 - RNA, 20 nt, Homo sapiens
ggggagcuguggaagcagua

SEQ ID NO: 7275 - RNA, 20 nt, Homo sapiens
uaaagagcccuguggagaca

SEQ ID NO: 7276 - RNA, 22 nt, Homo sapiens
ggagacgcggcccuguuggagu

SEQ ID NO: 7277 - RNA, 21 nt, Homo sapiens
cggcggggacggcgauugguc

SEQ ID NO: 7278 - RNA, 22 nt, Homo sapiens
aggcggggcgccgcgggaccgc

SEQ ID NO: 7279 - RNA, 22 nt, Homo sapiens
ucagugcacuacagaacuuugu

SEQ ID NO: 7280 - RNA, 22 nt, Homo sapiens
gugaaauguuuaggaccacuag

SEQ ID NO: 7281 - RNA, 23 nt, Homo sapiens
ucccccaggugugauucugauuu

SEQ ID NO: 7282 - RNA, 21 nt, Homo sapiens
aacauagaggaaauuccacgu

SEQ ID NO: 7283 - RNA, 22 nt, Homo sapiens
aggcaguguauuguuagcuggc

SEQ ID NO: 7284 - RNA, 24 nt, Homo sapiens
acugggggcuuucgggcucugcgu

SEQ ID NO: 7285 - RNA, 20 nt, Homo sapiens
cggcucugggucugugggga

SEQ ID NO: 7286 - RNA, 23 nt, Homo sapiens
cuguaauauaaauuuaauuuauu

SEQ ID NO: 7287 - RNA, 23 nt, Homo sapiens
ugaggggcagagagcgagacuuu

SEQ ID NO: 7288 - RNA, 18 nt, Homo sapiens
ucagcuggcccucauuuc

SEQ ID NO: 7289 - RNA, 23 nt, Homo sapiens
ucucacacagaaaucgcacccgu

SEQ ID NO: 7290 - RNA, 22 nt, Homo sapiens
uucccuuugucauccuaugccu

SEQ ID NO: 7291 - RNA, 22 nt, Homo sapiens
uucccuuugucauccuucgccu

SEQ ID NO: 7292 - RNA, 22 nt, Homo sapiens
ucugggcaacaaagugagaccu

SEQ ID NO: 7293 - RNA, 25 nt, Homo sapiens
gcugggcagggcuucugagcuccuu

SEQ ID NO: 7294 - RNA, 19 nt, Homo sapiens
gugaggacucgggaggugg

SEQ ID NO: 7295 - RNA, 21 nt, Homo sapiens
agugaaugauggguucugacc

SEQ ID NO: 7296 - RNA, 23 nt, Homo sapiens
cggcccgggcugcugcuguuccu

SEQ ID NO: 7297 - RNA, 22 nt, Homo sapiens
gccugcugggguggaaccuggu

SEQ ID NO: 7298 - RNA, 23 nt, Homo sapiens
aguauguucuuccaggacagaac

SEQ ID NO: 7299 - RNA, 22 nt, Homo sapiens
aagacgggaggaaagaagggag

SEQ ID NO: 7300 - RNA, 23 nt, Homo sapiens
acuccauuuguuuugaugaugga

SEQ ID NO: 7301 - RNA, 23 nt, Homo sapiens
aacauucaacgcugucggugagu

SEQ ID NO: 7302 - RNA, 23 nt, Homo sapiens
aacauucauugcugucggugggu

SEQ ID NO: 7303 - RNA, 22 nt, Homo sapiens
aacauucaaccugucggugagu

SEQ ID NO: 7304 - RNA, 23 nt, Homo sapiens
aacauucauuguugucggugggu

SEQ ID NO: 7305 - RNA, 22 nt, Homo sapiens
aaacauucgcggugcacuucuu

SEQ ID NO: 7306 - RNA, 21 nt, Homo sapiens
cggcggggacggcgauugguc

SEQ ID NO: 7307 - RNA, 22 nt, Homo sapiens
aggcggggcgccgcgggaccgc

SEQ ID NO: 7308 - RNA, 22 nt, Homo sapiens
ugcggggcuagggcuaacagca

SEQ ID NO: 7309 - RNA, 22 nt, Homo sapiens
ugagccccugugccgcccccag

SEQ ID NO: 7310 - RNA, 22 nt, Homo sapiens
cccugugcccggcccacuucug

SEQ ID NO: 7311 - RNA, 20 nt, Homo sapiens
ucacuguucagacaggcgga

SEQ ID NO: 7312 - RNA, 21 nt, Homo sapiens
ccuguugaaguguaaucccca

SEQ ID NO: 7313 - RNA, 22 nt, Homo sapiens
cagugcaauguuaaaagggcau

SEQ ID NO: 7314 - RNA, 22 nt, Homo sapiens
cagugcaaugaugaaagggcau

SEQ ID NO: 7315 - RNA, 22 nt, Homo sapiens
ucagugcacuacagaacuuugu

SEQ ID NO: 7316 - RNA, 22 nt, Homo sapiens
ucagugcaucacagaacuuugu

SEQ ID NO: 7317 - RNA, 21 nt, Homo sapiens
ucagugcaugacagaacuugg

SEQ ID NO: 7318 - RNA, 22 nt, Homo sapiens
uguaacagcaacuccaugugga

SEQ ID NO: 7319 - RNA, 22 nt, Homo sapiens
cucccacugcuucacuugacua

SEQ ID NO: 7320 - RNA, 23 nt, Homo sapiens
ugugcaaaucuaugcaaaacuga

SEQ ID NO: 7321 - RNA, 23 nt, Homo sapiens
ugugcaaauccaugcaaaacuga

SEQ ID NO: 7322 - RNA, 23 nt, Homo sapiens
cagugcaauaguauugucaaagc

SEQ ID NO: 7323 - RNA, 23 nt, Homo sapiens
cagugcaaugauauugucaaagc

SEQ ID NO: 7324 - RNA, 23 nt, Homo sapiens
aucaacagacauuaauugggcgc

SEQ ID NO: 7325 - RNA, 23 nt, Homo sapiens
agguuguccguggugaguucgca

SEQ ID NO: 7326 - RNA, 23 nt, Homo sapiens
uagugcaauauugcuuauagggu

SEQ ID NO: 7327 - RNA, 21 nt, Homo sapiens
uuaagacuugcagugauguuu

SEQ ID NO: 7328 - RNA, 21 nt, Homo sapiens
uuuugcaccuuuuggagugaa

SEQ ID NO: 7329 - RNA, 21 nt, Homo sapiens
gcgacccauacuugguuucag

SEQ ID NO: 7330 - RNA, 23 nt, Homo sapiens
guuugcacgggugggccuugucu

SEQ ID NO: 7331 - RNA, 22 nt, Homo sapiens
cuugguucagggagggucccca

SEQ ID NO: 7332 - RNA, 21 nt, Homo sapiens
ucccacguuguggcccagcag

SEQ ID NO: 7333 - RNA, 20 nt, Homo sapiens
agagucuugugaugucuugc

SEQ ID NO: 7334 - RNA, 22 nt, Homo sapiens
uggagugugacaaugguguuug

SEQ ID NO: 7335 - RNA, 22 nt, Homo sapiens
uucuggaauucugugugaggga

SEQ ID NO: 7336 - RNA, 23 nt, Homo sapiens
ugaguaccgccaugucuguuggg

SEQ ID NO: 7337 - RNA, 23 nt, Homo sapiens
caaagcgcuucucuuuagagugu

SEQ ID NO: 7338 - RNA, 23 nt, Homo sapiens
ucggggaucaucaugucacgaga

SEQ ID NO: 7339 - RNA, 21 nt, Homo sapiens
gcuaguccugacucagccagu

SEQ ID NO: 7340 - RNA, 19 nt, Homo sapiens
aggcugcggaauucaggac

SEQ ID NO: 7341 - RNA, 25 nt, Homo sapiens
aggggugguguugggacagcuccgu

SEQ ID NO: 7342 - RNA, 23 nt, Homo sapiens
aggaagcccuggaggggcuggag

SEQ ID NO: 7343 - RNA, 24 nt, Homo sapiens
uggggagcugaggcucugggggug

SEQ ID NO: 7344 - RNA, 22 nt, Homo sapiens
uggagugugacaaugguguuug

SEQ ID NO: 7345 - RNA, 23 nt, Homo sapiens
uggugcggagagggcccacagug

SEQ ID NO: 7346 - RNA, 21 nt, Homo sapiens
cggcggggacggcgauugguc

SEQ ID NO: 7347 - RNA, 22 nt, Homo sapiens
aggcggggcgccgcgggaccgc

SEQ ID NO: 7348 - RNA, 22 nt, Homo sapiens
uggguggucuggagauuugugc

SEQ ID NO: 7349 - RNA, 18 nt, Homo sapiens
cagggaggugaaugugau

SEQ ID NO: 7350 - RNA, 22 nt, Homo sapiens
cuccugagccauucugagccuc

SEQ ID NO: 7351 - RNA, 21 nt, Homo sapiens
agggcccccccucaauccugu

SEQ ID NO: 7352 - RNA, 22 nt, Homo sapiens
ugcggggcuagggcuaacagca

SEQ ID NO: 7353 - RNA, 22 nt, Homo sapiens
cgcaggggccgggugcucaccg

SEQ ID NO: 7354 - RNA, 22 nt, Homo sapiens
uccgagccugggucucccucuu

SEQ ID NO: 7355 - RNA, 22 nt, Homo sapiens
uuugguccccuucaaccagcug

SEQ ID NO: 7356 - RNA, 21 nt, Homo sapiens
cugacuguugccguccuccag

SEQ ID NO: 7357 - RNA, 20 nt, Homo sapiens
guagaggagauggcgcaggg

SEQ ID NO: 7358 - RNA, 21 nt, Homo sapiens
uucacaguggcuaaguucugc

SEQ ID NO: 7359 - RNA, 23 nt, Homo sapiens
ucuggcuccgugucuucacuccc

SEQ ID NO: 7360 - RNA, 22 nt, Homo sapiens
ugagaacugaauuccauggguu

SEQ ID NO: 7361 - RNA, 22 nt, Homo sapiens
uauggcacugguagaauucacu

SEQ ID NO: 7362 - RNA, 21 nt, Homo sapiens
ccaguccugugccugccgccu

SEQ ID NO: 7363 - RNA, 22 nt, Homo sapiens
cucccacugcuucacuugacua

SEQ ID NO: 7364 - RNA, 22 nt, Homo sapiens
cugugcgugugacagcggcuga

SEQ ID NO: 7365 - RNA, 22 nt, Homo sapiens
uguaaacauccuacacucagcu

SEQ ID NO: 7366 - RNA, 22 nt, Homo sapiens
ccucccacacccaaggcuugca

SEQ ID NO: 7367 - RNA, 22 nt, Homo sapiens
uaacugguugaacaacugaacc

SEQ ID NO: 7368 - RNA, 21 nt, Homo sapiens
caaagaggaaggucccauuac

SEQ ID NO: 7369 - RNA, 23 nt, Homo sapiens
uauucauuuauccccagccuaca

SEQ ID NO: 7370 - RNA, 22 nt, Homo sapiens
ucuucucuguuuuggccaugug

SEQ ID NO: 7371 - RNA, 22 nt, Homo sapiens
aaauuauuguacaucggaugag

SEQ ID NO: 7372 - RNA, 23 nt, Homo sapiens
uacccuguagaaccgaauuugug

SEQ ID NO: 7373 - RNA, 18 nt, Homo sapiens
ucagcuggcccucauuuc

SEQ ID NO: 7374 - RNA, 23 nt, Homo sapiens
uaauccuugcuaccugggugaga

SEQ ID NO: 7375 - RNA, 22 nt, Homo sapiens
uggugggcacagaaucuggacu

SEQ ID NO: 7376 - RNA, 22 nt, Homo sapiens
ccucuuccccuugucucuccag

SEQ ID NO: 7377 - RNA, 22 nt, Homo sapiens
uggguggucuggagauuugugc

SEQ ID NO: 7378 - RNA, 22 nt, Homo sapiens
uggugguuuacaaaguaauuca

SEQ ID NO: 7379 - RNA, 21 nt, Homo sapiens
gcgacccacucuugguuucca

SEQ ID NO: 7380 - RNA, 21 nt, Homo sapiens
gcgacccauacuugguuucag

SEQ ID NO: 7381 - RNA, 22 nt, Homo sapiens
ccucuuccccuugucucuccag

SEQ ID NO: 7382 - RNA, 20 nt, Homo sapiens
guagaggagauggcgcaggg

SEQ ID NO: 7383 - RNA, 21 nt, Homo sapiens
cggcggggacggcgauugguc

SEQ ID NO: 7384 - RNA, 23 nt, Homo sapiens
ugaggggcagagagcgagacuuu

SEQ ID NO: 7385 - RNA, 22 nt, Homo sapiens
aggcggggcgccgcgggaccgc

SEQ ID NO: 7386 - RNA, 22 nt, Homo sapiens
ugcggggcuagggcuaacagca

SEQ ID NO: 7387 - RNA, 22 nt, Homo sapiens
auccgcgcucugacucucugcc

SEQ ID NO: 7388 - RNA, 22 nt, Homo sapiens
cagugcaaugaugaaagggcau

SEQ ID NO: 7389 - RNA, 22 nt, Homo sapiens
agaaggaaauugaauucauuua

SEQ ID NO: 7390 - RNA, 23 nt, Homo sapiens
caaagcgcuucucuuuagagugu

SEQ ID NO: 7391 - RNA, 21 nt, Homo sapiens
cuccagagggaaguacuuucu

SEQ ID NO: 7392 - RNA, 21 nt, Homo sapiens
cuccagagggaugcacuuucu

SEQ ID NO: 7393 - RNA, 22 nt, Homo sapiens
uccagcaucagugauuuuguug

SEQ ID NO: 7394 - RNA, 22 nt, Homo sapiens
ugcggggcuagggcuaacagca

SEQ ID NO: 7395 - RNA, 22 nt, Homo sapiens
uggugguuuacaaaguaauuca

SEQ ID NO: 7396 - RNA, 23 nt, Homo sapiens
ugaggggcagagagcgagacuuu

SEQ ID NO: 7397 - RNA, 22 nt, Homo sapiens
cgucaacacuugcugguuuccu

SEQ ID NO: 7398 - RNA, 18 nt, Homo sapiens
ugcuuccuuucagagggu

SEQ ID NO: 7399 - RNA, 22 nt, Homo sapiens
aucuggagguaagaagcacuuu

SEQ ID NO: 7400 - RNA, 22 nt, Homo sapiens
ccucuuccccuugucucuccag

SEQ ID NO: 7401 - RNA, 22 nt, Homo sapiens
aucuggagguaagaagcacuuu

SEQ ID NO: 7402 - RNA, 24 nt, Homo sapiens
uugcagcugccugggagugacuuc

SEQ ID NO: 7403 - RNA, 18 nt, Homo sapiens
cagggaggugaaugugau

SEQ ID NO: 7404 - RNA, 22 nt, Homo sapiens
aaaacuguaauuacuuuuguac

SEQ ID NO: 7405 - RNA, 21 nt, Homo sapiens
cugaccuaugaauugacagcc

SEQ ID NO: 7406 - RNA, 21 nt, Homo sapiens
augaccuaugaauugacagac

SEQ ID NO: 7407 - RNA, 23 nt, Homo sapiens
uauucauuuauccccagccuaca

SEQ ID NO: 7408 - RNA, 21 nt, Homo sapiens
aggcaagaugcuggcauagcu

SEQ ID NO: 7409 - RNA, 23 nt, Homo sapiens
uaauccuugcuaccugggugaga

SEQ ID NO: 7410 - RNA, 23 nt, Homo sapiens
uggaguccaggaaucugcauuuu

SEQ ID NO: 7411 - RNA, 23 nt, Homo sapiens
caacggaaucccaaaagcagcug

SEQ ID NO: 7412 - RNA, 20 nt, Homo sapiens
ccuccugcccuccuugcugu

SEQ ID NO: 7413 - RNA, 23 nt, Homo sapiens
aggaagcccuggaggggcuggag

SEQ ID NO: 7414 - RNA, 21 nt, Homo sapiens
uaccacaggguagaaccacgg

SEQ ID NO: 7415 - RNA, 22 nt, Homo sapiens
uucaccaccuucuccacccagc

SEQ ID NO: 7416 - RNA, 22 nt, Homo sapiens
acucggcguggcgucggucgug

SEQ ID NO: 7417 - RNA, 22 nt, Homo sapiens
uagcaaaaacugcaguuacuuu

SEQ ID NO: 7418 - RNA, 22 nt, Homo sapiens
caaaguuuaagauccuugaagu

SEQ ID NO: 7419 - RNA, 22 nt, Homo sapiens
uccuucauuccaccggagucug

SEQ ID NO: 7420 - RNA, 22 nt, Homo sapiens
gguggcccggccgugccugagg

SEQ ID NO: 7421 - RNA, 24 nt, Homo sapiens
ccagacagaauucuaugcacuuuc

SEQ ID NO: 7422 - RNA, 22 nt, Homo sapiens
uuugguccccuucaaccagcug

SEQ ID NO: 7423 - RNA, 22 nt, Homo sapiens
uuugguccccuucaaccagcua

SEQ ID NO: 7424 - RNA, 22 nt, Homo sapiens
ucaggccaggcacaguggcuca

SEQ ID NO: 7425 - RNA, 21 nt, Homo sapiens
agcuacaucuggcuacugggu

SEQ ID NO: 7426 - RNA, 21 nt, Homo sapiens
cccggagccaggaugcagcuc

SEQ ID NO: 7427 - RNA, 22 nt, Homo sapiens
ccucuuccccuugucucuccag

SEQ ID NO: 7428 - RNA, 23 nt, Homo sapiens
cggcccgggcugcugcuguuccu

SEQ ID NO: 7429 - RNA, 21 nt, Homo sapiens
agggcccccccucaauccugu

SEQ ID NO: 7430 - RNA, 22 nt, Homo sapiens
aguggggaacccuuccaugagg

SEQ ID NO: 7431 - RNA, 24 nt, Homo sapiens
uucuccaaaagaaagcacuuucug

SEQ ID NO: 7432 - RNA, 22 nt, Homo sapiens
gaaagcgcuucccuuugcugga

SEQ ID NO: 7433 - RNA, 22 nt, Homo sapiens
caaagcgcuccccuuuagaggu

SEQ ID NO: 7434 - RNA, 23 nt, Homo sapiens
caaagcgcuucucuuuagagugu

SEQ ID NO: 7435 - RNA, 21 nt, Homo sapiens
caaagcgcuucccuuuggagc

SEQ ID NO: 7436 - RNA, 21 nt, Homo sapiens
aaagcgcuucccuucagagug

SEQ ID NO: 7437 - RNA, 21 nt, Homo sapiens
gaaagcgcuucucuuuagagg

SEQ ID NO: 7438 - RNA, 22 nt, Homo sapiens
aagugccuccuuuuagaguguu

SEQ ID NO: 7439 - RNA, 25 nt, Homo sapiens
aggggugguguugggacagcuccgu

SEQ ID NO: 7440 - RNA, 22 nt, Homo sapiens
aggcggggcgccgcgggaccgc

SEQ ID NO: 7441 - RNA, 23 nt, Homo sapiens
aggaagcccuggaggggcuggag

SEQ ID NO: 7442 - RNA, 22 nt, Homo sapiens
ugcggggcuagggcuaacagca

SEQ ID NO: 7443 - RNA, 21 nt, Homo sapiens
uggaggagaaggaaggugaug

SEQ ID NO: 7444 - RNA, 20 nt, Homo sapiens
ggggagcuguggaagcagua

SEQ ID NO: 7445 - RNA, 24 nt, Homo sapiens
uggggagcugaggcucugggggug

SEQ ID NO: 7446 - RNA, 22 nt, Homo sapiens
ucuucucuguuuuggccaugug

SEQ ID NO: 7447 - RNA, 23 nt, Homo sapiens
uauggcuuuucauuccuauguga

SEQ ID NO: 7448 - RNA, 23 nt, Homo sapiens
ccugcagcgacuugauggcuucc

SEQ ID NO: 7449 - RNA, 23 nt, Homo sapiens
ccugcagcgacuugauggcuucc

SEQ ID NO: 7450 - RNA, 22 nt, Homo sapiens
acgcccuucccccccuucuuca

SEQ ID NO: 7451 - RNA, 17 nt, Homo sapiens
gugggggagaggcuguc

SEQ ID NO: 7452 - RNA, 23 nt, Homo sapiens
uggaguccaggaaucugcauuuu

SEQ ID NO: 7453 - RNA, 23 nt, Homo sapiens
ucuggcuccgugucuucacuccc

SEQ ID NO: 7454 - RNA, 21 nt, Homo sapiens
ucgaggagcucacagucuagu

SEQ ID NO: 7455 - RNA, 25 nt, Homo sapiens
cccccacaaccgcgcuugacuagcu

SEQ ID NO: 7456 - RNA, 23 nt, Homo sapiens
ugagcgccucgacgacagagccg

SEQ ID NO: 7457 - RNA, 23 nt, Homo sapiens
ucccccaggugugauucugauuu

SEQ ID NO: 7458 - RNA, 22 nt, Homo sapiens
aauugcacgguauccaucugua

SEQ ID NO: 7459 - RNA, 25 nt, Homo sapiens
aggggugguguugggacagcuccgu

SEQ ID NO: 7460 - RNA, 23 nt, Homo sapiens
gcgaggaccccucggggucugac

SEQ ID NO: 7461 - RNA, 24 nt, Homo sapiens
acugggggcuuucgggcucugcgu

SEQ ID NO: 7462 - RNA, 21 nt, Homo sapiens
uggaggagaaggaaggugaug

SEQ ID NO: 7463 - RNA, 24 nt, Homo sapiens
agccuggaagcuggagccugcagu

SEQ ID NO: 7464 - RNA, 24 nt, Homo sapiens
uggcccugacugaagaccagcagu

SEQ ID NO: 7465 - RNA, 22 nt, Homo sapiens
ucucccaacccuuguaccagug

SEQ ID NO: 7466 - RNA, 21 nt, Homo sapiens
cucccacaugcaggguuugca

SEQ ID NO: 7467 - RNA, 23 nt, Homo sapiens
ugaguaccgccaugucuguuggg

SEQ ID NO: 7468 - RNA, 22 nt, Homo sapiens
ucaggccaggcacaguggcuca

SEQ ID NO: 7469 - RNA, 22 nt, Homo sapiens
uagcaccaucugaaaucgguua

SEQ ID NO: 7470 - RNA, 23 nt, Homo sapiens
uagcaccauuugaaaucaguguu

SEQ ID NO: 7471 - RNA, 22 nt, Homo sapiens
uagcaccauuugaaaucgguua

SEQ ID NO: 7472 - RNA, 22 nt, Homo sapiens
uguaaacauccuacacucagcu

SEQ ID NO: 7473 - RNA, 21 nt, Homo sapiens
uaaagugcugacagugcagau

SEQ ID NO: 7474 - RNA, 23 nt, Homo sapiens
cagugcaaugauauugucaaagc

SEQ ID NO: 7475 - RNA, 22 nt, Homo sapiens
cuggcccucucugcccuuccgu

SEQ ID NO: 7476 - RNA, 21 nt, Homo sapiens
gccccugggccuauccuagaa

SEQ ID NO: 7477 - RNA, 23 nt, Homo sapiens
ucccccaggugugauucugauuu

SEQ ID NO: 7478 - RNA, 23 nt, Homo sapiens
uacuccagagggcgucacucaug

SEQ ID NO: 7479 - RNA, 24 nt, Homo sapiens
acaaagugcuucccuuuagagugu

SEQ ID NO: 7480 - RNA, 22 nt, Homo sapiens
acaaagugcuucccuuuagagu

SEQ ID NO: 7481 - RNA, 24 nt, Homo sapiens
aaagacauaggauagagucaccuc

SEQ ID NO: 7482 - RNA, 23 nt, Homo sapiens
cugggaucuccggggucuugguu

SEQ ID NO: 7483 - RNA, 22 nt, Homo sapiens
aacuguuugcagaggaaacuga

SEQ ID NO: 7484 - RNA, 21 nt, Homo sapiens
uagcagcacagaaauauuggc

SEQ ID NO: 7485 - RNA, 22 nt, Homo sapiens
aacaauauccuggugcugagug

SEQ ID NO: 7486 - RNA, 22 nt, Homo sapiens
aacuguuugcagaggaaacuga

SEQ ID NO: 7487 - RNA, 21 nt, Homo sapiens
uugugcuugaucuaaccaugu

SEQ ID NO: 7488 - RNA, 22 nt, Homo sapiens
aucuggagguaagaagcacuuu

SEQ ID NO: 7489 - RNA, 21 nt, Homo sapiens
cagcagcacacugugguuugu

SEQ ID NO: 7490 - RNA, 23 nt, Homo sapiens
aaggagcuuacaaucuagcuggg

SEQ ID NO: 7491 - RNA, 22 nt, Homo sapiens
uuaucagaaucuccagggguac

SEQ ID NO: 7492 - RNA, 21 nt, Homo sapiens
uacucaaaaagcugucaguca

SEQ ID NO: 7493 - RNA, 22 nt, Homo sapiens
aacuguuugcagaggaaacuga

SEQ ID NO: 7494 - RNA, 22 nt, Homo sapiens
aucuggagguaagaagcacuuu

SEQ ID NO: 7495 - RNA, 24 nt, Homo sapiens
agcagaagcagggagguucuccca

SEQ ID NO: 7496 - RNA, 22 nt, Homo sapiens
aaacaaacauggugcacuucuu

SEQ ID NO: 7497 - RNA, 20 nt, Homo sapiens
cggcucugggucugugggga

SEQ ID NO: 7498 - RNA, 21 nt, Homo sapiens
ccuggaaacacugagguugug

SEQ ID NO: 7499 - RNA, 20 nt, Homo sapiens
guagaggagauggcgcaggg

SEQ ID NO: 7500 - RNA, 21 nt, Homo sapiens
gaaggcgcuucccuuuggagu

SEQ ID NO: 7501 - RNA, 22 nt, Homo sapiens
gaaggcgcuucccuuuagagcg

SEQ ID NO: 7502 - RNA, 19 nt, Homo sapiens
gggcgccugugaucccaac

SEQ ID NO: 7503 - RNA, 23 nt, Homo sapiens
aggaugagcaaagaaaguagauu

SEQ ID NO: 7504 - RNA, 22 nt, Homo sapiens
cggaugagcaaagaaagugguu

SEQ ID NO: 7505 - RNA, 22 nt, Homo sapiens
aacuggcccucaaagucccgcu

SEQ ID NO: 7506 - RNA, 21 nt, Homo sapiens
aagcauucuuucauugguugg

SEQ ID NO: 7507 - RNA, 20 nt, Homo sapiens
cgugccacccuuuuccccag

SEQ ID NO: 7508 - RNA, 22 nt, Homo sapiens
uuugguccccuucaaccagcug

SEQ ID NO: 7509 - RNA, 23 nt, Homo sapiens
uguaguguuuccuacuuuaugga

SEQ ID NO: 7510 - RNA, 25 nt, Homo sapiens
cccccacaaccgcgcuugacuagcu

SEQ ID NO: 7511 - RNA, 22 nt, Homo sapiens
uggcagugucuuagcugguugu

SEQ ID NO: 7512 - RNA, 23 nt, Homo sapiens
aggcaguguaguuagcugauugc

SEQ ID NO: 7513 - RNA, 23 nt, Homo sapiens
ucccccaggugugauucugauuu

SEQ ID NO: 7514 - RNA, 22 nt, Homo sapiens
uggcaguguauuguuagcuggu

SEQ ID NO: 7515 - RNA, 22 nt, Homo sapiens
aggcaguguauuguuagcuggc

SEQ ID NO: 7516 - RNA, 21 nt, Homo sapiens
uugaaaggcuauuucuugguc

SEQ ID NO: 7517 - RNA, 20 nt, Homo sapiens
aaaguagcuguaccauuugc

SEQ ID NO: 7518 - RNA, 21 nt, Homo sapiens
ucuuguguucucuagaucagu

SEQ ID NO: 7519 - RNA, 22 nt, Homo sapiens
ugagaaccacgucugcucugag

SEQ ID NO: 7520 - RNA, 20 nt, Homo sapiens
aggguguuucucucaucucu

SEQ ID NO: 7521 - RNA, 24 nt, Homo sapiens
acugggggcuuucgggcucugcgu

SEQ ID NO: 7522 - RNA, 19 nt, Homo sapiens
aagugugcagggcacuggu

SEQ ID NO: 7523 - RNA, 23 nt, Homo sapiens
uagugcaauauugcuuauagggu

SEQ ID NO: 7524 - RNA, 22 nt, Homo sapiens
uggagagaaaggcaguuccuga

SEQ ID NO: 7525 - RNA, 21 nt, Homo sapiens
gugcauuguaguugcauugca

SEQ ID NO: 7526 - RNA, 23 nt, Homo sapiens
uccaguaccacgugucagggcca

SEQ ID NO: 7527 - RNA, 22 nt, Homo sapiens
ucugggcaacaaagugagaccu

SEQ ID NO: 7528 - RNA, 25 nt, Homo sapiens
gcugggcagggcuucugagcuccuu

SEQ ID NO: 7529 - RNA, 22 nt, Homo sapiens
uuuccggcucgcgugggugugu

SEQ ID NO: 7530 - RNA, 27 nt, Homo sapiens
auugaucaucgacacuucgaacgcaau

SEQ ID NO: 7531 - RNA, 20 nt, Homo sapiens
ccuccugcccuccuugcugu

SEQ ID NO: 7532 - RNA, 23 nt, Homo sapiens
ugaggggcagagagcgagacuuu

SEQ ID NO: 7533 - RNA, 21 nt, Homo sapiens
gugccagcugcagugggggag

SEQ ID NO: 7534 - RNA, 21 nt, Homo sapiens
uggcagggaggcugggagggg

SEQ ID NO: 7535 - RNA, 17 nt, Homo sapiens
gugggggagaggcuguc

SEQ ID NO: 7536 - RNA, 23 nt, Homo sapiens
ucuggcuccgugucuucacuccc

SEQ ID NO: 7537 - RNA, 22 nt, Homo sapiens
uggagagaaaggcaguuccuga

SEQ ID NO: 7538 - RNA, 22 nt, Homo sapiens
cgcaggggccgggugcucaccg

SEQ ID NO: 7539 - RNA, 22 nt, Homo sapiens
gguccagaggggagauagguuc

SEQ ID NO: 7540 - RNA, 22 nt, Homo sapiens
uguaaacauccuacacucagcu

SEQ ID NO: 7541 - RNA, 22 nt, Homo sapiens
caaucacuaacuccacugccau

SEQ ID NO: 7542 - RNA, 23 nt, Homo sapiens
ucccccaggugugauucugauuu

SEQ ID NO: 7543 - RNA, 22 nt, Homo sapiens
agaggcuggccgugaugaauuc

SEQ ID NO: 7544 - RNA, 21 nt, Homo sapiens
agggggaaaguucuauagucc

SEQ ID NO: 7545 - RNA, 24 nt, Homo sapiens
acugggggcuuucgggcucugcgu

SEQ ID NO: 7546 - RNA, 22 nt, Homo sapiens
aucuggagguaagaagcacuuu

SEQ ID NO: 7547 - RNA, 22 nt, Homo sapiens
uggagugugacaaugguguuug

SEQ ID NO: 7548 - RNA, 23 nt, Homo sapiens
ucuggcuccgugucuucacuccc

SEQ ID NO: 7549 - RNA, 23 nt, Homo sapiens
ucuggcuccgugucuucacuccc

SEQ ID NO: 7550 - RNA, 23 nt, Homo sapiens
uaaggugcaucuagugcagauag

SEQ ID NO: 7551 - RNA, 21 nt, Homo sapiens
cggcggggacggcgauugguc

SEQ ID NO: 7552 - RNA, 23 nt, Homo sapiens
ugaguaccgccaugucuguuggg

SEQ ID NO: 7553 - RNA, 22 nt, Homo sapiens
cccugugcccggcccacuucug

SEQ ID NO: 7554 - RNA, 22 nt, Homo sapiens
cccugugcccggcccacuucug

SEQ ID NO: 7555 - RNA, 22 nt, Homo sapiens
ucaggccaggcacaguggcuca

SEQ ID NO: 7556 - RNA, 22 nt, Homo sapiens
cgucaacacuugcugguuuccu

SEQ ID NO: 7557 - RNA, 22 nt, Homo sapiens
aggcggggcgccgcgggaccgc

SEQ ID NO: 7558 - RNA, 22 nt, Homo sapiens
cugcccuggcccgagggaccga

SEQ ID NO: 7559 - RNA, 21 nt, Homo sapiens
aaggcagggcccccgcucccc

SEQ ID NO: 7560 - RNA, 23 nt, Homo sapiens
uggaguccaggaaucugcauuuu

SEQ ID NO: 7561 - RNA, 23 nt, Homo sapiens
uacuccagagggcgucacucaug

SEQ ID NO: 7562 - RNA, 22 nt, Homo sapiens
cauugcacuugucucggucuga

SEQ ID NO: 7563 - RNA, 21 nt, Homo sapiens
cauaaaguagaaagcacuacu

SEQ ID NO: 7564 - RNA, 22 nt, Homo sapiens
uccuucauuccaccggagucug

SEQ ID NO: 7565 - RNA, 21 nt, Homo sapiens
cggcggggacggcgauugguc

SEQ ID NO: 7566 - RNA, 23 nt, Homo sapiens
agcuacauugucugcuggguuuc

SEQ ID NO: 7567 - RNA, 23 nt, Homo sapiens
agcucggucugaggccccucagu

SEQ ID NO: 7568 - RNA, 19 nt, Homo sapiens
ugagcugcuguaccaaaau

SEQ ID NO: 7569 - RNA, 22 nt, Homo sapiens
ugugucacucgaugaccacugu

SEQ ID NO: 7570 - RNA, 19 nt, Homo sapiens
aagcagcugccucugaggc

SEQ ID NO: 7571 - RNA, 22 nt, Homo sapiens
aggcggggcgccgcgggaccgc

SEQ ID NO: 7572 - RNA, 22 nt, Homo sapiens
aggcagcgggguguaguggaua

SEQ ID NO: 7573 - RNA, 19 nt, Homo sapiens
ugagcugcuguaccaaaau

SEQ ID NO: 7574 - RNA, 22 nt, Homo sapiens
augggugaauuuguagaaggau

SEQ ID NO: 7575 - RNA, 22 nt, Homo sapiens
uauguaauaugguccacaucuu

SEQ ID NO: 7576 - RNA, 21 nt, Homo sapiens
cggggcagcucaguacaggau

SEQ ID NO: 7577 - RNA, 19 nt, Homo sapiens
agguugacauacguuuccc

SEQ ID NO: 7578 - RNA, 22 nt, Homo sapiens
cacgcucaugcacacacccaca

SEQ ID NO: 7579 - RNA, 21 nt, Homo sapiens
ccccaccuccucucuccucag

SEQ ID NO: 7580 - RNA, 22 nt, Homo sapiens
caaaacuggcaauuacuuuugc

SEQ ID NO: 7581 - RNA, 22 nt, Homo sapiens
aaaaacugagacuacuuuugca

SEQ ID NO: 7582 - RNA, 19 nt, Homo sapiens
aaaaacuguaauuacuuuu

SEQ ID NO: 7583 - RNA, 18 nt, Homo sapiens
cgggcguggugguggggg

SEQ ID NO: 7584 - RNA, 22 nt, Homo sapiens
uuugaggcuacagugagaugug

SEQ ID NO: 7585 - RNA, 22 nt, Homo sapiens
ugagaacugaauuccauggguu

SEQ ID NO: 7586 - RNA, 22 nt, Homo sapiens
ugagaacugaauuccauaggcu

SEQ ID NO: 7587 - RNA, 22 nt, Homo sapiens
gguccagaggggagauagguuc

SEQ ID NO: 7588 - RNA, 23 nt, Homo sapiens
guguuaauuaaaccucuauuuac

SEQ ID NO: 7589 - RNA, 22 nt, Homo sapiens
agaguugagucuggacgucccg

SEQ ID NO: 7590 - RNA, 22 nt, Homo sapiens
cuagguauggucccagggaucc

SEQ ID NO: 7591 - RNA, 23 nt, Homo sapiens
aaugacacgaucacucccguuga

SEQ ID NO: 7592 - RNA, 22 nt, Homo sapiens
agaggcuggccgugaugaauuc

SEQ ID NO: 7593 - RNA, 23 nt, Homo sapiens
caaagcgcuucucuuuagagugu

SEQ ID NO: 7594 - RNA, 21 nt, Homo sapiens
cuccagagggaaguacuuucu

SEQ ID NO: 7595 - RNA, 21 nt, Homo sapiens
cuccagagggaugcacuuucu

SEQ ID NO: 7596 - RNA, 21 nt, Homo sapiens
aguuaaugaauccuggaaagu

SEQ ID NO: 7597 - RNA, 22 nt, Homo sapiens
uugugucaauaugcgaugaugu

SEQ ID NO: 7598 - RNA, 19 nt, Homo sapiens
gugucugcuuccuguggga

SEQ ID NO: 7599 - RNA, 24 nt, Homo sapiens
agccuggaagcuggagccugcagu

SEQ ID NO: 7600 - RNA, 22 nt, Homo sapiens
auccgcgcucugacucucugcc

SEQ ID NO: 7601 - RNA, 21 nt, Homo sapiens
uggcagggaggcugggagggg

SEQ ID NO: 7602 - RNA, 21 nt, Homo sapiens
agggcccccccucaauccugu

SEQ ID NO: 7603 - RNA, 21 nt, Homo sapiens
uucacaguggcuaaguuccgc

SEQ ID NO: 7604 - RNA, 22 nt, Homo sapiens
uacccagagcaugcagugugaa

SEQ ID NO: 7605 - RNA, 19 nt, Homo sapiens
aggcugcggaauucaggac

SEQ ID NO: 7606 - RNA, 22 nt, Homo sapiens
caaaaguaauuguggauuuugu

SEQ ID NO: 7607 - RNA, 22 nt, Homo sapiens
ugagguaguaguuugugcuguu

SEQ ID NO: 7608 - RNA, 21 nt, Homo sapiens
ccccaccuccucucuccucag

SEQ ID NO: 7609 - RNA, 22 nt, Homo sapiens
ucugggcaacaaagugagaccu

SEQ ID NO: 7610 - RNA, 20 nt, Homo sapiens
ccccagggcgacgcggcggg

SEQ ID NO: 7611 - RNA, 22 nt, Homo sapiens
uguaacagcaacuccaugugga

SEQ ID NO: 7612 - RNA, 22 nt, Homo sapiens
aacacaccugguuaaccucuuu

SEQ ID NO: 7613 - RNA, 22 nt, Homo sapiens
aacacaccuauucaaggauuca

SEQ ID NO: 7614 - RNA, 22 nt, Homo sapiens
uggugggcacagaaucuggacu

SEQ ID NO: 7615 - RNA, 22 nt, Homo sapiens
ucagcaaacauuuauugugugc

SEQ ID NO: 7616 - RNA, 19 nt, Homo sapiens
aggcacggugucagcaggc

SEQ ID NO: 7617 - RNA, 25 nt, Homo sapiens
gcugggcagggcuucugagcuccuu

SEQ ID NO: 7618 - RNA, 22 nt, Homo sapiens
uggugggccgcagaacaugugc

SEQ ID NO: 7619 - RNA, 22 nt, Homo sapiens
agucauuggaggguuugagcag

SEQ ID NO: 7620 - RNA, 22 nt, Homo sapiens
ugugacagauugauaacugaaa

SEQ ID NO: 7621 - RNA, 18 nt, Homo sapiens
ugaggcaguagauugaau

SEQ ID NO: 7622 - RNA, 22 nt, Homo sapiens
ugcggggcuagggcuaacagca

SEQ ID NO: 7623 - RNA, 21 nt, Homo sapiens
ccccaccuccucucuccucag

SEQ ID NO: 7624 - RNA, 20 nt, Homo sapiens
ucugcaggguuugcuuugag

SEQ ID NO: 7625 - RNA, 20 nt, Homo sapiens
ucugcaggguuugcuuugag

SEQ ID NO: 7626 - RNA, 23 nt, Homo sapiens
ucuggcuccgugucuucacuccc

SEQ ID NO: 7627 - RNA, 22 nt, Homo sapiens
uguaaacauccuacacucagcu

SEQ ID NO: 7628 - RNA, 18 nt, Homo sapiens
cagggaggugaaugugau

SEQ ID NO: 7629 - RNA, 19 nt, Homo sapiens
aagugugcagggcacuggu

SEQ ID NO: 7630 - RNA, 23 nt, Homo sapiens
uacuccagagggcgucacucaug

SEQ ID NO: 7631 - RNA, 22 nt, Homo sapiens
uggagagaaaggcaguuccuga

SEQ ID NO: 7632 - RNA, 23 nt, Homo sapiens
cggcccgggcugcugcuguuccu

SEQ ID NO: 7633 - RNA, 22 nt, Homo sapiens
uggagugugacaaugguguuug

SEQ ID NO: 7634 - RNA, 22 nt, Homo sapiens
agaaggaaauugaauucauuua

SEQ ID NO: 7635 - RNA, 20 nt, Homo sapiens
ucguuugccuuuuucugcuu

SEQ ID NO: 7636 - RNA, 22 nt, Homo sapiens
ucuacaaaggaaagcgcuuucu

SEQ ID NO: 7637 - RNA, 18 nt, Homo sapiens
uugagaaggaggcugcug

SEQ ID NO: 7638 - RNA, 23 nt, Homo sapiens
uauggcuuuucauuccuauguga

SEQ ID NO: 7639 - RNA, 23 nt, Homo sapiens
gcaaagcacacggccugcagaga

SEQ ID NO: 7640 - RNA, 22 nt, Homo sapiens
uuauaaagcaaugagacugauu

SEQ ID NO: 7641 - RNA, 23 nt, Homo sapiens
ucucacacagaaaucgcacccgu

SEQ ID NO: 7642 - RNA, 22 nt, Homo sapiens
aagacgggaggaaagaagggag

SEQ ID NO: 7643 - RNA, 23 nt, Homo sapiens
cacucagccuugagggcacuuuc

SEQ ID NO: 7644 - RNA, 20 nt, Homo sapiens
cuacaaagggaagcccuuuc

SEQ ID NO: 7645 - RNA, 22 nt, Homo sapiens
cuacaaagggaagcacuuucuc

SEQ ID NO: 7646 - RNA, 21 nt, Homo sapiens
aguuaaugaauccuggaaagu

SEQ ID NO: 7647 - RNA, 23 nt, Homo sapiens
uaaaucccauggugccuucuccu

SEQ ID NO: 7648 - RNA, 22 nt, Homo sapiens
uggauuucuuugugaaucacca

SEQ ID NO: 7649 - RNA, 22 nt, Homo sapiens
uacccagagcaugcagugugaa

SEQ ID NO: 7650 - RNA, 23 nt, Homo sapiens
uggugcggagagggcccacagug

SEQ ID NO: 7651 - RNA, 23 nt, Homo sapiens
ucauagcccuguacaaugcugcu

SEQ ID NO: 7652 - RNA, 22 nt, Homo sapiens
cucuagagggaagcacuuucug

SEQ ID NO: 7653 - RNA, 22 nt, Homo sapiens
uagguaguuucauguuguuggg

SEQ ID NO: 7654 - RNA, 23 nt, Homo sapiens
agcuacauugucugcuggguuuc

SEQ ID NO: 7655 - RNA, 21 nt, Homo sapiens
aggcaagaugcuggcauagcu

SEQ ID NO: 7656 - RNA, 21 nt, Homo sapiens
gccccugggccuauccuagaa

SEQ ID NO: 7657 - RNA, 19 nt, Homo sapiens
aggcugcggaauucaggac

SEQ ID NO: 7658 - RNA, 25 nt, Homo sapiens
aggggugguguugggacagcuccgu

SEQ ID NO: 7659 - RNA, 20 nt, Homo sapiens
aggguguuucucucaucucu

SEQ ID NO: 7660 - RNA, 22 nt, Homo sapiens
ugcggggcuagggcuaacagca

SEQ ID NO: 7661 - RNA, 20 nt, Homo sapiens
ggggagcuguggaagcagua

SEQ ID NO: 7662 - RNA, 20 nt, Homo sapiens
ggggagcuguggaagcagua

SEQ ID NO: 7663 - RNA, 24 nt, Homo sapiens
uggggagcugaggcucugggggug

SEQ ID NO: 7664 - RNA, 21 nt, Homo sapiens
gccccugggccuauccuagaa

SEQ ID NO: 7665 - RNA, 23 nt, Homo sapiens
ucccuguccuccaggagcucacg

SEQ ID NO: 7666 - RNA, 22 nt, Homo sapiens
aauugcacgguauccaucugua

SEQ ID NO: 7667 - RNA, 18 nt, Homo sapiens
aucccaccucugccacca

SEQ ID NO: 7668 - RNA, 17 nt, Homo sapiens
ucccaccgcugccaccc

SEQ ID NO: 7669 - RNA, 22 nt, Homo sapiens
acagcaggcacagacaggcagu

SEQ ID NO: 7670 - RNA, 21 nt, Homo sapiens
aggggugcuaucugugauuga

SEQ ID NO: 7671 - RNA, 22 nt, Homo sapiens
gccugcugggguggaaccuggu

SEQ ID NO: 7672 - RNA, 23 nt, Homo sapiens
aggaccugcgggacaagauucuu

SEQ ID NO: 7673 - RNA, 21 nt, Homo sapiens
gaaggcgcuucccuuuggagu

SEQ ID NO: 7674 - RNA, 22 nt, Homo sapiens
gaaggcgcuucccuuuagagcg

SEQ ID NO: 7675 - RNA, 21 nt, Homo sapiens
agaccuggcccagaccucagc

SEQ ID NO: 7676 - RNA, 25 nt, Homo sapiens
ggcggagggaaguagguccguuggu

SEQ ID NO: 7677 - RNA, 23 nt, Homo sapiens
uggugcggagagggcccacagug

SEQ ID NO: 7678 - RNA, 21 nt, Homo sapiens
uggaggagaaggaaggugaug

SEQ ID NO: 7679 - RNA, 22 nt, Homo sapiens
aggcauugacuucucacuagcu

SEQ ID NO: 7680 - RNA, 21 nt, Homo sapiens
cauaaaguagaaagcacuacu

SEQ ID NO: 7681 - RNA, 22 nt, Homo sapiens
caaagaauucuccuuuugggcu

SEQ ID NO: 7682 - RNA, 22 nt, Homo sapiens
uguaacagcaacuccaugugga

SEQ ID NO: 7683 - RNA, 22 nt, Homo sapiens
uccuucauuccaccggagucug

SEQ ID NO: 7684 - RNA, 22 nt, Homo sapiens
aaaaguaauugcgaguuuuacc

SEQ ID NO: 7685 - RNA, 22 nt, Homo sapiens
aaaaguaauugugguuuuggcc

SEQ ID NO: 7686 - RNA, 22 nt, Homo sapiens
aaaaguaauugcgguuuuugcc

SEQ ID NO: 7687 - RNA, 22 nt, Homo sapiens
aaaaguaauugugguuuuugcc

SEQ ID NO: 7688 - RNA, 22 nt, Homo sapiens
aaaaguaaucgcgguuuuuguc

SEQ ID NO: 7689 - RNA, 22 nt, Homo sapiens
aaaaguaauugcggauuuugcc

SEQ ID NO: 7690 - RNA, 22 nt, Homo sapiens
aaaaguaauugcggucuuuggu

SEQ ID NO: 7691 - RNA, 21 nt, Homo sapiens
uaaaguaaauaugcaccaaaa

SEQ ID NO: 7692 - RNA, 21 nt, Homo sapiens
ucuaguaagaguggcagucga

SEQ ID NO: 7693 - RNA, 23 nt, Homo sapiens
caguaacaaagauucauccuugu

SEQ ID NO: 7694 - RNA, 23 nt, Homo sapiens
ucucacacagaaaucgcacccgu

SEQ ID NO: 7695 - RNA, 22 nt, Homo sapiens
ugagaccucuggguucugagcu

SEQ ID NO: 7696 - RNA, 20 nt, Homo sapiens
aggguguuucucucaucucu

SEQ ID NO: 7697 - RNA, 23 nt, Homo sapiens
uagcagcgggaacaguucugcag

SEQ ID NO: 7698 - RNA, 25 nt, Homo sapiens
aggggugguguugggacagcuccgu

SEQ ID NO: 7699 - RNA, 22 nt, Homo sapiens
ugcggggcuagggcuaacagca

SEQ ID NO: 7700 - RNA, 21 nt, Homo sapiens
gaagugugccguggugugucu

SEQ ID NO: 7701 - RNA, 23 nt, Homo sapiens
ugaguaccgccaugucuguuggg

SEQ ID NO: 7702 - RNA, 22 nt, Homo sapiens
gugagucucuaagaaaagagga

SEQ ID NO: 7703 - RNA, 22 nt, Homo sapiens
acccgucccguucguccccgga

SEQ ID NO: 7704 - RNA, 17 nt, Homo sapiens
ucgccuccuccucuccc

SEQ ID NO: 7705 - RNA, 21 nt, Homo sapiens
cggcggggacggcgauugguc

SEQ ID NO: 7706 - RNA, 22 nt, Homo sapiens
cauugcacuugucucggucuga

SEQ ID NO: 7707 - RNA, 25 nt, Homo sapiens
ggcggagggaaguagguccguuggu

SEQ ID NO: 7708 - RNA, 25 nt, Homo sapiens
ggcggagggaaguagguccguuggu

SEQ ID NO: 7709 - RNA, 22 nt, Homo sapiens
aggcggggcgccgcgggaccgc

SEQ ID NO: 7710 - RNA, 22 nt, Homo sapiens
ugcggggcuagggcuaacagca

SEQ ID NO: 7711 - RNA, 22 nt, Homo sapiens
uauugcacucgucccggccucc

SEQ ID NO: 7712 - RNA, 24 nt, Homo sapiens
aauccuuggaaccuaggugugagu

SEQ ID NO: 7713 - RNA, 23 nt, Homo sapiens
uacuccagagggcgucacucaug

SEQ ID NO: 7714 - RNA, 21 nt, Homo sapiens
gcgacccacucuugguuucca

SEQ ID NO: 7715 - RNA, 21 nt, Homo sapiens
gcgacccauacuugguuucag

SEQ ID NO: 7716 - RNA, 22 nt, Homo sapiens
auccgcgcucugacucucugcc

SEQ ID NO: 7717 - RNA, 23 nt, Homo sapiens
uauggcuuuuuauuccuauguga

SEQ ID NO: 7718 - RNA, 22 nt, Homo sapiens
uggagugugacaaugguguuug

SEQ ID NO: 7719 - RNA, 21 nt, Homo sapiens
acggugcuggauguggccuuu

SEQ ID NO: 7720 - RNA, 18 nt, Homo sapiens
cagggaggugaaugugau

SEQ ID NO: 7721 - RNA, 21 nt, Homo sapiens
cggcggggacggcgauugguc

SEQ ID NO: 7722 - RNA, 22 nt, Homo sapiens
uucccuuugucauccuaugccu

SEQ ID NO: 7723 - RNA, 22 nt, Homo sapiens
uucccuuugucauccuucgccu

SEQ ID NO: 7724 - RNA, 22 nt, Homo sapiens
aucacacaaaggcaacuuuugu

SEQ ID NO: 7725 - RNA, 19 nt, Homo sapiens
ugagcugcuguaccaaaau

SEQ ID NO: 7726 - RNA, 22 nt, Homo sapiens
ggggguccccggugcucggauc

SEQ ID NO: 7727 - RNA, 22 nt, Homo sapiens
aggcggggcgccgcgggaccgc

SEQ ID NO: 7728 - RNA, 22 nt, Homo sapiens
caaagugccucccuuuagagug

SEQ ID NO: 7729 - RNA, 22 nt, Homo sapiens
auccgcgcucugacucucugcc

SEQ ID NO: 7730 - RNA, 22 nt, Homo sapiens
augggugaauuuguagaaggau

SEQ ID NO: 7731 - RNA, 21 nt, Homo sapiens
acggugcuggauguggccuuu

SEQ ID NO: 7732 - RNA, 23 nt, Homo sapiens
acuugggcacugaaacaaugucc

SEQ ID NO: 7733 - RNA, 27 nt, Homo sapiens
cacuguaggugauggugagagugggca

SEQ ID NO: 7734 - RNA, 22 nt, Homo sapiens
ucuacagugcacgugucuccag

SEQ ID NO: 7735 - RNA, 19 nt, Homo sapiens
gaugaugcugcugaugcug

SEQ ID NO: 7736 - RNA, 23 nt, Homo sapiens
ucuggcuccgugucuucacuccc

SEQ ID NO: 7737 - RNA, 22 nt, Homo sapiens
uggagagaaaggcaguuccuga

SEQ ID NO: 7738 - RNA, 21 nt, Homo sapiens
auccuugcuaucugggugcua

SEQ ID NO: 7739 - RNA, 21 nt, Homo sapiens
aagccugcccggcuccucggg

SEQ ID NO: 7740 - RNA, 24 nt, Homo sapiens
uggggagcugaggcucugggggug

SEQ ID NO: 7741 - RNA, 22 nt, Homo sapiens
uucccuuugucauccuaugccu

SEQ ID NO: 7742 - RNA, 22 nt, Homo sapiens
uucccuuugucauccuucgccu

SEQ ID NO: 7743 - RNA, 23 nt, Homo sapiens
cgcauccccuagggcauuggugu

SEQ ID NO: 7744 - RNA, 23 nt, Homo sapiens
cgcauccccuagggcauuggugu

SEQ ID NO: 7745 - RNA, 22 nt, Homo sapiens
cgaaaacagcaauuaccuuugc

SEQ ID NO: 7746 - RNA, 27 nt, Homo sapiens
accuucuuguauaagcacugugcuaaa

SEQ ID NO: 7747 - RNA, 21 nt, Homo sapiens
aaggcagggcccccgcucccc

SEQ ID NO: 7748 - RNA, 22 nt, Homo sapiens
ucaccagcccuguguucccuag

SEQ ID NO: 7749 - RNA, 23 nt, Homo sapiens
agcugguguugugaaucaggccg

SEQ ID NO: 7750 - RNA, 21 nt, Homo sapiens
cagcagcacacugugguuugu

SEQ ID NO: 7751 - RNA, 22 nt, Homo sapiens
ccucccacacccaaggcuugca

SEQ ID NO: 7752 - RNA, 22 nt, Homo sapiens
uauggcacugguagaauucacu

SEQ ID NO: 7753 - RNA, 21 nt, Homo sapiens
agggcccccccucaauccugu

SEQ ID NO: 7754 - RNA, 21 nt, Homo sapiens
agggcccccccucaauccugu

SEQ ID NO: 7755 - RNA, 23 nt, Homo sapiens
ugaggggcagagagcgagacuuu

SEQ ID NO: 7756 - RNA, 21 nt, Homo sapiens
ccaccaccgugucugacacuu

SEQ ID NO: 7757 - RNA, 22 nt, Homo sapiens
uggagagaaaggcaguuccuga

SEQ ID NO: 7758 - RNA, 23 nt, Homo sapiens
ugaguaccgccaugucuguuggg

SEQ ID NO: 7759 - RNA, 20 nt, Homo sapiens
ccucugggcccuuccuccag

SEQ ID NO: 7760 - RNA, 22 nt, Homo sapiens
ucucugggccugugucuuaggc

SEQ ID NO: 7761 - RNA, 22 nt, Homo sapiens
cuccuauaugaugccuuucuuc

SEQ ID NO: 7762 - RNA, 23 nt, Homo sapiens
aggaccugcgggacaagauucuu

SEQ ID NO: 7763 - RNA, 22 nt, Homo sapiens
ugaaggucuacugugugccagg

SEQ ID NO: 7764 - RNA, 22 nt, Homo sapiens
aaacaaacauggugcacuucuu

SEQ ID NO: 7765 - RNA, 23 nt, Homo sapiens
agugccugagggaguaagagccc

SEQ ID NO: 7766 - RNA, 22 nt, Homo sapiens
aaccagcaccccaacuuuggac

SEQ ID NO: 7767 - RNA, 22 nt, Homo sapiens
aaaaguaauugcggauuuugcc

SEQ ID NO: 7768 - RNA, 22 nt, Homo sapiens
acccgucccguucguccccgga

SEQ ID NO: 7769 - RNA, 22 nt, Homo sapiens
cccugugcccggcccacuucug

SEQ ID NO: 7770 - RNA, 21 nt, Homo sapiens
auguaugugugcaugugcaug

SEQ ID NO: 7771 - RNA, 22 nt, Homo sapiens
uugugucaauaugcgaugaugu

SEQ ID NO: 7772 - RNA, 22 nt, Homo sapiens
ugugucacucgaugaccacugu

SEQ ID NO: 7773 - RNA, 21 nt, Homo sapiens
aauggcgccacuaggguugug

SEQ ID NO: 7774 - RNA, 20 nt, Homo sapiens
ggggagcuguggaagcagua

SEQ ID NO: 7775 - RNA, 22 nt, Homo sapiens
uauugcacucgucccggccucc

SEQ ID NO: 7776 - RNA, 17 nt, Homo sapiens
ucgccuccuccucuccc

SEQ ID NO: 7777 - RNA, 21 nt, Homo sapiens
ucgaggagcucacagucuagu

SEQ ID NO: 7778 - RNA, 21 nt, Homo sapiens
caagucacuagugguuccguu

SEQ ID NO: 7779 - RNA, 19 nt, Homo sapiens
aggcugcggaauucaggac

SEQ ID NO: 7780 - RNA, 20 nt, Homo sapiens
accaggaggcugaggccccu

SEQ ID NO: 7781 - RNA, 20 nt, Homo sapiens
guugugucaguuuaucaaac

SEQ ID NO: 7782 - RNA, 21 nt, Homo sapiens
guggcugcacucacuuccuuc

SEQ ID NO: 7783 - RNA, 21 nt, Homo sapiens
uggacugcccugaucuggaga

SEQ ID NO: 7784 - RNA, 19 nt, Homo sapiens
gggcgccugugaucccaac

SEQ ID NO: 7785 - RNA, 17 nt, Homo sapiens
ucgccuccuccucuccc

SEQ ID NO: 7786 - RNA, 21 nt, Homo sapiens
cccggagccaggaugcagcuc

SEQ ID NO: 7787 - RNA, 22 nt, Homo sapiens
uggagugugacaaugguguuug

SEQ ID NO: 7788 - RNA, 21 nt, Homo sapiens
cggcggggacggcgauugguc

SEQ ID NO: 7789 - RNA, 22 nt, Homo sapiens
acagcaggcacagacaggcagu

SEQ ID NO: 7790 - RNA, 22 nt, Homo sapiens
gccugcugggguggaaccuggu

SEQ ID NO: 7791 - RNA, 22 nt, Homo sapiens
augcugacauauuuacuagagg

SEQ ID NO: 7792 - RNA, 22 nt, Homo sapiens
aggcggggcgccgcgggaccgc

SEQ ID NO: 7793 - RNA, 22 nt, Homo sapiens
ugcggggcuagggcuaacagca

SEQ ID NO: 7794 - RNA, 22 nt, Homo sapiens
ugugcgcagggagaccucuccc

SEQ ID NO: 7795 - RNA, 21 nt, Homo sapiens
cggcggggacggcgauugguc

SEQ ID NO: 7796 - RNA, 21 nt, Homo sapiens
cggcggggacggcgauugguc

SEQ ID NO: 7797 - RNA, 22 nt, Homo sapiens
cgcaggggccgggugcucaccg

SEQ ID NO: 7798 - RNA, 22 nt, Homo sapiens
aggcggggcgccgcgggaccgc

SEQ ID NO: 7799 - RNA, 22 nt, Homo sapiens
aggcggggcgccgcgggaccgc

SEQ ID NO: 7800 - RNA, 22 nt, Homo sapiens
ugcggggcuagggcuaacagca

SEQ ID NO: 7801 - RNA, 22 nt, Homo sapiens
ugcggggcuagggcuaacagca

SEQ ID NO: 7802 - RNA, 21 nt, Homo sapiens
uggcagggaggcugggagggg

SEQ ID NO: 7803 - RNA, 18 nt, Homo sapiens
ugaggcaguagauugaau

SEQ ID NO: 7804 - RNA, 23 nt, Homo sapiens
ucccccaggugugauucugauuu

SEQ ID NO: 7805 - RNA, 24 nt, Homo sapiens
acugggggcuuucgggcucugcgu

SEQ ID NO: 7806 - RNA, 22 nt, Homo sapiens
acaggugagguucuugggagcc

SEQ ID NO: 7807 - RNA, 21 nt, Homo sapiens
caagucacuagugguuccguu

SEQ ID NO: 7808 - RNA, 20 nt, Homo sapiens
auguauaaauguauacacac

SEQ ID NO: 7809 - RNA, 22 nt, Homo sapiens
uggagugugacaaugguguuug

SEQ ID NO: 7810 - RNA, 24 nt, Homo sapiens
ccagacagaauucuaugcacuuuc

SEQ ID NO: 7811 - RNA, 19 nt, Homo sapiens
gugucugcuuccuguggga

SEQ ID NO: 7812 - RNA, 24 nt, Homo sapiens
aauccuuggaaccuaggugugagu

SEQ ID NO: 7813 - RNA, 19 nt, Homo sapiens
ugagcugcuguaccaaaau

SEQ ID NO: 7814 - RNA, 22 nt, Homo sapiens
cuccugagccauucugagccuc

SEQ ID NO: 7815 - RNA, 22 nt, Homo sapiens
uggagugugacaaugguguuug

SEQ ID NO: 7816 - RNA, 20 nt, Homo sapiens
cuuccucgucugucugcccc

SEQ ID NO: 7817 - RNA, 20 nt, Homo sapiens
ccccagggcgacgcggcggg

SEQ ID NO: 7818 - RNA, 21 nt, Homo sapiens
aggcaagaugcuggcauagcu

SEQ ID NO: 7819 - RNA, 20 nt, Homo sapiens
accaggaggcugaggccccu

SEQ ID NO: 7820 - RNA, 21 nt, Homo sapiens
uggaggagaaggaaggugaug

SEQ ID NO: 7821 - RNA, 23 nt, Homo sapiens
gcagcagagaauaggacuacguc

SEQ ID NO: 7822 - RNA, 22 nt, Homo sapiens
uauugcacucgucccggccucc

SEQ ID NO: 7823 - RNA, 21 nt, Homo sapiens
cggcggggacggcgauugguc

SEQ ID NO: 7824 - RNA, 22 nt, Homo sapiens
aggcggggcgccgcgggaccgc

SEQ ID NO: 7825 - RNA, 20 nt, Homo sapiens
ggggagcuguggaagcagua

SEQ ID NO: 7826 - RNA, 19 nt, Homo sapiens
aagcagcugccucugaggc

SEQ ID NO: 7827 - RNA, 23 nt, Homo sapiens
caguaacaaagauucauccuugu

SEQ ID NO: 7828 - RNA, 23 nt, Homo sapiens
ucccuguccuccaggagcucacg

SEQ ID NO: 7829 - RNA, 21 nt, Homo sapiens
cggcggggacggcgauugguc

SEQ ID NO: 7830 - RNA, 22 nt, Homo sapiens
aggcggggcgccgcgggaccgc

SEQ ID NO: 7831 - RNA, 22 nt, Homo sapiens
uggagugugacaaugguguuug

SEQ ID NO: 7832 - RNA, 21 nt, Homo sapiens
cggcggggacggcgauugguc

SEQ ID NO: 7833 - RNA, 22 nt, Homo sapiens
cauugcacuugucucggucuga

SEQ ID NO: 7834 - RNA, 23 nt, Homo sapiens
ugaggggcagagagcgagacuuu

SEQ ID NO: 7835 - RNA, 22 nt, Homo sapiens
ugauugguacgucuguggguag

SEQ ID NO: 7836 - RNA, 22 nt, Homo sapiens
aggcggggcgccgcgggaccgc

SEQ ID NO: 7837 - RNA, 23 nt, Homo sapiens
aggaagcccuggaggggcuggag

SEQ ID NO: 7838 - RNA, 22 nt, Homo sapiens
auccgcgcucugacucucugcc

SEQ ID NO: 7839 - RNA, 22 nt, Homo sapiens
ccucccacacccaaggcuugca

SEQ ID NO: 7840 - RNA, 23 nt, Homo sapiens
ucggggaucaucaugucacgaga

SEQ ID NO: 7841 - RNA, 19 nt, Homo sapiens
gugucugcuuccuguggga

SEQ ID NO: 7842 - RNA, 22 nt, Homo sapiens
uaugucugcugaccaucaccuu

SEQ ID NO: 7843 - RNA, 22 nt, Homo sapiens
cgcaggggccgggugcucaccg

SEQ ID NO: 7844 - RNA, 23 nt, Homo sapiens
ugagcgccucgacgacagagccg

SEQ ID NO: 7845 - RNA, 23 nt, Homo sapiens
ucccccaggugugauucugauuu

SEQ ID NO: 7846 - RNA, 23 nt, Homo sapiens
agcucggucugaggccccucagu

SEQ ID NO: 7847 - RNA, 22 nt, Homo sapiens
agaggcuggccgugaugaauuc

SEQ ID NO: 7848 - RNA, 24 nt, Homo sapiens
acugggggcuuucgggcucugcgu

SEQ ID NO: 7849 - RNA, 21 nt, Homo sapiens
uggaggagaaggaaggugaug

SEQ ID NO: 7850 - RNA, 22 nt, Homo sapiens
ugugcgcagggagaccucuccc

SEQ ID NO: 7851 - RNA, 21 nt, Homo sapiens
cccggagccaggaugcagcuc

SEQ ID NO: 7852 - RNA, 18 nt, Homo sapiens
ugaggcaguagauugaau

SEQ ID NO: 7853 - RNA, 22 nt, Homo sapiens
ugaaggucuacugugugccagg

SEQ ID NO: 7854 - RNA, 22 nt, Homo sapiens
agaggcuggccgugaugaauuc

SEQ ID NO: 7855 - RNA, 18 nt, Homo sapiens
ucagcuggcccucauuuc

SEQ ID NO: 7856 - RNA, 22 nt, Homo sapiens
cgaaaacagcaauuaccuuugc

SEQ ID NO: 7857 - RNA, 20 nt, Homo sapiens
ucguuugccuuuuucugcuu

SEQ ID NO: 7858 - RNA, 23 nt, Homo sapiens
uggugcggagagggcccacagug

SEQ ID NO: 7859 - RNA, 20 nt, Homo sapiens
ggggagcuguggaagcagua

SEQ ID NO: 7860 - RNA, 22 nt, Homo sapiens
uggagugugacaaugguguuug

SEQ ID NO: 7861 - RNA, 22 nt, Homo sapiens
ugcggggcuagggcuaacagca

SEQ ID NO: 7862 - RNA, 22 nt, Homo sapiens
ugaaggucuacugugugccagg

SEQ ID NO: 7863 - RNA, 18 nt, Homo sapiens
cgggcguggugguggggg

SEQ ID NO: 7864 - RNA, 23 nt, Homo sapiens
uggaguccaggaaucugcauuuu

SEQ ID NO: 7865 - RNA, 18 nt, Homo sapiens
cagggaggugaaugugau

SEQ ID NO: 7866 - RNA, 23 nt, Homo sapiens
ucuggcuccgugucuucacuccc

SEQ ID NO: 7867 - RNA, 24 nt, Homo sapiens
uuuggcaaugguagaacucacacu

SEQ ID NO: 7868 - RNA, 20 nt, Homo sapiens
ccccagggcgacgcggcggg

SEQ ID NO: 7869 - RNA, 22 nt, Homo sapiens
uucccuuugucauccuaugccu

SEQ ID NO: 7870 - RNA, 22 nt, Homo sapiens
uucccuuugucauccuucgccu

SEQ ID NO: 7871 - RNA, 22 nt, Homo sapiens
aguggggaacccuuccaugagg

SEQ ID NO: 7872 - RNA, 23 nt, Homo sapiens
aucgcugcgguugcgagcgcugu

SEQ ID NO: 7873 - RNA, 17 nt, Homo sapiens
ucucgcuggggccucca

SEQ ID NO: 7874 - RNA, 21 nt, Homo sapiens
uggaggagaaggaaggugaug

SEQ ID NO: 7875 - RNA, 22 nt, Homo sapiens
aggcagcgggguguaguggaua

SEQ ID NO: 7876 - RNA, 22 nt, Homo sapiens
acuccagccccacagccucagc

SEQ ID NO: 7877 - RNA, 21 nt, Homo sapiens
cggcggggacggcgauugguc

SEQ ID NO: 7878 - RNA, 22 nt, Homo sapiens
aggcggggcgccgcgggaccgc

SEQ ID NO: 7879 - RNA, 22 nt, Homo sapiens
ugcggggcuagggcuaacagca

SEQ ID NO: 7880 - RNA, 21 nt, Homo sapiens
uggcagggaggcugggagggg

SEQ ID NO: 7881 - RNA, 22 nt, Homo sapiens
aucacacaaaggcaacuuuugu

SEQ ID NO: 7882 - RNA, 21 nt, Homo sapiens
ccaccaccgugucugacacuu

SEQ ID NO: 7883 - RNA, 24 nt, Homo sapiens
agccuggaagcuggagccugcagu

SEQ ID NO: 7884 - RNA, 23 nt, Homo sapiens
guguuaauuaaaccucuauuuac

SEQ ID NO: 7885 - RNA, 18 nt, Homo sapiens
aucccaccucugccacca

SEQ ID NO: 7886 - RNA, 23 nt, Homo sapiens
ccucagggcuguagaacagggcu

SEQ ID NO: 7887 - RNA, 21 nt, Homo sapiens
ccaguccugugccugccgccu

SEQ ID NO: 7888 - RNA, 23 nt, Homo sapiens
uaaagugcuuauagugcagguag

SEQ ID NO: 7889 - RNA, 22 nt, Homo sapiens
agaucagaaggugauuguggcu

SEQ ID NO: 7890 - RNA, 21 nt, Homo sapiens
gugcauuguaguugcauugca

SEQ ID NO: 7891 - RNA, 20 nt, Homo sapiens
gugcauugcuguugcauugc

SEQ ID NO: 7892 - RNA, 20 nt, Homo sapiens
ugagcccuguccucccgcag

SEQ ID NO: 7893 - RNA, 17 nt, Homo sapiens
gugggggagaggcuguc

SEQ ID NO: 7894 - RNA, 21 nt, Homo sapiens
uccugcgcgucccagaugccc

SEQ ID NO: 7895 - RNA, 21 nt, Homo sapiens
cggcggggacggcgauugguc

SEQ ID NO: 7896 - RNA, 21 nt, Homo sapiens
aggggugcuaucugugauuga

SEQ ID NO: 7897 - RNA, 19 nt, Homo sapiens
aggcugcggaauucaggac

SEQ ID NO: 7898 - RNA, 22 nt, Homo sapiens
aggcggggcgccgcgggaccgc

SEQ ID NO: 7899 - RNA, 22 nt, Homo sapiens
ugcggggcuagggcuaacagca

SEQ ID NO: 7900 - RNA, 22 nt, Homo sapiens
acaggugagguucuugggagcc

SEQ ID NO: 7901 - RNA, 22 nt, Homo sapiens
ugugagguuggcauuguugucu

SEQ ID NO: 7902 - RNA, 21 nt, Homo sapiens
gugcauuguaguugcauugca

SEQ ID NO: 7903 - RNA, 20 nt, Homo sapiens
gugcauugcuguugcauugc

SEQ ID NO: 7904 - RNA, 22 nt, Homo sapiens
ucucccaacccuuguaccagug

SEQ ID NO: 7905 - RNA, 23 nt, Homo sapiens
aucccuugcaggggcuguugggu

SEQ ID NO: 7906 - RNA, 21 nt, Homo sapiens
cucccacaugcaggguuugca

SEQ ID NO: 7907 - RNA, 23 nt, Homo sapiens
cacucagccuugagggcacuuuc

SEQ ID NO: 7908 - RNA, 21 nt, Homo sapiens
gccccugggccuauccuagaa

SEQ ID NO: 7909 - RNA, 22 nt, Homo sapiens
uaacacugucugguaaagaugg

SEQ ID NO: 7910 - RNA, 22 nt, Homo sapiens
uaacacugucugguaacgaugu

SEQ ID NO: 7911 - RNA, 21 nt, Homo sapiens
cggcggggacggcgauugguc

SEQ ID NO: 7912 - RNA, 22 nt, Homo sapiens
aggcggggcgccgcgggaccgc

SEQ ID NO: 7913 - RNA, 22 nt, Homo sapiens
ugcggggcuagggcuaacagca

SEQ ID NO: 7914 - RNA, 22 nt, Homo sapiens
uuggggaaacggccgcugagug

SEQ ID NO: 7915 - RNA, 21 nt, Homo sapiens
agaccuggcccagaccucagc

SEQ ID NO: 7916 - RNA, 22 nt, Homo sapiens
uucuggaauucugugugaggga

SEQ ID NO: 7917 - RNA, 22 nt, Homo sapiens
aagcccuuaccccaaaaagcau

SEQ ID NO: 7918 - RNA, 22 nt, Homo sapiens
ugugacugguugaccagagggg

SEQ ID NO: 7919 - RNA, 22 nt, Homo sapiens
uggagugugacaaugguguuug

SEQ ID NO: 7920 - RNA, 22 nt, Homo sapiens
uagcuuaucagacugauguuga

SEQ ID NO: 7921 - RNA, 22 nt, Homo sapiens
caaaguuuaagauccuugaagu

SEQ ID NO: 7922 - RNA, 22 nt, Homo sapiens
uuugguccccuucaaccagcug

SEQ ID NO: 7923 - RNA, 20 nt, Homo sapiens
accaggaggcugaggccccu

SEQ ID NO: 7924 - RNA, 17 nt, Homo sapiens
gugggggagaggcuguc

SEQ ID NO: 7925 - RNA, 23 nt, Homo sapiens
ucuggcuccgugucuucacuccc

SEQ ID NO: 7926 - RNA, 21 nt, Homo sapiens
aagcauucuuucauugguugg

SEQ ID NO: 7927 - RNA, 22 nt, Homo sapiens
uggacggagaacugauaagggu

SEQ ID NO: 7928 - RNA, 22 nt, Homo sapiens
uggagagaaaggcaguuccuga

SEQ ID NO: 7929 - RNA, 23 nt, Homo sapiens
agcuacauugucugcuggguuuc

SEQ ID NO: 7930 - RNA, 21 nt, Homo sapiens
agcuacaucuggcuacugggu

SEQ ID NO: 7931 - RNA, 22 nt, Homo sapiens
gaggguuggguggaggcucucc

SEQ ID NO: 7932 - RNA, 23 nt, Homo sapiens
ugaggggcagagagcgagacuuu

SEQ ID NO: 7933 - RNA, 23 nt, Homo sapiens
ugaggggcagagagcgagacuuu

SEQ ID NO: 7934 - RNA, 19 nt, Homo sapiens
aggcugcggaauucaggac

SEQ ID NO: 7935 - RNA, 22 nt, Homo sapiens
uuauaaagcaaugagacugauu

SEQ ID NO: 7936 - RNA, 23 nt, Homo sapiens
ucuggcuccgugucuucacuccc

SEQ ID NO: 7937 - RNA, 21 nt, Homo sapiens
ugagaugaagcacuguagcuc

SEQ ID NO: 7938 - RNA, 20 nt, Homo sapiens
ccucugggcccuuccuccag

SEQ ID NO: 7939 - RNA, 22 nt, Homo sapiens
ucucugggccugugucuuaggc

SEQ ID NO: 7940 - RNA, 22 nt, Homo sapiens
caaagaauucuccuuuugggcu

SEQ ID NO: 7941 - RNA, 22 nt, Homo sapiens
aggcagcgggguguaguggaua

SEQ ID NO: 7942 - RNA, 22 nt, Homo sapiens
gccugcugggguggaaccuggu

SEQ ID NO: 7943 - RNA, 22 nt, Homo sapiens
ugugcgcagggagaccucuccc

SEQ ID NO: 7944 - RNA, 22 nt, Homo sapiens
aacuggccuacaaagucccagu

SEQ ID NO: 7945 - RNA, 22 nt, Homo sapiens
aacuggcccucaaagucccgcu

SEQ ID NO: 7946 - RNA, 20 nt, Homo sapiens
ucugcaggguuugcuuugag

SEQ ID NO: 7947 - RNA, 21 nt, Homo sapiens
cugaccuaugaauugacagcc

SEQ ID NO: 7948 - RNA, 22 nt, Homo sapiens
uguaaacauccuacacucagcu

SEQ ID NO: 7949 - RNA, 23 nt, Homo sapiens
gcgaggaccccucggggucugac

SEQ ID NO: 7950 - RNA, 21 nt, Homo sapiens
uggaggagaaggaaggugaug

SEQ ID NO: 7951 - RNA, 21 nt, Homo sapiens
agaccuggcccagaccucagc

SEQ ID NO: 7952 - RNA, 22 nt, Homo sapiens
caaagaauucuccuuuugggcu

SEQ ID NO: 7953 - RNA, 22 nt, Homo sapiens
cgcaggggccgggugcucaccg

SEQ ID NO: 7954 - RNA, 22 nt, Homo sapiens
ucaccagcccuguguucccuag

SEQ ID NO: 7955 - RNA, 23 nt, Homo sapiens
agcugguguugugaaucaggccg

SEQ ID NO: 7956 - RNA, 22 nt, Homo sapiens
uggagagaaaggcaguuccuga

SEQ ID NO: 7957 - RNA, 21 nt, Homo sapiens
cggcggggacggcgauugguc

SEQ ID NO: 7958 - RNA, 22 nt, Homo sapiens
cauugcacuugucucggucuga

SEQ ID NO: 7959 - RNA, 22 nt, Homo sapiens
aggcggggcgccgcgggaccgc

SEQ ID NO: 7960 - RNA, 23 nt, Homo sapiens
uggugcggagagggcccacagug

SEQ ID NO: 7961 - RNA, 23 nt, Homo sapiens
ugguuguaguccgugcgagaaua

SEQ ID NO: 7962 - RNA, 21 nt, Homo sapiens
uuggccacaauggguuagaac

SEQ ID NO: 7963 - RNA, 22 nt, Homo sapiens
aauugcacgguauccaucugua

SEQ ID NO: 7964 - RNA, 24 nt, Homo sapiens
uuuggcaaugguagaacucacacu

SEQ ID NO: 7965 - RNA, 23 nt, Homo sapiens
uagugcaauauugcuuauagggu

SEQ ID NO: 7966 - RNA, 21 nt, Homo sapiens
gcaggaacuugugagucuccu

SEQ ID NO: 7967 - RNA, 18 nt, Homo sapiens
uugagaaggaggcugcug

SEQ ID NO: 7968 - RNA, 22 nt, Homo sapiens
cuggacugagccgugcuacugg

SEQ ID NO: 7969 - RNA, 22 nt, Homo sapiens
uagcagcacauaaugguuugug

SEQ ID NO: 7970 - RNA, 22 nt, Homo sapiens
uagcagcacaucaugguuuaca

SEQ ID NO: 7971 - RNA, 22 nt, Homo sapiens
uagcagcacguaaauauuggcg

SEQ ID NO: 7972 - RNA, 22 nt, Homo sapiens
uggagagaaaggcaguuccuga

SEQ ID NO: 7973 - RNA, 23 nt, Homo sapiens
uaaggugcaucuagugcagauag

SEQ ID NO: 7974 - RNA, 21 nt, Homo sapiens
uagcagcacagaaauauuggc

SEQ ID NO: 7975 - RNA, 21 nt, Homo sapiens
uugugcuugaucuaaccaugu

SEQ ID NO: 7976 - RNA, 21 nt, Homo sapiens
acuggacuuggagucagaagg

SEQ ID NO: 7977 - RNA, 22 nt, Homo sapiens
acuggacuuagggucagaaggc

SEQ ID NO: 7978 - RNA, 22 nt, Homo sapiens
cagcagcaauucauguuuugaa

SEQ ID NO: 7979 - RNA, 21 nt, Homo sapiens
gcaguccaugggcauauacac

SEQ ID NO: 7980 - RNA, 21 nt, Homo sapiens
cagcagcacacugugguuugu

SEQ ID NO: 7981 - RNA, 21 nt, Homo sapiens
auccuugcuaucugggugcua

SEQ ID NO: 7982 - RNA, 22 nt, Homo sapiens
ucagcaaacauuuauugugugc

SEQ ID NO: 7983 - RNA, 22 nt, Homo sapiens
gaugagcucauuguaauaugag

SEQ ID NO: 7984 - RNA, 19 nt, Homo sapiens
ugagcugcuguaccaaaau

SEQ ID NO: 7985 - RNA, 23 nt, Homo sapiens
ugugcuugcucgucccgcccgca

SEQ ID NO: 7986 - RNA, 19 nt, Homo sapiens
aagcagcugccucugaggc

SEQ ID NO: 7987 - RNA, 20 nt, Homo sapiens
ggggagcuguggaagcagua

SEQ ID NO: 7988 - RNA, 22 nt, Homo sapiens
ugcccuuaaaggugaacccagu

SEQ ID NO: 7989 - RNA, 24 nt, Homo sapiens
uggggagcugaggcucugggggug

SEQ ID NO: 7990 - RNA, 21 nt, Homo sapiens
gugcauuguaguugcauugca

SEQ ID NO: 7991 - RNA, 20 nt, Homo sapiens
gugcauugcuguugcauugc

SEQ ID NO: 7992 - RNA, 21 nt, Homo sapiens
guggcugcacucacuuccuuc

SEQ ID NO: 7993 - RNA, 23 nt, Homo sapiens
ugaggggcagagagcgagacuuu

SEQ ID NO: 7994 - RNA, 22 nt, Homo sapiens
ugcggggcuagggcuaacagca

SEQ ID NO: 7995 - RNA, 22 nt, Homo sapiens
uauugcacucgucccggccucc

SEQ ID NO: 7996 - RNA, 21 nt, Homo sapiens
uggcagggaggcugggagggg

SEQ ID NO: 7997 - RNA, 22 nt, Homo sapiens
ugagccccugugccgcccccag

SEQ ID NO: 7998 - RNA, 24 nt, Homo sapiens
uggcccugacugaagaccagcagu

SEQ ID NO: 7999 - RNA, 25 nt, Homo sapiens
aggggugguguugggacagcuccgu

SEQ ID NO: 8000 - RNA, 23 nt, Homo sapiens
ugucacucggcucggcccacuac

SEQ ID NO: 8001 - RNA, 23 nt, Homo sapiens
uggugcggagagggcccacagug

SEQ ID NO: 8002 - RNA, 22 nt, Homo sapiens
ugcggggcuagggcuaacagca

SEQ ID NO: 8003 - RNA, 22 nt, Homo sapiens
acuccagccccacagccucagc

SEQ ID NO: 8004 - RNA, 20 nt, Homo sapiens
ggggagcuguggaagcagua

SEQ ID NO: 8005 - RNA, 22 nt, Homo sapiens
auccgcgcucugacucucugcc

SEQ ID NO: 8006 - RNA, 24 nt, Homo sapiens
uggggagcugaggcucugggggug

SEQ ID NO: 8007 - RNA, 20 nt, Homo sapiens
uacaguauagaugauguacu

SEQ ID NO: 8008 - RNA, 23 nt, Homo sapiens
cggcccgggcugcugcuguuccu

SEQ ID NO: 8009 - RNA, 19 nt, Homo sapiens
aggcugcggaauucaggac

SEQ ID NO: 8010 - RNA, 23 nt, Homo sapiens
cuggagauauggaagagcugugu

SEQ ID NO: 8011 - RNA, 17 nt, Homo sapiens
ucccaccgcugccaccc

SEQ ID NO: 8012 - RNA, 17 nt, Homo sapiens
ucgccuccuccucuccc

SEQ ID NO: 8013 - RNA, 22 nt, Homo sapiens
ugauauguuugauauauuaggu

SEQ ID NO: 8014 - RNA, 23 nt, Homo sapiens
agcuacauugucugcuggguuuc

SEQ ID NO: 8015 - RNA, 23 nt, Homo sapiens
gcaaagcacacggccugcagaga

SEQ ID NO: 8016 - RNA, 20 nt, Homo sapiens
gugcauugcuguugcauugc

SEQ ID NO: 8017 - RNA, 22 nt, Homo sapiens
uuaucagaaucuccagggguac

SEQ ID NO: 8018 - RNA, 22 nt, Homo sapiens
gagugccuucuuuuggagcguu

SEQ ID NO: 8019 - RNA, 22 nt, Homo sapiens
aagugccuccuuuuagaguguu

SEQ ID NO: 8020 - RNA, 22 nt, Homo sapiens
uggugggcacagaaucuggacu

SEQ ID NO: 8021 - RNA, 20 nt, Homo sapiens
auggagauagauauagaaau

SEQ ID NO: 8022 - RNA, 22 nt, Homo sapiens
uggugggccgcagaacaugugc

SEQ ID NO: 8023 - RNA, 22 nt, Homo sapiens
ugagaccucuggguucugagcu

SEQ ID NO: 8024 - RNA, 23 nt, Homo sapiens
uacccuguagaaccgaauuugug

SEQ ID NO: 8025 - RNA, 25 nt, Homo sapiens
aggggugguguugggacagcuccgu

SEQ ID NO: 8026 - RNA, 22 nt, Homo sapiens
aggcaguguauuguuagcuggc

SEQ ID NO: 8027 - RNA, 21 nt, Homo sapiens
uaccacaggguagaaccacgg

SEQ ID NO: 8028 - RNA, 22 nt, Homo sapiens
cuugguucagggagggucccca

SEQ ID NO: 8029 - RNA, 22 nt, Homo sapiens
uggaauguaaagaaguauguau

SEQ ID NO: 8030 - RNA, 21 nt, Homo sapiens
uccuucugcuccgucccccag

SEQ ID NO: 8031 - RNA, 21 nt, Homo sapiens
cggcggggacggcgauugguc

SEQ ID NO: 8032 - RNA, 22 nt, Homo sapiens
uggaauguaaggaagugugugg

SEQ ID NO: 8033 - RNA, 22 nt, Homo sapiens
uaugugggaugguaaaccgcuu

SEQ ID NO: 8034 - RNA, 22 nt, Homo sapiens
aauugcacgguauccaucugua

SEQ ID NO: 8035 - RNA, 24 nt, Homo sapiens
uucuccaaaagaaagcacuuucug

SEQ ID NO: 8036 - RNA, 22 nt, Homo sapiens
aagugccuccuuuuagaguguu

SEQ ID NO: 8037 - RNA, 21 nt, Homo sapiens
ugagcuaaaugugugcuggga

SEQ ID NO: 8038 - RNA, 20 nt, Homo sapiens
aggaauguuccuucuuugcc

SEQ ID NO: 8039 - RNA, 22 nt, Homo sapiens
aggcggggcgccgcgggaccgc

SEQ ID NO: 8040 - RNA, 23 nt, Homo sapiens
cgggucggaguuagcucaagcgg

SEQ ID NO: 8041 - RNA, 23 nt, Homo sapiens
uacugcaucaggaacugauugga

SEQ ID NO: 8042 - RNA, 23 nt, Homo sapiens
guccaguuuucccaggaaucccu

SEQ ID NO: 8043 - RNA, 22 nt, Homo sapiens
uccgagccugggucucccucuu

SEQ ID NO: 8044 - RNA, 22 nt, Homo sapiens
uuugguccccuucaaccagcug

SEQ ID NO: 8045 - RNA, 22 nt, Homo sapiens
uuugguccccuucaaccagcua

SEQ ID NO: 8046 - RNA, 22 nt, Homo sapiens
ugauugguacgucuguggguag

SEQ ID NO: 8047 - RNA, 22 nt, Homo sapiens
ugagccccugugccgcccccag

SEQ ID NO: 8048 - RNA, 22 nt, Homo sapiens
cucggcgcggggcgcgggcucc

SEQ ID NO: 8049 - RNA, 22 nt, Homo sapiens
uagcuuaucagacugauguuga

SEQ ID NO: 8050 - RNA, 22 nt, Homo sapiens
cauugcacuugucucggucuga

SEQ ID NO: 8051 - RNA, 20 nt, Homo sapiens
aggguguuucucucaucucu

SEQ ID NO: 8052 - RNA, 25 nt, Homo sapiens
ggcggagggaaguagguccguuggu

SEQ ID NO: 8053 - RNA, 22 nt, Homo sapiens
ugcggggcuagggcuaacagca

SEQ ID NO: 8054 - RNA, 20 nt, Homo sapiens
ccucugggcccuuccuccag

SEQ ID NO: 8055 - RNA, 22 nt, Homo sapiens
ucucugggccugugucuuaggc

SEQ ID NO: 8056 - RNA, 20 nt, Homo sapiens
cggcucugggucugugggga

SEQ ID NO: 8057 - RNA, 17 nt, Homo sapiens
ucccaccgcugccaccc

SEQ ID NO: 8058 - RNA, 21 nt, Homo sapiens
aaagcgcuucccuucagagug

SEQ ID NO: 8059 - RNA, 22 nt, Homo sapiens
uagcagcacauaaugguuugug

SEQ ID NO: 8060 - RNA, 22 nt, Homo sapiens
uagcagcacaucaugguuuaca

SEQ ID NO: 8061 - RNA, 22 nt, Homo sapiens
uagcagcacguaaauauuggcg

SEQ ID NO: 8062 - RNA, 21 nt, Homo sapiens
uagcagcacagaaauauuggc

SEQ ID NO: 8063 - RNA, 22 nt, Homo sapiens
cagcagcaauucauguuuugaa

SEQ ID NO: 8064 - RNA, 21 nt, Homo sapiens
cagcagcacacugugguuugu

SEQ ID NO: 8065 - RNA, 22 nt, Homo sapiens
ugugucacucgaugaccacugu

SEQ ID NO: 8066 - RNA, 22 nt, Homo sapiens
uggagagaaaggcaguuccuga

SEQ ID NO: 8067 - RNA, 22 nt, Homo sapiens
cauugcacuugucucggucuga

SEQ ID NO: 8068 - RNA, 20 nt, Homo sapiens
gugcauugcuguugcauugc

SEQ ID NO: 8069 - RNA, 22 nt, Homo sapiens
gagugccuucuuuuggagcguu

SEQ ID NO: 8070 - RNA, 22 nt, Homo sapiens
aagugccuccuuuuagaguguu

SEQ ID NO: 8071 - RNA, 22 nt, Homo sapiens
gugacaucacauauacggcagc

SEQ ID NO: 8072 - RNA, 22 nt, Homo sapiens
uggagugugacaaugguguuug

SEQ ID NO: 8073 - RNA, 22 nt, Homo sapiens
cuggcccucucugcccuuccgu

SEQ ID NO: 8074 - RNA, 23 nt, Homo sapiens
ccugcagcgacuugauggcuucc

SEQ ID NO: 8075 - RNA, 22 nt, Homo sapiens
aagacgggaggaaagaagggag

SEQ ID NO: 8076 - RNA, 21 nt, Homo sapiens
guggcugcacucacuuccuuc

SEQ ID NO: 8077 - RNA, 21 nt, Homo sapiens
ggcuagcaacagcgcuuaccu

SEQ ID NO: 8078 - RNA, 24 nt, Homo sapiens
uggggagcugaggcucugggggug

SEQ ID NO: 8079 - RNA, 22 nt, Homo sapiens
uggagagaaaggcaguuccuga

SEQ ID NO: 8080 - RNA, 22 nt, Homo sapiens
acuccagccccacagccucagc

SEQ ID NO: 8081 - RNA, 20 nt, Homo sapiens
cgugccacccuuuuccccag

SEQ ID NO: 8082 - RNA, 22 nt, Homo sapiens
aagauguggaaaaauuggaauc

SEQ ID NO: 8083 - RNA, 21 nt, Homo sapiens
acuggacuuggagucagaagg

SEQ ID NO: 8084 - RNA, 21 nt, Homo sapiens
cacaagguauugguauuaccu

SEQ ID NO: 8085 - RNA, 22 nt, Homo sapiens
ugagguaguaguuuguacaguu

SEQ ID NO: 8086 - RNA, 22 nt, Homo sapiens
agaaggaaauugaauucauuua

SEQ ID NO: 8087 - RNA, 22 nt, Homo sapiens
ccucuuccccuugucucuccag

SEQ ID NO: 8088 - RNA, 20 nt, Homo sapiens
guguguggaaaugcuucugc

SEQ ID NO: 8089 - RNA, 22 nt, Homo sapiens
uggacggagaacugauaagggu

SEQ ID NO: 8090 - RNA, 20 nt, Homo sapiens
ccucugggcccuuccuccag

SEQ ID NO: 8091 - RNA, 22 nt, Homo sapiens
ucucugggccugugucuuaggc

SEQ ID NO: 8092 - RNA, 21 nt, Homo sapiens
uggaggagaaggaaggugaug

SEQ ID NO: 8093 - RNA, 22 nt, Homo sapiens
uggagugugacaaugguguuug

SEQ ID NO: 8094 - RNA, 22 nt, Homo sapiens
aaggagcucacagucuauugag

SEQ ID NO: 8095 - RNA, 23 nt, Homo sapiens
aaggagcuuacaaucuagcuggg

SEQ ID NO: 8096 - RNA, 22 nt, Homo sapiens
aggcaguguauuguuagcuggc

SEQ ID NO: 8097 - RNA, 23 nt, Homo sapiens
uacuccagagggcgucacucaug

SEQ ID NO: 8098 - RNA, 23 nt, Homo sapiens
uaauccuugcuaccugggugaga

SEQ ID NO: 8099 - RNA, 19 nt, Homo sapiens
aguguggcuuucuuagagc

SEQ ID NO: 8100 - RNA, 22 nt, Homo sapiens
uggagugugacaaugguguuug

SEQ ID NO: 8101 - RNA, 22 nt, Homo sapiens
uucuggaauucugugugaggga

SEQ ID NO: 8102 - RNA, 21 nt, Homo sapiens
gcccuccgcccgugcaccccg

SEQ ID NO: 8103 - RNA, 22 nt, Homo sapiens
uggacggagaacugauaagggu

SEQ ID NO: 8104 - RNA, 21 nt, Homo sapiens
cggcggggacggcgauugguc

SEQ ID NO: 8105 - RNA, 21 nt, Homo sapiens
cggcggggacggcgauugguc

SEQ ID NO: 8106 - RNA, 22 nt, Homo sapiens
ugggucuuugcgggcgagauga

SEQ ID NO: 8107 - RNA, 23 nt, Homo sapiens
ugaggggcagagagcgagacuuu

SEQ ID NO: 8108 - RNA, 23 nt, Homo sapiens
agguuguccguggugaguucgca

SEQ ID NO: 8109 - RNA, 22 nt, Homo sapiens
aggcggggcgccgcgggaccgc

SEQ ID NO: 8110 - RNA, 22 nt, Homo sapiens
aggcggggcgccgcgggaccgc

SEQ ID NO: 8111 - RNA, 22 nt, Homo sapiens
ugcggggcuagggcuaacagca

SEQ ID NO: 8112 - RNA, 22 nt, Homo sapiens
ugcggggcuagggcuaacagca

SEQ ID NO: 8113 - RNA, 22 nt, Homo sapiens
uuugugaccugguccacuaacc

SEQ ID NO: 8114 - RNA, 23 nt, Homo sapiens
ugaggggcagagagcgagacuuu

SEQ ID NO: 8115 - RNA, 22 nt, Homo sapiens
ucaggcucaguccccucccgau

SEQ ID NO: 8116 - RNA, 22 nt, Homo sapiens
acuccagccccacagccucagc

SEQ ID NO: 8117 - RNA, 22 nt, Homo sapiens
ugagguaguagguuguauaguu

SEQ ID NO: 8118 - RNA, 22 nt, Homo sapiens
ugagguaguagguugugugguu

SEQ ID NO: 8119 - RNA, 22 nt, Homo sapiens
ugagguaguagguuguaugguu

SEQ ID NO: 8120 - RNA, 22 nt, Homo sapiens
agagguaguagguugcauaguu

SEQ ID NO: 8121 - RNA, 22 nt, Homo sapiens
ugagguaggagguuguauaguu

SEQ ID NO: 8122 - RNA, 22 nt, Homo sapiens
ugagguaguagauuguauaguu

SEQ ID NO: 8123 - RNA, 22 nt, Homo sapiens
ugagguaguaguuuguacaguu

SEQ ID NO: 8124 - RNA, 22 nt, Homo sapiens
ugagguaguaguuugugcuguu

SEQ ID NO: 8125 - RNA, 22 nt, Homo sapiens
ugagguaguaaguuguauuguu

SEQ ID NO: 8126 - RNA, 22 nt, Homo sapiens
uucccuuugucauccuaugccu

SEQ ID NO: 8127 - RNA, 22 nt, Homo sapiens
uucccuuugucauccuucgccu

SEQ ID NO: 8128 - RNA, 22 nt, Homo sapiens
aaagugcauccuuuuagagugu

SEQ ID NO: 8129 - RNA, 22 nt, Homo sapiens
aaagugcauccuuuuagagguu

SEQ ID NO: 8130 - RNA, 22 nt, Homo sapiens
aaagugcaucuuuuuagaggau

SEQ ID NO: 8131 - RNA, 22 nt, Homo sapiens
ucaaaacugaggggcauuuucu

SEQ ID NO: 8132 - RNA, 22 nt, Homo sapiens
ccaaaacugcaguuacuuuugc

SEQ ID NO: 8133 - RNA, 21 nt, Homo sapiens
cggcggggacggcgauugguc

SEQ ID NO: 8134 - RNA, 22 nt, Homo sapiens
aggcggggcgccgcgggaccgc

SEQ ID NO: 8135 - RNA, 23 nt, Homo sapiens
agugccugagggaguaagagccc

SEQ ID NO: 8136 - RNA, 22 nt, Homo sapiens
ucggccugaccacccaccccac

SEQ ID NO: 8137 - RNA, 17 nt, Homo sapiens
ucgccuccuccucuccc

SEQ ID NO: 8138 - RNA, 22 nt, Homo sapiens
acucggcguggcgucggucgug

SEQ ID NO: 8139 - RNA, 22 nt, Homo sapiens
cucggcgcggggcgcgggcucc

SEQ ID NO: 8140 - RNA, 23 nt, Homo sapiens
ucuggcuccgugucuucacuccc

SEQ ID NO: 8141 - RNA, 22 nt, Homo sapiens
uggcucaguucagcaggaacag

SEQ ID NO: 8142 - RNA, 22 nt, Homo sapiens
cauugcacuugucucggucuga

SEQ ID NO: 8143 - RNA, 22 nt, Homo sapiens
aauugcacgguauccaucugua

SEQ ID NO: 8144 - RNA, 22 nt, Homo sapiens
cgucaacacuugcugguuuccu

SEQ ID NO: 8145 - RNA, 25 nt, Homo sapiens
aggggugguguugggacagcuccgu

SEQ ID NO: 8146 - RNA, 22 nt, Homo sapiens
ugcggggcuagggcuaacagca

SEQ ID NO: 8147 - RNA, 23 nt, Homo sapiens
uaaaucccauggugccuucuccu

SEQ ID NO: 8148 - RNA, 21 nt, Homo sapiens
ugagcuaaaugugugcuggga

SEQ ID NO: 8149 - RNA, 21 nt, Homo sapiens
gcccuccgcccgugcaccccg

SEQ ID NO: 8150 - RNA, 22 nt, Homo sapiens
uuauaaagcaaugagacugauu

SEQ ID NO: 8151 - RNA, 25 nt, Homo sapiens
ggcggagggaaguagguccguuggu

SEQ ID NO: 8152 - RNA, 23 nt, Homo sapiens
uaaggugcaucuagugcagauag

SEQ ID NO: 8153 - RNA, 23 nt, Homo sapiens
cggcccgggcugcugcuguuccu

SEQ ID NO: 8154 - RNA, 24 nt, Homo sapiens
ugccugggucucuggccugcgcgu

SEQ ID NO: 8155 - RNA, 22 nt, Homo sapiens
ugcggggcuagggcuaacagca

SEQ ID NO: 8156 - RNA, 22 nt, Homo sapiens
uggagagaaaggcaguuccuga

SEQ ID NO: 8157 - RNA, 20 nt, Homo sapiens
ggggagcuguggaagcagua

SEQ ID NO: 8158 - RNA, 22 nt, Homo sapiens
ucaccagcccuguguucccuag

SEQ ID NO: 8159 - RNA, 23 nt, Homo sapiens
agcugguguugugaaucaggccg

SEQ ID NO: 8160 - RNA, 24 nt, Homo sapiens
ucccugagacccuuuaaccuguga

SEQ ID NO: 8161 - RNA, 22 nt, Homo sapiens
ucccugagacccuaacuuguga

SEQ ID NO: 8162 - RNA, 23 nt, Homo sapiens
ccucagggcuguagaacagggcu

SEQ ID NO: 8163 - RNA, 21 nt, Homo sapiens
uaccacaggguagaaccacgg

SEQ ID NO: 8164 - RNA, 21 nt, Homo sapiens
cgcgggugcuuacugacccuu

SEQ ID NO: 8165 - RNA, 21 nt, Homo sapiens
caucccuugcaugguggaggg

SEQ ID NO: 8166 - RNA, 18 nt, Homo sapiens
aucccaccucugccacca

SEQ ID NO: 8167 - RNA, 23 nt, Homo sapiens
uguaguguuuccuacuuuaugga

SEQ ID NO: 8168 - RNA, 22 nt, Homo sapiens
aucuggagguaagaagcacuuu

SEQ ID NO: 8169 - RNA, 23 nt, Homo sapiens
caaagcgcuucucuuuagagugu

SEQ ID NO: 8170 - RNA, 21 nt, Homo sapiens
cuccagagggaaguacuuucu

SEQ ID NO: 8171 - RNA, 21 nt, Homo sapiens
cuccagagggaugcacuuucu

SEQ ID NO: 8172 - RNA, 22 nt, Homo sapiens
aagauguggaaaaauuggaauc

SEQ ID NO: 8173 - RNA, 23 nt, Homo sapiens
aggaagcccuggaggggcuggag

SEQ ID NO: 8174 - RNA, 22 nt, Homo sapiens
aagcugccaguugaagaacugu

SEQ ID NO: 8175 - RNA, 23 nt, Homo sapiens
cacccggcugugugcacaugugc

SEQ ID NO: 8176 - RNA, 24 nt, Homo sapiens
uggggagcugaggcucugggggug

SEQ ID NO: 8177 - RNA, 21 nt, Homo sapiens
caaagaggaaggucccauuac

SEQ ID NO: 8178 - RNA, 21 nt, Homo sapiens
ucacuccucuccucccgucuu

SEQ ID NO: 8179 - RNA, 22 nt, Homo sapiens
ucaggccaggcacaguggcuca

SEQ ID NO: 8180 - RNA, 23 nt, Homo sapiens
aacauucaacgcugucggugagu

SEQ ID NO: 8181 - RNA, 22 nt, Homo sapiens
uggcucaguucagcaggaacag

SEQ ID NO: 8182 - RNA, 22 nt, Homo sapiens
acgcccuucccccccuucuuca

SEQ ID NO: 8183 - RNA, 22 nt, Homo sapiens
ugugacugguugaccagagggg

SEQ ID NO: 8184 - RNA, 22 nt, Homo sapiens
uagcagcacauaaugguuugug

SEQ ID NO: 8185 - RNA, 22 nt, Homo sapiens
uagcagcacaucaugguuuaca

SEQ ID NO: 8186 - RNA, 22 nt, Homo sapiens
uagcagcacguaaauauuggcg

SEQ ID NO: 8187 - RNA, 21 nt, Homo sapiens
uagcagcacagaaauauuggc

SEQ ID NO: 8188 - RNA, 22 nt, Homo sapiens
uuggggaaacggccgcugagug

SEQ ID NO: 8189 - RNA, 22 nt, Homo sapiens
gaggguuggguggaggcucucc

SEQ ID NO: 8190 - RNA, 21 nt, Homo sapiens
aggggugcuaucugugauuga

SEQ ID NO: 8191 - RNA, 22 nt, Homo sapiens
cagcagcaauucauguuuugaa

SEQ ID NO: 8192 - RNA, 21 nt, Homo sapiens
cagcagcacacugugguuugu

SEQ ID NO: 8193 - RNA, 19 nt, Homo sapiens
ugucucugcugggguuucu

SEQ ID NO: 8194 - RNA, 22 nt, Homo sapiens
agacuucccauuugaagguggc

SEQ ID NO: 8195 - RNA, 23 nt, Homo sapiens
aucgcugcgguugcgagcgcugu

SEQ ID NO: 8196 - RNA, 17 nt, Homo sapiens
ucucgcuggggccucca

SEQ ID NO: 8197 - RNA, 22 nt, Homo sapiens
aggcagcgggguguaguggaua

SEQ ID NO: 8198 - RNA, 22 nt, Homo sapiens
caaagugccucccuuuagagug

SEQ ID NO: 8199 - RNA, 22 nt, Homo sapiens
caaagugccucccuuuagagug

SEQ ID NO: 8200 - RNA, 22 nt, Homo sapiens
ugugcgcagggagaccucuccc

SEQ ID NO: 8201 - RNA, 24 nt, Homo sapiens
agccuggaagcuggagccugcagu

SEQ ID NO: 8202 - RNA, 17 nt, Homo sapiens
ucgccuccuccucuccc

SEQ ID NO: 8203 - RNA, 21 nt, Homo sapiens
agcuacaucuggcuacugggu

SEQ ID NO: 8204 - RNA, 21 nt, Homo sapiens
uaguagaccguauagcguacg

SEQ ID NO: 8205 - RNA, 22 nt, Homo sapiens
caaaaaccacaguuucuuuugc

SEQ ID NO: 8206 - RNA, 25 nt, Homo sapiens
aggggugguguugggacagcuccgu

SEQ ID NO: 8207 - RNA, 25 nt, Homo sapiens
ggcggagggaaguagguccguuggu

SEQ ID NO: 8208 - RNA, 21 nt, Homo sapiens
uggaggagaaggaaggugaug

SEQ ID NO: 8209 - RNA, 20 nt, Homo sapiens
ggggagcuguggaagcagua

SEQ ID NO: 8210 - RNA, 22 nt, Homo sapiens
ugucuacuacuggagacacugg

SEQ ID NO: 8211 - RNA, 21 nt, Homo sapiens
cccggagccaggaugcagcuc

SEQ ID NO: 8212 - RNA, 20 nt, Homo sapiens
ugagcccuguccucccgcag

SEQ ID NO: 8213 - RNA, 22 nt, Homo sapiens
ccucuuccccuugucucuccag

SEQ ID NO: 8214 - RNA, 24 nt, Homo sapiens
ccagacagaauucuaugcacuuuc

SEQ ID NO: 8215 - RNA, 23 nt, Homo sapiens
uauggcuuuucauuccuauguga

SEQ ID NO: 8216 - RNA, 21 nt, Homo sapiens
uccugcgcgucccagaugccc

SEQ ID NO: 8217 - RNA, 23 nt, Homo sapiens
ugucugcccgcaugccugccucu

SEQ ID NO: 8218 - RNA, 23 nt, Homo sapiens
cacucagccuugagggcacuuuc

SEQ ID NO: 8219 - RNA, 19 nt, Homo sapiens
agcugucugaaaaugucuu

SEQ ID NO: 8220 - RNA, 19 nt, Homo sapiens
gugucugcuuccuguggga

SEQ ID NO: 8221 - RNA, 20 nt, Homo sapiens
guagaggagauggcgcaggg

SEQ ID NO: 8222 - RNA, 22 nt, Homo sapiens
ugugagguuggcauuguugucu

SEQ ID NO: 8223 - RNA, 22 nt, Homo sapiens
aucacacaaaggcaacuuuugu

SEQ ID NO: 8224 - RNA, 23 nt, Homo sapiens
uauggcuuuucauuccuauguga

SEQ ID NO: 8225 - RNA, 19 nt, Homo sapiens
aagugugcagggcacuggu

SEQ ID NO: 8226 - RNA, 23 nt, Homo sapiens
cucucaccacugcccucccacag

SEQ ID NO: 8227 - RNA, 22 nt, Homo sapiens
uggagagaaaggcaguuccuga

SEQ ID NO: 8228 - RNA, 20 nt, Homo sapiens
ccccagggcgacgcggcggg

SEQ ID NO: 8229 - RNA, 22 nt, Homo sapiens
aaaagcuggguugagagggcga

SEQ ID NO: 8230 - RNA, 22 nt, Homo sapiens
aaaagcuggguugagagggcaa

SEQ ID NO: 8231 - RNA, 20 nt, Homo sapiens
aaaagcuggguugagagggu

SEQ ID NO: 8232 - RNA, 19 nt, Homo sapiens
aaaagcuggguugagagga

SEQ ID NO: 8233 - RNA, 21 nt, Homo sapiens
uggguuuacguugggagaacu

SEQ ID NO: 8234 - RNA, 23 nt, Homo sapiens
ccugcagcgacuugauggcuucc

SEQ ID NO: 8235 - RNA, 21 nt, Homo sapiens
ccccaccuccucucuccucag

SEQ ID NO: 8236 - RNA, 20 nt, Homo sapiens
ggggagcuguggaagcagua

SEQ ID NO: 8237 - RNA, 26 nt, Homo sapiens
gaugaugauggcagcaaauucugaaa

SEQ ID NO: 8238 - RNA, 18 nt, Homo sapiens
cagggaggugaaugugau

SEQ ID NO: 8239 - RNA, 23 nt, Homo sapiens
ucuggcuccgugucuucacuccc

SEQ ID NO: 8240 - RNA, 21 nt, Homo sapiens
cggcggggacggcgauugguc

SEQ ID NO: 8241 - RNA, 22 nt, Homo sapiens
ugauugguacgucuguggguag

SEQ ID NO: 8242 - RNA, 22 nt, Homo sapiens
aggcggggcgccgcgggaccgc

SEQ ID NO: 8243 - RNA, 24 nt, Homo sapiens
uggggagcugaggcucugggggug

SEQ ID NO: 8244 - RNA, 22 nt, Homo sapiens
aacccguagauccgaacuugug

SEQ ID NO: 8245 - RNA, 21 nt, Homo sapiens
cccggagccaggaugcagcuc

SEQ ID NO: 8246 - RNA, 22 nt, Homo sapiens
uggguggucuggagauuugugc

SEQ ID NO: 8247 - RNA, 22 nt, Homo sapiens
cucggcgcggggcgcgggcucc

SEQ ID NO: 8248 - RNA, 21 nt, Homo sapiens
caucccuugcaugguggaggg

SEQ ID NO: 8249 - RNA, 22 nt, Homo sapiens
uguaaacauccuacacucagcu

SEQ ID NO: 8250 - RNA, 23 nt, Homo sapiens
cgcauccccuagggcauuggugu

SEQ ID NO: 8251 - RNA, 21 nt, Homo sapiens
gccccugggccuauccuagaa

SEQ ID NO: 8252 - RNA, 23 nt, Homo sapiens
uaauccuugcuaccugggugaga

SEQ ID NO: 8253 - RNA, 21 nt, Homo sapiens
gaaggcgcuucccuuuggagu

SEQ ID NO: 8254 - RNA, 22 nt, Homo sapiens
gaaggcgcuucccuuuagagcg

SEQ ID NO: 8255 - RNA, 22 nt, Homo sapiens
ccucccacacccaaggcuugca

SEQ ID NO: 8256 - RNA, 22 nt, Homo sapiens
uggugggcacagaaucuggacu

SEQ ID NO: 8257 - RNA, 22 nt, Homo sapiens
aagcugccaguugaagaacugu

SEQ ID NO: 8258 - RNA, 22 nt, Homo sapiens
aaaagcuggguugagagggcga

SEQ ID NO: 8259 - RNA, 22 nt, Homo sapiens
aaaagcuggguugagagggcaa

SEQ ID NO: 8260 - RNA, 20 nt, Homo sapiens
aaaagcuggguugagagggu

SEQ ID NO: 8261 - RNA, 19 nt, Homo sapiens
aaaagcuggguugagagga

SEQ ID NO: 8262 - RNA, 23 nt, Homo sapiens
cacucagccuugagggcacuuuc

SEQ ID NO: 8263 - RNA, 22 nt, Homo sapiens
aagugcuuccuuuuagaggguu

SEQ ID NO: 8264 - RNA, 22 nt, Homo sapiens
ucugggcaacaaagugagaccu

SEQ ID NO: 8265 - RNA, 25 nt, Homo sapiens
gcugggcagggcuucugagcuccuu

SEQ ID NO: 8266 - RNA, 23 nt, Homo sapiens
uaaagugcuuauagugcagguag

SEQ ID NO: 8267 - RNA, 17 nt, Homo sapiens
gugggggagaggcuguc

SEQ ID NO: 8268 - RNA, 23 nt, Homo sapiens
cacucagccuugagggcacuuuc

SEQ ID NO: 8269 - RNA, 24 nt, Homo sapiens
ccagacagaauucuaugcacuuuc

SEQ ID NO: 8270 - RNA, 19 nt, Homo sapiens
agcugucugaaaaugucuu

SEQ ID NO: 8271 - RNA, 23 nt, Homo sapiens
uggaguccaggaaucugcauuuu

SEQ ID NO: 8272 - RNA, 22 nt, Homo sapiens
ggggguccccggugcucggauc

SEQ ID NO: 8273 - RNA, 19 nt, Homo sapiens
ucuaggcugguacugcuga

SEQ ID NO: 8274 - RNA, 20 nt, Homo sapiens
ucugcaggguuugcuuugag

SEQ ID NO: 8275 - RNA, 19 nt, Homo sapiens
gaugaugcugcugaugcug

SEQ ID NO: 8276 - RNA, 23 nt, Homo sapiens
ucccccaggugugauucugauuu

SEQ ID NO: 8277 - RNA, 24 nt, Homo sapiens
acugggggcuuucgggcucugcgu

SEQ ID NO: 8278 - RNA, 22 nt, Homo sapiens
cagugguuuuacccuaugguag

SEQ ID NO: 8279 - RNA, 23 nt, Homo sapiens
ugaggggcagagagcgagacuuu

SEQ ID NO: 8280 - RNA, 22 nt, Homo sapiens
cgcaggggccgggugcucaccg

SEQ ID NO: 8281 - RNA, 23 nt, Homo sapiens
guccaguuuucccaggaaucccu

SEQ ID NO: 8282 - RNA, 20 nt, Homo sapiens
auuccuagaaauuguucaua

SEQ ID NO: 8283 - RNA, 22 nt, Homo sapiens
gugaaauguuuaggaccacuag

SEQ ID NO: 8284 - RNA, 21 nt, Homo sapiens
uucacaguggcuaaguuccgc

SEQ ID NO: 8285 - RNA, 23 nt, Homo sapiens
uacuccagagggcgucacucaug

SEQ ID NO: 8286 - RNA, 26 nt, Homo sapiens
gaugaugauggcagcaaauucugaaa

SEQ ID NO: 8287 - RNA, 24 nt, Homo sapiens
uggggagcugaggcucugggggug

SEQ ID NO: 8288 - RNA, 21 nt, Homo sapiens
gaaggcgcuucccuuuggagu

SEQ ID NO: 8289 - RNA, 22 nt, Homo sapiens
gaaggcgcuucccuuuagagcg

SEQ ID NO: 8290 - RNA, 22 nt, Homo sapiens
ucugcccccuccgcugcugcca

SEQ ID NO: 8291 - RNA, 20 nt, Homo sapiens
acugccccaggugcugcugg

SEQ ID NO: 8292 - RNA, 21 nt, Homo sapiens
cggggcagcucaguacaggau

SEQ ID NO: 8293 - RNA, 25 nt, Homo sapiens
ugggaacggguuccggcagacgcug

SEQ ID NO: 8294 - RNA, 22 nt, Homo sapiens
caaucacuaacuccacugccau

SEQ ID NO: 8295 - RNA, 21 nt, Homo sapiens
aggaggcagcgcucucaggac

SEQ ID NO: 8296 - RNA, 25 nt, Homo sapiens
cccccacaaccgcgcuugacuagcu

SEQ ID NO: 8297 - RNA, 22 nt, Homo sapiens
ugagguaguaguuugugcuguu

SEQ ID NO: 8298 - RNA, 22 nt, Homo sapiens
cucccacugcuucacuugacua

SEQ ID NO: 8299 - RNA, 23 nt, Homo sapiens
cacucagccuugagggcacuuuc

SEQ ID NO: 8300 - RNA, 22 nt, Homo sapiens
uacgucaucguugucaucguca

SEQ ID NO: 8301 - RNA, 20 nt, Homo sapiens
aggguguuucucucaucucu

SEQ ID NO: 8302 - RNA, 21 nt, Homo sapiens
uuaggccgcagaucuggguga

SEQ ID NO: 8303 - RNA, 22 nt, Homo sapiens
ugauugguacgucuguggguag

SEQ ID NO: 8304 - RNA, 22 nt, Homo sapiens
ccucccacacccaaggcuugca

SEQ ID NO: 8305 - RNA, 23 nt, Homo sapiens
uaaagugcuuauagugcagguag

SEQ ID NO: 8306 - RNA, 21 nt, Homo sapiens
agagaagaagaucagccugca

SEQ ID NO: 8307 - RNA, 21 nt, Homo sapiens
caagucacuagugguuccguu

SEQ ID NO: 8308 - RNA, 22 nt, Homo sapiens
agaucagaaggugauuguggcu

SEQ ID NO: 8309 - RNA, 23 nt, Homo sapiens
ugagcgccucgacgacagagccg

SEQ ID NO: 8310 - RNA, 17 nt, Homo sapiens
gugggggagaggcuguc

SEQ ID NO: 8311 - RNA, 22 nt, Homo sapiens
uguaacagcaacuccaugugga

SEQ ID NO: 8312 - RNA, 20 nt, Homo sapiens
ggggagcuguggaagcagua

SEQ ID NO: 8313 - RNA, 22 nt, Homo sapiens
cgcaggggccgggugcucaccg

SEQ ID NO: 8314 - RNA, 22 nt, Homo sapiens
ucggccugaccacccaccccac

SEQ ID NO: 8315 - RNA, 22 nt, Homo sapiens
uucuggaauucugugugaggga

SEQ ID NO: 8316 - RNA, 19 nt, Homo sapiens
agcugucugaaaaugucuu

SEQ ID NO: 8317 - RNA, 22 nt, Homo sapiens
acccgucccguucguccccgga

SEQ ID NO: 8318 - RNA, 22 nt, Homo sapiens
caaagaauucuccuuuugggcu

SEQ ID NO: 8319 - RNA, 23 nt, Homo sapiens
uacuccagagggcgucacucaug

SEQ ID NO: 8320 - RNA, 22 nt, Homo sapiens
acuccagccccacagccucagc

SEQ ID NO: 8321 - RNA, 22 nt, Homo sapiens
caugccuugaguguaggaccgu

SEQ ID NO: 8322 - RNA, 23 nt, Homo sapiens
cggcccgggcugcugcuguuccu

SEQ ID NO: 8323 - RNA, 18 nt, Homo sapiens
cgggcguggugguggggg

SEQ ID NO: 8324 - RNA, 23 nt, Homo sapiens
ucuggcuccgugucuucacuccc

SEQ ID NO: 8325 - RNA, 21 nt, Homo sapiens
gaaggcgcuucccuuuggagu

SEQ ID NO: 8326 - RNA, 22 nt, Homo sapiens
gaaggcgcuucccuuuagagcg

SEQ ID NO: 8327 - RNA, 22 nt, Homo sapiens
gguggcccggccgugccugagg

SEQ ID NO: 8328 - RNA, 20 nt, Homo sapiens
agaccauggguucucauugu

SEQ ID NO: 8329 - RNA, 21 nt, Homo sapiens
uugaaaggcuauuucuugguc

SEQ ID NO: 8330 - RNA, 23 nt, Homo sapiens
uacuccagagggcgucacucaug

SEQ ID NO: 8331 - RNA, 22 nt, Homo sapiens
cacacacugcaauuacuuuugc

SEQ ID NO: 8332 - RNA, 24 nt, Homo sapiens
uucuccaaaagaaagcacuuucug

SEQ ID NO: 8333 - RNA, 22 nt, Homo sapiens
aagugccuccuuuuagaguguu

SEQ ID NO: 8334 - RNA, 22 nt, Homo sapiens
agaucagaaggugauuguggcu

SEQ ID NO: 8335 - RNA, 21 nt, Homo sapiens
gccccugggccuauccuagaa

SEQ ID NO: 8336 - RNA, 23 nt, Homo sapiens
agcuacauugucugcuggguuuc

SEQ ID NO: 8337 - RNA, 21 nt, Homo sapiens
uugaaaggcuauuucuugguc

SEQ ID NO: 8338 - RNA, 23 nt, Homo sapiens
agcuacauugucugcuggguuuc

SEQ ID NO: 8339 - RNA, 23 nt, Homo sapiens
gcgaggaccccucggggucugac

SEQ ID NO: 8340 - RNA, 22 nt, Homo sapiens
ucggccugaccacccaccccac

SEQ ID NO: 8341 - RNA, 23 nt, Homo sapiens
ugaguaccgccaugucuguuggg

SEQ ID NO: 8342 - RNA, 22 nt, Homo sapiens
gugugcggaaaugcuucugcua

SEQ ID NO: 8343 - RNA, 22 nt, Homo sapiens
uacgucaucguugucaucguca

SEQ ID NO: 8344 - RNA, 22 nt, Homo sapiens
agaucgaccguguuauauucgc

SEQ ID NO: 8345 - RNA, 21 nt, Homo sapiens
cgcgggugcuuacugacccuu

SEQ ID NO: 8346 - RNA, 21 nt, Homo sapiens
cccggagccaggaugcagcuc

SEQ ID NO: 8347 - RNA, 23 nt, Homo sapiens
ucuggcuccgugucuucacuccc

SEQ ID NO: 8348 - RNA, 21 nt, Homo sapiens
cggcggggacggcgauugguc

SEQ ID NO: 8349 - RNA, 23 nt, Homo sapiens
ugaggggcagagagcgagacuuu

SEQ ID NO: 8350 - RNA, 22 nt, Homo sapiens
aggcggggcgccgcgggaccgc

SEQ ID NO: 8351 - RNA, 17 nt, Homo sapiens
ucgccuccuccucuccc

SEQ ID NO: 8352 - RNA, 21 nt, Homo sapiens
cggcggggacggcgauugguc

SEQ ID NO: 8353 - RNA, 23 nt, Homo sapiens
ugaggggcagagagcgagacuuu

SEQ ID NO: 8354 - RNA, 22 nt, Homo sapiens
aagacgggaggaaagaagggag

SEQ ID NO: 8355 - RNA, 22 nt, Homo sapiens
uacucaggagaguggcaaucac

SEQ ID NO: 8356 - RNA, 24 nt, Homo sapiens
uucuccaaaagaaagcacuuucug

SEQ ID NO: 8357 - RNA, 22 nt, Homo sapiens
aagugccuccuuuuagaguguu

SEQ ID NO: 8358 - RNA, 22 nt, Homo sapiens
aggcggggcgccgcgggaccgc

SEQ ID NO: 8359 - RNA, 22 nt, Homo sapiens
ugcggggcuagggcuaacagca

SEQ ID NO: 8360 - RNA, 23 nt, Homo sapiens
ccugcagcgacuugauggcuucc

SEQ ID NO: 8361 - RNA, 21 nt, Homo sapiens
gugccagcugcagugggggag

SEQ ID NO: 8362 - RNA, 18 nt, Homo sapiens
cagggaggugaaugugau

SEQ ID NO: 8363 - RNA, 22 nt, Homo sapiens
gcccgcguguggagccaggugu

SEQ ID NO: 8364 - RNA, 23 nt, Homo sapiens
ucuggcuccgugucuucacuccc

SEQ ID NO: 8365 - RNA, 23 nt, Homo sapiens
ucccuguccuccaggagcucacg

SEQ ID NO: 8366 - RNA, 23 nt, Homo sapiens
ugaggggcagagagcgagacuuu

SEQ ID NO: 8367 - RNA, 21 nt, Homo sapiens
ugucuugcaggccgucaugca

SEQ ID NO: 8368 - RNA, 22 nt, Homo sapiens
cacgcucaugcacacacccaca

SEQ ID NO: 8369 - RNA, 22 nt, Homo sapiens
ggggguccccggugcucggauc

SEQ ID NO: 8370 - RNA, 22 nt, Homo sapiens
gucccucuccaaaugugucuug

SEQ ID NO: 8371 - RNA, 20 nt, Homo sapiens
guccgcucggcgguggccca

SEQ ID NO: 8372 - RNA, 23 nt, Homo sapiens
uucauuugguauaaaccgcgauu

SEQ ID NO: 8373 - RNA, 22 nt, Homo sapiens
uuugugaccugguccacuaacc

SEQ ID NO: 8374 - RNA, 22 nt, Homo sapiens
uccagcaucagugauuuuguug

SEQ ID NO: 8375 - RNA, 20 nt, Homo sapiens
guagaggagauggcgcaggg

SEQ ID NO: 8376 - RNA, 23 nt, Homo sapiens
agcuacauugucugcuggguuuc

SEQ ID NO: 8377 - RNA, 23 nt, Homo sapiens
uauucauuuauccccagccuaca

SEQ ID NO: 8378 - RNA, 18 nt, Homo sapiens
ugcuuccuuucagagggu

SEQ ID NO: 8379 - RNA, 22 nt, Homo sapiens
aucuggagguaagaagcacuuu

SEQ ID NO: 8380 - RNA, 25 nt, Homo sapiens
ggcggagggaaguagguccguuggu

SEQ ID NO: 8381 - RNA, 22 nt, Homo sapiens
aacgcacuucccuuuagagugu

SEQ ID NO: 8382 - RNA, 21 nt, Homo sapiens
ugacaacuauggaugagcucu

SEQ ID NO: 8383 - RNA, 22 nt, Homo sapiens
uucuggaauucugugugaggga

SEQ ID NO: 8384 - RNA, 22 nt, Homo sapiens
aagcccuuaccccaaaaagcau

SEQ ID NO: 8385 - RNA, 22 nt, Homo sapiens
uguaacagcaacuccaugugga

SEQ ID NO: 8386 - RNA, 23 nt, Homo sapiens
ucccccaggugugauucugauuu

SEQ ID NO: 8387 - RNA, 24 nt, Homo sapiens
acugggggcuuucgggcucugcgu

SEQ ID NO: 8388 - RNA, 23 nt, Homo sapiens
aggaagcccuggaggggcuggag

SEQ ID NO: 8389 - RNA, 22 nt, Homo sapiens
caaaaaccacaguuucuuuugc

SEQ ID NO: 8390 - RNA, 22 nt, Homo sapiens
augggugaauuuguagaaggau

SEQ ID NO: 8391 - RNA, 21 nt, Homo sapiens
uacucaaaaagcugucaguca

SEQ ID NO: 8392 - RNA, 20 nt, Homo sapiens
agagguauagggcaugggaa

SEQ ID NO: 8393 - RNA, 23 nt, Homo sapiens
cuggagauauggaagagcugugu

SEQ ID NO: 8394 - RNA, 20 nt, Homo sapiens
auggagauagauauagaaau

SEQ ID NO: 8395 - RNA, 19 nt, Homo sapiens
aagcagcugccucugaggc

SEQ ID NO: 8396 - RNA, 22 nt, Homo sapiens
ucugggcaacaaagugagaccu

SEQ ID NO: 8397 - RNA, 25 nt, Homo sapiens
gcugggcagggcuucugagcuccuu

SEQ ID NO: 8398 - RNA, 24 nt, Homo sapiens
uuuggcaaugguagaacucacacu

SEQ ID NO: 8399 - RNA, 22 nt, Homo sapiens
agacccuggucugcacucuauc

SEQ ID NO: 8400 - RNA, 26 nt, Homo sapiens
gaugaugauggcagcaaauucugaaa

SEQ ID NO: 8401 - RNA, 20 nt, Homo sapiens
ccucugggcccuuccuccag

SEQ ID NO: 8402 - RNA, 22 nt, Homo sapiens
ucucugggccugugucuuaggc

SEQ ID NO: 8403 - RNA, 22 nt, Homo sapiens
ccucuuccccuugucucuccag

SEQ ID NO: 8404 - RNA, 21 nt, Homo sapiens
agggcccccccucaauccugu

SEQ ID NO: 8405 - RNA, 21 nt, Homo sapiens
agggcccccccucaauccugu

SEQ ID NO: 8406 - RNA, 21 nt, Homo sapiens
gccccugggccuauccuagaa

SEQ ID NO: 8407 - RNA, 17 nt, Homo sapiens
gugggggagaggcuguc

SEQ ID NO: 8408 - RNA, 20 nt, Homo sapiens
cggcucugggucugugggga

SEQ ID NO: 8409 - RNA, 21 nt, Homo sapiens
cggcggggacggcgauugguc

SEQ ID NO: 8410 - RNA, 22 nt, Homo sapiens
aggcggggcgccgcgggaccgc

SEQ ID NO: 8411 - RNA, 22 nt, Homo sapiens
aaggagcucacagucuauugag

SEQ ID NO: 8412 - RNA, 23 nt, Homo sapiens
aaggagcuuacaaucuagcuggg

SEQ ID NO: 8413 - RNA, 18 nt, Homo sapiens
uccagugcccuccucucc

SEQ ID NO: 8414 - RNA, 24 nt, Homo sapiens
acaaagugcuucccuuuagagugu

SEQ ID NO: 8415 - RNA, 22 nt, Homo sapiens
acaaagugcuucccuuuagagu

SEQ ID NO: 8416 - RNA, 22 nt, Homo sapiens
ucucccaacccuuguaccagug

SEQ ID NO: 8417 - RNA, 17 nt, Homo sapiens
ucgccuccuccucuccc

SEQ ID NO: 8418 - RNA, 23 nt, Homo sapiens
ucuggcuccgugucuucacuccc

SEQ ID NO: 8419 - RNA, 23 nt, Homo sapiens
cacucagccuugagggcacuuuc

SEQ ID NO: 8420 - RNA, 18 nt, Homo sapiens
uccagugcccuccucucc

SEQ ID NO: 8421 - RNA, 21 nt, Homo sapiens
ucuuguguucucuagaucagu

SEQ ID NO: 8422 - RNA, 20 nt, Homo sapiens
guugugucaguuuaucaaac

SEQ ID NO: 8423 - RNA, 22 nt, Homo sapiens
gcccgcguguggagccaggugu

SEQ ID NO: 8424 - RNA, 22 nt, Homo sapiens
ugcggggcuagggcuaacagca

SEQ ID NO: 8425 - RNA, 21 nt, Homo sapiens
uuuugcaccuuuuggagugaa

SEQ ID NO: 8426 - RNA, 22 nt, Homo sapiens
auucugcauuuuuagcaaguuc

SEQ ID NO: 8427 - RNA, 23 nt, Homo sapiens
guuugcacgggugggccuugucu

SEQ ID NO: 8428 - RNA, 24 nt, Homo sapiens
acaaagugcuucccuuuagagugu

SEQ ID NO: 8429 - RNA, 22 nt, Homo sapiens
acaaagugcuucccuuuagagu

SEQ ID NO: 8430 - RNA, 21 nt, Homo sapiens
uaggacacauggucuacuucu

SEQ ID NO: 8431 - RNA, 23 nt, Homo sapiens
ucuggcuccgugucuucacuccc

SEQ ID NO: 8432 - RNA, 21 nt, Homo sapiens
cggcggggacggcgauugguc

SEQ ID NO: 8433 - RNA, 22 nt, Homo sapiens
aggcggggcgccgcgggaccgc

SEQ ID NO: 8434 - RNA, 21 nt, Homo sapiens
ugcaggaccaagaugagcccu

SEQ ID NO: 8435 - RNA, 21 nt, Homo sapiens
agaccuggcccagaccucagc

SEQ ID NO: 8436 - RNA, 25 nt, Homo sapiens
ggcggagggaaguagguccguuggu

SEQ ID NO: 8437 - RNA, 22 nt, Homo sapiens
gugaaauguuuaggaccacuag

SEQ ID NO: 8438 - RNA, 23 nt, Homo sapiens
uuuggcacuagcacauuuuugcu

SEQ ID NO: 8439 - RNA, 23 nt, Homo sapiens
ccugcagcgacuugauggcuucc

SEQ ID NO: 8440 - RNA, 22 nt, Homo sapiens
aaccagcaccccaacuuuggac

SEQ ID NO: 8441 - RNA, 22 nt, Homo sapiens
uagguaguuuccuguuguuggg

SEQ ID NO: 8442 - RNA, 22 nt, Homo sapiens
cacgcucaugcacacacccaca

SEQ ID NO: 8443 - RNA, 22 nt, Homo sapiens
agaggcuggccgugaugaauuc

SEQ ID NO: 8444 - RNA, 24 nt, Homo sapiens
ugccugggucucuggccugcgcgu

SEQ ID NO: 8445 - RNA, 22 nt, Homo sapiens
cugcccuggcccgagggaccga

SEQ ID NO: 8446 - RNA, 21 nt, Homo sapiens
aggguaagcugaaccucugau

SEQ ID NO: 8447 - RNA, 19 nt, Homo sapiens
gggcgccugugaucccaac

SEQ ID NO: 8448 - RNA, 20 nt, Homo sapiens
cuuccucgucugucugcccc

SEQ ID NO: 8449 - RNA, 22 nt, Homo sapiens
ugagaacugaauuccauggguu

SEQ ID NO: 8450 - RNA, 21 nt, Homo sapiens
uucacaguggcuaaguucugc

SEQ ID NO: 8451 - RNA, 25 nt, Homo sapiens
ggcggagggaaguagguccguuggu

SEQ ID NO: 8452 - RNA, 17 nt, Homo sapiens
ucgccuccuccucuccc

SEQ ID NO: 8453 - RNA, 22 nt, Homo sapiens
aggcagcgggguguaguggaua

SEQ ID NO: 8454 - RNA, 21 nt, Homo sapiens
uaauuuuauguauaagcuagu

SEQ ID NO: 8455 - RNA, 23 nt, Homo sapiens
ugaggggcagagagcgagacuuu

SEQ ID NO: 8456 - RNA, 21 nt, Homo sapiens
cugaccuaugaauugacagcc

SEQ ID NO: 8457 - RNA, 24 nt, Homo sapiens
agccuggaagcuggagccugcagu

SEQ ID NO: 8458 - RNA, 23 nt, Homo sapiens
uaauccuugcuaccugggugaga

SEQ ID NO: 8459 - RNA, 22 nt, Homo sapiens
uagcuuaucagacugauguuga

SEQ ID NO: 8460 - RNA, 20 nt, Homo sapiens
ggggagcuguggaagcagua

SEQ ID NO: 8461 - RNA, 19 nt, Homo sapiens
aggcugcggaauucaggac

SEQ ID NO: 8462 - RNA, 22 nt, Homo sapiens
ucugcccccuccgcugcugcca

SEQ ID NO: 8463 - RNA, 20 nt, Homo sapiens
acugccccaggugcugcugg

SEQ ID NO: 8464 - RNA, 22 nt, Homo sapiens
uggugggcacagaaucuggacu

SEQ ID NO: 8465 - RNA, 22 nt, Homo sapiens
uggugggccgcagaacaugugc

SEQ ID NO: 8466 - RNA, 23 nt, Homo sapiens
aagugccgccaucuuuugagugu

SEQ ID NO: 8467 - RNA, 22 nt, Homo sapiens
uguaacagcaacuccaugugga

SEQ ID NO: 8468 - RNA, 23 nt, Homo sapiens
ucucacacagaaaucgcacccgu

SEQ ID NO: 8469 - RNA, 22 nt, Homo sapiens
acuccagccccacagccucagc

SEQ ID NO: 8470 - RNA, 18 nt, Homo sapiens
ucagcuggcccucauuuc

SEQ ID NO: 8471 - RNA, 24 nt, Homo sapiens
uggggagcugaggcucugggggug

SEQ ID NO: 8472 - RNA, 22 nt, Homo sapiens
augguacccuggcauacugagu

SEQ ID NO: 8473 - RNA, 21 nt, Homo sapiens
cggcggggacggcgauugguc

SEQ ID NO: 8474 - RNA, 22 nt, Homo sapiens
aggcggggcgccgcgggaccgc

SEQ ID NO: 8475 - RNA, 22 nt, Homo sapiens
ugcggggcuagggcuaacagca

SEQ ID NO: 8476 - RNA, 20 nt, Homo sapiens
agaccauggguucucauugu

SEQ ID NO: 8477 - RNA, 22 nt, Homo sapiens
uggagugugacaaugguguuug

SEQ ID NO: 8478 - RNA, 23 nt, Homo sapiens
gaacgcgcuucccuauagagggu

SEQ ID NO: 8479 - RNA, 22 nt, Homo sapiens
gugacaucacauauacggcagc

SEQ ID NO: 8480 - RNA, 21 nt, Homo sapiens
uccuucugcuccgucccccag

SEQ ID NO: 8481 - RNA, 22 nt, Homo sapiens
cuuggcaccuagcaagcacuca

SEQ ID NO: 8482 - RNA, 22 nt, Homo sapiens
caaagaauucuccuuuugggcu

SEQ ID NO: 8483 - RNA, 23 nt, Homo sapiens
uuuggcacuagcacauuuuugcu

SEQ ID NO: 8484 - RNA, 22 nt, Homo sapiens
aggcauugacuucucacuagcu

SEQ ID NO: 8485 - RNA, 22 nt, Homo sapiens
uaaugccccuaaaaauccuuau

SEQ ID NO: 8486 - RNA, 23 nt, Homo sapiens
ugagcgccucgacgacagagccg

SEQ ID NO: 8487 - RNA, 22 nt, Homo sapiens
acccgucccguucguccccgga

SEQ ID NO: 8488 - RNA, 25 nt, Homo sapiens
aggggugguguugggacagcuccgu

SEQ ID NO: 8489 - RNA, 22 nt, Homo sapiens
ugcggggcuagggcuaacagca

SEQ ID NO: 8490 - RNA, 20 nt, Homo sapiens
ggggagcuguggaagcagua

SEQ ID NO: 8491 - RNA, 22 nt, Homo sapiens
uauugcacucgucccggccucc

SEQ ID NO: 8492 - RNA, 23 nt, Homo sapiens
aggaccugcgggacaagauucuu

SEQ ID NO: 8493 - RNA, 21 nt, Homo sapiens
aucacauugccagggauuucc

SEQ ID NO: 8494 - RNA, 21 nt, Homo sapiens
aucacauugccagggauuacc

SEQ ID NO: 8495 - RNA, 26 nt, Homo sapiens
gaugaugauggcagcaaauucugaaa

SEQ ID NO: 8496 - RNA, 22 nt, Homo sapiens
uaugucugcugaccaucaccuu

SEQ ID NO: 8497 - RNA, 22 nt, Homo sapiens
uggagagaaaggcaguuccuga

SEQ ID NO: 8498 - RNA, 22 nt, Homo sapiens
cucggcgcggggcgcgggcucc

SEQ ID NO: 8499 - RNA, 22 nt, Homo sapiens
uacccagagcaugcagugugaa

SEQ ID NO: 8500 - RNA, 20 nt, Homo sapiens
ccauggaucuccaggugggu

SEQ ID NO: 8501 - RNA, 19 nt, Homo sapiens
aguguggcuuucuuagagc

SEQ ID NO: 8502 - RNA, 20 nt, Homo sapiens
ucacuguucagacaggcgga

SEQ ID NO: 8503 - RNA, 22 nt, Homo sapiens
uguaaacauccuacacucagcu

SEQ ID NO: 8504 - RNA, 24 nt, Homo sapiens
ugccugggucucuggccugcgcgu

SEQ ID NO: 8505 - RNA, 20 nt, Homo sapiens
guugugucaguuuaucaaac

SEQ ID NO: 8506 - RNA, 22 nt, Homo sapiens
ugagccccugugccgcccccag

SEQ ID NO: 8507 - RNA, 21 nt, Homo sapiens
ucguggccuggucuccauuau

SEQ ID NO: 8508 - RNA, 25 nt, Homo sapiens
aggggugguguugggacagcuccgu

SEQ ID NO: 8509 - RNA, 23 nt, Homo sapiens
uaaggugcaucuagugcagauag

SEQ ID NO: 8510 - RNA, 22 nt, Homo sapiens
aaagugcauccuuuuagagugu

SEQ ID NO: 8511 - RNA, 22 nt, Homo sapiens
aaagugcauccuuuuagagguu

SEQ ID NO: 8512 - RNA, 22 nt, Homo sapiens
aaagugcaucuuuuuagaggau

SEQ ID NO: 8513 - RNA, 22 nt, Homo sapiens
ccucuuccccuugucucuccag

SEQ ID NO: 8514 - RNA, 20 nt, Homo sapiens
guagaggagauggcgcaggg

SEQ ID NO: 8515 - RNA, 23 nt, Homo sapiens
ucauagcccuguacaaugcugcu

SEQ ID NO: 8516 - RNA, 18 nt, Homo sapiens
aucccaccucugccacca

SEQ ID NO: 8517 - RNA, 24 nt, Homo sapiens
uugcagcugccugggagugacuuc

SEQ ID NO: 8518 - RNA, 22 nt, Homo sapiens
auccgcgcucugacucucugcc

SEQ ID NO: 8519 - RNA, 21 nt, Homo sapiens
ccccaccuccucucuccucag

SEQ ID NO: 8520 - RNA, 22 nt, Homo sapiens
ucugcccccuccgcugcugcca

SEQ ID NO: 8521 - RNA, 20 nt, Homo sapiens
ugagcccuguccucccgcag

SEQ ID NO: 8522 - RNA, 22 nt, Homo sapiens
aguggggaacccuuccaugagg

SEQ ID NO: 8523 - RNA, 22 nt, Homo sapiens
ucggccugaccacccaccccac

SEQ ID NO: 8524 - RNA, 22 nt, Homo sapiens
uuggggaaacggccgcugagug

SEQ ID NO: 8525 - RNA, 22 nt, Homo sapiens
acagcaggcacagacaggcagu

SEQ ID NO: 8526 - RNA, 19 nt, Homo sapiens
accgugcaaagguagcaua

SEQ ID NO: 8527 - RNA, 21 nt, Homo sapiens
cugaccuaugaauugacagcc

SEQ ID NO: 8528 - RNA, 22 nt, Homo sapiens
cagugcaauguuaaaagggcau

SEQ ID NO: 8529 - RNA, 21 nt, Homo sapiens
aucacauugccagggauuucc

SEQ ID NO: 8530 - RNA, 21 nt, Homo sapiens
aucacauugccagggauuacc

SEQ ID NO: 8531 - RNA, 21 nt, Homo sapiens
uggcagggaggcugggagggg

SEQ ID NO: 8532 - RNA, 22 nt, Homo sapiens
uguaaacauccuacacucagcu

SEQ ID NO: 8533 - RNA, 21 nt, Homo sapiens
agggcccccccucaauccugu

SEQ ID NO: 8534 - RNA, 18 nt, Homo sapiens
ucagcuggcccucauuuc

SEQ ID NO: 8535 - RNA, 21 nt, Homo sapiens
aagccugcccggcuccucggg

SEQ ID NO: 8536 - RNA, 22 nt, Homo sapiens
caaaaguaauuguggauuuugu

SEQ ID NO: 8537 - RNA, 23 nt, Homo sapiens
uauggcuuuuuauuccuauguga

SEQ ID NO: 8538 - RNA, 23 nt, Homo sapiens
uauggcuuuucauuccuauguga

SEQ ID NO: 8539 - RNA, 23 nt, Homo sapiens
ucuggcuccgugucuucacuccc

SEQ ID NO: 8540 - RNA, 23 nt, Homo sapiens
uaaggugcaucuagugcaguuag

SEQ ID NO: 8541 - RNA, 23 nt, Homo sapiens
uaauacugccggguaaugaugga

SEQ ID NO: 8542 - RNA, 22 nt, Homo sapiens
auaagacgagcaaaaagcuugu

SEQ ID NO: 8543 - RNA, 22 nt, Homo sapiens
auaagacgaacaaaagguuugu

SEQ ID NO: 8544 - RNA, 22 nt, Homo sapiens
cuggcccucucugcccuuccgu

SEQ ID NO: 8545 - RNA, 23 nt, Homo sapiens
uaauccuugcuaccugggugaga

SEQ ID NO: 8546 - RNA, 22 nt, Homo sapiens
uggugggcacagaaucuggacu

SEQ ID NO: 8547 - RNA, 23 nt, Homo sapiens
agugccugagggaguaagagccc

SEQ ID NO: 8548 - RNA, 25 nt, Homo sapiens
agggaucgcgggcggguggcggccu

SEQ ID NO: 8549 - RNA, 23 nt, Homo sapiens
cucucaccacugcccucccacag

SEQ ID NO: 8550 - RNA, 21 nt, Homo sapiens
uugaaaggcuauuucuugguc

SEQ ID NO: 8551 - RNA, 21 nt, Homo sapiens
uaaagugcugacagugcagau

SEQ ID NO: 8552 - RNA, 23 nt, Homo sapiens
cagugcaaugauauugucaaagc

SEQ ID NO: 8553 - RNA, 22 nt, Homo sapiens
ucaggcucaguccccucccgau

SEQ ID NO: 8554 - RNA, 22 nt, Homo sapiens
aucacacaaaggcaacuuuugu

SEQ ID NO: 8555 - RNA, 19 nt, Homo sapiens
ugucucugcugggguuucu

SEQ ID NO: 8556 - RNA, 24 nt, Homo sapiens
ucccugagacccuuuaaccuguga

SEQ ID NO: 8557 - RNA, 22 nt, Homo sapiens
ucccugagacccuaacuuguga

SEQ ID NO: 8558 - RNA, 23 nt, Homo sapiens
ccucagggcuguagaacagggcu

SEQ ID NO: 8559 - RNA, 25 nt, Homo sapiens
aggggugguguugggacagcuccgu

SEQ ID NO: 8560 - RNA, 20 nt, Homo sapiens
ggggagcuguggaagcagua

SEQ ID NO: 8561 - RNA, 22 nt, Homo sapiens
uaugugggaugguaaaccgcuu

SEQ ID NO: 8562 - RNA, 20 nt, Homo sapiens
ggggagcuguggaagcagua

SEQ ID NO: 8563 - RNA, 21 nt, Homo sapiens
acuggacuuggagucagaagg

SEQ ID NO: 8564 - RNA, 22 nt, Homo sapiens
acuggacuuagggucagaaggc

SEQ ID NO: 8565 - RNA, 22 nt, Homo sapiens
uuagggcccuggcuccaucucc

SEQ ID NO: 8566 - RNA, 23 nt, Homo sapiens
ucggggaucaucaugucacgaga

SEQ ID NO: 8567 - RNA, 22 nt, Homo sapiens
uggagugugacaaugguguuug

SEQ ID NO: 8568 - RNA, 23 nt, Homo sapiens
uauggcuuuucauuccuauguga

SEQ ID NO: 8569 - RNA, 22 nt, Homo sapiens
aucacacaaaggcaacuuuugu

SEQ ID NO: 8570 - RNA, 21 nt, Homo sapiens
ccaguccugugccugccgccu

SEQ ID NO: 8571 - RNA, 22 nt, Homo sapiens
uggcaguguauuguuagcuggu

SEQ ID NO: 8572 - RNA, 22 nt, Homo sapiens
cgucaacacuugcugguuuccu

SEQ ID NO: 8573 - RNA, 20 nt, Homo sapiens
ccucugggcccuuccuccag

SEQ ID NO: 8574 - RNA, 22 nt, Homo sapiens
ucucugggccugugucuuaggc

SEQ ID NO: 8575 - RNA, 22 nt, Homo sapiens
ccucccacacccaaggcuugca

SEQ ID NO: 8576 - RNA, 22 nt, Homo sapiens
gcugacuccuaguccagggcuc

SEQ ID NO: 8577 - RNA, 22 nt, Homo sapiens
acgcccuucccccccuucuuca

SEQ ID NO: 8578 - RNA, 19 nt, Homo sapiens
aggcugcggaauucaggac

SEQ ID NO: 8579 - RNA, 21 nt, Homo sapiens
ugacaacuauggaugagcucu

SEQ ID NO: 8580 - RNA, 22 nt, Homo sapiens
uagcagcacauaaugguuugug

SEQ ID NO: 8581 - RNA, 23 nt, Homo sapiens
ucuggcuccgugucuucacuccc

SEQ ID NO: 8582 - RNA, 23 nt, Homo sapiens
cggcccgggcugcugcuguuccu

SEQ ID NO: 8583 - RNA, 21 nt, Homo sapiens
agggcccccccucaauccugu

SEQ ID NO: 8584 - RNA, 23 nt, Homo sapiens
ugaggggcagagagcgagacuuu

SEQ ID NO: 8585 - RNA, 22 nt, Homo sapiens
ugcggggcuagggcuaacagca

SEQ ID NO: 8586 - RNA, 22 nt, Homo sapiens
cuuaugcaagauucccuucuac

SEQ ID NO: 8587 - RNA, 22 nt, Homo sapiens
uggugggcacagaaucuggacu

SEQ ID NO: 8588 - RNA, 22 nt, Homo sapiens
uggugggccgcagaacaugugc

SEQ ID NO: 8589 - RNA, 21 nt, Homo sapiens
gcgacccacucuugguuucca

SEQ ID NO: 8590 - RNA, 21 nt, Homo sapiens
gcgacccauacuugguuucag

SEQ ID NO: 8591 - RNA, 24 nt, Homo sapiens
gaccuggacauguuugugcccagu

SEQ ID NO: 8592 - RNA, 22 nt, Homo sapiens
aaggagcucacagucuauugag

SEQ ID NO: 8593 - RNA, 23 nt, Homo sapiens
aaggagcuuacaaucuagcuggg

SEQ ID NO: 8594 - RNA, 20 nt, Homo sapiens
uaaggcacgcggugaaugcc

SEQ ID NO: 8595 - RNA, 22 nt, Homo sapiens
cucuagagggaagcacuuucug

SEQ ID NO: 8596 - RNA, 21 nt, Homo sapiens
aaagcgcuucccuucagagug

SEQ ID NO: 8597 - RNA, 21 nt, Homo sapiens
gaaagcgcuucucuuuagagg

SEQ ID NO: 8598 - RNA, 22 nt, Homo sapiens
aaagugcauccuuuuagagugu

SEQ ID NO: 8599 - RNA, 22 nt, Homo sapiens
cucuagagggaagcgcuuucug

SEQ ID NO: 8600 - RNA, 22 nt, Homo sapiens
cucuagagggaagcgcuuucug

SEQ ID NO: 8601 - RNA, 22 nt, Homo sapiens
cucuagagggaagcacuuucug

SEQ ID NO: 8602 - RNA, 22 nt, Homo sapiens
aaaaugguucccuuuagagugu

SEQ ID NO: 8603 - RNA, 23 nt, Homo sapiens
gaacgcgcuucccuauagagggu

SEQ ID NO: 8604 - RNA, 22 nt, Homo sapiens
cucuagagggaagcacuuucug

SEQ ID NO: 8605 - RNA, 22 nt, Homo sapiens
uccuucauuccaccggagucug

SEQ ID NO: 8606 - RNA, 21 nt, Homo sapiens
agggcccccccucaauccugu

SEQ ID NO: 8607 - RNA, 22 nt, Homo sapiens
acuccagccccacagccucagc

SEQ ID NO: 8608 - RNA, 18 nt, Homo sapiens
aucccaccucugccacca

SEQ ID NO: 8609 - RNA, 22 nt, Homo sapiens
ccucccacacccaaggcuugca

SEQ ID NO: 8610 - RNA, 21 nt, Homo sapiens
gugcauuguaguugcauugca

SEQ ID NO: 8611 - RNA, 21 nt, Homo sapiens
cggcggggacggcgauugguc

SEQ ID NO: 8612 - RNA, 22 nt, Homo sapiens
aggcggggcgccgcgggaccgc

SEQ ID NO: 8613 - RNA, 24 nt, Homo sapiens
ugccugggucucuggccugcgcgu

SEQ ID NO: 8614 - RNA, 22 nt, Homo sapiens
agaggcuggccgugaugaauuc

SEQ ID NO: 8615 - RNA, 21 nt, Homo sapiens
uggcagggaggcugggagggg

SEQ ID NO: 8616 - RNA, 22 nt, Homo sapiens
ucggccugaccacccaccccac

SEQ ID NO: 8617 - RNA, 18 nt, Homo sapiens
aucccaccucugccacca

SEQ ID NO: 8618 - RNA, 24 nt, Homo sapiens
uggcccugacugaagaccagcagu

SEQ ID NO: 8619 - RNA, 24 nt, Homo sapiens
uggcccugacugaagaccagcagu

SEQ ID NO: 8620 - RNA, 23 nt, Homo sapiens
cggcccgggcugcugcuguuccu

SEQ ID NO: 8621 - RNA, 21 nt, Homo sapiens
cggcggggacggcgauugguc

SEQ ID NO: 8622 - RNA, 22 nt, Homo sapiens
ucugcccccuccgcugcugcca

SEQ ID NO: 8623 - RNA, 20 nt, Homo sapiens
acugccccaggugcugcugg

SEQ ID NO: 8624 - RNA, 22 nt, Homo sapiens
aggcggggcgccgcgggaccgc

SEQ ID NO: 8625 - RNA, 22 nt, Homo sapiens
caaagugccucccuuuagagug

SEQ ID NO: 8626 - RNA, 20 nt, Homo sapiens
ggggagcuguggaagcagua

SEQ ID NO: 8627 - RNA, 22 nt, Homo sapiens
uauugcacucgucccggccucc

SEQ ID NO: 8628 - RNA, 20 nt, Homo sapiens
ccuccugcccuccuugcugu

SEQ ID NO: 8629 - RNA, 22 nt, Homo sapiens
acagcaggcacagacaggcagu

SEQ ID NO: 8630 - RNA, 21 nt, Homo sapiens
aauaauacaugguugaucuuu

SEQ ID NO: 8631 - RNA, 22 nt, Homo sapiens
gccugcugggguggaaccuggu

SEQ ID NO: 8632 - RNA, 22 nt, Homo sapiens
auaauacaugguuaaccucuuu

SEQ ID NO: 8633 - RNA, 20 nt, Homo sapiens
ggggagcuguggaagcagua

SEQ ID NO: 8634 - RNA, 22 nt, Homo sapiens
uuuccggcucgcgugggugugu

SEQ ID NO: 8635 - RNA, 19 nt, Homo sapiens
gugaggacucgggaggugg

SEQ ID NO: 8636 - RNA, 22 nt, Homo sapiens
ucugggcaacaaagugagaccu

SEQ ID NO: 8637 - RNA, 18 nt, Homo sapiens
cagggaggugaaugugau

SEQ ID NO: 8638 - RNA, 23 nt, Homo sapiens
ucuggcuccgugucuucacuccc

SEQ ID NO: 8639 - RNA, 21 nt, Homo sapiens
ucgaggagcucacagucuagu

SEQ ID NO: 8640 - RNA, 21 nt, Homo sapiens
cggcggggacggcgauugguc

SEQ ID NO: 8641 - RNA, 19 nt, Homo sapiens
ugagcugcuguaccaaaau

SEQ ID NO: 8642 - RNA, 19 nt, Homo sapiens
aggcacggugucagcaggc

SEQ ID NO: 8643 - RNA, 19 nt, Homo sapiens
aggcugcggaauucaggac

SEQ ID NO: 8644 - RNA, 25 nt, Homo sapiens
gcugggcagggcuucugagcuccuu

SEQ ID NO: 8645 - RNA, 19 nt, Homo sapiens
aagcagcugccucugaggc

SEQ ID NO: 8646 - RNA, 22 nt, Homo sapiens
aggcggggcgccgcgggaccgc

SEQ ID NO: 8647 - RNA, 22 nt, Homo sapiens
cuccugagccauucugagccuc

SEQ ID NO: 8648 - RNA, 22 nt, Homo sapiens
ucaccagcccuguguucccuag

SEQ ID NO: 8649 - RNA, 22 nt, Homo sapiens
ccucuuccccuugucucuccag

SEQ ID NO: 8650 - RNA, 23 nt, Homo sapiens
agcuacauugucugcuggguuuc

SEQ ID NO: 8651 - RNA, 22 nt, Homo sapiens
aauugcacgguauccaucugua

SEQ ID NO: 8652 - RNA, 23 nt, Homo sapiens
ucuuggaguaggucauugggugg

SEQ ID NO: 8653 - RNA, 25 nt, Homo sapiens
aggggugguguugggacagcuccgu

SEQ ID NO: 8654 - RNA, 21 nt, Homo sapiens
gcaggaacuugugagucuccu

SEQ ID NO: 8655 - RNA, 21 nt, Homo sapiens
gcaggaacuugugagucuccu

SEQ ID NO: 8656 - RNA, 24 nt, Homo sapiens
uggcccugacugaagaccagcagu

SEQ ID NO: 8657 - RNA, 21 nt, Homo sapiens
uggcagggaggcugggagggg

SEQ ID NO: 8658 - RNA, 21 nt, Homo sapiens
ucacagugaaccggucucuuu

SEQ ID NO: 8659 - RNA, 20 nt, Homo sapiens
ucugcaggguuugcuuugag

SEQ ID NO: 8660 - RNA, 22 nt, Homo sapiens
cucuagagggaagcacuuucug

SEQ ID NO: 8661 - RNA, 20 nt, Homo sapiens
guugugucaguuuaucaaac

SEQ ID NO: 8662 - RNA, 22 nt, Homo sapiens
caaaaaccacaguuucuuuugc

SEQ ID NO: 8663 - RNA, 23 nt, Homo sapiens
ucuggcuccgugucuucacuccc

SEQ ID NO: 8664 - RNA, 22 nt, Homo sapiens
uggagagaaaggcaguuccuga

SEQ ID NO: 8665 - RNA, 22 nt, Homo sapiens
gcugacuccuaguccagggcuc

SEQ ID NO: 8666 - RNA, 22 nt, Homo sapiens
uguaaacauccuacacucagcu

SEQ ID NO: 8667 - RNA, 21 nt, Homo sapiens
uggcagggaggcugggagggg

SEQ ID NO: 8668 - RNA, 22 nt, Homo sapiens
ucaccagcccuguguucccuag

SEQ ID NO: 8669 - RNA, 23 nt, Homo sapiens
agcugguguugugaaucaggccg

SEQ ID NO: 8670 - RNA, 20 nt, Homo sapiens
ccccagggcgacgcggcggg

SEQ ID NO: 8671 - RNA, 22 nt, Homo sapiens
aacuggcccucaaagucccgcu

SEQ ID NO: 8672 - RNA, 20 nt, Homo sapiens
ccuccugcccuccuugcugu

SEQ ID NO: 8673 - RNA, 22 nt, Homo sapiens
gguccagaggggagauagguuc

SEQ ID NO: 8674 - RNA, 21 nt, Homo sapiens
uaaagugcugacagugcagau

SEQ ID NO: 8675 - RNA, 23 nt, Homo sapiens
cagugcaaugauauugucaaagc

SEQ ID NO: 8676 - RNA, 21 nt, Homo sapiens
gccccugggccuauccuagaa

SEQ ID NO: 8677 - RNA, 23 nt, Homo sapiens
uagcagcgggaacaguucugcag

SEQ ID NO: 8678 - RNA, 19 nt, Homo sapiens
ugucucugcugggguuucu

SEQ ID NO: 8679 - RNA, 22 nt, Homo sapiens
cuugguucagggagggucccca

SEQ ID NO: 8680 - RNA, 21 nt, Homo sapiens
uggaggagaaggaaggugaug

SEQ ID NO: 8681 - RNA, 21 nt, Homo sapiens
aaggcagggcccccgcucccc

SEQ ID NO: 8682 - RNA, 23 nt, Homo sapiens
cucucaccacugcccucccacag

SEQ ID NO: 8683 - RNA, 22 nt, Homo sapiens
augggugaauuuguagaaggau

SEQ ID NO: 8684 - RNA, 22 nt, Homo sapiens
gguccagaggggagauagguuc

SEQ ID NO: 8685 - RNA, 22 nt, Homo sapiens
aaaucucugcaggcaaauguga

SEQ ID NO: 8686 - RNA, 21 nt, Homo sapiens
acuggacuuggagucagaagg

SEQ ID NO: 8687 - RNA, 22 nt, Homo sapiens
acuggacuuagggucagaaggc

SEQ ID NO: 8688 - RNA, 22 nt, Homo sapiens
ugagaaccacgucugcucugag

SEQ ID NO: 8689 - RNA, 22 nt, Homo sapiens
ucuucucuguuuuggccaugug

SEQ ID NO: 8690 - RNA, 21 nt, Homo sapiens
uggcagggaggcugggagggg

SEQ ID NO: 8691 - RNA, 21 nt, Homo sapiens
ccccaccuccucucuccucag

SEQ ID NO: 8692 - RNA, 22 nt, Homo sapiens
uggagugugacaaugguguuug

SEQ ID NO: 8693 - RNA, 22 nt, Homo sapiens
ucggccugaccacccaccccac

SEQ ID NO: 8694 - RNA, 23 nt, Homo sapiens
uauggcuuuucauuccuauguga

SEQ ID NO: 8695 - RNA, 22 nt, Homo sapiens
uacccagagcaugcagugugaa

SEQ ID NO: 8696 - RNA, 22 nt, Homo sapiens
uagguaguuuccuguuguuggg

SEQ ID NO: 8697 - RNA, 22 nt, Homo sapiens
uuggggaaacggccgcugagug

SEQ ID NO: 8698 - RNA, 22 nt, Homo sapiens
uguaaacauccuacacucagcu

SEQ ID NO: 8699 - RNA, 22 nt, Homo sapiens
aguggggaacccuuccaugagg

SEQ ID NO: 8700 - RNA, 22 nt, Homo sapiens
uggugggcacagaaucuggacu

SEQ ID NO: 8701 - RNA, 25 nt, Homo sapiens
aggggugguguugggacagcuccgu

SEQ ID NO: 8702 - RNA, 22 nt, Homo sapiens
uggugggccgcagaacaugugc

SEQ ID NO: 8703 - RNA, 24 nt, Homo sapiens
ugccugggucucuggccugcgcgu

SEQ ID NO: 8704 - RNA, 20 nt, Homo sapiens
accaggaggcugaggccccu

SEQ ID NO: 8705 - RNA, 20 nt, Homo sapiens
ggggagcuguggaagcagua

SEQ ID NO: 8706 - RNA, 21 nt, Homo sapiens
aaggcagggcccccgcucccc

SEQ ID NO: 8707 - RNA, 23 nt, Homo sapiens
uacccuguagauccgaauuugug

SEQ ID NO: 8708 - RNA, 23 nt, Homo sapiens
uacccuguagaaccgaauuugug

SEQ ID NO: 8709 - RNA, 22 nt, Homo sapiens
acaggugagguucuugggagcc

SEQ ID NO: 8710 - RNA, 23 nt, Homo sapiens
uaaauuucaccuuucugagaagg

SEQ ID NO: 8711 - RNA, 23 nt, Homo sapiens
uaaauuucaccuuucugagaagg

SEQ ID NO: 8712 - RNA, 22 nt, Homo sapiens
ugugacagauugauaacugaaa

SEQ ID NO: 8713 - RNA, 21 nt, Homo sapiens
aggguaagcugaaccucugau

SEQ ID NO: 8714 - RNA, 18 nt, Homo sapiens
cgggcguggugguggggg

SEQ ID NO: 8715 - RNA, 23 nt, Homo sapiens
cggcccgggcugcugcuguuccu

SEQ ID NO: 8716 - RNA, 22 nt, Homo sapiens
uggagagaaaggcaguuccuga

SEQ ID NO: 8717 - RNA, 21 nt, Homo sapiens
cggcggggacggcgauugguc

SEQ ID NO: 8718 - RNA, 22 nt, Homo sapiens
aggcggggcgccgcgggaccgc

SEQ ID NO: 8719 - RNA, 22 nt, Homo sapiens
ugcggggcuagggcuaacagca

SEQ ID NO: 8720 - RNA, 24 nt, Homo sapiens
uggggagcugaggcucugggggug

SEQ ID NO: 8721 - RNA, 21 nt, Homo sapiens
cccggagccaggaugcagcuc

SEQ ID NO: 8722 - RNA, 20 nt, Homo sapiens
ucugcaggguuugcuuugag

SEQ ID NO: 8723 - RNA, 20 nt, Homo sapiens
ucacaccugccucgcccccc

SEQ ID NO: 8724 - RNA, 23 nt, Homo sapiens
uggaguccaggaaucugcauuuu

SEQ ID NO: 8725 - RNA, 23 nt, Homo sapiens
caaagugcuuacagugcagguag

SEQ ID NO: 8726 - RNA, 20 nt, Homo sapiens
ccuccugcccuccuugcugu

SEQ ID NO: 8727 - RNA, 22 nt, Homo sapiens
uacugcagacguggcaaucaug

SEQ ID NO: 8728 - RNA, 21 nt, Homo sapiens
uacugcagacaguggcaauca

SEQ ID NO: 8729 - RNA, 22 nt, Homo sapiens
ggggguccccggugcucggauc

SEQ ID NO: 8730 - RNA, 25 nt, Homo sapiens
agggaucgcgggcggguggcggccu

SEQ ID NO: 8731 - RNA, 24 nt, Homo sapiens
ugccugggucucuggccugcgcgu

SEQ ID NO: 8732 - RNA, 24 nt, Homo sapiens
ugccugggucucuggccugcgcgu

SEQ ID NO: 8733 - RNA, 22 nt, Homo sapiens
ugagccccugugccgcccccag

SEQ ID NO: 8734 - RNA, 22 nt, Homo sapiens
ccucuuccccuugucucuccag

SEQ ID NO: 8735 - RNA, 22 nt, Homo sapiens
agaaggaaauugaauucauuua

SEQ ID NO: 8736 - RNA, 17 nt, Homo sapiens
ucgccuccuccucuccc

SEQ ID NO: 8737 - RNA, 18 nt, Homo sapiens
cagggaggugaaugugau

SEQ ID NO: 8738 - RNA, 23 nt, Homo sapiens
ucuggcuccgugucuucacuccc

SEQ ID NO: 8739 - RNA, 22 nt, Homo sapiens
uucccuuugucauccuaugccu

SEQ ID NO: 8740 - RNA, 22 nt, Homo sapiens
uucccuuugucauccuucgccu

SEQ ID NO: 8741 - RNA, 23 nt, Homo sapiens
ugaggggcagagagcgagacuuu

SEQ ID NO: 8742 - RNA, 20 nt, Homo sapiens
guagaggagauggcgcaggg

SEQ ID NO: 8743 - RNA, 23 nt, Homo sapiens
uacccuguagaaccgaauuugug

SEQ ID NO: 8744 - RNA, 22 nt, Homo sapiens
acgcccuucccccccuucuuca

SEQ ID NO: 8745 - RNA, 22 nt, Homo sapiens
ucggauccgucugagcuuggcu

SEQ ID NO: 8746 - RNA, 24 nt, Homo sapiens
uuuggcaaugguagaacucacacu

SEQ ID NO: 8747 - RNA, 22 nt, Homo sapiens
uggcucaguucagcaggaacag

SEQ ID NO: 8748 - RNA, 22 nt, Homo sapiens
aucuggagguaagaagcacuuu

SEQ ID NO: 8749 - RNA, 20 nt, Homo sapiens
cggcucugggucugugggga

SEQ ID NO: 8750 - RNA, 22 nt, Homo sapiens
cuccugagccauucugagccuc

SEQ ID NO: 8751 - RNA, 20 nt, Homo sapiens
uaaggcacgcggugaaugcc

SEQ ID NO: 8752 - RNA, 17 nt, Homo sapiens
ucgccuccuccucuccc

SEQ ID NO: 8753 - RNA, 22 nt, Homo sapiens
ggagacgcggcccuguuggagu

SEQ ID NO: 8754 - RNA, 21 nt, Homo sapiens
ugagaugaagcacuguagcuc

SEQ ID NO: 8755 - RNA, 22 nt, Homo sapiens
ucgugucuuguguugcagccgg

SEQ ID NO: 8756 - RNA, 21 nt, Homo sapiens
ugacaacuauggaugagcucu

SEQ ID NO: 8757 - RNA, 23 nt, Homo sapiens
uagcagcgggaacaguucugcag

SEQ ID NO: 8758 - RNA, 21 nt, Homo sapiens
uaaggcacccuucugaguaga

SEQ ID NO: 8759 - RNA, 23 nt, Homo sapiens
aucgcugcgguugcgagcgcugu

SEQ ID NO: 8760 - RNA, 19 nt, Homo sapiens
aagugugcagggcacuggu

SEQ ID NO: 8761 - RNA, 22 nt, Homo sapiens
cuugguucagggagggucccca

SEQ ID NO: 8762 - RNA, 21 nt, Homo sapiens
gcaggaacuugugagucuccu

SEQ ID NO: 8763 - RNA, 23 nt, Homo sapiens
gagggucuugggagggaugugac

SEQ ID NO: 8764 - RNA, 24 nt, Homo sapiens
uggcccugacugaagaccagcagu

SEQ ID NO: 8765 - RNA, 21 nt, Homo sapiens
ccaguccugugccugccgccu

SEQ ID NO: 8766 - RNA, 20 nt, Homo sapiens
ccccagggcgacgcggcggg

SEQ ID NO: 8767 - RNA, 22 nt, Homo sapiens
ugggucuuugcgggcgagauga

SEQ ID NO: 8768 - RNA, 19 nt, Homo sapiens
accgugcaaagguagcaua

SEQ ID NO: 8769 - RNA, 22 nt, Homo sapiens
cuggcccucucugcccuuccgu

SEQ ID NO: 8770 - RNA, 23 nt, Homo sapiens
ucccccaggugugauucugauuu

SEQ ID NO: 8771 - RNA, 21 nt, Homo sapiens
acuggacuuggagucagaagg

SEQ ID NO: 8772 - RNA, 22 nt, Homo sapiens
aggcaguguauuguuagcuggc

SEQ ID NO: 8773 - RNA, 21 nt, Homo sapiens
cggggcagcucaguacaggau

SEQ ID NO: 8774 - RNA, 24 nt, Homo sapiens
acugggggcuuucgggcucugcgu

SEQ ID NO: 8775 - RNA, 22 nt, Homo sapiens
gguggcccggccgugccugagg

SEQ ID NO: 8776 - RNA, 21 nt, Homo sapiens
uggcagggaggcugggagggg

SEQ ID NO: 8777 - RNA, 22 nt, Homo sapiens
ucaccagcccuguguucccuag

SEQ ID NO: 8778 - RNA, 22 nt, Homo sapiens
uggagagaaaggcaguuccuga

SEQ ID NO: 8779 - RNA, 22 nt, Homo sapiens
cgcaggggccgggugcucaccg

SEQ ID NO: 8780 - RNA, 21 nt, Homo sapiens
aucacauugccagggauuucc

SEQ ID NO: 8781 - RNA, 21 nt, Homo sapiens
aucacauugccagggauuacc

SEQ ID NO: 8782 - RNA, 22 nt, Homo sapiens
aguggggaacccuuccaugagg

SEQ ID NO: 8783 - RNA, 19 nt, Homo sapiens
ugggcguaucuguaugcua

SEQ ID NO: 8784 - RNA, 19 nt, Homo sapiens
aggcugcggaauucaggac

SEQ ID NO: 8785 - RNA, 20 nt, Homo sapiens
ggggagcuguggaagcagua

SEQ ID NO: 8786 - RNA, 22 nt, Homo sapiens
ugagguaguagguuguauaguu

SEQ ID NO: 8787 - RNA, 22 nt, Homo sapiens
ugagguaguagguugugugguu

SEQ ID NO: 8788 - RNA, 22 nt, Homo sapiens
ugagguaguagguuguaugguu

SEQ ID NO: 8789 - RNA, 22 nt, Homo sapiens
agagguaguagguugcauaguu

SEQ ID NO: 8790 - RNA, 22 nt, Homo sapiens
ugagguaggagguuguauaguu

SEQ ID NO: 8791 - RNA, 22 nt, Homo sapiens
ugagguaguagauuguauaguu

SEQ ID NO: 8792 - RNA, 22 nt, Homo sapiens
ugagguaguaguuuguacaguu

SEQ ID NO: 8793 - RNA, 22 nt, Homo sapiens
ugagguaguaguuugugcuguu

SEQ ID NO: 8794 - RNA, 21 nt, Homo sapiens
ccccaccuccucucuccucag

SEQ ID NO: 8795 - RNA, 22 nt, Homo sapiens
ugugagguuggcauuguugucu

SEQ ID NO: 8796 - RNA, 22 nt, Homo sapiens
uuggggaaacggccgcugagug

SEQ ID NO: 8797 - RNA, 22 nt, Homo sapiens
aguggggaacccuuccaugagg

SEQ ID NO: 8798 - RNA, 20 nt, Homo sapiens
ggggagcuguggaagcagua

SEQ ID NO: 8799 - RNA, 22 nt, Homo sapiens
ugagguaguaaguuguauuguu

SEQ ID NO: 8800 - RNA, 22 nt, Homo sapiens
ucagugcacuacagaacuuugu

SEQ ID NO: 8801 - RNA, 20 nt, Homo sapiens
ccccagggcgacgcggcggg

SEQ ID NO: 8802 - RNA, 21 nt, Homo sapiens
uaaagugcugacagugcagau

SEQ ID NO: 8803 - RNA, 23 nt, Homo sapiens
cagugcaaugauauugucaaagc

SEQ ID NO: 8804 - RNA, 23 nt, Homo sapiens
agguuacccgagcaacuuugcau

SEQ ID NO: 8805 - RNA, 21 nt, Homo sapiens
uggguuuacguugggagaacu

SEQ ID NO: 8806 - RNA, 23 nt, Homo sapiens
uauucauuuauccccagccuaca

SEQ ID NO: 8807 - RNA, 23 nt, Homo sapiens
ccugcagcgacuugauggcuucc

SEQ ID NO: 8808 - RNA, 20 nt, Homo sapiens
uaaggcacgcggugaaugcc

SEQ ID NO: 8809 - RNA, 21 nt, Homo sapiens
ucacuccucuccucccgucuu

SEQ ID NO: 8810 - RNA, 22 nt, Homo sapiens
aagacgggaggaaagaagggag

SEQ ID NO: 8811 - RNA, 21 nt, Homo sapiens
uaaggcacccuucugaguaga

SEQ ID NO: 8812 - RNA, 19 nt, Homo sapiens
aggcacggugucagcaggc

SEQ ID NO: 8813 - RNA, 20 nt, Homo sapiens
accaggaggcugaggccccu

SEQ ID NO: 8814 - RNA, 22 nt, Homo sapiens
ugagaccucuggguucugagcu

SEQ ID NO: 8815 - RNA, 20 nt, Homo sapiens
ggggagcuguggaagcagua

SEQ ID NO: 8816 - RNA, 23 nt, Homo sapiens
uauggcuuuucauuccuauguga

SEQ ID NO: 8817 - RNA, 23 nt, Homo sapiens
ucuggcuccgugucuucacuccc

SEQ ID NO: 8818 - RNA, 21 nt, Homo sapiens
cucccacaugcaggguuugca

SEQ ID NO: 8819 - RNA, 21 nt, Homo sapiens
uaaagugcugacagugcagau

SEQ ID NO: 8820 - RNA, 23 nt, Homo sapiens
cagugcaaugauauugucaaagc

SEQ ID NO: 8821 - RNA, 22 nt, Homo sapiens
ccucccacacccaaggcuugca

SEQ ID NO: 8822 - RNA, 20 nt, Homo sapiens
aggguguuucucucaucucu

SEQ ID NO: 8823 - RNA, 21 nt, Homo sapiens
uggaggagaaggaaggugaug

SEQ ID NO: 8824 - RNA, 22 nt, Homo sapiens
aggcauugacuucucacuagcu

SEQ ID NO: 8825 - RNA, 22 nt, Homo sapiens
uucuggaauucugugugaggga

SEQ ID NO: 8826 - RNA, 22 nt, Homo sapiens
cccugugcccggcccacuucug

SEQ ID NO: 8827 - RNA, 22 nt, Homo sapiens
aacacaccugguuaaccucuuu

SEQ ID NO: 8828 - RNA, 22 nt, Homo sapiens
gcugacuccuaguccagggcuc

SEQ ID NO: 8829 - RNA, 22 nt, Homo sapiens
caaucacuaacuccacugccau

SEQ ID NO: 8830 - RNA, 22 nt, Homo sapiens
aacacaccuauucaaggauuca

SEQ ID NO: 8831 - RNA, 22 nt, Homo sapiens
cgucaacacuugcugguuuccu

SEQ ID NO: 8832 - RNA, 23 nt, Homo sapiens
caaagcgcuucucuuuagagugu

SEQ ID NO: 8833 - RNA, 21 nt, Homo sapiens
cuccagagggaaguacuuucu

SEQ ID NO: 8834 - RNA, 21 nt, Homo sapiens
cuccagagggaugcacuuucu

SEQ ID NO: 8835 - RNA, 20 nt, Homo sapiens
auguauaaauguauacacac

SEQ ID NO: 8836 - RNA, 20 nt, Homo sapiens
aggguguuucucucaucucu

SEQ ID NO: 8837 - RNA, 22 nt, Homo sapiens
augcugacauauuuacuagagg

SEQ ID NO: 8838 - RNA, 23 nt, Homo sapiens
uauucauuuauccccagccuaca

SEQ ID NO: 8839 - RNA, 21 nt, Homo sapiens
uggaggagaaggaaggugaug

SEQ ID NO: 8840 - RNA, 21 nt, Homo sapiens
ccuggaaacacugagguugug

SEQ ID NO: 8841 - RNA, 20 nt, Homo sapiens
ggggagcuguggaagcagua

SEQ ID NO: 8842 - RNA, 22 nt, Homo sapiens
acccgucccguucguccccgga

SEQ ID NO: 8843 - RNA, 22 nt, Homo sapiens
uggaauguaaggaagugugugg

SEQ ID NO: 8844 - RNA, 23 nt, Homo sapiens
ucccccaggugugauucugauuu

SEQ ID NO: 8845 - RNA, 22 nt, Homo sapiens
cgucaacacuugcugguuuccu

SEQ ID NO: 8846 - RNA, 24 nt, Homo sapiens
acugggggcuuucgggcucugcgu

SEQ ID NO: 8847 - RNA, 24 nt, Homo sapiens
ugccugggucucuggccugcgcgu

SEQ ID NO: 8848 - RNA, 22 nt, Homo sapiens
uauugcacucgucccggccucc

SEQ ID NO: 8849 - RNA, 22 nt, Homo sapiens
auccgcgcucugacucucugcc

SEQ ID NO: 8850 - RNA, 21 nt, Homo sapiens
ccccaccuccucucuccucag

SEQ ID NO: 8851 - RNA, 19 nt, Homo sapiens
auggauaaggcuuuggcuu

SEQ ID NO: 8852 - RNA, 20 nt, Homo sapiens
guguguggaaaugcuucugc

SEQ ID NO: 8853 - RNA, 22 nt, Homo sapiens
cucuagagggaagcacuuucug

SEQ ID NO: 8854 - RNA, 21 nt, Homo sapiens
cucccacaugcaggguuugca

SEQ ID NO: 8855 - RNA, 22 nt, Homo sapiens
aaggagcucacagucuauugag

SEQ ID NO: 8856 - RNA, 22 nt, Homo sapiens
uguaaacauccuacacucagcu

SEQ ID NO: 8857 - RNA, 22 nt, Homo sapiens
uauugcacauuacuaaguugca

SEQ ID NO: 8858 - RNA, 21 nt, Homo sapiens
gccccugggccuauccuagaa

SEQ ID NO: 8859 - RNA, 22 nt, Homo sapiens
uccagcaucagugauuuuguug

SEQ ID NO: 8860 - RNA, 22 nt, Homo sapiens
uugggaucauuuugcauccaua

SEQ ID NO: 8861 - RNA, 22 nt, Homo sapiens
cuuaugcaagauucccuucuac

SEQ ID NO: 8862 - RNA, 22 nt, Homo sapiens
ugaaggucuacugugugccagg

SEQ ID NO: 8863 - RNA, 22 nt, Homo sapiens
ccucccacacccaaggcuugca

SEQ ID NO: 8864 - RNA, 21 nt, Homo sapiens
aacaggugacugguuagacaa

SEQ ID NO: 8865 - RNA, 22 nt, Homo sapiens
gguggcccggccgugccugagg

SEQ ID NO: 8866 - RNA, 23 nt, Homo sapiens
aaggagcuuacaaucuagcuggg

SEQ ID NO: 8867 - RNA, 21 nt, Homo sapiens
uggaggagaaggaaggugaug

SEQ ID NO: 8868 - RNA, 23 nt, Homo sapiens
cugggaucuccggggucuugguu

SEQ ID NO: 8869 - RNA, 20 nt, Homo sapiens
ggggagcuguggaagcagua

SEQ ID NO: 8870 - RNA, 22 nt, Homo sapiens
ugugacugguugaccagagggg

SEQ ID NO: 8871 - RNA, 22 nt, Homo sapiens
uaaucucagcuggcaacuguga

SEQ ID NO: 8872 - RNA, 22 nt, Homo sapiens
aaggagcucacagucuauugag

SEQ ID NO: 8873 - RNA, 22 nt, Homo sapiens
uguaaacauccuacacucagcu

SEQ ID NO: 8874 - RNA, 23 nt, Homo sapiens
ugaggggcagagagcgagacuuu

SEQ ID NO: 8875 - RNA, 22 nt, Homo sapiens
ugagaaccacgucugcucugag

SEQ ID NO: 8876 - RNA, 24 nt, Homo sapiens
ugccugggucucuggccugcgcgu

SEQ ID NO: 8877 - RNA, 23 nt, Homo sapiens
aaggagcuuacaaucuagcuggg

SEQ ID NO: 8878 - RNA, 21 nt, Homo sapiens
uggaggagaaggaaggugaug

SEQ ID NO: 8879 - RNA, 22 nt, Homo sapiens
uggagugugacaaugguguuug

SEQ ID NO: 8880 - RNA, 22 nt, Homo sapiens
ucggccugaccacccaccccac

SEQ ID NO: 8881 - RNA, 21 nt, Homo sapiens
uugggacauacuuaugcuaaa

SEQ ID NO: 8882 - RNA, 22 nt, Homo sapiens
uggagagaaaggcaguuccuga

SEQ ID NO: 8883 - RNA, 21 nt, Homo sapiens
cggcggggacggcgauugguc

SEQ ID NO: 8884 - RNA, 22 nt, Homo sapiens
ucugcccccuccgcugcugcca

SEQ ID NO: 8885 - RNA, 20 nt, Homo sapiens
ccuccugcccuccuugcugu

SEQ ID NO: 8886 - RNA, 21 nt, Homo sapiens
agggcccccccucaauccugu

SEQ ID NO: 8887 - RNA, 20 nt, Homo sapiens
acugccccaggugcugcugg

SEQ ID NO: 8888 - RNA, 21 nt, Homo sapiens
cggggcagcucaguacaggau

SEQ ID NO: 8889 - RNA, 23 nt, Homo sapiens
uagcagcgggaacaguucugcag

SEQ ID NO: 8890 - RNA, 19 nt, Homo sapiens
aggcugcggaauucaggac

SEQ ID NO: 8891 - RNA, 23 nt, Homo sapiens
aucgcugcgguugcgagcgcugu

SEQ ID NO: 8892 - RNA, 22 nt, Homo sapiens
aggcggggcgccgcgggaccgc

SEQ ID NO: 8893 - RNA, 22 nt, Homo sapiens
aggcggggcgccgcgggaccgc

SEQ ID NO: 8894 - RNA, 22 nt, Homo sapiens
ugcggggcuagggcuaacagca

SEQ ID NO: 8895 - RNA, 22 nt, Homo sapiens
ugcggggcuagggcuaacagca

SEQ ID NO: 8896 - RNA, 22 nt, Homo sapiens
ugcccuuaaaggugaacccagu

SEQ ID NO: 8897 - RNA, 24 nt, Homo sapiens
agccugauuaaacacaugcucuga

SEQ ID NO: 8898 - RNA, 23 nt, Homo sapiens
cggcccgggcugcugcuguuccu

SEQ ID NO: 8899 - RNA, 22 nt, Homo sapiens
ugggucuuugcgggcgagauga

SEQ ID NO: 8900 - RNA, 22 nt, Homo sapiens
aucacacaaaggcaacuuuugu

SEQ ID NO: 8901 - RNA, 22 nt, Homo sapiens
caaagugccucccuuuagagug

SEQ ID NO: 8902 - RNA, 24 nt, Homo sapiens
uggcccugacugaagaccagcagu

SEQ ID NO: 8903 - RNA, 23 nt, Homo sapiens
ucuggcuccgugucuucacuccc

SEQ ID NO: 8904 - RNA, 23 nt, Homo sapiens
cggcccgggcugcugcuguuccu

SEQ ID NO: 8905 - RNA, 22 nt, Homo sapiens
cucccacugcuucacuugacua

SEQ ID NO: 8906 - RNA, 21 nt, Homo sapiens
agggcccccccucaauccugu

SEQ ID NO: 8907 - RNA, 22 nt, Homo sapiens
uguaaacauccuacacucagcu

SEQ ID NO: 8908 - RNA, 23 nt, Homo sapiens
ugaggggcagagagcgagacuuu

SEQ ID NO: 8909 - RNA, 22 nt, Homo sapiens
ccucccacacccaaggcuugca

SEQ ID NO: 8910 - RNA, 25 nt, Homo sapiens
agggaucgcgggcggguggcggccu

SEQ ID NO: 8911 - RNA, 20 nt, Homo sapiens
accaggaggcugaggccccu

SEQ ID NO: 8912 - RNA, 18 nt, Homo sapiens
ucagcuggcccucauuuc

SEQ ID NO: 8913 - RNA, 23 nt, Homo sapiens
ucuggcuccgugucuucacuccc

SEQ ID NO: 8914 - RNA, 22 nt, Homo sapiens
uggagagaaaggcaguuccuga

SEQ ID NO: 8915 - RNA, 22 nt, Homo sapiens
uguaacagcaacuccaugugga

SEQ ID NO: 8916 - RNA, 22 nt, Homo sapiens
cucccacugcuucacuugacua

SEQ ID NO: 8917 - RNA, 22 nt, Homo sapiens
uguaaacauccuacacucagcu

SEQ ID NO: 8918 - RNA, 21 nt, Homo sapiens
uggguuuacguugggagaacu

SEQ ID NO: 8919 - RNA, 24 nt, Homo sapiens
ugccugggucucuggccugcgcgu

SEQ ID NO: 8920 - RNA, 21 nt, Homo sapiens
uccgguucucagggcuccacc

SEQ ID NO: 8921 - RNA, 23 nt, Homo sapiens
uggugcggagagggcccacagug

SEQ ID NO: 8922 - RNA, 21 nt, Homo sapiens
uggaggagaaggaaggugaug

SEQ ID NO: 8923 - RNA, 27 nt, Homo sapiens
cacuguaggugauggugagagugggca

SEQ ID NO: 8924 - RNA, 22 nt, Homo sapiens
ugagccccugugccgcccccag

SEQ ID NO: 8925 - RNA, 21 nt, Homo sapiens
ccuguugaaguguaaucccca

SEQ ID NO: 8926 - RNA, 22 nt, Homo sapiens
ucuacagugcacgugucuccag

SEQ ID NO: 8927 - RNA, 23 nt, Homo sapiens
aucaacagacauuaauugggcgc

SEQ ID NO: 8928 - RNA, 21 nt, Homo sapiens
acagucugcugagguuggagc

SEQ ID NO: 8929 - RNA, 22 nt, Homo sapiens
augcugacauauuuacuagagg

SEQ ID NO: 8930 - RNA, 19 nt, Homo sapiens
aagcagcugccucugaggc

SEQ ID NO: 8931 - RNA, 22 nt, Homo sapiens
ugugcgcagggagaccucuccc

SEQ ID NO: 8932 - RNA, 22 nt, Homo sapiens
ugagccccugugccgcccccag

SEQ ID NO: 8933 - RNA, 22 nt, Homo sapiens
uggagugugacaaugguguuug

SEQ ID NO: 8934 - RNA, 22 nt, Homo sapiens
ucggauccgucugagcuuggcu

SEQ ID NO: 8935 - RNA, 17 nt, Homo sapiens
ucgccuccuccucuccc

SEQ ID NO: 8936 - RNA, 22 nt, Homo sapiens
uggagagaaaggcaguuccuga

SEQ ID NO: 8937 - RNA, 21 nt, Homo sapiens
cucccacaugcaggguuugca

SEQ ID NO: 8938 - RNA, 22 nt, Homo sapiens
uugggaucauuuugcauccaua

SEQ ID NO: 8939 - RNA, 19 nt, Homo sapiens
gggcgccugugaucccaac

SEQ ID NO: 8940 - RNA, 22 nt, Homo sapiens
uccgagccugggucucccucuu

SEQ ID NO: 8941 - RNA, 23 nt, Homo sapiens
cugggaucuccggggucuugguu

SEQ ID NO: 8942 - RNA, 20 nt, Homo sapiens
ggggagcuguggaagcagua

SEQ ID NO: 8943 - RNA, 17 nt, Homo sapiens
ucgccuccuccucuccc

SEQ ID NO: 8944 - RNA, 23 nt, Homo sapiens
ucuggcuccgugucuucacuccc

SEQ ID NO: 8945 - RNA, 21 nt, Homo sapiens
cggcggggacggcgauugguc

SEQ ID NO: 8946 - RNA, 21 nt, Homo sapiens
ugaguuggccaucugagugag

SEQ ID NO: 8947 - RNA, 25 nt, Homo sapiens
aggggugguguugggacagcuccgu

SEQ ID NO: 8948 - RNA, 22 nt, Homo sapiens
aggcggggcgccgcgggaccgc

SEQ ID NO: 8949 - RNA, 22 nt, Homo sapiens
acuccagccccacagccucagc

SEQ ID NO: 8950 - RNA, 24 nt, Homo sapiens
agccugauuaaacacaugcucuga

SEQ ID NO: 8951 - RNA, 22 nt, Homo sapiens
ccucuuccccuugucucuccag

SEQ ID NO: 8952 - RNA, 22 nt, Homo sapiens
uggguggucuggagauuugugc

SEQ ID NO: 8953 - RNA, 22 nt, Homo sapiens
ugagaacugaauuccauggguu

SEQ ID NO: 8954 - RNA, 22 nt, Homo sapiens
uucaccaccuucuccacccagc

SEQ ID NO: 8955 - RNA, 22 nt, Homo sapiens
aagcugccaguugaagaacugu

SEQ ID NO: 8956 - RNA, 21 nt, Homo sapiens
ccaccaccgugucugacacuu

SEQ ID NO: 8957 - RNA, 23 nt, Homo sapiens
ucccccaggugugauucugauuu

SEQ ID NO: 8958 - RNA, 22 nt, Homo sapiens
aauugcacgguauccaucugua

SEQ ID NO: 8959 - RNA, 23 nt, Homo sapiens
uacuccagagggcgucacucaug

SEQ ID NO: 8960 - RNA, 19 nt, Homo sapiens
ugagcugcuguaccaaaau

SEQ ID NO: 8961 - RNA, 25 nt, Homo sapiens
aggggugguguugggacagcuccgu

SEQ ID NO: 8962 - RNA, 24 nt, Homo sapiens
acugggggcuuucgggcucugcgu

SEQ ID NO: 8963 - RNA, 22 nt, Homo sapiens
ucuucucuguuuuggccaugug

SEQ ID NO: 8964 - RNA, 22 nt, Homo sapiens
uggagugugacaaugguguuug

SEQ ID NO: 8965 - RNA, 20 nt, Homo sapiens
cuuccucgucugucugcccc

SEQ ID NO: 8966 - RNA, 21 nt, Homo sapiens
uccugcgcgucccagaugccc

SEQ ID NO: 8967 - RNA, 23 nt, Homo sapiens
gaacgcgcuucccuauagagggu

SEQ ID NO: 8968 - RNA, 26 nt, Homo sapiens
aaguaguugguuuguaugagaugguu

SEQ ID NO: 8969 - RNA, 22 nt, Homo sapiens
aagcugccaguugaagaacugu

SEQ ID NO: 8970 - RNA, 22 nt, Homo sapiens
uaaugccccuaaaaauccuuau

SEQ ID NO: 8971 - RNA, 19 nt, Homo sapiens
ugagcugcuguaccaaaau

SEQ ID NO: 8972 - RNA, 21 nt, Homo sapiens
aaacuacugaaaaucaaagau

SEQ ID NO: 8973 - RNA, 21 nt, Homo sapiens
uggguuuacguugggagaacu

SEQ ID NO: 8974 - RNA, 23 nt, Homo sapiens
uggugcggagagggcccacagug

SEQ ID NO: 8975 - RNA, 22 nt, Homo sapiens
ugcggggcuagggcuaacagca

SEQ ID NO: 8976 - RNA, 20 nt, Homo sapiens
ucugcaggguuugcuuugag

SEQ ID NO: 8977 - RNA, 21 nt, Homo sapiens
ccccaccuccucucuccucag

SEQ ID NO: 8978 - RNA, 23 nt, Homo sapiens
ucuggcuccgugucuucacuccc

SEQ ID NO: 8979 - RNA, 23 nt, Homo sapiens
caaagugcuuacagugcagguag

SEQ ID NO: 8980 - RNA, 21 nt, Homo sapiens
cggcggggacggcgauugguc

SEQ ID NO: 8981 - RNA, 21 nt, Homo sapiens
ccaguccugugccugccgccu

SEQ ID NO: 8982 - RNA, 23 nt, Homo sapiens
agcuacauugucugcuggguuuc

SEQ ID NO: 8983 - RNA, 22 nt, Homo sapiens
uguaaacauccuacacucagcu

SEQ ID NO: 8984 - RNA, 23 nt, Homo sapiens
ugaggggcagagagcgagacuuu

SEQ ID NO: 8985 - RNA, 22 nt, Homo sapiens
uacugcagacguggcaaucaug

SEQ ID NO: 8986 - RNA, 21 nt, Homo sapiens
uacugcagacaguggcaauca

SEQ ID NO: 8987 - RNA, 22 nt, Homo sapiens
uggugggcacagaaucuggacu

SEQ ID NO: 8988 - RNA, 21 nt, Homo sapiens
ugaguuggccaucugagugag

SEQ ID NO: 8989 - RNA, 19 nt, Homo sapiens
ugggcguaucuguaugcua

SEQ ID NO: 8990 - RNA, 23 nt, Homo sapiens
uaaaucccauggugccuucuccu

SEQ ID NO: 8991 - RNA, 22 nt, Homo sapiens
uccgagccugggucucccucuu

SEQ ID NO: 8992 - RNA, 22 nt, Homo sapiens
uggugggccgcagaacaugugc

SEQ ID NO: 8993 - RNA, 22 nt, Homo sapiens
aggcggggcgccgcgggaccgc

SEQ ID NO: 8994 - RNA, 22 nt, Homo sapiens
uggauuucuuugugaaucacca

SEQ ID NO: 8995 - RNA, 20 nt, Homo sapiens
ggggagcuguggaagcagua

SEQ ID NO: 8996 - RNA, 24 nt, Homo sapiens
uggggagcugaggcucugggggug

SEQ ID NO: 8997 - RNA, 24 nt, Homo sapiens
uggggagcugaggcucugggggug

SEQ ID NO: 8998 - RNA, 22 nt, Homo sapiens
acccgucccguucguccccgga

SEQ ID NO: 8999 - RNA, 22 nt, Homo sapiens
cagugguuuuacccuaugguag

SEQ ID NO: 9000 - RNA, 21 nt, Homo sapiens
cggcggggacggcgauugguc

SEQ ID NO: 9001 - RNA, 21 nt, Homo sapiens
ugacaacuauggaugagcucu

SEQ ID NO: 9002 - RNA, 22 nt, Homo sapiens
aggcggggcgccgcgggaccgc

SEQ ID NO: 9003 - RNA, 22 nt, Homo sapiens
ugcggggcuagggcuaacagca

SEQ ID NO: 9004 - RNA, 22 nt, Homo sapiens
ugcggggcuagggcuaacagca

SEQ ID NO: 9005 - RNA, 21 nt, Homo sapiens
agaggauacccuuuguauguu

SEQ ID NO: 9006 - RNA, 27 nt, Homo sapiens
accuucuuguauaagcacugugcuaaa

SEQ ID NO: 9007 - RNA, 20 nt, Homo sapiens
uaaagagcccuguggagaca

SEQ ID NO: 9008 - RNA, 22 nt, Homo sapiens
cagugcaaugaugaaagggcau

SEQ ID NO: 9009 - RNA, 18 nt, Homo sapiens
cagggaggugaaugugau

SEQ ID NO: 9010 - RNA, 22 nt, Homo sapiens
ugauauguuugauauauuaggu

SEQ ID NO: 9011 - RNA, 22 nt, Homo sapiens
uagguaguuuccuguuguuggg

SEQ ID NO: 9012 - RNA, 23 nt, Homo sapiens
aagugccgccaucuuuugagugu

SEQ ID NO: 9013 - RNA, 21 nt, Homo sapiens
ucacuccucuccucccgucuu

SEQ ID NO: 9014 - RNA, 22 nt, Homo sapiens
ucaggcucaguccccucccgau

SEQ ID NO: 9015 - RNA, 22 nt, Homo sapiens
agacuucccauuugaagguggc

SEQ ID NO: 9016 - RNA, 23 nt, Homo sapiens
acuugggcacugaaacaaugucc

SEQ ID NO: 9017 - RNA, 21 nt, Homo sapiens
uggaggagaaggaaggugaug

SEQ ID NO: 9018 - RNA, 21 nt, Homo sapiens
uaaagugcugacagugcagau

SEQ ID NO: 9019 - RNA, 22 nt, Homo sapiens
acgcccuucccccccuucuuca

SEQ ID NO: 9020 - RNA, 18 nt, Homo sapiens
uccagugcccuccucucc

SEQ ID NO: 9021 - RNA, 22 nt, Homo sapiens
uccagcaucagugauuuuguug

SEQ ID NO: 9022 - RNA, 22 nt, Homo sapiens
cacgcucaugcacacacccaca

SEQ ID NO: 9023 - RNA, 22 nt, Homo sapiens
ugugcgcagggagaccucuccc

SEQ ID NO: 9024 - RNA, 23 nt, Homo sapiens
cacccggcugugugcacaugugc

SEQ ID NO: 9025 - RNA, 23 nt, Homo sapiens
agcagcauuguacagggcuauga

SEQ ID NO: 9026 - RNA, 23 nt, Homo sapiens
agcagcauuguacagggcuauca

SEQ ID NO: 9027 - RNA, 21 nt, Homo sapiens
aagcauucuuucauugguugg

SEQ ID NO: 9028 - RNA, 22 nt, Homo sapiens
ugagccccugugccgcccccag

SEQ ID NO: 9029 - RNA, 22 nt, Homo sapiens
caaagaauucuccuuuugggcu

SEQ ID NO: 9030 - RNA, 22 nt, Homo sapiens
uggcucaguucagcaggaacag

SEQ ID NO: 9031 - RNA, 22 nt, Homo sapiens
gaaagcgcuucccuuugcugga

SEQ ID NO: 9032 - RNA, 22 nt, Homo sapiens
caaagcgcuccccuuuagaggu

SEQ ID NO: 9033 - RNA, 23 nt, Homo sapiens
caaagcgcuucucuuuagagugu

SEQ ID NO: 9034 - RNA, 21 nt, Homo sapiens
caaagcgcuucccuuuggagc

SEQ ID NO: 9035 - RNA, 21 nt, Homo sapiens
aaagcgcuucccuucagagug

SEQ ID NO: 9036 - RNA, 21 nt, Homo sapiens
aaagcgcuucccuucagagug

SEQ ID NO: 9037 - RNA, 21 nt, Homo sapiens
gaaagcgcuucucuuuagagg

SEQ ID NO: 9038 - RNA, 19 nt, Homo sapiens
ugagcugcuguaccaaaau

SEQ ID NO: 9039 - RNA, 21 nt, Homo sapiens
cuucuugugcucuaggauugu

SEQ ID NO: 9040 - RNA, 19 nt, Homo sapiens
aagcagcugccucugaggc

SEQ ID NO: 9041 - RNA, 21 nt, Homo sapiens
uacucaaaaagcugucaguca

SEQ ID NO: 9042 - RNA, 20 nt, Homo sapiens
ugagcccuguccucccgcag

SEQ ID NO: 9043 - RNA, 18 nt, Homo sapiens
aucccaccucugccacca

SEQ ID NO: 9044 - RNA, 22 nt, Homo sapiens
ucugggcaacaaagugagaccu

SEQ ID NO: 9045 - RNA, 22 nt, Homo sapiens
uguaaacauccuacacucagcu

SEQ ID NO: 9046 - RNA, 21 nt, Homo sapiens
acuggacuuggagucagaagg

SEQ ID NO: 9047 - RNA, 22 nt, Homo sapiens
acuggacuuagggucagaaggc

SEQ ID NO: 9048 - RNA, 22 nt, Homo sapiens
ccucccacacccaaggcuugca

SEQ ID NO: 9049 - RNA, 23 nt, Homo sapiens
gacacgggcgacagcugcggccc

SEQ ID NO: 9050 - RNA, 25 nt, Homo sapiens
gcugggcagggcuucugagcuccuu

SEQ ID NO: 9051 - RNA, 22 nt, Homo sapiens
agacuucccauuugaagguggc

SEQ ID NO: 9052 - RNA, 20 nt, Homo sapiens
ggggagcuguggaagcagua

SEQ ID NO: 9053 - RNA, 21 nt, Homo sapiens
cauaaaguagaaagcacuacu

SEQ ID NO: 9054 - RNA, 23 nt, Homo sapiens
uaaggugcaucuagugcagauag

SEQ ID NO: 9055 - RNA, 23 nt, Homo sapiens
cuguaauauaaauuuaauuuauu

SEQ ID NO: 9056 - RNA, 23 nt, Homo sapiens
uagugcaauauugcuuauagggu

SEQ ID NO: 9057 - RNA, 21 nt, Homo sapiens
gugucuuuugcucugcaguca

SEQ ID NO: 9058 - RNA, 22 nt, Homo sapiens
aaaaguauuugcggguuuuguc

SEQ ID NO: 9059 - RNA, 22 nt, Homo sapiens
acaguagagggaggaaucgcag

SEQ ID NO: 9060 - RNA, 23 nt, Homo sapiens
cggcccgggcugcugcuguuccu

SEQ ID NO: 9061 - RNA, 22 nt, Homo sapiens
ugagaaccacgucugcucugag

SEQ ID NO: 9062 - RNA, 21 nt, Homo sapiens
ccgucgccgccacccgagccg

SEQ ID NO: 9063 - RNA, 21 nt, Homo sapiens
cccggagccaggaugcagcuc

SEQ ID NO: 9064 - RNA, 17 nt, Homo sapiens
ucgccuccuccucuccc

SEQ ID NO: 9065 - RNA, 21 nt, Homo sapiens
cggcggggacggcgauugguc

SEQ ID NO: 9066 - RNA, 21 nt, Homo sapiens
gccccugggccuauccuagaa

SEQ ID NO: 9067 - RNA, 23 nt, Homo sapiens
ugaggggcagagagcgagacuuu

SEQ ID NO: 9068 - RNA, 22 nt, Homo sapiens
uccgagccugggucucccucuu

SEQ ID NO: 9069 - RNA, 22 nt, Homo sapiens
aggcggggcgccgcgggaccgc

SEQ ID NO: 9070 - RNA, 17 nt, Homo sapiens
ucucgcuggggccucca

SEQ ID NO: 9071 - RNA, 22 nt, Homo sapiens
ugcggggcuagggcuaacagca

SEQ ID NO: 9072 - RNA, 23 nt, Homo sapiens
uggaguccaggaaucugcauuuu

SEQ ID NO: 9073 - RNA, 18 nt, Homo sapiens
ugaggcaguagauugaau

SEQ ID NO: 9074 - RNA, 22 nt, Homo sapiens
cccugugcccggcccacuucug

SEQ ID NO: 9075 - RNA, 20 nt, Homo sapiens
ccuccugcccuccuugcugu

SEQ ID NO: 9076 - RNA, 21 nt, Homo sapiens
aggggugcuaucugugauuga

SEQ ID NO: 9077 - RNA, 22 nt, Homo sapiens
uggcagugucuuagcugguugu

SEQ ID NO: 9078 - RNA, 22 nt, Homo sapiens
caaucacuaacuccacugccau

SEQ ID NO: 9079 - RNA, 23 nt, Homo sapiens
aggcaguguaguuagcugauugc

SEQ ID NO: 9080 - RNA, 22 nt, Homo sapiens
uggcaguguauuguuagcuggu

SEQ ID NO: 9081 - RNA, 22 nt, Homo sapiens
aggcaguguauuguuagcuggc

SEQ ID NO: 9082 - RNA, 21 nt, Homo sapiens
aggaggcagcgcucucaggac

SEQ ID NO: 9083 - RNA, 20 nt, Homo sapiens
ucugcaggguuugcuuugag

SEQ ID NO: 9084 - RNA, 22 nt, Homo sapiens
ucggauccgucugagcuuggcu

SEQ ID NO: 9085 - RNA, 18 nt, Homo sapiens
cagggaggugaaugugau

SEQ ID NO: 9086 - RNA, 23 nt, Homo sapiens
ucuggcuccgugucuucacuccc

SEQ ID NO: 9087 - RNA, 21 nt, Homo sapiens
cggcggggacggcgauugguc

SEQ ID NO: 9088 - RNA, 23 nt, Homo sapiens
gcaaagcacacggccugcagaga

SEQ ID NO: 9089 - RNA, 22 nt, Homo sapiens
uuauaaagcaaugagacugauu

SEQ ID NO: 9090 - RNA, 22 nt, Homo sapiens
aagacgggaggaaagaagggag

SEQ ID NO: 9091 - RNA, 22 nt, Homo sapiens
aguggggaacccuuccaugagg

SEQ ID NO: 9092 - RNA, 19 nt, Homo sapiens
aggcugcggaauucaggac

SEQ ID NO: 9093 - RNA, 19 nt, Homo sapiens
ucuaggcugguacugcuga

SEQ ID NO: 9094 - RNA, 22 nt, Homo sapiens
aggcggggcgccgcgggaccgc

SEQ ID NO: 9095 - RNA, 21 nt, Homo sapiens
uggaggagaaggaaggugaug

SEQ ID NO: 9096 - RNA, 22 nt, Homo sapiens
uggugguuuacaaaguaauuca

SEQ ID NO: 9097 - RNA, 22 nt, Homo sapiens
aacccguagauccgaacuugug

SEQ ID NO: 9098 - RNA, 22 nt, Homo sapiens
uggagugugacaaugguguuug

SEQ ID NO: 9099 - RNA, 23 nt, Homo sapiens
ucuggcuccgugucuucacuccc

SEQ ID NO: 9100 - RNA, 21 nt, Homo sapiens
cggcggggacggcgauugguc

SEQ ID NO: 9101 - RNA, 21 nt, Homo sapiens
ccaguccugugccugccgccu

SEQ ID NO: 9102 - RNA, 25 nt, Homo sapiens
cccccacaaccgcgcuugacuagcu

SEQ ID NO: 9103 - RNA, 21 nt, Homo sapiens
gccccugggccuauccuagaa

SEQ ID NO: 9104 - RNA, 22 nt, Homo sapiens
aguggggaacccuuccaugagg

SEQ ID NO: 9105 - RNA, 22 nt, Homo sapiens
aggcggggcgccgcgggaccgc

SEQ ID NO: 9106 - RNA, 22 nt, Homo sapiens
ccucuuccccuugucucuccag

SEQ ID NO: 9107 - RNA, 22 nt, Homo sapiens
augggugaauuuguagaaggau

SEQ ID NO: 9108 - RNA, 17 nt, Homo sapiens
gugggggagaggcuguc

SEQ ID NO: 9109 - RNA, 18 nt, Homo sapiens
ugaggcaguagauugaau

SEQ ID NO: 9110 - RNA, 23 nt, Homo sapiens
uaaggugcaucuagugcagauag

SEQ ID NO: 9111 - RNA, 23 nt, Homo sapiens
uaaggugcaucuagugcaguuag

SEQ ID NO: 9112 - RNA, 23 nt, Homo sapiens
ugucugcccgcaugccugccucu

SEQ ID NO: 9113 - RNA, 22 nt, Homo sapiens
caaucacuaacuccacugccau

SEQ ID NO: 9114 - RNA, 22 nt, Homo sapiens
uugcauauguaggaugucccau

SEQ ID NO: 9115 - RNA, 23 nt, Homo sapiens
uaauccuugcuaccugggugaga

SEQ ID NO: 9116 - RNA, 22 nt, Homo sapiens
aaugcacccgggcaaggauucu

SEQ ID NO: 9117 - RNA, 22 nt, Homo sapiens
aaugcaccugggcaaggauuca

SEQ ID NO: 9118 - RNA, 24 nt, Homo sapiens
gaccuggacauguuugugcccagu

SEQ ID NO: 9119 - RNA, 21 nt, Homo sapiens
agaccuggcccagaccucagc

SEQ ID NO: 9120 - RNA, 21 nt, Homo sapiens
ccuggaaacacugagguugug

SEQ ID NO: 9121 - RNA, 21 nt, Homo sapiens
agaggauacccuuuguauguu

SEQ ID NO: 9122 - RNA, 21 nt, Homo sapiens
uggcagggaggcugggagggg

SEQ ID NO: 9123 - RNA, 22 nt, Homo sapiens
acaggugagguucuugggagcc

SEQ ID NO: 9124 - RNA, 24 nt, Homo sapiens
ccagacagaauucuaugcacuuuc

SEQ ID NO: 9125 - RNA, 22 nt, Homo sapiens
ucugcccccuccgcugcugcca

SEQ ID NO: 9126 - RNA, 22 nt, Homo sapiens
uguaacagcaacuccaugugga

SEQ ID NO: 9127 - RNA, 22 nt, Homo sapiens
uguaaacauccucgacuggaag

SEQ ID NO: 9128 - RNA, 22 nt, Homo sapiens
uguaaacauccuacacucagcu

SEQ ID NO: 9129 - RNA, 23 nt, Homo sapiens
uguaaacauccuacacucucagc

SEQ ID NO: 9130 - RNA, 22 nt, Homo sapiens
uguaaacauccccgacuggaag

SEQ ID NO: 9131 - RNA, 22 nt, Homo sapiens
uguaaacauccuugacuggaag

SEQ ID NO: 9132 - RNA, 20 nt, Homo sapiens
acugccccaggugcugcugg

SEQ ID NO: 9133 - RNA, 23 nt, Homo sapiens
ucccuguccuccaggagcucacg

SEQ ID NO: 9134 - RNA, 23 nt, Homo sapiens
ucuuggaguaggucauugggugg

SEQ ID NO: 9135 - RNA, 21 nt, Homo sapiens
cggggcagcucaguacaggau

SEQ ID NO: 9136 - RNA, 25 nt, Homo sapiens
aggggugguguugggacagcuccgu

SEQ ID NO: 9137 - RNA, 22 nt, Homo sapiens
acuccagccccacagccucagc

SEQ ID NO: 9138 - RNA, 18 nt, Homo sapiens
aucccaccucugccacca

SEQ ID NO: 9139 - RNA, 22 nt, Homo sapiens
ugagaacugaauuccauggguu

SEQ ID NO: 9140 - RNA, 22 nt, Homo sapiens
ugagaacugaauuccauaggcu

SEQ ID NO: 9141 - RNA, 22 nt, Homo sapiens
gugugcggaaaugcuucugcua

SEQ ID NO: 9142 - RNA, 23 nt, Homo sapiens
ucccccaggugugauucugauuu

SEQ ID NO: 9143 - RNA, 25 nt, Homo sapiens
aggggugguguugggacagcuccgu

SEQ ID NO: 9144 - RNA, 24 nt, Homo sapiens
acugggggcuuucgggcucugcgu

SEQ ID NO: 9145 - RNA, 21 nt, Homo sapiens
ucguggccuggucuccauuau

SEQ ID NO: 9146 - RNA, 20 nt, Homo sapiens
ucugcaggguuugcuuugag

SEQ ID NO: 9147 - RNA, 20 nt, Homo sapiens
ucugcaggguuugcuuugag

SEQ ID NO: 9148 - RNA, 23 nt, Homo sapiens
ugaguaccgccaugucuguuggg

SEQ ID NO: 9149 - RNA, 22 nt, Homo sapiens
aacuggccuacaaagucccagu

SEQ ID NO: 9150 - RNA, 22 nt, Homo sapiens
aacuggcccucaaagucccgcu

SEQ ID NO: 9151 - RNA, 22 nt, Homo sapiens
gguggcccggccgugccugagg

SEQ ID NO: 9152 - RNA, 20 nt, Homo sapiens
accaggaggcugaggccccu

SEQ ID NO: 9153 - RNA, 22 nt, Homo sapiens
uagcagcacauaaugguuugug

SEQ ID NO: 9154 - RNA, 22 nt, Homo sapiens
uagcagcacaucaugguuuaca

SEQ ID NO: 9155 - RNA, 22 nt, Homo sapiens
uagcagcacguaaauauuggcg

SEQ ID NO: 9156 - RNA, 23 nt, Homo sapiens
uaaggugcaucuagugcagauag

SEQ ID NO: 9157 - RNA, 21 nt, Homo sapiens
uagcagcacagaaauauuggc

SEQ ID NO: 9158 - RNA, 20 nt, Homo sapiens
ccuccugcccuccuugcugu

SEQ ID NO: 9159 - RNA, 22 nt, Homo sapiens
acagcaggcacagacaggcagu

SEQ ID NO: 9160 - RNA, 22 nt, Homo sapiens
cauugcacuugucucggucuga

SEQ ID NO: 9161 - RNA, 22 nt, Homo sapiens
gccugcugggguggaaccuggu

SEQ ID NO: 9162 - RNA, 22 nt, Homo sapiens
cagcagcaauucauguuuugaa

SEQ ID NO: 9163 - RNA, 21 nt, Homo sapiens
cagcagcacacugugguuugu

SEQ ID NO: 9164 - RNA, 23 nt, Homo sapiens
aucgcugcgguugcgagcgcugu

SEQ ID NO: 9165 - RNA, 25 nt, Homo sapiens
ggcggagggaaguagguccguuggu

SEQ ID NO: 9166 - RNA, 21 nt, Homo sapiens
uggaggagaaggaaggugaug

SEQ ID NO: 9167 - RNA, 22 nt, Homo sapiens
aggcagcgggguguaguggaua

SEQ ID NO: 9168 - RNA, 22 nt, Homo sapiens
auccgcgcucugacucucugcc

SEQ ID NO: 9169 - RNA, 23 nt, Homo sapiens
aaaagugcuuacagugcagguag

SEQ ID NO: 9170 - RNA, 22 nt, Homo sapiens
cuccugagccauucugagccuc

SEQ ID NO: 9171 - RNA, 18 nt, Homo sapiens
cgggcguggugguggggg

SEQ ID NO: 9172 - RNA, 23 nt, Homo sapiens
uuauugcuuaagaauacgcguag

SEQ ID NO: 9173 - RNA, 23 nt, Homo sapiens
uaaggugcaucuagugcaguuag

SEQ ID NO: 9174 - RNA, 23 nt, Homo sapiens
ugugcaaaucuaugcaaaacuga

SEQ ID NO: 9175 - RNA, 22 nt, Homo sapiens
aacaauauccuggugcugagug

SEQ ID NO: 9176 - RNA, 22 nt, Homo sapiens
agagguaguagguugcauaguu

SEQ ID NO: 9177 - RNA, 21 nt, Homo sapiens
agaccuggcccagaccucagc

SEQ ID NO: 9178 - RNA, 22 nt, Homo sapiens
uggagagaaaggcaguuccuga

SEQ ID NO: 9179 - RNA, 21 nt, Homo sapiens
cggcggggacggcgauugguc

SEQ ID NO: 9180 - RNA, 21 nt, Homo sapiens
cggcggggacggcgauugguc

SEQ ID NO: 9181 - RNA, 22 nt, Homo sapiens
cgcaggggccgggugcucaccg

SEQ ID NO: 9182 - RNA, 21 nt, Homo sapiens
ccacaccguaucugacacuuu

SEQ ID NO: 9183 - RNA, 23 nt, Homo sapiens
aucaacagacauuaauugggcgc

SEQ ID NO: 9184 - RNA, 22 nt, Homo sapiens
cauugcacuugucucggucuga

SEQ ID NO: 9185 - RNA, 23 nt, Homo sapiens
cgcauccccuagggcauuggugu

SEQ ID NO: 9186 - RNA, 23 nt, Homo sapiens
ucccccaggugugauucugauuu

SEQ ID NO: 9187 - RNA, 22 nt, Homo sapiens
agaggcuggccgugaugaauuc

SEQ ID NO: 9188 - RNA, 22 nt, Homo sapiens
cgucaacacuugcugguuuccu

SEQ ID NO: 9189 - RNA, 24 nt, Homo sapiens
acugggggcuuucgggcucugcgu

SEQ ID NO: 9190 - RNA, 22 nt, Homo sapiens
aggcggggcgccgcgggaccgc

SEQ ID NO: 9191 - RNA, 22 nt, Homo sapiens
aggcggggcgccgcgggaccgc

SEQ ID NO: 9192 - RNA, 22 nt, Homo sapiens
ugugcgcagggagaccucuccc

SEQ ID NO: 9193 - RNA, 21 nt, Homo sapiens
uucacaguggcuaaguuccgc

SEQ ID NO: 9194 - RNA, 22 nt, Homo sapiens
aaggagcucacagucuauugag

SEQ ID NO: 9195 - RNA, 21 nt, Homo sapiens
cagcagcacacugugguuugu

SEQ ID NO: 9196 - RNA, 22 nt, Homo sapiens
ucagcaaacauuuauugugugc

SEQ ID NO: 9197 - RNA, 21 nt, Homo sapiens
ugagcuaaaugugugcuggga

SEQ ID NO: 9198 - RNA, 23 nt, Homo sapiens
aaggagcuuacaaucuagcuggg

SEQ ID NO: 9199 - RNA, 21 nt, Homo sapiens
uggaggagaaggaaggugaug

SEQ ID NO: 9200 - RNA, 22 nt, Homo sapiens
uggugguuuacaaaguaauuca

SEQ ID NO: 9201 - RNA, 21 nt, Homo sapiens
ccccaccuccucucuccucag

SEQ ID NO: 9202 - RNA, 22 nt, Homo sapiens
uggagugugacaaugguguuug

SEQ ID NO: 9203 - RNA, 22 nt, Homo sapiens
acccgucccguucguccccgga

SEQ ID NO: 9204 - RNA, 18 nt, Homo sapiens
aucccaccucugccacca

SEQ ID NO: 9205 - RNA, 23 nt, Homo sapiens
ucuggcuccgugucuucacuccc

SEQ ID NO: 9206 - RNA, 23 nt, Homo sapiens
uaaggugcaucuagugcagauag

SEQ ID NO: 9207 - RNA, 21 nt, Homo sapiens
cggcggggacggcgauugguc

SEQ ID NO: 9208 - RNA, 22 nt, Homo sapiens
cauugcacuugucucggucuga

SEQ ID NO: 9209 - RNA, 21 nt, Homo sapiens
agggcccccccucaauccugu

SEQ ID NO: 9210 - RNA, 21 nt, Homo sapiens
agggcccccccucaauccugu

SEQ ID NO: 9211 - RNA, 22 nt, Homo sapiens
uguaaacauccuacacucagcu

SEQ ID NO: 9212 - RNA, 23 nt, Homo sapiens
ucccccaggugugauucugauuu

SEQ ID NO: 9213 - RNA, 23 nt, Homo sapiens
ugaggggcagagagcgagacuuu

SEQ ID NO: 9214 - RNA, 23 nt, Homo sapiens
ugaggggcagagagcgagacuuu

SEQ ID NO: 9215 - RNA, 22 nt, Homo sapiens
ccucccacacccaaggcuugca

SEQ ID NO: 9216 - RNA, 24 nt, Homo sapiens
acugggggcuuucgggcucugcgu

SEQ ID NO: 9217 - RNA, 25 nt, Homo sapiens
ggcggagggaaguagguccguuggu

SEQ ID NO: 9218 - RNA, 24 nt, Homo sapiens
ugccugggucucuggccugcgcgu

SEQ ID NO: 9219 - RNA, 22 nt, Homo sapiens
aggcggggcgccgcgggaccgc

SEQ ID NO: 9220 - RNA, 22 nt, Homo sapiens
ugcggggcuagggcuaacagca

SEQ ID NO: 9221 - RNA, 21 nt, Homo sapiens
uggaggagaaggaaggugaug

SEQ ID NO: 9222 - RNA, 21 nt, Homo sapiens
agaggauacccuuuguauguu

SEQ ID NO: 9223 - RNA, 22 nt, Homo sapiens
ucguaccgugaguaauaaugcg

SEQ ID NO: 9224 - RNA, 22 nt, Homo sapiens
cucccacugcuucacuugacua

SEQ ID NO: 9225 - RNA, 23 nt, Homo sapiens
gaagugcuucgauuuuggggugu

SEQ ID NO: 9226 - RNA, 22 nt, Homo sapiens
agucauuggaggguuugagcag

SEQ ID NO: 9227 - RNA, 23 nt, Homo sapiens
aaggagcuuacaaucuagcuggg

SEQ ID NO: 9228 - RNA, 22 nt, Homo sapiens
guggguacggcccagugggggg

SEQ ID NO: 9229 - RNA, 17 nt, Homo sapiens
ucauauugcuucuuucu

SEQ ID NO: 9230 - RNA, 22 nt, Homo sapiens
ugagaacugaauuccauggguu

SEQ ID NO: 9231 - RNA, 22 nt, Homo sapiens
uagcagcacaucaugguuuaca

SEQ ID NO: 9232 - RNA, 22 nt, Homo sapiens
ucaggccaggcacaguggcuca

SEQ ID NO: 9233 - RNA, 23 nt, Homo sapiens
uaaagugcuuauagugcagguag

SEQ ID NO: 9234 - RNA, 19 nt, Homo sapiens
gugucugcuuccuguggga

SEQ ID NO: 9235 - RNA, 24 nt, Homo sapiens
ugccugggucucuggccugcgcgu

SEQ ID NO: 9236 - RNA, 23 nt, Homo sapiens
ucuuugguuaucuagcuguauga

SEQ ID NO: 9237 - RNA, 22 nt, Homo sapiens
ucaccagcccuguguucccuag

SEQ ID NO: 9238 - RNA, 23 nt, Homo sapiens
agcugguguugugaaucaggccg

SEQ ID NO: 9239 - RNA, 21 nt, Homo sapiens
ccaguccugugccugccgccu

SEQ ID NO: 9240 - RNA, 22 nt, Homo sapiens
uacccagagcaugcagugugaa

SEQ ID NO: 9241 - RNA, 20 nt, Homo sapiens
auuccuagaaauuguucaua

SEQ ID NO: 9242 - RNA, 22 nt, Homo sapiens
ugaaggucuacugugugccagg

SEQ ID NO: 9243 - RNA, 22 nt, Homo sapiens
uggugggcacagaaucuggacu

SEQ ID NO: 9244 - RNA, 22 nt, Homo sapiens
uggugggcacagaaucuggacu

SEQ ID NO: 9245 - RNA, 19 nt, Homo sapiens
aggcugcggaauucaggac

SEQ ID NO: 9246 - RNA, 22 nt, Homo sapiens
uggugggccgcagaacaugugc

SEQ ID NO: 9247 - RNA, 22 nt, Homo sapiens
uggugggccgcagaacaugugc

SEQ ID NO: 9248 - RNA, 21 nt, Homo sapiens
uggacugcccugaucuggaga

SEQ ID NO: 9249 - RNA, 22 nt, Homo sapiens
uggguggucuggagauuugugc

SEQ ID NO: 9250 - RNA, 22 nt, Homo sapiens
acucggcguggcgucggucgug

SEQ ID NO: 9251 - RNA, 19 nt, Homo sapiens
gaugaugcugcugaugcug

SEQ ID NO: 9252 - RNA, 22 nt, Homo sapiens
cucggcgcggggcgcgggcucc

SEQ ID NO: 9253 - RNA, 21 nt, Homo sapiens
ccaguccugugccugccgccu

SEQ ID NO: 9254 - RNA, 22 nt, Homo sapiens
ucaggccaggcacaguggcuca

SEQ ID NO: 9255 - RNA, 21 nt, Homo sapiens
ccaccaccgugucugacacuu

SEQ ID NO: 9256 - RNA, 22 nt, Homo sapiens
uggcucaguucagcaggaacag

SEQ ID NO: 9257 - RNA, 22 nt, Homo sapiens
uagcaccaucugaaaucgguua

SEQ ID NO: 9258 - RNA, 23 nt, Homo sapiens
uagcaccauuugaaaucaguguu

SEQ ID NO: 9259 - RNA, 22 nt, Homo sapiens
uagcaccauuugaaaucgguua

SEQ ID NO: 9260 - RNA, 22 nt, Homo sapiens
uggcagugucuuagcugguugu

SEQ ID NO: 9261 - RNA, 22 nt, Homo sapiens
caaucacuaacuccacugccau

SEQ ID NO: 9262 - RNA, 22 nt, Homo sapiens
ucaggcucaguccccucccgau

SEQ ID NO: 9263 - RNA, 25 nt, Homo sapiens
aggggugguguugggacagcuccgu

SEQ ID NO: 9264 - RNA, 21 nt, Homo sapiens
guggcugcacucacuuccuuc

SEQ ID NO: 9265 - RNA, 21 nt, Homo sapiens
aaggcagggcccccgcucccc

SEQ ID NO: 9266 - RNA, 22 nt, Homo sapiens
uggagugugacaaugguguuug

SEQ ID NO: 9267 - RNA, 23 nt, Homo sapiens
cucucaccacugcccucccacag

SEQ ID NO: 9268 - RNA, 17 nt, Homo sapiens
ucgccuccuccucuccc

SEQ ID NO: 9269 - RNA, 21 nt, Homo sapiens
ucgaggagcucacagucuagu

SEQ ID NO: 9270 - RNA, 21 nt, Homo sapiens
cggcggggacggcgauugguc

SEQ ID NO: 9271 - RNA, 22 nt, Homo sapiens
cccugugcccggcccacuucug

SEQ ID NO: 9272 - RNA, 22 nt, Homo sapiens
uggugggcacagaaucuggacu

SEQ ID NO: 9273 - RNA, 25 nt, Homo sapiens
aggggugguguugggacagcuccgu

SEQ ID NO: 9274 - RNA, 22 nt, Homo sapiens
uggugggccgcagaacaugugc

SEQ ID NO: 9275 - RNA, 22 nt, Homo sapiens
aggcggggcgccgcgggaccgc

SEQ ID NO: 9276 - RNA, 21 nt, Homo sapiens
uggaggagaaggaaggugaug

SEQ ID NO: 9277 - RNA, 20 nt, Homo sapiens
ggggagcuguggaagcagua

SEQ ID NO: 9278 - RNA, 17 nt, Homo sapiens
ucccaccgcugccaccc

SEQ ID NO: 9279 - RNA, 23 nt, Homo sapiens
ucuggcuccgugucuucacuccc

SEQ ID NO: 9280 - RNA, 22 nt, Homo sapiens
uggagagaaaggcaguuccuga

SEQ ID NO: 9281 - RNA, 21 nt, Homo sapiens
cggcggggacggcgauugguc

SEQ ID NO: 9282 - RNA, 21 nt, Homo sapiens
cggcggggacggcgauugguc

SEQ ID NO: 9283 - RNA, 22 nt, Homo sapiens
cccugugcccggcccacuucug

SEQ ID NO: 9284 - RNA, 22 nt, Homo sapiens
aaaaguaauugcggauuuugcc

SEQ ID NO: 9285 - RNA, 22 nt, Homo sapiens
cauugcacuugucucggucuga

SEQ ID NO: 9286 - RNA, 21 nt, Homo sapiens
aggggugcuaucugugauuga

SEQ ID NO: 9287 - RNA, 22 nt, Homo sapiens
aguggggaacccuuccaugagg

SEQ ID NO: 9288 - RNA, 22 nt, Homo sapiens
aggcggggcgccgcgggaccgc

SEQ ID NO: 9289 - RNA, 22 nt, Homo sapiens
aggcggggcgccgcgggaccgc

SEQ ID NO: 9290 - RNA, 23 nt, Homo sapiens
uggugcggagagggcccacagug

SEQ ID NO: 9291 - RNA, 22 nt, Homo sapiens
ugcggggcuagggcuaacagca

SEQ ID NO: 9292 - RNA, 22 nt, Homo sapiens
ugcggggcuagggcuaacagca

SEQ ID NO: 9293 - RNA, 20 nt, Homo sapiens
ggggagcuguggaagcagua

SEQ ID NO: 9294 - RNA, 22 nt, Homo sapiens
aaaucucugcaggcaaauguga

SEQ ID NO: 9295 - RNA, 21 nt, Homo sapiens
ugacaacuauggaugagcucu

SEQ ID NO: 9296 - RNA, 21 nt, Homo sapiens
uugaaaggcuauuucuugguc

SEQ ID NO: 9297 - RNA, 21 nt, Homo sapiens
ugagcuaaaugugugcuggga

SEQ ID NO: 9298 - RNA, 22 nt, Homo sapiens
gucccucuccaaaugugucuug

SEQ ID NO: 9299 - RNA, 21 nt, Homo sapiens
uggaggagaaggaaggugaug

SEQ ID NO: 9300 - RNA, 24 nt, Homo sapiens
uggggagcugaggcucugggggug

SEQ ID NO: 9301 - RNA, 22 nt, Homo sapiens
uggagugugacaaugguguuug

SEQ ID NO: 9302 - RNA, 22 nt, Homo sapiens
ugcccuguggacucaguucugg

SEQ ID NO: 9303 - RNA, 21 nt, Homo sapiens
cggcggggacggcgauugguc

SEQ ID NO: 9304 - RNA, 22 nt, Homo sapiens
cccugugcccggcccacuucug

SEQ ID NO: 9305 - RNA, 22 nt, Homo sapiens
ucaggccaggcacaguggcuca

SEQ ID NO: 9306 - RNA, 22 nt, Homo sapiens
uguaaacauccuacacucagcu

SEQ ID NO: 9307 - RNA, 22 nt, Homo sapiens
caaaacuggcaauuacuuuugc

SEQ ID NO: 9308 - RNA, 22 nt, Homo sapiens
aaaaacugagacuacuuuugca

SEQ ID NO: 9309 - RNA, 19 nt, Homo sapiens
aaaaacuguaauuacuuuu

SEQ ID NO: 9310 - RNA, 25 nt, Homo sapiens
aggggugguguugggacagcuccgu

SEQ ID NO: 9311 - RNA, 22 nt, Homo sapiens
aggcggggcgccgcgggaccgc

SEQ ID NO: 9312 - RNA, 22 nt, Homo sapiens
ugcggggcuagggcuaacagca

SEQ ID NO: 9313 - RNA, 23 nt, Homo sapiens
cacccggcugugugcacaugugc

SEQ ID NO: 9314 - RNA, 23 nt, Homo sapiens
uggaguccaggaaucugcauuuu

SEQ ID NO: 9315 - RNA, 24 nt, Homo sapiens
cugaagugauguguaacugaucag

SEQ ID NO: 9316 - RNA, 23 nt, Homo sapiens
caguaacaaagauucauccuugu

SEQ ID NO: 9317 - RNA, 21 nt, Homo sapiens
uggacugcccugaucuggaga

SEQ ID NO: 9318 - RNA, 18 nt, Homo sapiens
gcaugggugguucagugg

SEQ ID NO: 9319 - RNA, 22 nt, Homo sapiens
ugauauguuugauauauuaggu

SEQ ID NO: 9320 - RNA, 21 nt, Homo sapiens
aucacauugccagggauuucc

SEQ ID NO: 9321 - RNA, 21 nt, Homo sapiens
aucacauugccagggauuacc

SEQ ID NO: 9322 - RNA, 20 nt, Homo sapiens
ccucugggcccuuccuccag

SEQ ID NO: 9323 - RNA, 22 nt, Homo sapiens
ucucugggccugugucuuaggc

SEQ ID NO: 9324 - RNA, 22 nt, Homo sapiens
caaucacuaacuccacugccau

SEQ ID NO: 9325 - RNA, 23 nt, Homo sapiens
ucccccaggugugauucugauuu

SEQ ID NO: 9326 - RNA, 24 nt, Homo sapiens
acugggggcuuucgggcucugcgu

SEQ ID NO: 9327 - RNA, 18 nt, Homo sapiens
aucccaccucugccacca

SEQ ID NO: 9328 - RNA, 19 nt, Homo sapiens
gaugaugcugcugaugcug

SEQ ID NO: 9329 - RNA, 22 nt, Homo sapiens
cccugugcccggcccacuucug

SEQ ID NO: 9330 - RNA, 23 nt, Homo sapiens
caacggaaucccaaaagcagcug

SEQ ID NO: 9331 - RNA, 25 nt, Homo sapiens
aggggugguguugggacagcuccgu

SEQ ID NO: 9332 - RNA, 21 nt, Homo sapiens
agggggaaaguucuauagucc

SEQ ID NO: 9333 - RNA, 22 nt, Homo sapiens
caaagugccucccuuuagagug

SEQ ID NO: 9334 - RNA, 20 nt, Homo sapiens
ucacaccugccucgcccccc

SEQ ID NO: 9335 - RNA, 22 nt, Homo sapiens
cagugguuuuacccuaugguag

SEQ ID NO: 9336 - RNA, 21 nt, Homo sapiens
uugugcuugaucuaaccaugu

SEQ ID NO: 9337 - RNA, 20 nt, Homo sapiens
gugcauugcuguugcauugc

SEQ ID NO: 9338 - RNA, 23 nt, Homo sapiens
cacucagccuugagggcacuuuc

SEQ ID NO: 9339 - RNA, 22 nt, Homo sapiens
gagugccuucuuuuggagcguu

SEQ ID NO: 9340 - RNA, 22 nt, Homo sapiens
aagugccuccuuuuagaguguu

SEQ ID NO: 9341 - RNA, 23 nt, Homo sapiens
ugagugugugugugugagugugu

SEQ ID NO: 9342 - RNA, 22 nt, Homo sapiens
cacacacugcaauuacuuuugc

SEQ ID NO: 9343 - RNA, 25 nt, Homo sapiens
aggggugguguugggacagcuccgu

SEQ ID NO: 9344 - RNA, 22 nt, Homo sapiens
ugugcgcagggagaccucuccc

SEQ ID NO: 9345 - RNA, 23 nt, Homo sapiens
ucuggcuccgugucuucacuccc

SEQ ID NO: 9346 - RNA, 22 nt, Homo sapiens
cauugcacuugucucggucuga

SEQ ID NO: 9347 - RNA, 23 nt, Homo sapiens
ucccccaggugugauucugauuu

SEQ ID NO: 9348 - RNA, 22 nt, Homo sapiens
cgucaacacuugcugguuuccu

SEQ ID NO: 9349 - RNA, 23 nt, Homo sapiens
uucauuugguauaaaccgcgauu

SEQ ID NO: 9350 - RNA, 24 nt, Homo sapiens
acugggggcuuucgggcucugcgu

SEQ ID NO: 9351 - RNA, 22 nt, Homo sapiens
cuugguucagggagggucccca

SEQ ID NO: 9352 - RNA, 24 nt, Homo sapiens
ugccugggucucuggccugcgcgu

SEQ ID NO: 9353 - RNA, 20 nt, Homo sapiens
cggcucugggucugugggga

SEQ ID NO: 9354 - RNA, 21 nt, Homo sapiens
uggaggagaaggaaggugaug

SEQ ID NO: 9355 - RNA, 22 nt, Homo sapiens
uggguggucuggagauuugugc

SEQ ID NO: 9356 - RNA, 25 nt, Homo sapiens
aggggugguguugggacagcuccgu

SEQ ID NO: 9357 - RNA, 23 nt, Homo sapiens
uauucauuuauccccagccuaca

SEQ ID NO: 9358 - RNA, 22 nt, Homo sapiens
auccgcgcucugacucucugcc

SEQ ID NO: 9359 - RNA, 21 nt, Homo sapiens
ucguggccuggucuccauuau

SEQ ID NO: 9360 - RNA, 19 nt, Homo sapiens
gaugaugcugcugaugcug

SEQ ID NO: 9361 - RNA, 18 nt, Homo sapiens
cagggaggugaaugugau

SEQ ID NO: 9362 - RNA, 23 nt, Homo sapiens
ucuggcuccgugucuucacuccc

SEQ ID NO: 9363 - RNA, 23 nt, Homo sapiens
uaaggugcaucuagugcagauag

SEQ ID NO: 9364 - RNA, 22 nt, Homo sapiens
cccugugcccggcccacuucug

SEQ ID NO: 9365 - RNA, 20 nt, Homo sapiens
ccccagggcgacgcggcggg

SEQ ID NO: 9366 - RNA, 22 nt, Homo sapiens
aagcugccaguugaagaacugu

SEQ ID NO: 9367 - RNA, 22 nt, Homo sapiens
uguaaacauccuacacucagcu

SEQ ID NO: 9368 - RNA, 22 nt, Homo sapiens
cuggcccucucugcccuuccgu

SEQ ID NO: 9369 - RNA, 23 nt, Homo sapiens
agguuguccguggugaguucgca

SEQ ID NO: 9370 - RNA, 22 nt, Homo sapiens
aucuggagguaagaagcacuuu

SEQ ID NO: 9371 - RNA, 19 nt, Homo sapiens
ucuaggcugguacugcuga

SEQ ID NO: 9372 - RNA, 21 nt, Homo sapiens
uggaggagaaggaaggugaug

SEQ ID NO: 9373 - RNA, 21 nt, Homo sapiens
cccggagccaggaugcagcuc

SEQ ID NO: 9374 - RNA, 21 nt, Homo sapiens
cccggagccaggaugcagcuc

SEQ ID NO: 9375 - RNA, 21 nt, Homo sapiens
uggcagggaggcugggagggg

SEQ ID NO: 9376 - RNA, 22 nt, Homo sapiens
ugagccccugugccgcccccag

SEQ ID NO: 9377 - RNA, 17 nt, Homo sapiens
ucgccuccuccucuccc

SEQ ID NO: 9378 - RNA, 22 nt, Homo sapiens
ucugggcaacaaagugagaccu

SEQ ID NO: 9379 - RNA, 22 nt, Homo sapiens
uucauucggcuguccagaugua

SEQ ID NO: 9380 - RNA, 21 nt, Homo sapiens
cggcggggacggcgauugguc

SEQ ID NO: 9381 - RNA, 23 nt, Homo sapiens
ugaguaccgccaugucuguuggg

SEQ ID NO: 9382 - RNA, 23 nt, Homo sapiens
cccaguguucagacuaccuguuc

SEQ ID NO: 9383 - RNA, 23 nt, Homo sapiens
cccaguguuuagacuaucuguuc

SEQ ID NO: 9384 - RNA, 23 nt, Homo sapiens
aaugacacgaucacucccguuga

SEQ ID NO: 9385 - RNA, 22 nt, Homo sapiens
cgucaacacuugcugguuuccu

SEQ ID NO: 9386 - RNA, 23 nt, Homo sapiens
cacucagccuugagggcacuuuc

SEQ ID NO: 9387 - RNA, 19 nt, Homo sapiens
aggcacggugucagcaggc

SEQ ID NO: 9388 - RNA, 25 nt, Homo sapiens
gcugggcagggcuucugagcuccuu

SEQ ID NO: 9389 - RNA, 22 nt, Homo sapiens
aggcggggcgccgcgggaccgc

SEQ ID NO: 9390 - RNA, 22 nt, Homo sapiens
ugcggggcuagggcuaacagca

SEQ ID NO: 9391 - RNA, 21 nt, Homo sapiens
ccccaccuccucucuccucag

SEQ ID NO: 9392 - RNA, 21 nt, Homo sapiens
acggugcuggauguggccuuu

SEQ ID NO: 9393 - RNA, 22 nt, Homo sapiens
uucuggaauucugugugaggga

SEQ ID NO: 9394 - RNA, 19 nt, Homo sapiens
gaugaugcugcugaugcug

SEQ ID NO: 9395 - RNA, 23 nt, Homo sapiens
ucuggcuccgugucuucacuccc

SEQ ID NO: 9396 - RNA, 22 nt, Homo sapiens
uggagagaaaggcaguuccuga

SEQ ID NO: 9397 - RNA, 22 nt, Homo sapiens
uucaccaccuucuccacccagc

SEQ ID NO: 9398 - RNA, 23 nt, Homo sapiens
ucccccaggugugauucugauuu

SEQ ID NO: 9399 - RNA, 24 nt, Homo sapiens
acugggggcuuucgggcucugcgu

SEQ ID NO: 9400 - RNA, 20 nt, Homo sapiens
accaggaggcugaggccccu

SEQ ID NO: 9401 - RNA, 23 nt, Homo sapiens
aggaagcccuggaggggcuggag

SEQ ID NO: 9402 - RNA, 20 nt, Homo sapiens
ggggagcuguggaagcagua

SEQ ID NO: 9403 - RNA, 24 nt, Homo sapiens
uggggagcugaggcucugggggug

SEQ ID NO: 9404 - RNA, 22 nt, Homo sapiens
acucggcguggcgucggucgug

SEQ ID NO: 9405 - RNA, 18 nt, Homo sapiens
cagggaggugaaugugau

SEQ ID NO: 9406 - RNA, 21 nt, Homo sapiens
uggaggagaaggaaggugaug

SEQ ID NO: 9407 - RNA, 22 nt, Homo sapiens
ucuucucuguuuuggccaugug

SEQ ID NO: 9408 - RNA, 22 nt, Homo sapiens
uuugaggcuacagugagaugug

SEQ ID NO: 9409 - RNA, 23 nt, Homo sapiens
ucuggcuccgugucuucacuccc

SEQ ID NO: 9410 - RNA, 22 nt, Homo sapiens
ucugcccccuccgcugcugcca

SEQ ID NO: 9411 - RNA, 20 nt, Homo sapiens
acugccccaggugcugcugg

SEQ ID NO: 9412 - RNA, 21 nt, Homo sapiens
cggggcagcucaguacaggau

SEQ ID NO: 9413 - RNA, 19 nt, Homo sapiens
gggcgccugugaucccaac

SEQ ID NO: 9414 - RNA, 20 nt, Homo sapiens
agaccauggguucucauugu

SEQ ID NO: 9415 - RNA, 22 nt, Homo sapiens
uggagugugacaaugguguuug

SEQ ID NO: 9416 - RNA, 22 nt, Homo sapiens
ugagaccucuggguucugagcu

SEQ ID NO: 9417 - RNA, 22 nt, Homo sapiens
aggcagcgggguguaguggaua

SEQ ID NO: 9418 - RNA, 20 nt, Homo sapiens
ggggagcuguggaagcagua

SEQ ID NO: 9419 - RNA, 24 nt, Homo sapiens
uggggagcugaggcucugggggug

SEQ ID NO: 9420 - RNA, 22 nt, Homo sapiens
uuugaggcuacagugagaugug

SEQ ID NO: 9421 - RNA, 22 nt, Homo sapiens
ucugcccccuccgcugcugcca

SEQ ID NO: 9422 - RNA, 20 nt, Homo sapiens
acugccccaggugcugcugg

SEQ ID NO: 9423 - RNA, 21 nt, Homo sapiens
cggggcagcucaguacaggau

SEQ ID NO: 9424 - RNA, 22 nt, Homo sapiens
agacccuggucugcacucuauc

SEQ ID NO: 9425 - RNA, 21 nt, Homo sapiens
aggguaagcugaaccucugau

SEQ ID NO: 9426 - RNA, 19 nt, Homo sapiens
gggcgccugugaucccaac

SEQ ID NO: 9427 - RNA, 20 nt, Homo sapiens
agaccauggguucucauugu

SEQ ID NO: 9428 - RNA, 22 nt, Homo sapiens
uggagugugacaaugguguuug

SEQ ID NO: 9429 - RNA, 22 nt, Homo sapiens
aggcagcgggguguaguggaua

SEQ ID NO: 9430 - RNA, 23 nt, Homo sapiens
uacccuguagauccgaauuugug

SEQ ID NO: 9431 - RNA, 23 nt, Homo sapiens
uacccuguagaaccgaauuugug

SEQ ID NO: 9432 - RNA, 21 nt, Homo sapiens
uggcagggaggcugggagggg

SEQ ID NO: 9433 - RNA, 21 nt, Homo sapiens
ccccaccuccucucuccucag

SEQ ID NO: 9434 - RNA, 22 nt, Homo sapiens
ucugggcaacaaagugagaccu

SEQ ID NO: 9435 - RNA, 21 nt, Homo sapiens
cggcggggacggcgauugguc

SEQ ID NO: 9436 - RNA, 22 nt, Homo sapiens
cauugcacuugucucggucuga

SEQ ID NO: 9437 - RNA, 22 nt, Homo sapiens
aaaagcuggguugagagggcga

SEQ ID NO: 9438 - RNA, 22 nt, Homo sapiens
aaaagcuggguugagagggcaa

SEQ ID NO: 9439 - RNA, 20 nt, Homo sapiens
aaaagcuggguugagagggu

SEQ ID NO: 9440 - RNA, 19 nt, Homo sapiens
aaaagcuggguugagagga

SEQ ID NO: 9441 - RNA, 22 nt, Homo sapiens
uccuguacugagcugccccgag

SEQ ID NO: 9442 - RNA, 24 nt, Homo sapiens
cugaagugauguguaacugaucag

SEQ ID NO: 9443 - RNA, 25 nt, Homo sapiens
gcugggcagggcuucugagcuccuu

SEQ ID NO: 9444 - RNA, 22 nt, Homo sapiens
ugcggggcuagggcuaacagca

SEQ ID NO: 9445 - RNA, 20 nt, Homo sapiens
ggggagcuguggaagcagua

SEQ ID NO: 9446 - RNA, 22 nt, Homo sapiens
auccgcgcucugacucucugcc

SEQ ID NO: 9447 - RNA, 21 nt, Homo sapiens
ccccaccuccucucuccucag

SEQ ID NO: 9448 - RNA, 23 nt, Homo sapiens
ucuggcuccgugucuucacuccc

SEQ ID NO: 9449 - RNA, 22 nt, Homo sapiens
uggacggagaacugauaagggu

SEQ ID NO: 9450 - RNA, 21 nt, Homo sapiens
cggcggggacggcgauugguc

SEQ ID NO: 9451 - RNA, 23 nt, Homo sapiens
cgcauccccuagggcauuggugu

SEQ ID NO: 9452 - RNA, 23 nt, Homo sapiens
acuucaccugguccacuagccgu

SEQ ID NO: 9453 - RNA, 23 nt, Homo sapiens
ugaggggcagagagcgagacuuu

SEQ ID NO: 9454 - RNA, 23 nt, Homo sapiens
agguuguccguggugaguucgca

SEQ ID NO: 9455 - RNA, 22 nt, Homo sapiens
aguggggaacccuuccaugagg

SEQ ID NO: 9456 - RNA, 22 nt, Homo sapiens
aggcggggcgccgcgggaccgc

SEQ ID NO: 9457 - RNA, 23 nt, Homo sapiens
aggaagcccuggaggggcuggag

SEQ ID NO: 9458 - RNA, 22 nt, Homo sapiens
ugcggggcuagggcuaacagca

SEQ ID NO: 9459 - RNA, 21 nt, Homo sapiens
uacucaaaaagcugucaguca

SEQ ID NO: 9460 - RNA, 20 nt, Homo sapiens
ggggagcuguggaagcagua

SEQ ID NO: 9461 - RNA, 21 nt, Homo sapiens
uggcagggaggcugggagggg

SEQ ID NO: 9462 - RNA, 22 nt, Homo sapiens
ugagccccugugccgcccccag

SEQ ID NO: 9463 - RNA, 18 nt, Homo sapiens
uugagaaggaggcugcug

SEQ ID NO: 9464 - RNA, 23 nt, Homo sapiens
cggcccgggcugcugcuguuccu

SEQ ID NO: 9465 - RNA, 22 nt, Homo sapiens
uggagagaaaggcaguuccuga

SEQ ID NO: 9466 - RNA, 22 nt, Homo sapiens
caaagaauucuccuuuugggcu

SEQ ID NO: 9467 - RNA, 21 nt, Homo sapiens
cggcggggacggcgauugguc

SEQ ID NO: 9468 - RNA, 22 nt, Homo sapiens
uggcucaguucagcaggaacag

SEQ ID NO: 9469 - RNA, 22 nt, Homo sapiens
aauugcacgguauccaucugua

SEQ ID NO: 9470 - RNA, 23 nt, Homo sapiens
ugaggggcagagagcgagacuuu

SEQ ID NO: 9471 - RNA, 21 nt, Homo sapiens
guggcugcacucacuuccuuc

SEQ ID NO: 9472 - RNA, 22 nt, Homo sapiens
aggcggggcgccgcgggaccgc

SEQ ID NO: 9473 - RNA, 22 nt, Homo sapiens
ugcggggcuagggcuaacagca

SEQ ID NO: 9474 - RNA, 22 nt, Homo sapiens
acuccagccccacagccucagc

SEQ ID NO: 9475 - RNA, 21 nt, Homo sapiens
agugaaugauggguucugacc

SEQ ID NO: 9476 - RNA, 22 nt, Homo sapiens
uaacacugucugguaaagaugg

SEQ ID NO: 9477 - RNA, 23 nt, Homo sapiens
aacauucaacgcugucggugagu

SEQ ID NO: 9478 - RNA, 23 nt, Homo sapiens
aacauucauugcugucggugggu

SEQ ID NO: 9479 - RNA, 22 nt, Homo sapiens
aacauucaaccugucggugagu

SEQ ID NO: 9480 - RNA, 23 nt, Homo sapiens
aacauucauuguugucggugggu

SEQ ID NO: 9481 - RNA, 22 nt, Homo sapiens
ugauugguacgucuguggguag

SEQ ID NO: 9482 - RNA, 22 nt, Homo sapiens
aaaaguaauugcgaguuuuacc

SEQ ID NO: 9483 - RNA, 22 nt, Homo sapiens
aaaaguaauugugguuuuggcc

SEQ ID NO: 9484 - RNA, 22 nt, Homo sapiens
aaaaguaauugcgguuuuugcc

SEQ ID NO: 9485 - RNA, 22 nt, Homo sapiens
aaaaguaauugugguuuuugcc

SEQ ID NO: 9486 - RNA, 22 nt, Homo sapiens
aaaaguaaucgcgguuuuuguc

SEQ ID NO: 9487 - RNA, 22 nt, Homo sapiens
aaaaguaauugcggauuuugcc

SEQ ID NO: 9488 - RNA, 22 nt, Homo sapiens
aaaaguaauugcggucuuuggu

SEQ ID NO: 9489 - RNA, 22 nt, Homo sapiens
aaaaguauuugcggguuuuguc

SEQ ID NO: 9490 - RNA, 22 nt, Homo sapiens
caaaaguaauuguggauuuugu

SEQ ID NO: 9491 - RNA, 21 nt, Homo sapiens
uaaaguaaauaugcaccaaaa

SEQ ID NO: 9492 - RNA, 22 nt, Homo sapiens
uggaauguaaagaaguauguau

SEQ ID NO: 9493 - RNA, 21 nt, Homo sapiens
cccggagccaggaugcagcuc

SEQ ID NO: 9494 - RNA, 21 nt, Homo sapiens
ccccaccuccucucuccucag

SEQ ID NO: 9495 - RNA, 20 nt, Homo sapiens
cuuccucgucugucugcccc

SEQ ID NO: 9496 - RNA, 18 nt, Homo sapiens
gucccuguucaggcgcca

SEQ ID NO: 9497 - RNA, 23 nt, Homo sapiens
uggaguccaggaaucugcauuuu

SEQ ID NO: 9498 - RNA, 23 nt, Homo sapiens
acuccauuuguuuugaugaugga

SEQ ID NO: 9499 - RNA, 23 nt, Homo sapiens
uuaaugcuaaucgugauaggggu

SEQ ID NO: 9500 - RNA, 22 nt, Homo sapiens
uggaauguaaggaagugugugg

SEQ ID NO: 9501 - RNA, 22 nt, Homo sapiens
gaugagcucauuguaauaugag

SEQ ID NO: 9502 - RNA, 20 nt, Homo sapiens
aggaauguuccuucuuugcc

SEQ ID NO: 9503 - RNA, 18 nt, Homo sapiens
ucagcuggcccucauuuc

SEQ ID NO: 9504 - RNA, 21 nt, Homo sapiens
agagaagaagaucagccugca

SEQ ID NO: 9505 - RNA, 22 nt, Homo sapiens
ucucccaacccuuguaccagug

SEQ ID NO: 9506 - RNA, 22 nt, Homo sapiens
uggagagaaaggcaguuccuga

SEQ ID NO: 9507 - RNA, 22 nt, Homo sapiens
ugggucuuugcgggcgagauga

SEQ ID NO: 9508 - RNA, 22 nt, Homo sapiens
ucaggccaggcacaguggcuca

SEQ ID NO: 9509 - RNA, 22 nt, Homo sapiens
aucacacaaaggcaacuuuugu

SEQ ID NO: 9510 - RNA, 23 nt, Homo sapiens
cacucagccuugagggcacuuuc

SEQ ID NO: 9511 - RNA, 22 nt, Homo sapiens
ccucccacacccaaggcuugca

SEQ ID NO: 9512 - RNA, 21 nt, Homo sapiens
ugagcuaaaugugugcuggga

SEQ ID NO: 9513 - RNA, 23 nt, Homo sapiens
ucuuugguuaucuagcuguauga

SEQ ID NO: 9514 - RNA, 20 nt, Homo sapiens
ggggagcuguggaagcagua

SEQ ID NO: 9515 - RNA, 22 nt, Homo sapiens
caaagugccucccuuuagagug

SEQ ID NO: 9516 - RNA, 21 nt, Homo sapiens
acggugcuggauguggccuuu

SEQ ID NO: 9517 - RNA, 23 nt, Homo sapiens
ucuggcuccgugucuucacuccc

SEQ ID NO: 9518 - RNA, 22 nt, Homo sapiens
aggugguccguggcgcguucgc

SEQ ID NO: 9519 - RNA, 25 nt, Homo sapiens
aggggugguguugggacagcuccgu

SEQ ID NO: 9520 - RNA, 20 nt, Homo sapiens
ggggagcuguggaagcagua

SEQ ID NO: 9521 - RNA, 22 nt, Homo sapiens
uggagugugacaaugguguuug

SEQ ID NO: 9522 - RNA, 22 nt, Homo sapiens
uggguggucuggagauuugugc

SEQ ID NO: 9523 - RNA, 22 nt, Homo sapiens
acucggcguggcgucggucgug

SEQ ID NO: 9524 - RNA, 22 nt, Homo sapiens
cucggcgcggggcgcgggcucc

SEQ ID NO: 9525 - RNA, 21 nt, Homo sapiens
cggcggggacggcgauugguc

SEQ ID NO: 9526 - RNA, 22 nt, Homo sapiens
ucaggccaggcacaguggcuca

SEQ ID NO: 9527 - RNA, 21 nt, Homo sapiens
ccaccaccgugucugacacuu

SEQ ID NO: 9528 - RNA, 22 nt, Homo sapiens
cauugcacuugucucggucuga

SEQ ID NO: 9529 - RNA, 23 nt, Homo sapiens
uuacaguuguucaaccaguuacu

SEQ ID NO: 9530 - RNA, 22 nt, Homo sapiens
aggcggggcgccgcgggaccgc

SEQ ID NO: 9531 - RNA, 22 nt, Homo sapiens
ugcggggcuagggcuaacagca

SEQ ID NO: 9532 - RNA, 22 nt, Homo sapiens
agaaggaaauugaauucauuua

SEQ ID NO: 9533 - RNA, 24 nt, Homo sapiens
ucccugagacccuuuaaccuguga

SEQ ID NO: 9534 - RNA, 22 nt, Homo sapiens
ucccugagacccuaacuuguga

SEQ ID NO: 9535 - RNA, 23 nt, Homo sapiens
ccucagggcuguagaacagggcu

SEQ ID NO: 9536 - RNA, 24 nt, Homo sapiens
uggcccugacugaagaccagcagu

SEQ ID NO: 9537 - RNA, 20 nt, Homo sapiens
ccuccugcccuccuugcugu

SEQ ID NO: 9538 - RNA, 21 nt, Homo sapiens
uucacaguggcuaaguuccgc

SEQ ID NO: 9539 - RNA, 21 nt, Homo sapiens
uucacaguggcuaaguucugc

SEQ ID NO: 9540 - RNA, 23 nt, Homo sapiens
ucccuguccuccaggagcucacg

SEQ ID NO: 9541 - RNA, 22 nt, Homo sapiens
aguggggaacccuuccaugagg

SEQ ID NO: 9542 - RNA, 22 nt, Homo sapiens
uugagaaugaugaaucauuagg

SEQ ID NO: 9543 - RNA, 25 nt, Homo sapiens
aggggugguguugggacagcuccgu

SEQ ID NO: 9544 - RNA, 21 nt, Homo sapiens
uggaggagaaggaaggugaug

SEQ ID NO: 9545 - RNA, 20 nt, Homo sapiens
ggggagcuguggaagcagua

SEQ ID NO: 9546 - RNA, 18 nt, Homo sapiens
ucagcuggcccucauuuc

SEQ ID NO: 9547 - RNA, 22 nt, Homo sapiens
uggagugugacaaugguguuug

SEQ ID NO: 9548 - RNA, 21 nt, Homo sapiens
cggcggggacggcgauugguc

SEQ ID NO: 9549 - RNA, 23 nt, Homo sapiens
ugaguaccgccaugucuguuggg

SEQ ID NO: 9550 - RNA, 22 nt, Homo sapiens
uacccagagcaugcagugugaa

SEQ ID NO: 9551 - RNA, 22 nt, Homo sapiens
uguaaacauccucgacuggaag

SEQ ID NO: 9552 - RNA, 22 nt, Homo sapiens
uguaaacauccuacacucagcu

SEQ ID NO: 9553 - RNA, 23 nt, Homo sapiens
uguaaacauccuacacucucagc

SEQ ID NO: 9554 - RNA, 22 nt, Homo sapiens
uguaaacauccccgacuggaag

SEQ ID NO: 9555 - RNA, 22 nt, Homo sapiens
uguaaacauccuugacuggaag

SEQ ID NO: 9556 - RNA, 22 nt, Homo sapiens
agaucagaaggugauuguggcu

SEQ ID NO: 9557 - RNA, 22 nt, Homo sapiens
ucagcaaacauuuauugugugc

SEQ ID NO: 9558 - RNA, 19 nt, Homo sapiens
aggcugcggaauucaggac

SEQ ID NO: 9559 - RNA, 21 nt, Homo sapiens
guggcugcacucacuuccuuc

SEQ ID NO: 9560 - RNA, 22 nt, Homo sapiens
aggcggggcgccgcgggaccgc

SEQ ID NO: 9561 - RNA, 21 nt, Homo sapiens
cugacuguugccguccuccag

SEQ ID NO: 9562 - RNA, 22 nt, Homo sapiens
uggagugugacaaugguguuug

SEQ ID NO: 9563 - RNA, 21 nt, Homo sapiens
cggcggggacggcgauugguc

SEQ ID NO: 9564 - RNA, 20 nt, Homo sapiens
uguuuugauaacaguaaugu

SEQ ID NO: 9565 - RNA, 22 nt, Homo sapiens
uagcuuaucagacugauguuga

SEQ ID NO: 9566 - RNA, 22 nt, Homo sapiens
uggugggcacagaaucuggacu

SEQ ID NO: 9567 - RNA, 22 nt, Homo sapiens
uccgagccugggucucccucuu

SEQ ID NO: 9568 - RNA, 22 nt, Homo sapiens
uggugggccgcagaacaugugc

SEQ ID NO: 9569 - RNA, 22 nt, Homo sapiens
aggcggggcgccgcgggaccgc

SEQ ID NO: 9570 - RNA, 24 nt, Homo sapiens
uggggagcugaggcucugggggug

SEQ ID NO: 9571 - RNA, 22 nt, Homo sapiens
ugagccccugugccgcccccag

SEQ ID NO: 9572 - RNA, 21 nt, Homo sapiens
ugagaugaagcacuguagcuc

SEQ ID NO: 9573 - RNA, 22 nt, Homo sapiens
ugcccuguggacucaguucugg

SEQ ID NO: 9574 - RNA, 22 nt, Homo sapiens
ucagugcacuacagaacuuugu

SEQ ID NO: 9575 - RNA, 22 nt, Homo sapiens
ucagugcaucacagaacuuugu

SEQ ID NO: 9576 - RNA, 21 nt, Homo sapiens
ucagugcaugacagaacuugg

SEQ ID NO: 9577 - RNA, 23 nt, Homo sapiens
cggcccgggcugcugcuguuccu

SEQ ID NO: 9578 - RNA, 22 nt, Homo sapiens
cccugugcccggcccacuucug

SEQ ID NO: 9579 - RNA, 23 nt, Homo sapiens
ucccuguccuccaggagcucacg

SEQ ID NO: 9580 - RNA, 22 nt, Homo sapiens
uggcagugucuuagcugguugu

SEQ ID NO: 9581 - RNA, 23 nt, Homo sapiens
aggcaguguaguuagcugauugc

SEQ ID NO: 9582 - RNA, 23 nt, Homo sapiens
aagugccgccaucuuuugagugu

SEQ ID NO: 9583 - RNA, 22 nt, Homo sapiens
uggcaguguauuguuagcuggu

SEQ ID NO: 9584 - RNA, 22 nt, Homo sapiens
aggcaguguauuguuagcuggc

SEQ ID NO: 9585 - RNA, 19 nt, Homo sapiens
aggcacggugucagcaggc

SEQ ID NO: 9586 - RNA, 19 nt, Homo sapiens
ugucucugcugggguuucu

SEQ ID NO: 9587 - RNA, 25 nt, Homo sapiens
aggggugguguugggacagcuccgu

SEQ ID NO: 9588 - RNA, 22 nt, Homo sapiens
uccgagccugggucucccucuu

SEQ ID NO: 9589 - RNA, 24 nt, Homo sapiens
ugccugggucucuggccugcgcgu

SEQ ID NO: 9590 - RNA, 22 nt, Homo sapiens
ugagaccucuggguucugagcu

SEQ ID NO: 9591 - RNA, 22 nt, Homo sapiens
cugcccuggcccgagggaccga

SEQ ID NO: 9592 - RNA, 20 nt, Homo sapiens
ggggagcuguggaagcagua

SEQ ID NO: 9593 - RNA, 22 nt, Homo sapiens
gugaaauguuuaggaccacuag

SEQ ID NO: 9594 - RNA, 22 nt, Homo sapiens
uuggggaaacggccgcugagug

SEQ ID NO: 9595 - RNA, 22 nt, Homo sapiens
aacaauauccuggugcugagug

SEQ ID NO: 9596 - RNA, 22 nt, Homo sapiens
aauugcacgguauccaucugua

SEQ ID NO: 9597 - RNA, 22 nt, Homo sapiens
aguggggaacccuuccaugagg

SEQ ID NO: 9598 - RNA, 20 nt, Homo sapiens
aaaguagcuguaccauuugc

SEQ ID NO: 9599 - RNA, 25 nt, Homo sapiens
aggggugguguugggacagcuccgu

SEQ ID NO: 9600 - RNA, 20 nt, Homo sapiens
ggggagcuguggaagcagua

SEQ ID NO: 9601 - RNA, 17 nt, Homo sapiens
ucgccuccuccucuccc

SEQ ID NO: 9602 - RNA, 21 nt, Homo sapiens
ugcaggaccaagaugagcccu

SEQ ID NO: 9603 - RNA, 24 nt, Homo sapiens
uugcagcugccugggagugacuuc

SEQ ID NO: 9604 - RNA, 23 nt, Homo sapiens
ucuggcuccgugucuucacuccc

SEQ ID NO: 9605 - RNA, 22 nt, Homo sapiens
uggagagaaaggcaguuccuga

SEQ ID NO: 9606 - RNA, 21 nt, Homo sapiens
cggcggggacggcgauugguc

SEQ ID NO: 9607 - RNA, 23 nt, Homo sapiens
agcuacauugucugcuggguuuc

SEQ ID NO: 9608 - RNA, 21 nt, Homo sapiens
agggcccccccucaauccugu

SEQ ID NO: 9609 - RNA, 23 nt, Homo sapiens
ucccccaggugugauucugauuu

SEQ ID NO: 9610 - RNA, 23 nt, Homo sapiens
aagugccgccaucuuuugagugu

SEQ ID NO: 9611 - RNA, 21 nt, Homo sapiens
acuggacuuggagucagaagg

SEQ ID NO: 9612 - RNA, 22 nt, Homo sapiens
gugacaucacauauacggcagc

SEQ ID NO: 9613 - RNA, 24 nt, Homo sapiens
acugggggcuuucgggcucugcgu

SEQ ID NO: 9614 - RNA, 22 nt, Homo sapiens
aggcggggcgccgcgggaccgc

SEQ ID NO: 9615 - RNA, 17 nt, Homo sapiens
ucgccuccuccucuccc

SEQ ID NO: 9616 - RNA, 18 nt, Homo sapiens
cagggaggugaaugugau

SEQ ID NO: 9617 - RNA, 23 nt, Homo sapiens
ucuggcuccgugucuucacuccc

SEQ ID NO: 9618 - RNA, 21 nt, Homo sapiens
cggcggggacggcgauugguc

SEQ ID NO: 9619 - RNA, 22 nt, Homo sapiens
cauugcacuugucucggucuga

SEQ ID NO: 9620 - RNA, 22 nt, Homo sapiens
aggcggggcgccgcgggaccgc

SEQ ID NO: 9621 - RNA, 20 nt, Homo sapiens
accaggaggcugaggccccu

SEQ ID NO: 9622 - RNA, 22 nt, Homo sapiens
ugcggggcuagggcuaacagca

SEQ ID NO: 9623 - RNA, 21 nt, Homo sapiens
uggaggagaaggaaggugaug

SEQ ID NO: 9624 - RNA, 22 nt, Homo sapiens
aggcagcgggguguaguggaua

SEQ ID NO: 9625 - RNA, 22 nt, Homo sapiens
auccgcgcucugacucucugcc

SEQ ID NO: 9626 - RNA, 22 nt, Homo sapiens
aacccguagauccgaucuugug

SEQ ID NO: 9627 - RNA, 22 nt, Homo sapiens
cacccguagaaccgaccuugcg

SEQ ID NO: 9628 - RNA, 22 nt, Homo sapiens
aaaaccgucuaguuacaguugu

SEQ ID NO: 9629 - RNA, 22 nt, Homo sapiens
uagcagcacauaaugguuugug

SEQ ID NO: 9630 - RNA, 22 nt, Homo sapiens
uagcagcacaucaugguuuaca

SEQ ID NO: 9631 - RNA, 22 nt, Homo sapiens
uagcagcacguaaauauuggcg

SEQ ID NO: 9632 - RNA, 21 nt, Homo sapiens
caucccuugcaugguggaggg

SEQ ID NO: 9633 - RNA, 21 nt, Homo sapiens
uagcagcacagaaauauuggc

SEQ ID NO: 9634 - RNA, 22 nt, Homo sapiens
uccuucauuccaccggagucug

SEQ ID NO: 9635 - RNA, 22 nt, Homo sapiens
ugguuuaccgucccacauacau

SEQ ID NO: 9636 - RNA, 22 nt, Homo sapiens
cagcagcaauucauguuuugaa

SEQ ID NO: 9637 - RNA, 22 nt, Homo sapiens
uugcauauguaggaugucccau

SEQ ID NO: 9638 - RNA, 21 nt, Homo sapiens
cagcagcacacugugguuugu

SEQ ID NO: 9639 - RNA, 18 nt, Homo sapiens
ugcuuccuuucagagggu

SEQ ID NO: 9640 - RNA, 22 nt, Homo sapiens
aucuggagguaagaagcacuuu

SEQ ID NO: 9641 - RNA, 22 nt, Homo sapiens
uuaugguuugccugggacugag

SEQ ID NO: 9642 - RNA, 22 nt, Homo sapiens
augcugacauauuuacuagagg

SEQ ID NO: 9643 - RNA, 19 nt, Homo sapiens
aagcagcugccucugaggc

SEQ ID NO: 9644 - RNA, 23 nt, Homo sapiens
uauucauuuauccccagccuaca

SEQ ID NO: 9645 - RNA, 22 nt, Homo sapiens
uggauuucuuugugaaucacca

SEQ ID NO: 9646 - RNA, 22 nt, Homo sapiens
ugugcgcagggagaccucuccc

SEQ ID NO: 9647 - RNA, 23 nt, Homo sapiens
cggcccgggcugcugcuguuccu

SEQ ID NO: 9648 - RNA, 23 nt, Homo sapiens
cggcccgggcugcugcuguuccu

SEQ ID NO: 9649 - RNA, 21 nt, Homo sapiens
agggcccccccucaauccugu

SEQ ID NO: 9650 - RNA, 23 nt, Homo sapiens
aggaagcccuggaggggcuggag

SEQ ID NO: 9651 - RNA, 20 nt, Homo sapiens
gugucugggcggacagcugc

SEQ ID NO: 9652 - RNA, 21 nt, Homo sapiens
cauaaaguagaaagcacuacu

SEQ ID NO: 9653 - RNA, 22 nt, Homo sapiens
uggagagaaaggcaguuccuga

SEQ ID NO: 9654 - RNA, 22 nt, Homo sapiens
caaucacuaacuccacugccau

SEQ ID NO: 9655 - RNA, 21 nt, Homo sapiens
agagaagaagaucagccugca

SEQ ID NO: 9656 - RNA, 24 nt, Homo sapiens
uggcccugacugaagaccagcagu

SEQ ID NO: 9657 - RNA, 22 nt, Homo sapiens
uggguggucuggagauuugugc

SEQ ID NO: 9658 - RNA, 23 nt, Homo sapiens
guccaguuuucccaggaaucccu

SEQ ID NO: 9659 - RNA, 23 nt, Homo sapiens
ucuggcuccgugucuucacuccc

SEQ ID NO: 9660 - RNA, 22 nt, Homo sapiens
agaucagaaggugauuguggcu

SEQ ID NO: 9661 - RNA, 21 nt, Homo sapiens
cagcagcacacugugguuugu

SEQ ID NO: 9662 - RNA, 22 nt, Homo sapiens
gucccucuccaaaugugucuug

SEQ ID NO: 9663 - RNA, 23 nt, Homo sapiens
uggaagacuagugauuuuguugu

SEQ ID NO: 9664 - RNA, 20 nt, Homo sapiens
cggcucugggucugugggga

SEQ ID NO: 9665 - RNA, 22 nt, Homo sapiens
uaugugggaugguaaaccgcuu

SEQ ID NO: 9666 - RNA, 22 nt, Homo sapiens
aaaagcuggguugagagggcga

SEQ ID NO: 9667 - RNA, 22 nt, Homo sapiens
aaaagcuggguugagagggcaa

SEQ ID NO: 9668 - RNA, 20 nt, Homo sapiens
aaaagcuggguugagagggu

SEQ ID NO: 9669 - RNA, 19 nt, Homo sapiens
aaaagcuggguugagagga

SEQ ID NO: 9670 - RNA, 22 nt, Homo sapiens
uuuugcaauauguuccugaaua

SEQ ID NO: 9671 - RNA, 22 nt, Homo sapiens
uuuugcaauauguuccugaaua

SEQ ID NO: 9672 - RNA, 22 nt, Homo sapiens
ucaggcucaguccccucccgau

SEQ ID NO: 9673 - RNA, 23 nt, Homo sapiens
cacucagccuugagggcacuuuc

SEQ ID NO: 9674 - RNA, 22 nt, Homo sapiens
ugugucacucgaugaccacugu

SEQ ID NO: 9675 - RNA, 23 nt, Homo sapiens
ucuuugguuaucuagcuguauga

SEQ ID NO: 9676 - RNA, 23 nt, Homo sapiens
gagggucuugggagggaugugac

SEQ ID NO: 9677 - RNA, 22 nt, Homo sapiens
ucggauccgucugagcuuggcu

SEQ ID NO: 9678 - RNA, 22 nt, Homo sapiens
ucggauccgucugagcuuggcu

SEQ ID NO: 9679 - RNA, 17 nt, Homo sapiens
ucgccuccuccucuccc

SEQ ID NO: 9680 - RNA, 22 nt, Homo sapiens
uucuggaauucugugugaggga

SEQ ID NO: 9681 - RNA, 22 nt, Homo sapiens
uugggaucauuuugcauccaua

SEQ ID NO: 9682 - RNA, 19 nt, Homo sapiens
aggcacggugucagcaggc

SEQ ID NO: 9683 - RNA, 21 nt, Homo sapiens
guucaaauccagaucuauaac

SEQ ID NO: 9684 - RNA, 23 nt, Homo sapiens
cugggaucuccggggucuugguu

SEQ ID NO: 9685 - RNA, 21 nt, Homo sapiens
cccggagccaggaugcagcuc

SEQ ID NO: 9686 - RNA, 24 nt, Homo sapiens
uggcccugacugaagaccagcagu

SEQ ID NO: 9687 - RNA, 23 nt, Homo sapiens
ucuggcuccgugucuucacuccc

SEQ ID NO: 9688 - RNA, 22 nt, Homo sapiens
ucucccaacccuuguaccagug

SEQ ID NO: 9689 - RNA, 23 nt, Homo sapiens
cggcccgggcugcugcuguuccu

SEQ ID NO: 9690 - RNA, 22 nt, Homo sapiens
uggagagaaaggcaguuccuga

SEQ ID NO: 9691 - RNA, 22 nt, Homo sapiens
uguaaacauccuacacucagcu

SEQ ID NO: 9692 - RNA, 22 nt, Homo sapiens
uggcagugucuuagcugguugu

SEQ ID NO: 9693 - RNA, 23 nt, Homo sapiens
aggcaguguaguuagcugauugc

SEQ ID NO: 9694 - RNA, 22 nt, Homo sapiens
uggcaguguauuguuagcuggu

SEQ ID NO: 9695 - RNA, 22 nt, Homo sapiens
aggcaguguauuguuagcuggc

SEQ ID NO: 9696 - RNA, 22 nt, Homo sapiens
cgucaacacuugcugguuuccu

SEQ ID NO: 9697 - RNA, 22 nt, Homo sapiens
gguggcccggccgugccugagg

SEQ ID NO: 9698 - RNA, 23 nt, Homo sapiens
aggaagcccuggaggggcuggag

SEQ ID NO: 9699 - RNA, 22 nt, Homo sapiens
cuccugagccauucugagccuc

SEQ ID NO: 9700 - RNA, 21 nt, Homo sapiens
uccuucugcuccgucccccag

SEQ ID NO: 9701 - RNA, 17 nt, Homo sapiens
ucgccuccuccucuccc

SEQ ID NO: 9702 - RNA, 22 nt, Homo sapiens
agaguugagucuggacgucccg

SEQ ID NO: 9703 - RNA, 24 nt, Homo sapiens
agcagaagcagggagguucuccca

SEQ ID NO: 9704 - RNA, 18 nt, Homo sapiens
ugcuuccuuucagagggu

SEQ ID NO: 9705 - RNA, 22 nt, Homo sapiens
aucuggagguaagaagcacuuu

SEQ ID NO: 9706 - RNA, 22 nt, Homo sapiens
agucauuggaggguuugagcag

SEQ ID NO: 9707 - RNA, 22 nt, Homo sapiens
cuugguucagggagggucccca

SEQ ID NO: 9708 - RNA, 22 nt, Homo sapiens
auccgcgcucugacucucugcc

SEQ ID NO: 9709 - RNA, 21 nt, Homo sapiens
uggcagggaggcugggagggg

SEQ ID NO: 9710 - RNA, 22 nt, Homo sapiens
uuugguccccuucaaccagcug

SEQ ID NO: 9711 - RNA, 22 nt, Homo sapiens
uagcagcacauaaugguuugug

SEQ ID NO: 9712 - RNA, 22 nt, Homo sapiens
uagcagcacaucaugguuuaca

SEQ ID NO: 9713 - RNA, 22 nt, Homo sapiens
uagcagcacguaaauauuggcg

SEQ ID NO: 9714 - RNA, 24 nt, Homo sapiens
uuuggcaaugguagaacucacacu

SEQ ID NO: 9715 - RNA, 21 nt, Homo sapiens
uagcagcacagaaauauuggc

SEQ ID NO: 9716 - RNA, 21 nt, Homo sapiens
aggcaagaugcuggcauagcu

SEQ ID NO: 9717 - RNA, 22 nt, Homo sapiens
aaaagcuggguugagagggcga

SEQ ID NO: 9718 - RNA, 22 nt, Homo sapiens
aaaagcuggguugagagggcaa

SEQ ID NO: 9719 - RNA, 20 nt, Homo sapiens
aaaagcuggguugagagggu

SEQ ID NO: 9720 - RNA, 19 nt, Homo sapiens
aaaagcuggguugagagga

SEQ ID NO: 9721 - RNA, 22 nt, Homo sapiens
uuauaaagcaaugagacugauu

SEQ ID NO: 9722 - RNA, 22 nt, Homo sapiens
auauaauacaaccugcuaagug

SEQ ID NO: 9723 - RNA, 22 nt, Homo sapiens
cagcagcaauucauguuuugaa

SEQ ID NO: 9724 - RNA, 21 nt, Homo sapiens
cagcagcacacugugguuugu

SEQ ID NO: 9725 - RNA, 22 nt, Homo sapiens
uucacaaggaggugucauuuau

SEQ ID NO: 9726 - RNA, 22 nt, Homo sapiens
ucagcaaacauuuauugugugc

SEQ ID NO: 9727 - RNA, 21 nt, Homo sapiens
caaagaggaaggucccauuac

SEQ ID NO: 9728 - RNA, 21 nt, Homo sapiens
aaggcagggcccccgcucccc

SEQ ID NO: 9729 - RNA, 21 nt, Homo sapiens
cugacuguugccguccuccag

SEQ ID NO: 9730 - RNA, 21 nt, Homo sapiens
gcccuccgcccgugcaccccg

SEQ ID NO: 9731 - RNA, 23 nt, Homo sapiens
ucuggcuccgugucuucacuccc

SEQ ID NO: 9732 - RNA, 21 nt, Homo sapiens
cggcggggacggcgauugguc

SEQ ID NO: 9733 - RNA, 23 nt, Homo sapiens
ucccccaggugugauucugauuu

SEQ ID NO: 9734 - RNA, 23 nt, Homo sapiens
ugaggggcagagagcgagacuuu

SEQ ID NO: 9735 - RNA, 22 nt, Homo sapiens
gaaagcgcuucccuuugcugga

SEQ ID NO: 9736 - RNA, 22 nt, Homo sapiens
caaagcgcuccccuuuagaggu

SEQ ID NO: 9737 - RNA, 23 nt, Homo sapiens
caaagcgcuucucuuuagagugu

SEQ ID NO: 9738 - RNA, 21 nt, Homo sapiens
caaagcgcuucccuuuggagc

SEQ ID NO: 9739 - RNA, 21 nt, Homo sapiens
aaagcgcuucccuucagagug

SEQ ID NO: 9740 - RNA, 21 nt, Homo sapiens
gaaagcgcuucucuuuagagg

SEQ ID NO: 9741 - RNA, 24 nt, Homo sapiens
acugggggcuuucgggcucugcgu

SEQ ID NO: 9742 - RNA, 24 nt, Homo sapiens
ugccugggucucuggccugcgcgu

SEQ ID NO: 9743 - RNA, 22 nt, Homo sapiens
aggcggggcgccgcgggaccgc

SEQ ID NO: 9744 - RNA, 23 nt, Homo sapiens
uggugcggagagggcccacagug

SEQ ID NO: 9745 - RNA, 22 nt, Homo sapiens
ugcggggcuagggcuaacagca

SEQ ID NO: 9746 - RNA, 22 nt, Homo sapiens
ugcggggcuagggcuaacagca

SEQ ID NO: 9747 - RNA, 21 nt, Homo sapiens
ccuggaaacacugagguugug

SEQ ID NO: 9748 - RNA, 22 nt, Homo sapiens
uggagugugacaaugguguuug

SEQ ID NO: 9749 - RNA, 17 nt, Homo sapiens
ucccaccgcugccaccc

SEQ ID NO: 9750 - RNA, 21 nt, Homo sapiens
cggcggggacggcgauugguc

SEQ ID NO: 9751 - RNA, 22 nt, Homo sapiens
uggugggcacagaaucuggacu

SEQ ID NO: 9752 - RNA, 22 nt, Homo sapiens
uggugggccgcagaacaugugc

SEQ ID NO: 9753 - RNA, 22 nt, Homo sapiens
aggcggggcgccgcgggaccgc

SEQ ID NO: 9754 - RNA, 21 nt, Homo sapiens
uggaggagaaggaaggugaug

SEQ ID NO: 9755 - RNA, 21 nt, Homo sapiens
cggcggggacggcgauugguc

SEQ ID NO: 9756 - RNA, 23 nt, Homo sapiens
ugaggggcagagagcgagacuuu

SEQ ID NO: 9757 - RNA, 22 nt, Homo sapiens
aggcggggcgccgcgggaccgc

SEQ ID NO: 9758 - RNA, 24 nt, Homo sapiens
uggggagcugaggcucugggggug

SEQ ID NO: 9759 - RNA, 22 nt, Homo sapiens
ugagguaguagguuguauaguu

SEQ ID NO: 9760 - RNA, 22 nt, Homo sapiens
ugagguaguagguugugugguu

SEQ ID NO: 9761 - RNA, 19 nt, Homo sapiens
ugucucugcugggguuucu

SEQ ID NO: 9762 - RNA, 22 nt, Homo sapiens
ucuauacagacccuggcuuuuc

SEQ ID NO: 9763 - RNA, 22 nt, Homo sapiens
uauacaagggcagacucucucu

SEQ ID NO: 9764 - RNA, 22 nt, Homo sapiens
uauacaagggcaagcucucugu

SEQ ID NO: 9765 - RNA, 19 nt, Homo sapiens
gagccaguuggacaggagc

SEQ ID NO: 9766 - RNA, 22 nt, Homo sapiens
gucccucuccaaaugugucuug

SEQ ID NO: 9767 - RNA, 22 nt, Homo sapiens
acuuguaugcuagcucagguag

SEQ ID NO: 9768 - RNA, 17 nt, Homo sapiens
ucucgcuggggccucca

SEQ ID NO: 9769 - RNA, 22 nt, Homo sapiens
cacuggcuccuuucuggguaga

SEQ ID NO: 9770 - RNA, 20 nt, Homo sapiens
ggggagcuguggaagcagua

SEQ ID NO: 9771 - RNA, 22 nt, Homo sapiens
guggguacggcccagugggggg

SEQ ID NO: 9772 - RNA, 18 nt, Homo sapiens
cagggaggugaaugugau

SEQ ID NO: 9773 - RNA, 22 nt, Homo sapiens
acagcaggcacagacaggcagu

SEQ ID NO: 9774 - RNA, 22 nt, Homo sapiens
cuggcccucucugcccuuccgu

SEQ ID NO: 9775 - RNA, 22 nt, Homo sapiens
gccugcugggguggaaccuggu

SEQ ID NO: 9776 - RNA, 22 nt, Homo sapiens
ucaggcucaguccccucccgau

SEQ ID NO: 9777 - RNA, 22 nt, Homo sapiens
cgucaacacuugcugguuuccu

SEQ ID NO: 9778 - RNA, 21 nt, Homo sapiens
aagccugcccggcuccucggg

SEQ ID NO: 9779 - RNA, 21 nt, Homo sapiens
uggaggagaaggaaggugaug

SEQ ID NO: 9780 - RNA, 22 nt, Homo sapiens
uaacacugucugguaaagaugg

SEQ ID NO: 9781 - RNA, 21 nt, Homo sapiens
cuccguuugccuguuucgcug

SEQ ID NO: 9782 - RNA, 22 nt, Homo sapiens
uaacacugucugguaacgaugu

SEQ ID NO: 9783 - RNA, 22 nt, Homo sapiens
uguaaacauccucgacuggaag

SEQ ID NO: 9784 - RNA, 22 nt, Homo sapiens
uguaaacauccuacacucagcu

SEQ ID NO: 9785 - RNA, 23 nt, Homo sapiens
uguaaacauccuacacucucagc

SEQ ID NO: 9786 - RNA, 22 nt, Homo sapiens
uguaaacauccccgacuggaag

SEQ ID NO: 9787 - RNA, 22 nt, Homo sapiens
uguaaacauccuugacuggaag

SEQ ID NO: 9788 - RNA, 23 nt, Homo sapiens
ugagcgccucgacgacagagccg

SEQ ID NO: 9789 - RNA, 21 nt, Homo sapiens
cgcgggugcuuacugacccuu

SEQ ID NO: 9790 - RNA, 23 nt, Homo sapiens
ucuggcuccgugucuucacuccc

SEQ ID NO: 9791 - RNA, 22 nt, Homo sapiens
uggagagaaaggcaguuccuga

SEQ ID NO: 9792 - RNA, 21 nt, Homo sapiens
uucacaguggcuaaguuccgc

SEQ ID NO: 9793 - RNA, 23 nt, Homo sapiens
ugagcgccucgacgacagagccg

SEQ ID NO: 9794 - RNA, 23 nt, Homo sapiens
ugaggggcagagagcgagacuuu

SEQ ID NO: 9795 - RNA, 22 nt, Homo sapiens
aucuggagguaagaagcacuuu

SEQ ID NO: 9796 - RNA, 23 nt, Homo sapiens
caaagcgcuucucuuuagagugu

SEQ ID NO: 9797 - RNA, 21 nt, Homo sapiens
cuccagagggaaguacuuucu

SEQ ID NO: 9798 - RNA, 21 nt, Homo sapiens
cuccagagggaugcacuuucu

SEQ ID NO: 9799 - RNA, 21 nt, Homo sapiens
uggaggagaaggaaggugaug

SEQ ID NO: 9800 - RNA, 22 nt, Homo sapiens
uauugcacucgucccggccucc

SEQ ID NO: 9801 - RNA, 26 nt, Homo sapiens
gaugaugauggcagcaaauucugaaa

SEQ ID NO: 9802 - RNA, 18 nt, Homo sapiens
ucagcuggcccucauuuc

SEQ ID NO: 9803 - RNA, 22 nt, Homo sapiens
cccugugcccggcccacuucug

SEQ ID NO: 9804 - RNA, 23 nt, Homo sapiens
ugugcaaaucuaugcaaaacuga

SEQ ID NO: 9805 - RNA, 22 nt, Homo sapiens
aacaauauccuggugcugagug

SEQ ID NO: 9806 - RNA, 22 nt, Homo sapiens
agagguaguagguugcauaguu

SEQ ID NO: 9807 - RNA, 21 nt, Homo sapiens
auguaugugugcaugugcaug

SEQ ID NO: 9808 - RNA, 22 nt, Homo sapiens
uagcaccaucugaaaucgguua

SEQ ID NO: 9809 - RNA, 22 nt, Homo sapiens
uggcaguguauuguuagcuggu

SEQ ID NO: 9810 - RNA, 22 nt, Homo sapiens
ucagcaaacauuuauugugugc

SEQ ID NO: 9811 - RNA, 22 nt, Homo sapiens
caaaaaucucaauuacuuuugc

SEQ ID NO: 9812 - RNA, 22 nt, Homo sapiens
uagcaaaaacugcaguuacuuu

SEQ ID NO: 9813 - RNA, 23 nt, Homo sapiens
aguauguucuuccaggacagaac

SEQ ID NO: 9814 - RNA, 22 nt, Homo sapiens
agacuucccauuugaagguggc

SEQ ID NO: 9815 - RNA, 21 nt, Homo sapiens
uggaggagaaggaaggugaug

SEQ ID NO: 9816 - RNA, 17 nt, Homo sapiens
ucgccuccuccucuccc

SEQ ID NO: 9817 - RNA, 22 nt, Homo sapiens
uuugaggcuacagugagaugug

SEQ ID NO: 9818 - RNA, 21 nt, Homo sapiens
cggcggggacggcgauugguc

SEQ ID NO: 9819 - RNA, 22 nt, Homo sapiens
uggcucaguucagcaggaacag

SEQ ID NO: 9820 - RNA, 22 nt, Homo sapiens
ucaggcucaguccccucccgau

SEQ ID NO: 9821 - RNA, 23 nt, Homo sapiens
cucuugagggaagcacuuucugu

SEQ ID NO: 9822 - RNA, 19 nt, Homo sapiens
gagccaguuggacaggagc

SEQ ID NO: 9823 - RNA, 22 nt, Homo sapiens
ggggguccccggugcucggauc

SEQ ID NO: 9824 - RNA, 23 nt, Homo sapiens
acuugggcacugaaacaaugucc

SEQ ID NO: 9825 - RNA, 22 nt, Homo sapiens
aggcggggcgccgcgggaccgc

SEQ ID NO: 9826 - RNA, 22 nt, Homo sapiens
cacuggcuccuuucuggguaga

SEQ ID NO: 9827 - RNA, 22 nt, Homo sapiens
acgcccuucccccccuucuuca

SEQ ID NO: 9828 - RNA, 22 nt, Homo sapiens
uuagggcccuggcuccaucucc

SEQ ID NO: 9829 - RNA, 21 nt, Homo sapiens
cucccacaugcaggguuugca

SEQ ID NO: 9830 - RNA, 22 nt, Homo sapiens
ucaggccaggcacaguggcuca

SEQ ID NO: 9831 - RNA, 22 nt, Homo sapiens
ccucccacacccaaggcuugca

SEQ ID NO: 9832 - RNA, 22 nt, Homo sapiens
uccgagccugggucucccucuu

SEQ ID NO: 9833 - RNA, 21 nt, Homo sapiens
uaaagugcugacagugcagau

SEQ ID NO: 9834 - RNA, 24 nt, Homo sapiens
agcagaagcagggagguucuccca

SEQ ID NO: 9835 - RNA, 22 nt, Homo sapiens
aacaauauccuggugcugagug

SEQ ID NO: 9836 - RNA, 21 nt, Homo sapiens
gaaggcgcuucccuuuggagu

SEQ ID NO: 9837 - RNA, 22 nt, Homo sapiens
gaaggcgcuucccuuuagagcg

SEQ ID NO: 9838 - RNA, 22 nt, Homo sapiens
auucugcauuuuuagcaaguuc

SEQ ID NO: 9839 - RNA, 22 nt, Homo sapiens
acuccagccccacagccucagc

SEQ ID NO: 9840 - RNA, 21 nt, Homo sapiens
uuaauaucggacaaccauugu

SEQ ID NO: 9841 - RNA, 22 nt, Homo sapiens
acaggugagguucuugggagcc

SEQ ID NO: 9842 - RNA, 22 nt, Homo sapiens
cucuagagggaagcacuuucug

SEQ ID NO: 9843 - RNA, 23 nt, Homo sapiens
uagcagcgggaacaguucugcag

SEQ ID NO: 9844 - RNA, 21 nt, Homo sapiens
aacaggugacugguuagacaa

SEQ ID NO: 9845 - RNA, 23 nt, Homo sapiens
aucgcugcgguugcgagcgcugu

SEQ ID NO: 9846 - RNA, 24 nt, Homo sapiens
ugccugggucucuggccugcgcgu

SEQ ID NO: 9847 - RNA, 22 nt, Homo sapiens
gguggcccggccgugccugagg

SEQ ID NO: 9848 - RNA, 17 nt, Homo sapiens
ucucgcuggggccucca

SEQ ID NO: 9849 - RNA, 22 nt, Homo sapiens
ucuucucuguuuuggccaugug

SEQ ID NO: 9850 - RNA, 22 nt, Homo sapiens
acucggcguggcgucggucgug

SEQ ID NO: 9851 - RNA, 23 nt, Homo sapiens
ucuggcuccgugucuucacuccc

SEQ ID NO: 9852 - RNA, 18 nt, Homo sapiens
ugaggcaguagauugaau

SEQ ID NO: 9853 - RNA, 21 nt, Homo sapiens
cggcggggacggcgauugguc

SEQ ID NO: 9854 - RNA, 22 nt, Homo sapiens
aacacaccugguuaaccucuuu

SEQ ID NO: 9855 - RNA, 22 nt, Homo sapiens
aacacaccuauucaaggauuca

SEQ ID NO: 9856 - RNA, 22 nt, Homo sapiens
uccgagccugggucucccucuu

SEQ ID NO: 9857 - RNA, 22 nt, Homo sapiens
aggcggggcgccgcgggaccgc

SEQ ID NO: 9858 - RNA, 24 nt, Homo sapiens
uggggagcugaggcucugggggug

SEQ ID NO: 9859 - RNA, 21 nt, Homo sapiens
uggcagggaggcugggagggg

SEQ ID NO: 9860 - RNA, 22 nt, Homo sapiens
cgcaggggccgggugcucaccg

SEQ ID NO: 9861 - RNA, 22 nt, Homo sapiens
aacuggcccucaaagucccgcu

SEQ ID NO: 9862 - RNA, 22 nt, Homo sapiens
uucaccaccuucuccacccagc

SEQ ID NO: 9863 - RNA, 21 nt, Homo sapiens
agggcccccccucaauccugu

SEQ ID NO: 9864 - RNA, 22 nt, Homo sapiens
agaggcuggccgugaugaauuc

SEQ ID NO: 9865 - RNA, 19 nt, Homo sapiens
aggcugcggaauucaggac

SEQ ID NO: 9866 - RNA, 22 nt, Homo sapiens
cgcaggggccgggugcucaccg

SEQ ID NO: 9867 - RNA, 23 nt, Homo sapiens
caacggaaucccaaaagcagcug

SEQ ID NO: 9868 - RNA, 22 nt, Homo sapiens
agaggcuggccgugaugaauuc

SEQ ID NO: 9869 - RNA, 23 nt, Homo sapiens
uagcagcgggaacaguucugcag

SEQ ID NO: 9870 - RNA, 23 nt, Homo sapiens
uucucgaggaaagaagcacuuuc

SEQ ID NO: 9871 - RNA, 24 nt, Homo sapiens
ugccugggucucuggccugcgcgu

SEQ ID NO: 9872 - RNA, 22 nt, Homo sapiens
uggauuucuuugugaaucacca

SEQ ID NO: 9873 - RNA, 23 nt, Homo sapiens
aaaagugcuuacagugcagguag

SEQ ID NO: 9874 - RNA, 21 nt, Homo sapiens
uaaagugcugacagugcagau

SEQ ID NO: 9875 - RNA, 22 nt, Homo sapiens
ucugggcaacaaagugagaccu

SEQ ID NO: 9876 - RNA, 23 nt, Homo sapiens
caaagugcuuacagugcagguag

SEQ ID NO: 9877 - RNA, 18 nt, Homo sapiens
ugaggcaguagauugaau

SEQ ID NO: 9878 - RNA, 23 nt, Homo sapiens
uaaagugcuuauagugcagguag

SEQ ID NO: 9879 - RNA, 23 nt, Homo sapiens
caaagugcucauagugcagguag

SEQ ID NO: 9880 - RNA, 22 nt, Homo sapiens
acacagggcuguugugaagacu

SEQ ID NO: 9881 - RNA, 22 nt, Homo sapiens
uguaaacauccuacacucagcu

SEQ ID NO: 9882 - RNA, 23 nt, Homo sapiens
aggaccugcgggacaagauucuu

SEQ ID NO: 9883 - RNA, 22 nt, Homo sapiens
cgucaacacuugcugguuuccu

SEQ ID NO: 9884 - RNA, 22 nt, Homo sapiens
caaagugccucccuuuagagug

SEQ ID NO: 9885 - RNA, 24 nt, Homo sapiens
acaaagugcuucccuuuagagugu

SEQ ID NO: 9886 - RNA, 22 nt, Homo sapiens
acaaagugcuucccuuuagagu

SEQ ID NO: 9887 - RNA, 23 nt, Homo sapiens
cucuugagggaagcacuuucugu

SEQ ID NO: 9888 - RNA, 22 nt, Homo sapiens
ccucccacacccaaggcuugca

SEQ ID NO: 9889 - RNA, 21 nt, Homo sapiens
caaagaggaaggucccauuac

SEQ ID NO: 9890 - RNA, 25 nt, Homo sapiens
gcugggcagggcuucugagcuccuu

SEQ ID NO: 9891 - RNA, 21 nt, Homo sapiens
aggaggcagcgcucucaggac

SEQ ID NO: 9892 - RNA, 21 nt, Homo sapiens
ucccacguuguggcccagcag

SEQ ID NO: 9893 - RNA, 23 nt, Homo sapiens
caaagugcuguucgugcagguag

SEQ ID NO: 9894 - RNA, 23 nt, Homo sapiens
cggcccgggcugcugcuguuccu

SEQ ID NO: 9895 - RNA, 21 nt, Homo sapiens
cggcggggacggcgauugguc

SEQ ID NO: 9896 - RNA, 21 nt, Homo sapiens
agggcccccccucaauccugu

SEQ ID NO: 9897 - RNA, 20 nt, Homo sapiens
ccucugggcccuuccuccag

SEQ ID NO: 9898 - RNA, 22 nt, Homo sapiens
ucucugggccugugucuuaggc

SEQ ID NO: 9899 - RNA, 21 nt, Homo sapiens
aaagcgcuucccuucagagug

SEQ ID NO: 9900 - RNA, 22 nt, Homo sapiens
agacuucccauuugaagguggc

SEQ ID NO: 9901 - RNA, 21 nt, Homo sapiens
agggggaaaguucuauagucc

SEQ ID NO: 9902 - RNA, 22 nt, Homo sapiens
aggcggggcgccgcgggaccgc

SEQ ID NO: 9903 - RNA, 22 nt, Homo sapiens
ugcggggcuagggcuaacagca

SEQ ID NO: 9904 - RNA, 21 nt, Homo sapiens
uggaggagaaggaaggugaug

SEQ ID NO: 9905 - RNA, 20 nt, Homo sapiens
ucugcaggguuugcuuugag

SEQ ID NO: 9906 - RNA, 18 nt, Homo sapiens
aucccaccucugccacca

SEQ ID NO: 9907 - RNA, 22 nt, Homo sapiens
ugcuggaucagugguucgaguc

SEQ ID NO: 9908 - RNA, 22 nt, Homo sapiens
acagcaggcacagacaggcagu

SEQ ID NO: 9909 - RNA, 21 nt, Homo sapiens
aucacauugccagggauuucc

SEQ ID NO: 9910 - RNA, 21 nt, Homo sapiens
aucacauugccagggauuacc

SEQ ID NO: 9911 - RNA, 22 nt, Homo sapiens
aggugguccguggcgcguucgc

SEQ ID NO: 9912 - RNA, 23 nt, Homo sapiens
ucccccaggugugauucugauuu

SEQ ID NO: 9913 - RNA, 22 nt, Homo sapiens
gccugcugggguggaaccuggu

SEQ ID NO: 9914 - RNA, 23 nt, Homo sapiens
ucuuggaguaggucauugggugg

SEQ ID NO: 9915 - RNA, 23 nt, Homo sapiens
ucuuggaguaggucauugggugg

SEQ ID NO: 9916 - RNA, 25 nt, Homo sapiens
aggggugguguugggacagcuccgu

SEQ ID NO: 9917 - RNA, 24 nt, Homo sapiens
acugggggcuuucgggcucugcgu

SEQ ID NO: 9918 - RNA, 22 nt, Homo sapiens
cagugcaauguuaaaagggcau

SEQ ID NO: 9919 - RNA, 22 nt, Homo sapiens
cagugcaaugaugaaagggcau

SEQ ID NO: 9920 - RNA, 24 nt, Homo sapiens
ccagacagaauucuaugcacuuuc

SEQ ID NO: 9921 - RNA, 22 nt, Homo sapiens
uuggggaaacggccgcugagug

SEQ ID NO: 9922 - RNA, 22 nt, Homo sapiens
aaggagcucacagucuauugag

SEQ ID NO: 9923 - RNA, 23 nt, Homo sapiens
cagugcaauaguauugucaaagc

SEQ ID NO: 9924 - RNA, 23 nt, Homo sapiens
cagugcaaugauauugucaaagc

SEQ ID NO: 9925 - RNA, 23 nt, Homo sapiens
ucucacacagaaaucgcacccgu

SEQ ID NO: 9926 - RNA, 22 nt, Homo sapiens
aucacacaaaggcaacuuuugu

SEQ ID NO: 9927 - RNA, 21 nt, Homo sapiens
acuggacuuggagucagaagg

SEQ ID NO: 9928 - RNA, 23 nt, Homo sapiens
uagugcaauauugcuuauagggu

SEQ ID NO: 9929 - RNA, 21 nt, Homo sapiens
ucacuccucuccucccgucuu

SEQ ID NO: 9930 - RNA, 22 nt, Homo sapiens
aguggggaacccuuccaugagg

SEQ ID NO: 9931 - RNA, 22 nt, Homo sapiens
aaagugcauccuuuuagagugu

SEQ ID NO: 9932 - RNA, 22 nt, Homo sapiens
aaagugcauccuuuuagagguu

SEQ ID NO: 9933 - RNA, 22 nt, Homo sapiens
aaagugcaucuuuuuagaggau

SEQ ID NO: 9934 - RNA, 19 nt, Homo sapiens
ugagcugcuguaccaaaau

SEQ ID NO: 9935 - RNA, 19 nt, Homo sapiens
aggcugcggaauucaggac

SEQ ID NO: 9936 - RNA, 19 nt, Homo sapiens
agcugucugaaaaugucuu

SEQ ID NO: 9937 - RNA, 19 nt, Homo sapiens
gugucugcuuccuguggga

SEQ ID NO: 9938 - RNA, 19 nt, Homo sapiens
aagcagcugccucugaggc

SEQ ID NO: 9939 - RNA, 23 nt, Homo sapiens
aaggagcuuacaaucuagcuggg

SEQ ID NO: 9940 - RNA, 20 nt, Homo sapiens
ucugcaggguuugcuuugag

SEQ ID NO: 9941 - RNA, 17 nt, Homo sapiens
ucgccuccuccucuccc

SEQ ID NO: 9942 - RNA, 23 nt, Homo sapiens
caaagugcuuacagugcagguag

SEQ ID NO: 9943 - RNA, 22 nt, Homo sapiens
cgcaggggccgggugcucaccg

SEQ ID NO: 9944 - RNA, 22 nt, Homo sapiens
uguaacagcaacuccaugugga

SEQ ID NO: 9945 - RNA, 22 nt, Homo sapiens
uggcucaguucagcaggaacag

SEQ ID NO: 9946 - RNA, 23 nt, Homo sapiens
ucccccaggugugauucugauuu

SEQ ID NO: 9947 - RNA, 22 nt, Homo sapiens
uacugcagacguggcaaucaug

SEQ ID NO: 9948 - RNA, 21 nt, Homo sapiens
uacugcagacaguggcaauca

SEQ ID NO: 9949 - RNA, 19 nt, Homo sapiens
aggcugcggaauucaggac

SEQ ID NO: 9950 - RNA, 24 nt, Homo sapiens
acugggggcuuucgggcucugcgu

SEQ ID NO: 9951 - RNA, 21 nt, Homo sapiens
aauggcgccacuaggguugug

SEQ ID NO: 9952 - RNA, 20 nt, Homo sapiens
accaggaggcugaggccccu

SEQ ID NO: 9953 - RNA, 17 nt, Homo sapiens
ucgccuccuccucuccc

SEQ ID NO: 9954 - RNA, 21 nt, Homo sapiens
cggcggggacggcgauugguc

SEQ ID NO: 9955 - RNA, 22 nt, Homo sapiens
cauugcacuugucucggucuga

SEQ ID NO: 9956 - RNA, 22 nt, Homo sapiens
uccagcaucagugauuuuguug

SEQ ID NO: 9957 - RNA, 21 nt, Homo sapiens
gaaggcgcuucccuuuggagu

SEQ ID NO: 9958 - RNA, 22 nt, Homo sapiens
gaaggcgcuucccuuuagagcg

SEQ ID NO: 9959 - RNA, 19 nt, Homo sapiens
gggcgccugugaucccaac

SEQ ID NO: 9960 - RNA, 21 nt, Homo sapiens
aagccugcccggcuccucggg

SEQ ID NO: 9961 - RNA, 25 nt, Homo sapiens
ggcggagggaaguagguccguuggu

SEQ ID NO: 9962 - RNA, 22 nt, Homo sapiens
aggcggggcgccgcgggaccgc

SEQ ID NO: 9963 - RNA, 22 nt, Homo sapiens
gguggcccggccgugccugagg

SEQ ID NO: 9964 - RNA, 22 nt, Homo sapiens
ugcggggcuagggcuaacagca

SEQ ID NO: 9965 - RNA, 23 nt, Homo sapiens
cccaguguucagacuaccuguuc

SEQ ID NO: 9966 - RNA, 23 nt, Homo sapiens
cccaguguuuagacuaucuguuc

SEQ ID NO: 9967 - RNA, 22 nt, Homo sapiens
cauugcacuugucucggucuga

SEQ ID NO: 9968 - RNA, 22 nt, Homo sapiens
aauugcacgguauccaucugua

SEQ ID NO: 9969 - RNA, 22 nt, Homo sapiens
uaaugccccuaaaaauccuuau

SEQ ID NO: 9970 - RNA, 22 nt, Homo sapiens
caaccuggaggacuccaugcug

SEQ ID NO: 9971 - RNA, 22 nt, Homo sapiens
caagaaccucaguugcuuuugu

SEQ ID NO: 9972 - RNA, 19 nt, Homo sapiens
gagccaguuggacaggagc

SEQ ID NO: 9973 - RNA, 24 nt, Homo sapiens
gaccuggacauguuugugcccagu

SEQ ID NO: 9974 - RNA, 21 nt, Homo sapiens
guggcugcacucacuuccuuc

SEQ ID NO: 9975 - RNA, 22 nt, Homo sapiens
cacuggcuccuuucuggguaga

SEQ ID NO: 9976 - RNA, 23 nt, Homo sapiens
uacccuguagaaccgaauuugug

SEQ ID NO: 9977 - RNA, 21 nt, Homo sapiens
agugaaugauggguucugacc

SEQ ID NO: 9978 - RNA, 20 nt, Homo sapiens
uaaagagcccuguggagaca

SEQ ID NO: 9979 - RNA, 22 nt, Homo sapiens
cagugcaaugaugaaagggcau

SEQ ID NO: 9980 - RNA, 23 nt, Homo sapiens
aacauucaacgcugucggugagu

SEQ ID NO: 9981 - RNA, 23 nt, Homo sapiens
aacauucauugcugucggugggu

SEQ ID NO: 9982 - RNA, 22 nt, Homo sapiens
aacauucaaccugucggugagu

SEQ ID NO: 9983 - RNA, 23 nt, Homo sapiens
aacauucauuguugucggugggu

SEQ ID NO: 9984 - RNA, 22 nt, Homo sapiens
cgcaggggccgggugcucaccg

SEQ ID NO: 9985 - RNA, 22 nt, Homo sapiens
acagcaggcacagacaggcagu

SEQ ID NO: 9986 - RNA, 22 nt, Homo sapiens
aauugcacuuuagcaaugguga

SEQ ID NO: 9987 - RNA, 22 nt, Homo sapiens
gccugcugggguggaaccuggu

SEQ ID NO: 9988 - RNA, 21 nt, Homo sapiens
caaagaggaaggucccauuac

SEQ ID NO: 9989 - RNA, 22 nt, Homo sapiens
gucccucuccaaaugugucuug

SEQ ID NO: 9990 - RNA, 19 nt, Homo sapiens
gaugaugcugcugaugcug

SEQ ID NO: 9991 - RNA, 22 nt, Homo sapiens
ucaaaacugaggggcauuuucu

SEQ ID NO: 9992 - RNA, 23 nt, Homo sapiens
ugugcaaaucuaugcaaaacuga

SEQ ID NO: 9993 - RNA, 22 nt, Homo sapiens
aacaauauccuggugcugagug

SEQ ID NO: 9994 - RNA, 22 nt, Homo sapiens
agagguaguagguugcauaguu

SEQ ID NO: 9995 - RNA, 22 nt, Homo sapiens
uuggggaaacggccgcugagug

SEQ ID NO: 9996 - RNA, 23 nt, Homo sapiens
agguuguccguggugaguucgca

SEQ ID NO: 9997 - RNA, 22 nt, Homo sapiens
ugauugguacgucuguggguag

SEQ ID NO: 9998 - RNA, 22 nt, Homo sapiens
aaaaguauuugcggguuuuguc

SEQ ID NO: 9999 - RNA, 22 nt, Homo sapiens
ccaaaacugcaguuacuuuugc

SEQ ID NO: 10000 - RNA, 23 nt, Homo sapiens
aggaagcccuggaggggcuggag

SEQ ID NO: 10001 - RNA, 23 nt, Homo sapiens
uccaguaccacgugucagggcca

SEQ ID NO: 10002 - RNA, 21 nt, Homo sapiens
uaaagugcugacagugcagau

SEQ ID NO: 10003 - RNA, 26 nt, Homo sapiens
aaguaguugguuuguaugagaugguu

SEQ ID NO: 10004 - RNA, 22 nt, Homo sapiens
aggcauugacuucucacuagcu

SEQ ID NO: 10005 - RNA, 22 nt, Homo sapiens
ugugagguuggcauuguugucu

SEQ ID NO: 10006 - RNA, 22 nt, Homo sapiens
ugugacugguugaccagagggg

SEQ ID NO: 10007 - RNA, 21 nt, Homo sapiens
cauaaaguagaaagcacuacu

SEQ ID NO: 10008 - RNA, 23 nt, Homo sapiens
ucuggcuccgugucuucacuccc

SEQ ID NO: 10009 - RNA, 21 nt, Homo sapiens
auuugugcuuggcucugucac

SEQ ID NO: 10010 - RNA, 21 nt, Homo sapiens
uucacaguggcuaaguuccgc

SEQ ID NO: 10011 - RNA, 21 nt, Homo sapiens
uucacaguggcuaaguucugc

SEQ ID NO: 10012 - RNA, 22 nt, Homo sapiens
uaaugccccuaaaaauccuuau

SEQ ID NO: 10013 - RNA, 23 nt, Homo sapiens
ugaggggcagagagcgagacuuu

SEQ ID NO: 10014 - RNA, 22 nt, Homo sapiens
cgucaacacuugcugguuuccu

SEQ ID NO: 10015 - RNA, 22 nt, Homo sapiens
aacgcacuucccuuuagagugu

SEQ ID NO: 10016 - RNA, 22 nt, Homo sapiens
caaaguuuaagauccuugaagu

SEQ ID NO: 10017 - RNA, 20 nt, Homo sapiens
accaggaggcugaggccccu

SEQ ID NO: 10018 - RNA, 23 nt, Homo sapiens
caguaacaaagauucauccuugu

SEQ ID NO: 10019 - RNA, 25 nt, Homo sapiens
cuagugagggacagaaccaggauuc

SEQ ID NO: 10020 - RNA, 22 nt, Homo sapiens
ugagccccugugccgcccccag

SEQ ID NO: 10021 - RNA, 20 nt, Homo sapiens
ucguuugccuuuuucugcuu

SEQ ID NO: 10022 - RNA, 20 nt, Homo sapiens
agagguauagggcaugggaa

SEQ ID NO: 10023 - RNA, 22 nt, Homo sapiens
uguaaacauccuacacucagcu

SEQ ID NO: 10024 - RNA, 21 nt, Homo sapiens
acuggacuuggagucagaagg

SEQ ID NO: 10025 - RNA, 21 nt, Homo sapiens
ugaguuggccaucugagugag

SEQ ID NO: 10026 - RNA, 19 nt, Homo sapiens
agcugucugaaaaugucuu

SEQ ID NO: 10027 - RNA, 20 nt, Homo sapiens
cggcucugggucugugggga

SEQ ID NO: 10028 - RNA, 22 nt, Homo sapiens
uauaccucaguuuuaucaggug

SEQ ID NO: 10029 - RNA, 20 nt, Homo sapiens
uaaggcacgcggugaaugcc

SEQ ID NO: 10030 - RNA, 23 nt, Homo sapiens
ucuggcuccgugucuucacuccc

SEQ ID NO: 10031 - RNA, 22 nt, Homo sapiens
cgcaggggccgggugcucaccg

SEQ ID NO: 10032 - RNA, 23 nt, Homo sapiens
cccaguguucagacuaccuguuc

SEQ ID NO: 10033 - RNA, 23 nt, Homo sapiens
cccaguguuuagacuaucuguuc

SEQ ID NO: 10034 - RNA, 22 nt, Homo sapiens
uggcaguguauuguuagcuggu

SEQ ID NO: 10035 - RNA, 23 nt, Homo sapiens
ugaggggcagagagcgagacuuu

SEQ ID NO: 10036 - RNA, 22 nt, Homo sapiens
aguggggaacccuuccaugagg

SEQ ID NO: 10037 - RNA, 21 nt, Homo sapiens
uaaggcacccuucugaguaga

SEQ ID NO: 10038 - RNA, 22 nt, Homo sapiens
aaagugcauccuuuuagagugu

SEQ ID NO: 10039 - RNA, 22 nt, Homo sapiens
aaagugcauccuuuuagagguu

SEQ ID NO: 10040 - RNA, 22 nt, Homo sapiens
aaagugcaucuuuuuagaggau

SEQ ID NO: 10041 - RNA, 24 nt, Homo sapiens
cugaagugauguguaacugaucag

SEQ ID NO: 10042 - RNA, 25 nt, Homo sapiens
aggggugguguugggacagcuccgu

SEQ ID NO: 10043 - RNA, 19 nt, Homo sapiens
aagugugcagggcacuggu

SEQ ID NO: 10044 - RNA, 23 nt, Homo sapiens
uggugcggagagggcccacagug

SEQ ID NO: 10045 - RNA, 20 nt, Homo sapiens
ggggagcuguggaagcagua

SEQ ID NO: 10046 - RNA, 23 nt, Homo sapiens
uacccuguagauccgaauuugug

SEQ ID NO: 10047 - RNA, 23 nt, Homo sapiens
uacccuguagaaccgaauuugug

SEQ ID NO: 10048 - RNA, 20 nt, Homo sapiens
gugucugggcggacagcugc

SEQ ID NO: 10049 - RNA, 17 nt, Homo sapiens
ucccuguucgggcgcca

SEQ ID NO: 10050 - RNA, 23 nt, Homo sapiens
ucuggcuccgugucuucacuccc

SEQ ID NO: 10051 - RNA, 22 nt, Homo sapiens
cucccacugcuucacuugacua

SEQ ID NO: 10052 - RNA, 22 nt, Homo sapiens
uguaaacauccucgacuggaag

SEQ ID NO: 10053 - RNA, 22 nt, Homo sapiens
uguaaacauccuacacucagcu

SEQ ID NO: 10054 - RNA, 22 nt, Homo sapiens
uguaaacauccccgacuggaag

SEQ ID NO: 10055 - RNA, 22 nt, Homo sapiens
uguaaacauccuugacuggaag

SEQ ID NO: 10056 - RNA, 21 nt, Homo sapiens
ucacuccucuccucccgucuu

SEQ ID NO: 10057 - RNA, 22 nt, Homo sapiens
aauccuuugucccugggugaga

SEQ ID NO: 10058 - RNA, 22 nt, Homo sapiens
aucuggagguaagaagcacuuu

SEQ ID NO: 10059 - RNA, 22 nt, Homo sapiens
aacgcacuucccuuuagagugu

SEQ ID NO: 10060 - RNA, 22 nt, Homo sapiens
gaugagcucauuguaauaugag

SEQ ID NO: 10061 - RNA, 22 nt, Homo sapiens
uaugucugcugaccaucaccuu

SEQ ID NO: 10062 - RNA, 21 nt, Homo sapiens
ugagaugaagcacuguagcuc

SEQ ID NO: 10063 - RNA, 23 nt, Homo sapiens
uaaggugcaucuagugcagauag

SEQ ID NO: 10064 - RNA, 23 nt, Homo sapiens
uaaggugcaucuagugcaguuag

SEQ ID NO: 10065 - RNA, 23 nt, Homo sapiens
caacggaaucccaaaagcagcug

SEQ ID NO: 10066 - RNA, 22 nt, Homo sapiens
uguaacagcaacuccaugugga

SEQ ID NO: 10067 - RNA, 22 nt, Homo sapiens
cucccacugcuucacuugacua

SEQ ID NO: 10068 - RNA, 21 nt, Homo sapiens
uugugcuugaucuaaccaugu

SEQ ID NO: 10069 - RNA, 24 nt, Homo sapiens
agcagaagcagggagguucuccca

SEQ ID NO: 10070 - RNA, 22 nt, Homo sapiens
uguaaacauccuacacucagcu

SEQ ID NO: 10071 - RNA, 23 nt, Homo sapiens
cgcauccccuagggcauuggugu

SEQ ID NO: 10072 - RNA, 22 nt, Homo sapiens
cuggcccucucugcccuuccgu

SEQ ID NO: 10073 - RNA, 22 nt, Homo sapiens
aauugcacgguauccaucugua

SEQ ID NO: 10074 - RNA, 22 nt, Homo sapiens
ccucccacacccaaggcuugca

SEQ ID NO: 10075 - RNA, 22 nt, Homo sapiens
auucugcauuuuuagcaaguuc

SEQ ID NO: 10076 - RNA, 24 nt, Homo sapiens
ugccugggucucuggccugcgcgu

SEQ ID NO: 10077 - RNA, 23 nt, Homo sapiens
cuguaauauaaauuuaauuuauu

SEQ ID NO: 10078 - RNA, 23 nt, Homo sapiens
ucaagagcaauaacgaaaaaugu

SEQ ID NO: 10079 - RNA, 22 nt, Homo sapiens
ugaaggucuacugugugccagg

SEQ ID NO: 10080 - RNA, 21 nt, Homo sapiens
cagcagcacacugugguuugu

SEQ ID NO: 10081 - RNA, 21 nt, Homo sapiens
ccuguugaaguguaaucccca

SEQ ID NO: 10082 - RNA, 22 nt, Homo sapiens
ugagaacugaauuccauggguu

SEQ ID NO: 10083 - RNA, 21 nt, Homo sapiens
auuugugcuuggcucugucac

SEQ ID NO: 10084 - RNA, 22 nt, Homo sapiens
uaaucucagcuggcaacuguga

SEQ ID NO: 10085 - RNA, 22 nt, Homo sapiens
aucacacaaaggcaacuuuugu

SEQ ID NO: 10086 - RNA, 23 nt, Homo sapiens
aucaacagacauuaauugggcgc

SEQ ID NO: 10087 - RNA, 22 nt, Homo sapiens
agacccuggucugcacucuauc

SEQ ID NO: 10088 - RNA, 21 nt, Homo sapiens
cacaagguauugguauuaccu

SEQ ID NO: 10089 - RNA, 23 nt, Homo sapiens
acuugggcacugaaacaaugucc

SEQ ID NO: 10090 - RNA, 22 nt, Homo sapiens
ucuucucuguuuuggccaugug

SEQ ID NO: 10091 - RNA, 21 nt, Homo sapiens
aagcauucuuucauugguugg

SEQ ID NO: 10092 - RNA, 23 nt, Homo sapiens
caagucuuauuugagcaccuguu

SEQ ID NO: 10093 - RNA, 23 nt, Homo sapiens
uauggcuuuuuauuccuauguga

SEQ ID NO: 10094 - RNA, 22 nt, Homo sapiens
ugagaacugaauuccauggguu

SEQ ID NO: 10095 - RNA, 22 nt, Homo sapiens
caaccuggaggacuccaugcug

SEQ ID NO: 10096 - RNA, 19 nt, Homo sapiens
ugucucugcugggguuucu

SEQ ID NO: 10097 - RNA, 20 nt, Homo sapiens
agaccauggguucucauugu

SEQ ID NO: 10098 - RNA, 22 nt, Homo sapiens
uggagugugacaaugguguuug

SEQ ID NO: 10099 - RNA, 23 nt, Homo sapiens
ucuuugguuaucuagcuguauga

SEQ ID NO: 10100 - RNA, 23 nt, Homo sapiens
caagucuuauuugagcaccuguu

SEQ ID NO: 10101 - RNA, 22 nt, Homo sapiens
uugcauagucacaaaagugauc

SEQ ID NO: 10102 - RNA, 22 nt, Homo sapiens
uaaugccccuaaaaauccuuau

SEQ ID NO: 10103 - RNA, 22 nt, Homo sapiens
aaaaguaauugcgaguuuuacc

SEQ ID NO: 10104 - RNA, 22 nt, Homo sapiens
aaaaguaauugugguuuuggcc

SEQ ID NO: 10105 - RNA, 22 nt, Homo sapiens
aaaaguaauugcgguuuuugcc

SEQ ID NO: 10106 - RNA, 22 nt, Homo sapiens
aaaaguaauugugguuuuugcc

SEQ ID NO: 10107 - RNA, 22 nt, Homo sapiens
aaaaguaaucgcgguuuuuguc

SEQ ID NO: 10108 - RNA, 22 nt, Homo sapiens
aaaaguaauugcggauuuugcc

SEQ ID NO: 10109 - RNA, 22 nt, Homo sapiens
aaaaguaauugcggucuuuggu

SEQ ID NO: 10110 - RNA, 21 nt, Homo sapiens
uaaaguaaauaugcaccaaaa

SEQ ID NO: 10111 - RNA, 23 nt, Homo sapiens
aguauguucuuccaggacagaac

SEQ ID NO: 10112 - RNA, 22 nt, Homo sapiens
uugcauagucacaaaagugauc

SEQ ID NO: 10113 - RNA, 23 nt, Homo sapiens
ugguuguaguccgugcgagaaua

SEQ ID NO: 10114 - RNA, 23 nt, Homo sapiens
aguauguucuuccaggacagaac

SEQ ID NO: 10115 - RNA, 23 nt, Homo sapiens
caagucuuauuugagcaccuguu

SEQ ID NO: 10116 - RNA, 23 nt, Homo sapiens
cuggagauauggaagagcugugu

SEQ ID NO: 10117 - RNA, 23 nt, Homo sapiens
uuauugcuuaagaauacgcguag

SEQ ID NO: 10118 - RNA, 22 nt, Homo sapiens
uugcauagucacaaaagugauc

SEQ ID NO: 10119 - RNA, 22 nt, Homo sapiens
aacuguuugcagaggaaacuga

SEQ ID NO: 10120 - RNA, 21 nt, Homo sapiens
uagcagcacagaaauauuggc

SEQ ID NO: 10121 - RNA, 22 nt, Homo sapiens
uuuugcaauauguuccugaaua

SEQ ID NO: 10122 - RNA, 20 nt, Homo sapiens
auggagauagauauagaaau

SEQ ID NO: 10123 - RNA, 19 nt, Homo sapiens
ucuaggcugguacugcuga

SEQ ID NO: 10124 - RNA, 23 nt, Homo sapiens
caagucuuauuugagcaccuguu

SEQ ID NO: 10125 - RNA, 22 nt, Homo sapiens
cugugcgugugacagcggcuga

SEQ ID NO: 10126 - RNA, 22 nt, Homo sapiens
uaaugccccuaaaaauccuuau

SEQ ID NO: 10127 - RNA, 22 nt, Homo sapiens
aaaaguaauugcgaguuuuacc

SEQ ID NO: 10128 - RNA, 22 nt, Homo sapiens
aaaaguaauugugguuuuggcc

SEQ ID NO: 10129 - RNA, 22 nt, Homo sapiens
aaaaguaauugcgguuuuugcc

SEQ ID NO: 10130 - RNA, 22 nt, Homo sapiens
aaaaguaauugugguuuuugcc

SEQ ID NO: 10131 - RNA, 22 nt, Homo sapiens
aaaaguaaucgcgguuuuuguc

SEQ ID NO: 10132 - RNA, 22 nt, Homo sapiens
aaaaguaauugcggauuuugcc

SEQ ID NO: 10133 - RNA, 22 nt, Homo sapiens
aaaaguaauugcggucuuuggu

SEQ ID NO: 10134 - RNA, 21 nt, Homo sapiens
uaaaguaaauaugcaccaaaa

SEQ ID NO: 10135 - RNA, 23 nt, Homo sapiens
aguauguucuuccaggacagaac

SEQ ID NO: 10136 - RNA, 27 nt, Homo sapiens
accuucuuguauaagcacugugcuaaa

SEQ ID NO: 10137 - RNA, 22 nt, Homo sapiens
uucuggaauucugugugaggga

SEQ ID NO: 10138 - RNA, 21 nt, Homo sapiens
uaccacaggguagaaccacgg

SEQ ID NO: 10139 - RNA, 22 nt, Homo sapiens
uuauaaagcaaugagacugauu

SEQ ID NO: 10140 - RNA, 22 nt, Homo sapiens
ucagcaaacauuuauugugugc

SEQ ID NO: 10141 - RNA, 22 nt, Homo sapiens
agacuucccauuugaagguggc

SEQ ID NO: 10142 - RNA, 23 nt, Homo sapiens
aucccuugcaggggcuguugggu

SEQ ID NO: 10143 - RNA, 22 nt, Homo sapiens
uucaccaccuucuccacccagc

SEQ ID NO: 10144 - RNA, 22 nt, Homo sapiens
aagcugccaguugaagaacugu

SEQ ID NO: 10145 - RNA, 22 nt, Homo sapiens
agaucagaaggugauuguggcu

SEQ ID NO: 10146 - RNA, 22 nt, Homo sapiens
aaaagcuggguugagagggcga

SEQ ID NO: 10147 - RNA, 22 nt, Homo sapiens
aaaagcuggguugagagggcaa

SEQ ID NO: 10148 - RNA, 20 nt, Homo sapiens
aaaagcuggguugagagggu

SEQ ID NO: 10149 - RNA, 19 nt, Homo sapiens
aaaagcuggguugagagga

SEQ ID NO: 10150 - RNA, 20 nt, Homo sapiens
gugcauugcuguugcauugc

SEQ ID NO: 10151 - RNA, 22 nt, Homo sapiens
gagugccuucuuuuggagcguu

SEQ ID NO: 10152 - RNA, 22 nt, Homo sapiens
aagugccuccuuuuagaguguu

SEQ ID NO: 10153 - RNA, 23 nt, Homo sapiens
agugccugagggaguaagagccc

SEQ ID NO: 10154 - RNA, 22 nt, Homo sapiens
aagauguggaaaaauuggaauc

SEQ ID NO: 10155 - RNA, 19 nt, Homo sapiens
ugucucugcugggguuucu

SEQ ID NO: 10156 - RNA, 23 nt, Homo sapiens
acuugggcacugaaacaaugucc

SEQ ID NO: 10157 - RNA, 21 nt, Homo sapiens
uccuucugcuccgucccccag

SEQ ID NO: 10158 - RNA, 21 nt, Homo sapiens
uaccacaggguagaaccacgg

SEQ ID NO: 10159 - RNA, 22 nt, Homo sapiens
uguaacagcaacuccaugugga

SEQ ID NO: 10160 - RNA, 23 nt, Homo sapiens
agcuacauugucugcuggguuuc

SEQ ID NO: 10161 - RNA, 21 nt, Homo sapiens
agcuacaucuggcuacugggu

SEQ ID NO: 10162 - RNA, 21 nt, Homo sapiens
uggcagggaggcugggagggg

SEQ ID NO: 10163 - RNA, 22 nt, Homo sapiens
aggcauugacuucucacuagcu

SEQ ID NO: 10164 - RNA, 18 nt, Homo sapiens
cgggcguggugguggggg

SEQ ID NO: 10165 - RNA, 19 nt, Homo sapiens
gaugaugcugcugaugcug

SEQ ID NO: 10166 - RNA, 22 nt, Homo sapiens
cgcaggggccgggugcucaccg

SEQ ID NO: 10167 - RNA, 25 nt, Homo sapiens
cccccacaaccgcgcuugacuagcu

SEQ ID NO: 10168 - RNA, 22 nt, Homo sapiens
cucccacugcuucacuugacua

SEQ ID NO: 10169 - RNA, 21 nt, Homo sapiens
uaaagugcugacagugcagau

SEQ ID NO: 10170 - RNA, 23 nt, Homo sapiens
cagugcaaugauauugucaaagc

SEQ ID NO: 10171 - RNA, 22 nt, Homo sapiens
uaugucugcugaccaucaccuu

SEQ ID NO: 10172 - RNA, 22 nt, Homo sapiens
ugagaccucuggguucugagcu

SEQ ID NO: 10173 - RNA, 23 nt, Homo sapiens
uaaggugcaucuagugcagauag

SEQ ID NO: 10174 - RNA, 21 nt, Homo sapiens
cggcggggacggcgauugguc

SEQ ID NO: 10175 - RNA, 22 nt, Homo sapiens
uuggggaaacggccgcugagug

SEQ ID NO: 10176 - RNA, 23 nt, Homo sapiens
agcucggucugaggccccucagu

SEQ ID NO: 10177 - RNA, 19 nt, Homo sapiens
aggcugcggaauucaggac

SEQ ID NO: 10178 - RNA, 22 nt, Homo sapiens
aggcggggcgccgcgggaccgc

SEQ ID NO: 10179 - RNA, 22 nt, Homo sapiens
ugcggggcuagggcuaacagca

SEQ ID NO: 10180 - RNA, 22 nt, Homo sapiens
cugcccuggcccgagggaccga

SEQ ID NO: 10181 - RNA, 22 nt, Homo sapiens
aggcagcgggguguaguggaua

SEQ ID NO: 10182 - RNA, 24 nt, Homo sapiens
agccuggaagcuggagccugcagu

SEQ ID NO: 10183 - RNA, 21 nt, Homo sapiens
agggcccccccucaauccugu

SEQ ID NO: 10184 - RNA, 20 nt, Homo sapiens
ggggagcuguggaagcagua

SEQ ID NO: 10185 - RNA, 20 nt, Homo sapiens
ggggagcuguggaagcagua

SEQ ID NO: 10186 - RNA, 24 nt, Homo sapiens
uggggagcugaggcucugggggug

SEQ ID NO: 10187 - RNA, 22 nt, Homo sapiens
acucggcguggcgucggucgug

SEQ ID NO: 10188 - RNA, 22 nt, Homo sapiens
cucggcgcggggcgcgggcucc

SEQ ID NO: 10189 - RNA, 21 nt, Homo sapiens
gcccuccgcccgugcaccccg

SEQ ID NO: 10190 - RNA, 22 nt, Homo sapiens
ucugcccccuccgcugcugcca

SEQ ID NO: 10191 - RNA, 22 nt, Homo sapiens
cauugcacuugucucggucuga

SEQ ID NO: 10192 - RNA, 20 nt, Homo sapiens
acugccccaggugcugcugg

SEQ ID NO: 10193 - RNA, 21 nt, Homo sapiens
gccccugggccuauccuagaa

SEQ ID NO: 10194 - RNA, 21 nt, Homo sapiens
cggggcagcucaguacaggau

SEQ ID NO: 10195 - RNA, 23 nt, Homo sapiens
ugagugugugugugugagugugu

SEQ ID NO: 10196 - RNA, 23 nt, Homo sapiens
acuugggcacugaaacaaugucc

SEQ ID NO: 10197 - RNA, 19 nt, Homo sapiens
aagugugcagggcacuggu

SEQ ID NO: 10198 - RNA, 25 nt, Homo sapiens
ggcggagggaaguagguccguuggu

SEQ ID NO: 10199 - RNA, 21 nt, Homo sapiens
cccggagccaggaugcagcuc

SEQ ID NO: 10200 - RNA, 18 nt, Homo sapiens
cagggaggugaaugugau

SEQ ID NO: 10201 - RNA, 23 nt, Homo sapiens
ucuggcuccgugucuucacuccc

SEQ ID NO: 10202 - RNA, 21 nt, Homo sapiens
uccugcgcgucccagaugccc

SEQ ID NO: 10203 - RNA, 21 nt, Homo sapiens
cggcggggacggcgauugguc

SEQ ID NO: 10204 - RNA, 23 nt, Homo sapiens
ugaguaccgccaugucuguuggg

SEQ ID NO: 10205 - RNA, 20 nt, Homo sapiens
ccuccugcccuccuugcugu

SEQ ID NO: 10206 - RNA, 23 nt, Homo sapiens
agugccugagggaguaagagccc

SEQ ID NO: 10207 - RNA, 19 nt, Homo sapiens
aggcugcggaauucaggac

SEQ ID NO: 10208 - RNA, 21 nt, Homo sapiens
cgcgggugcuuacugacccuu

SEQ ID NO: 10209 - RNA, 21 nt, Homo sapiens
cccggagccaggaugcagcuc

SEQ ID NO: 10210 - RNA, 21 nt, Homo sapiens
uuaggccgcagaucuggguga

SEQ ID NO: 10211 - RNA, 20 nt, Homo sapiens
ccccagggcgacgcggcggg

SEQ ID NO: 10212 - RNA, 22 nt, Homo sapiens
agaggcuggccgugaugaauuc

SEQ ID NO: 10213 - RNA, 20 nt, Homo sapiens
aaaguagcuguaccauuugc

SEQ ID NO: 10214 - RNA, 19 nt, Homo sapiens
gggcgccugugaucccaac

SEQ ID NO: 10215 - RNA, 19 nt, Homo sapiens
aggcugcggaauucaggac

SEQ ID NO: 10216 - RNA, 21 nt, Homo sapiens
uacuuggaaaggcaucaguug

SEQ ID NO: 10217 - RNA, 20 nt, Homo sapiens
ggggagcuguggaagcagua

SEQ ID NO: 10218 - RNA, 21 nt, Homo sapiens
ccccaccuccucucuccucag

SEQ ID NO: 10219 - RNA, 22 nt, Homo sapiens
ugagccccugugccgcccccag

SEQ ID NO: 10220 - RNA, 20 nt, Homo sapiens
ugagcccuguccucccgcag

SEQ ID NO: 10221 - RNA, 24 nt, Homo sapiens
ucccugagacccuuuaaccuguga

SEQ ID NO: 10222 - RNA, 22 nt, Homo sapiens
ucccugagacccuaacuuguga

SEQ ID NO: 10223 - RNA, 23 nt, Homo sapiens
ccucagggcuguagaacagggcu

SEQ ID NO: 10224 - RNA, 21 nt, Homo sapiens
ucgaggagcucacagucuagu

SEQ ID NO: 10225 - RNA, 22 nt, Homo sapiens
uccgagccugggucucccucuu

SEQ ID NO: 10226 - RNA, 21 nt, Homo sapiens
uggaggagaaggaaggugaug

SEQ ID NO: 10227 - RNA, 20 nt, Homo sapiens
ggggagcuguggaagcagua

SEQ ID NO: 10228 - RNA, 23 nt, Homo sapiens
ccugcagcgacuugauggcuucc

SEQ ID NO: 10229 - RNA, 20 nt, Homo sapiens
ucugcaggguuugcuuugag

SEQ ID NO: 10230 - RNA, 20 nt, Homo sapiens
guguguggaaaugcuucugc

SEQ ID NO: 10231 - RNA, 21 nt, Homo sapiens
cggcggggacggcgauugguc

SEQ ID NO: 10232 - RNA, 23 nt, Homo sapiens
uaaaucccauggugccuucuccu

SEQ ID NO: 10233 - RNA, 22 nt, Homo sapiens
agacuucccauuugaagguggc

SEQ ID NO: 10234 - RNA, 22 nt, Homo sapiens
aggcggggcgccgcgggaccgc

SEQ ID NO: 10235 - RNA, 22 nt, Homo sapiens
gguggcccggccgugccugagg

SEQ ID NO: 10236 - RNA, 21 nt, Homo sapiens
agagaagaagaucagccugca

SEQ ID NO: 10237 - RNA, 24 nt, Homo sapiens
ucccugagacccuuuaaccuguga

SEQ ID NO: 10238 - RNA, 22 nt, Homo sapiens
ucccugagacccuaacuuguga

SEQ ID NO: 10239 - RNA, 23 nt, Homo sapiens
ccucagggcuguagaacagggcu

SEQ ID NO: 10240 - RNA, 20 nt, Homo sapiens
ccucugggcccuuccuccag

SEQ ID NO: 10241 - RNA, 22 nt, Homo sapiens
ucucugggccugugucuuaggc

SEQ ID NO: 10242 - RNA, 22 nt, Homo sapiens
aauugcacgguauccaucugua

SEQ ID NO: 10243 - RNA, 22 nt, Homo sapiens
ucuucucuguuuuggccaugug

SEQ ID NO: 10244 - RNA, 18 nt, Homo sapiens
cgggcguggugguggggg

SEQ ID NO: 10245 - RNA, 17 nt, Homo sapiens
gugggggagaggcuguc

SEQ ID NO: 10246 - RNA, 22 nt, Homo sapiens
ggagacgcggcccuguuggagu

SEQ ID NO: 10247 - RNA, 20 nt, Homo sapiens
ccccagggcgacgcggcggg

SEQ ID NO: 10248 - RNA, 22 nt, Homo sapiens
cauugcacuugucucggucuga

SEQ ID NO: 10249 - RNA, 21 nt, Homo sapiens
gccccugggccuauccuagaa

SEQ ID NO: 10250 - RNA, 23 nt, Homo sapiens
ucccccaggugugauucugauuu

SEQ ID NO: 10251 - RNA, 22 nt, Homo sapiens
uuuguucguucggcucgcguga

SEQ ID NO: 10252 - RNA, 23 nt, Homo sapiens
ugaggggcagagagcgagacuuu

SEQ ID NO: 10253 - RNA, 22 nt, Homo sapiens
uggugggcacagaaucuggacu

SEQ ID NO: 10254 - RNA, 24 nt, Homo sapiens
acugggggcuuucgggcucugcgu

SEQ ID NO: 10255 - RNA, 22 nt, Homo sapiens
uggugggccgcagaacaugugc

SEQ ID NO: 10256 - RNA, 22 nt, Homo sapiens
ugagaccucuggguucugagcu

SEQ ID NO: 10257 - RNA, 22 nt, Homo sapiens
cacuggcuccuuucuggguaga

SEQ ID NO: 10258 - RNA, 21 nt, Homo sapiens
gugccagcugcagugggggag

SEQ ID NO: 10259 - RNA, 21 nt, Homo sapiens
uggcagggaggcugggagggg

SEQ ID NO: 10260 - RNA, 22 nt, Homo sapiens
ugagccccugugccgcccccag

SEQ ID NO: 10261 - RNA, 17 nt, Homo sapiens
ucccuguucgggcgcca

SEQ ID NO: 10262 - RNA, 22 nt, Homo sapiens
uucuggaauucugugugaggga

SEQ ID NO: 10263 - RNA, 22 nt, Homo sapiens
aagcccuuaccccaaaaagcau

SEQ ID NO: 10264 - RNA, 18 nt, Homo sapiens
cagggaggugaaugugau

SEQ ID NO: 10265 - RNA, 23 nt, Homo sapiens
uaaggugcaucuagugcagauag

SEQ ID NO: 10266 - RNA, 22 nt, Homo sapiens
cgcaggggccgggugcucaccg

SEQ ID NO: 10267 - RNA, 22 nt, Homo sapiens
uacccagagcaugcagugugaa

SEQ ID NO: 10268 - RNA, 20 nt, Homo sapiens
ccccagggcgacgcggcggg

SEQ ID NO: 10269 - RNA, 22 nt, Homo sapiens
acagcaggcacagacaggcagu

SEQ ID NO: 10270 - RNA, 22 nt, Homo sapiens
aauugcacuuuagcaaugguga

SEQ ID NO: 10271 - RNA, 22 nt, Homo sapiens
gccugcugggguggaaccuggu

SEQ ID NO: 10272 - RNA, 25 nt, Homo sapiens
aggggugguguugggacagcuccgu

SEQ ID NO: 10273 - RNA, 22 nt, Homo sapiens
ugcggggcuagggcuaacagca

SEQ ID NO: 10274 - RNA, 20 nt, Homo sapiens
cggcucugggucugugggga

SEQ ID NO: 10275 - RNA, 22 nt, Homo sapiens
cugcccuggcccgagggaccga

SEQ ID NO: 10276 - RNA, 20 nt, Homo sapiens
ggggagcuguggaagcagua

SEQ ID NO: 10277 - RNA, 22 nt, Homo sapiens
ugcccuuaaaggugaacccagu

SEQ ID NO: 10278 - RNA, 24 nt, Homo sapiens
uuuggcaaugguagaacucacacu

SEQ ID NO: 10279 - RNA, 21 nt, Homo sapiens
cggcggggacggcgauugguc

SEQ ID NO: 10280 - RNA, 22 nt, Homo sapiens
uagguaguuuccuguuguuggg

SEQ ID NO: 10281 - RNA, 20 nt, Homo sapiens
auuccuagaaauuguucaua

SEQ ID NO: 10282 - RNA, 21 nt, Homo sapiens
gcgacccacucuugguuucca

SEQ ID NO: 10283 - RNA, 21 nt, Homo sapiens
gcgacccauacuugguuucag

SEQ ID NO: 10284 - RNA, 24 nt, Homo sapiens
ugccugggucucuggccugcgcgu

SEQ ID NO: 10285 - RNA, 22 nt, Homo sapiens
aggcggggcgccgcgggaccgc

SEQ ID NO: 10286 - RNA, 22 nt, Homo sapiens
ugcggggcuagggcuaacagca

SEQ ID NO: 10287 - RNA, 23 nt, Homo sapiens
cgggucggaguuagcucaagcgg

SEQ ID NO: 10288 - RNA, 20 nt, Homo sapiens
uacaguauagaugauguacu

SEQ ID NO: 10289 - RNA, 23 nt, Homo sapiens
caaagugcuuacagugcagguag

SEQ ID NO: 10290 - RNA, 22 nt, Homo sapiens
uguaacagcaacuccaugugga

SEQ ID NO: 10291 - RNA, 22 nt, Homo sapiens
cucccacugcuucacuugacua

SEQ ID NO: 10292 - RNA, 21 nt, Homo sapiens
cacauuacacggucgaccucu

SEQ ID NO: 10293 - RNA, 22 nt, Homo sapiens
uauguaauaugguccacaucuu

SEQ ID NO: 10294 - RNA, 22 nt, Homo sapiens
aggcaguguauuguuagcuggc

SEQ ID NO: 10295 - RNA, 22 nt, Homo sapiens
uacugcagacguggcaaucaug

SEQ ID NO: 10296 - RNA, 21 nt, Homo sapiens
uacugcagacaguggcaauca

SEQ ID NO: 10297 - RNA, 21 nt, Homo sapiens
gugucuuuugcucugcaguca

SEQ ID NO: 10298 - RNA, 24 nt, Homo sapiens
aaagacauaggauagagucaccuc

SEQ ID NO: 10299 - RNA, 22 nt, Homo sapiens
ugagccccugugccgcccccag

SEQ ID NO: 10300 - RNA, 26 nt, Homo sapiens
gaugaugauggcagcaaauucugaaa

SEQ ID NO: 10301 - RNA, 22 nt, Homo sapiens
uggguggucuggagauuugugc

SEQ ID NO: 10302 - RNA, 22 nt, Homo sapiens
uggagagaaaggcaguuccuga

SEQ ID NO: 10303 - RNA, 21 nt, Homo sapiens
ccaccaccgugucugacacuu

SEQ ID NO: 10304 - RNA, 20 nt, Homo sapiens
ccucugggcccuuccuccag

SEQ ID NO: 10305 - RNA, 22 nt, Homo sapiens
ucucugggccugugucuuaggc

SEQ ID NO: 10306 - RNA, 22 nt, Homo sapiens
aucaugaugggcuccucggugu

SEQ ID NO: 10307 - RNA, 18 nt, Homo sapiens
ugcuuccuuucagagggu

SEQ ID NO: 10308 - RNA, 22 nt, Homo sapiens
aucuggagguaagaagcacuuu

SEQ ID NO: 10309 - RNA, 19 nt, Homo sapiens
aagcagcugccucugaggc

SEQ ID NO: 10310 - RNA, 22 nt, Homo sapiens
aggcauugacuucucacuagcu

SEQ ID NO: 10311 - RNA, 22 nt, Homo sapiens
caaagaauucuccuuuugggcu

SEQ ID NO: 10312 - RNA, 22 nt, Homo sapiens
ucugcccccuccgcugcugcca

SEQ ID NO: 10313 - RNA, 22 nt, Homo sapiens
uagcuuaucagacugauguuga

SEQ ID NO: 10314 - RNA, 22 nt, Homo sapiens
aaggagcucacagucuauugag

SEQ ID NO: 10315 - RNA, 20 nt, Homo sapiens
acugccccaggugcugcugg

SEQ ID NO: 10316 - RNA, 23 nt, Homo sapiens
gcaaagcacacggccugcagaga

SEQ ID NO: 10317 - RNA, 22 nt, Homo sapiens
uaaugccccuaaaaauccuuau

SEQ ID NO: 10318 - RNA, 21 nt, Homo sapiens
cggggcagcucaguacaggau

SEQ ID NO: 10319 - RNA, 24 nt, Homo sapiens
acaaagugcuucccuuuagagugu

SEQ ID NO: 10320 - RNA, 22 nt, Homo sapiens
acaaagugcuucccuuuagagu

SEQ ID NO: 10321 - RNA, 21 nt, Homo sapiens
aggguaagcugaaccucugau

SEQ ID NO: 10322 - RNA, 19 nt, Homo sapiens
ugagcugcuguaccaaaau

SEQ ID NO: 10323 - RNA, 19 nt, Homo sapiens
aagcagcugccucugaggc

SEQ ID NO: 10324 - RNA, 23 nt, Homo sapiens
aaggagcuuacaaucuagcuggg

SEQ ID NO: 10325 - RNA, 22 nt, Homo sapiens
ucuucucuguuuuggccaugug

SEQ ID NO: 10326 - RNA, 20 nt, Homo sapiens
ccccagggcgacgcggcggg

SEQ ID NO: 10327 - RNA, 22 nt, Homo sapiens
uuggggaaacggccgcugagug

SEQ ID NO: 10328 - RNA, 21 nt, Homo sapiens
uucacaguggcuaaguuccgc

SEQ ID NO: 10329 - RNA, 21 nt, Homo sapiens
aggggugcuaucugugauuga

SEQ ID NO: 10330 - RNA, 23 nt, Homo sapiens
uggugcggagagggcccacagug

SEQ ID NO: 10331 - RNA, 21 nt, Homo sapiens
uggaggagaaggaaggugaug

SEQ ID NO: 10332 - RNA, 22 nt, Homo sapiens
ugagccccugugccgcccccag

SEQ ID NO: 10333 - RNA, 22 nt, Homo sapiens
ccucuuccccuugucucuccag

SEQ ID NO: 10334 - RNA, 24 nt, Homo sapiens
ucccugagacccuuuaaccuguga

SEQ ID NO: 10335 - RNA, 22 nt, Homo sapiens
ucccugagacccuaacuuguga

SEQ ID NO: 10336 - RNA, 22 nt, Homo sapiens
augguacccuggcauacugagu

SEQ ID NO: 10337 - RNA, 22 nt, Homo sapiens
augguacccuggcauacugagu

SEQ ID NO: 10338 - RNA, 23 nt, Homo sapiens
ccucagggcuguagaacagggcu

SEQ ID NO: 10339 - RNA, 23 nt, Homo sapiens
uauggcuuuucauuccuauguga

SEQ ID NO: 10340 - RNA, 20 nt, Homo sapiens
auuccuagaaauuguucaua

SEQ ID NO: 10341 - RNA, 22 nt, Homo sapiens
auucugcauuuuuagcaaguuc

SEQ ID NO: 10342 - RNA, 21 nt, Homo sapiens
ccccaccuccucucuccucag

SEQ ID NO: 10343 - RNA, 22 nt, Homo sapiens
ggagacgcggcccuguuggagu

SEQ ID NO: 10344 - RNA, 21 nt, Homo sapiens
cggcggggacggcgauugguc

SEQ ID NO: 10345 - RNA, 21 nt, Homo sapiens
aggggugcuaucugugauuga

SEQ ID NO: 10346 - RNA, 22 nt, Homo sapiens
aggcggggcgccgcgggaccgc

SEQ ID NO: 10347 - RNA, 17 nt, Homo sapiens
ucucgcuggggccucca

SEQ ID NO: 10348 - RNA, 22 nt, Homo sapiens
ugcggggcuagggcuaacagca

SEQ ID NO: 10349 - RNA, 21 nt, Homo sapiens
aguuaggauuaggucguggaa

SEQ ID NO: 10350 - RNA, 23 nt, Homo sapiens
caagucuuauuugagcaccuguu

SEQ ID NO: 10351 - RNA, 21 nt, Homo sapiens
cauaaaguagaaagcacuacu

SEQ ID NO: 10352 - RNA, 23 nt, Homo sapiens
ugguuguaguccgugcgagaaua

SEQ ID NO: 10353 - RNA, 21 nt, Homo sapiens
aucacauugccagggauuucc

SEQ ID NO: 10354 - RNA, 21 nt, Homo sapiens
aucacauugccagggauuacc

SEQ ID NO: 10355 - RNA, 22 nt, Homo sapiens
uuauaaagcaaugagacugauu

SEQ ID NO: 10356 - RNA, 21 nt, Homo sapiens
aucauagaggaaaauccacgu

SEQ ID NO: 10357 - RNA, 22 nt, Homo sapiens
aucauagaggaaaauccauguu

SEQ ID NO: 10358 - RNA, 22 nt, Homo sapiens
aucacacaaaggcaacuuuugu

SEQ ID NO: 10359 - RNA, 21 nt, Homo sapiens
uuaagacuugcagugauguuu

SEQ ID NO: 10360 - RNA, 22 nt, Homo sapiens
aaaaguaauugcgaguuuuacc

SEQ ID NO: 10361 - RNA, 22 nt, Homo sapiens
aaaaguaauugugguuuuggcc

SEQ ID NO: 10362 - RNA, 22 nt, Homo sapiens
aaaaguaauugcgguuuuugcc

SEQ ID NO: 10363 - RNA, 22 nt, Homo sapiens
aaaaguaauugugguuuuugcc

SEQ ID NO: 10364 - RNA, 22 nt, Homo sapiens
aaaaguaaucgcgguuuuuguc

SEQ ID NO: 10365 - RNA, 22 nt, Homo sapiens
aaaaguaauugcggauuuugcc

SEQ ID NO: 10366 - RNA, 22 nt, Homo sapiens
aaaaguaauugcggucuuuggu

SEQ ID NO: 10367 - RNA, 21 nt, Homo sapiens
uaaaguaaauaugcaccaaaa

SEQ ID NO: 10368 - RNA, 22 nt, Homo sapiens
cuggacugagccgugcuacugg

SEQ ID NO: 10369 - RNA, 19 nt, Homo sapiens
gaugaugcugcugaugcug

SEQ ID NO: 10370 - RNA, 20 nt, Homo sapiens
agagguauagggcaugggaa

SEQ ID NO: 10371 - RNA, 21 nt, Homo sapiens
acuggacuuggagucagaagg

SEQ ID NO: 10372 - RNA, 22 nt, Homo sapiens
gaaguuguucgugguggauucg

SEQ ID NO: 10373 - RNA, 22 nt, Homo sapiens
acuggacuuagggucagaaggc

SEQ ID NO: 10374 - RNA, 21 nt, Homo sapiens
gcaguccaugggcauauacac

SEQ ID NO: 10375 - RNA, 23 nt, Homo sapiens
uaauccuugcuaccugggugaga

SEQ ID NO: 10376 - RNA, 22 nt, Homo sapiens
aaugcacccgggcaaggauucu

SEQ ID NO: 10377 - RNA, 22 nt, Homo sapiens
aaugcaccugggcaaggauuca

SEQ ID NO: 10378 - RNA, 22 nt, Homo sapiens
agaaggaaauugaauucauuua

SEQ ID NO: 10379 - RNA, 22 nt, Homo sapiens
aggcauugacuucucacuagcu

SEQ ID NO: 10380 - RNA, 22 nt, Homo sapiens
ucugggcaacaaagugagaccu

SEQ ID NO: 10381 - RNA, 22 nt, Homo sapiens
cagugcaaugaugaaagggcau

SEQ ID NO: 10382 - RNA, 20 nt, Homo sapiens
guguguggaaaugcuucugc

SEQ ID NO: 10383 - RNA, 20 nt, Homo sapiens
ccccagggcgacgcggcggg

SEQ ID NO: 10384 - RNA, 21 nt, Homo sapiens
caaagaggaaggucccauuac

SEQ ID NO: 10385 - RNA, 22 nt, Homo sapiens
uaugcauuguauuuuuaggucc

SEQ ID NO: 10386 - RNA, 25 nt, Homo sapiens
gcugggcagggcuucugagcuccuu

SEQ ID NO: 10387 - RNA, 22 nt, Homo sapiens
agucauuggaggguuugagcag

SEQ ID NO: 10388 - RNA, 19 nt, Homo sapiens
aguguggcuuucuuagagc

SEQ ID NO: 10389 - RNA, 24 nt, Homo sapiens
uggcccugacugaagaccagcagu

SEQ ID NO: 10390 - RNA, 25 nt, Homo sapiens
ugggaacggguuccggcagacgcug

SEQ ID NO: 10391 - RNA, 21 nt, Homo sapiens
gcccuccgcccgugcaccccg

SEQ ID NO: 10392 - RNA, 21 nt, Homo sapiens
uccugcgcgucccagaugccc

SEQ ID NO: 10393 - RNA, 21 nt, Homo sapiens
cggcggggacggcgauugguc

SEQ ID NO: 10394 - RNA, 23 nt, Homo sapiens
ugaggggcagagagcgagacuuu

SEQ ID NO: 10395 - RNA, 19 nt, Homo sapiens
ugagcugcuguaccaaaau

SEQ ID NO: 10396 - RNA, 19 nt, Homo sapiens
aggcacggugucagcaggc

SEQ ID NO: 10397 - RNA, 20 nt, Homo sapiens
guccgcucggcgguggccca

SEQ ID NO: 10398 - RNA, 25 nt, Homo sapiens
ggcggagggaaguagguccguuggu

SEQ ID NO: 10399 - RNA, 22 nt, Homo sapiens
aggcggggcgccgcgggaccgc

SEQ ID NO: 10400 - RNA, 22 nt, Homo sapiens
ugcggggcuagggcuaacagca

SEQ ID NO: 10401 - RNA, 21 nt, Homo sapiens
uggcagggaggcugggagggg

SEQ ID NO: 10402 - RNA, 20 nt, Homo sapiens
gugucugggcggacagcugc

SEQ ID NO: 10403 - RNA, 22 nt, Homo sapiens
acccgucccguucguccccgga

SEQ ID NO: 10404 - RNA, 18 nt, Homo sapiens
gucccuguucaggcgcca

SEQ ID NO: 10405 - RNA, 18 nt, Homo sapiens
cagggaggugaaugugau

SEQ ID NO: 10406 - RNA, 21 nt, Homo sapiens
ucgaggagcucacagucuagu

SEQ ID NO: 10407 - RNA, 22 nt, Homo sapiens
ucgugucuuguguugcagccgg

SEQ ID NO: 10408 - RNA, 23 nt, Homo sapiens
uaaggugcaucuagugcagauag

SEQ ID NO: 10409 - RNA, 22 nt, Homo sapiens
ucugcccccuccgcugcugcca

SEQ ID NO: 10410 - RNA, 22 nt, Homo sapiens
acacagggcuguugugaagacu

SEQ ID NO: 10411 - RNA, 22 nt, Homo sapiens
aaggagcucacagucuauugag

SEQ ID NO: 10412 - RNA, 20 nt, Homo sapiens
acugccccaggugcugcugg

SEQ ID NO: 10413 - RNA, 23 nt, Homo sapiens
ucccccaggugugauucugauuu

SEQ ID NO: 10414 - RNA, 23 nt, Homo sapiens
ugaggggcagagagcgagacuuu

SEQ ID NO: 10415 - RNA, 21 nt, Homo sapiens
cggggcagcucaguacaggau

SEQ ID NO: 10416 - RNA, 24 nt, Homo sapiens
acugggggcuuucgggcucugcgu

SEQ ID NO: 10417 - RNA, 22 nt, Homo sapiens
gucccucuccaaaugugucuug

SEQ ID NO: 10418 - RNA, 23 nt, Homo sapiens
aaggagcuuacaaucuagcuggg

SEQ ID NO: 10419 - RNA, 21 nt, Homo sapiens
uggaggagaaggaaggugaug

SEQ ID NO: 10420 - RNA, 22 nt, Homo sapiens
uauugcacucgucccggccucc

SEQ ID NO: 10421 - RNA, 21 nt, Homo sapiens
cccggagccaggaugcagcuc

SEQ ID NO: 10422 - RNA, 20 nt, Homo sapiens
ugagcccuguccucccgcag

SEQ ID NO: 10423 - RNA, 22 nt, Homo sapiens
gugugcggaaaugcuucugcua

SEQ ID NO: 10424 - RNA, 23 nt, Homo sapiens
cggcccgggcugcugcuguuccu

SEQ ID NO: 10425 - RNA, 21 nt, Homo sapiens
auuugugcuuggcucugucac

SEQ ID NO: 10426 - RNA, 22 nt, Homo sapiens
uccgagccugggucucccucuu

SEQ ID NO: 10427 - RNA, 21 nt, Homo sapiens
guggcugcacucacuuccuuc

SEQ ID NO: 10428 - RNA, 22 nt, Homo sapiens
ggagacgcggcccuguuggagu

SEQ ID NO: 10429 - RNA, 21 nt, Homo sapiens
ucgaggagcucacagucuagu

SEQ ID NO: 10430 - RNA, 21 nt, Homo sapiens
cggcggggacggcgauugguc

SEQ ID NO: 10431 - RNA, 22 nt, Homo sapiens
ucugcccccuccgcugcugcca

SEQ ID NO: 10432 - RNA, 22 nt, Homo sapiens
cauugcacuugucucggucuga

SEQ ID NO: 10433 - RNA, 20 nt, Homo sapiens
acugccccaggugcugcugg

SEQ ID NO: 10434 - RNA, 20 nt, Homo sapiens
ccucugggcccuuccuccag

SEQ ID NO: 10435 - RNA, 22 nt, Homo sapiens
ucucugggccugugucuuaggc

SEQ ID NO: 10436 - RNA, 23 nt, Homo sapiens
ucccccaggugugauucugauuu

SEQ ID NO: 10437 - RNA, 21 nt, Homo sapiens
cggggcagcucaguacaggau

SEQ ID NO: 10438 - RNA, 24 nt, Homo sapiens
acugggggcuuucgggcucugcgu

SEQ ID NO: 10439 - RNA, 22 nt, Homo sapiens
aggcggggcgccgcgggaccgc

SEQ ID NO: 10440 - RNA, 23 nt, Homo sapiens
uggugcggagagggcccacagug

SEQ ID NO: 10441 - RNA, 22 nt, Homo sapiens
ugcggggcuagggcuaacagca

SEQ ID NO: 10442 - RNA, 22 nt, Homo sapiens
ucaccagcccuguguucccuag

SEQ ID NO: 10443 - RNA, 20 nt, Homo sapiens
gugucugggcggacagcugc

SEQ ID NO: 10444 - RNA, 21 nt, Homo sapiens
acucuagcugccaaaggcgcu

SEQ ID NO: 10445 - RNA, 24 nt, Homo sapiens
uugcagcugccugggagugacuuc

SEQ ID NO: 10446 - RNA, 24 nt, Homo sapiens
ccagacagaauucuaugcacuuuc

SEQ ID NO: 10447 - RNA, 23 nt, Homo sapiens
agcugguguugugaaucaggccg

SEQ ID NO: 10448 - RNA, 23 nt, Homo sapiens
ucuggcuccgugucuucacuccc

SEQ ID NO: 10449 - RNA, 22 nt, Homo sapiens
ucgugucuuguguugcagccgg

SEQ ID NO: 10450 - RNA, 22 nt, Homo sapiens
uucccuuugucauccuaugccu

SEQ ID NO: 10451 - RNA, 22 nt, Homo sapiens
uucccuuugucauccuucgccu

SEQ ID NO: 10452 - RNA, 22 nt, Homo sapiens
aucuggagguaagaagcacuuu

SEQ ID NO: 10453 - RNA, 21 nt, Homo sapiens
acagucugcugagguuggagc

SEQ ID NO: 10454 - RNA, 21 nt, Homo sapiens
cggcggggacggcgauugguc

SEQ ID NO: 10455 - RNA, 22 nt, Homo sapiens
cauugcacuugucucggucuga

SEQ ID NO: 10456 - RNA, 23 nt, Homo sapiens
aggaccugcgggacaagauucuu

SEQ ID NO: 10457 - RNA, 20 nt, Homo sapiens
uaaggcacgcggugaaugcc

SEQ ID NO: 10458 - RNA, 22 nt, Homo sapiens
cucuagagggaagcacuuucug

SEQ ID NO: 10459 - RNA, 21 nt, Homo sapiens
aaagcgcuucccuucagagug

SEQ ID NO: 10460 - RNA, 21 nt, Homo sapiens
gaaagcgcuucucuuuagagg

SEQ ID NO: 10461 - RNA, 22 nt, Homo sapiens
aaagugcauccuuuuagagugu

SEQ ID NO: 10462 - RNA, 22 nt, Homo sapiens
cucuagagggaagcgcuuucug

SEQ ID NO: 10463 - RNA, 22 nt, Homo sapiens
cucuagagggaagcgcuuucug

SEQ ID NO: 10464 - RNA, 22 nt, Homo sapiens
cucuagagggaagcacuuucug

SEQ ID NO: 10465 - RNA, 22 nt, Homo sapiens
aaaaugguucccuuuagagugu

SEQ ID NO: 10466 - RNA, 23 nt, Homo sapiens
gaacgcgcuucccuauagagggu

SEQ ID NO: 10467 - RNA, 22 nt, Homo sapiens
cucuagagggaagcacuuucug

SEQ ID NO: 10468 - RNA, 23 nt, Homo sapiens
ucggggaucaucaugucacgaga

SEQ ID NO: 10469 - RNA, 22 nt, Homo sapiens
uggucuaggauuguuggaggag

SEQ ID NO: 10470 - RNA, 23 nt, Homo sapiens
gcgaggaccccucggggucugac

SEQ ID NO: 10471 - RNA, 22 nt, Homo sapiens
aggcggggcgccgcgggaccgc

SEQ ID NO: 10472 - RNA, 22 nt, Homo sapiens
ugcggggcuagggcuaacagca

SEQ ID NO: 10473 - RNA, 20 nt, Homo sapiens
ucugcaggguuugcuuugag

SEQ ID NO: 10474 - RNA, 22 nt, Homo sapiens
ucggccugaccacccaccccac

SEQ ID NO: 10475 - RNA, 22 nt, Homo sapiens
gugugcggaaaugcuucugcua

SEQ ID NO: 10476 - RNA, 23 nt, Homo sapiens
cggcccgggcugcugcuguuccu

SEQ ID NO: 10477 - RNA, 23 nt, Homo sapiens
caaagugcuuacagugcagguag

SEQ ID NO: 10478 - RNA, 22 nt, Homo sapiens
aacacaccugguuaaccucuuu

SEQ ID NO: 10479 - RNA, 21 nt, Homo sapiens
aggggugcuaucugugauuga

SEQ ID NO: 10480 - RNA, 22 nt, Homo sapiens
aacacaccuauucaaggauuca

SEQ ID NO: 10481 - RNA, 23 nt, Homo sapiens
uagcagcgggaacaguucugcag

SEQ ID NO: 10482 - RNA, 22 nt, Homo sapiens
uacugcagacguggcaaucaug

SEQ ID NO: 10483 - RNA, 21 nt, Homo sapiens
uacugcagacaguggcaauca

SEQ ID NO: 10484 - RNA, 19 nt, Homo sapiens
aggcugcggaauucaggac

SEQ ID NO: 10485 - RNA, 23 nt, Homo sapiens
aucgcugcgguugcgagcgcugu

SEQ ID NO: 10486 - RNA, 21 nt, Homo sapiens
aguuaggauuaggucguggaa

SEQ ID NO: 10487 - RNA, 22 nt, Homo sapiens
uagcagcacauaaugguuugug

SEQ ID NO: 10488 - RNA, 23 nt, Homo sapiens
ugauuguagccuuuuggaguaga

SEQ ID NO: 10489 - RNA, 23 nt, Homo sapiens
aaggagcuuacaaucuagcuggg

SEQ ID NO: 10490 - RNA, 23 nt, Homo sapiens
cucucaccacugcccucccacag

SEQ ID NO: 10491 - RNA, 24 nt, Homo sapiens
agccuggaagcuggagccugcagu

SEQ ID NO: 10492 - RNA, 24 nt, Homo sapiens
uugcagcugccugggagugacuuc

SEQ ID NO: 10493 - RNA, 22 nt, Homo sapiens
aaaagcuggguugagagggcga

SEQ ID NO: 10494 - RNA, 22 nt, Homo sapiens
aaaagcuggguugagagggcaa

SEQ ID NO: 10495 - RNA, 20 nt, Homo sapiens
aaaagcuggguugagagggu

SEQ ID NO: 10496 - RNA, 19 nt, Homo sapiens
aaaagcuggguugagagga

SEQ ID NO: 10497 - RNA, 22 nt, Homo sapiens
caaaguuuaagauccuugaagu

SEQ ID NO: 10498 - RNA, 17 nt, Homo sapiens
ucgccuccuccucuccc

SEQ ID NO: 10499 - RNA, 23 nt, Homo sapiens
cggcccgggcugcugcuguuccu

SEQ ID NO: 10500 - RNA, 23 nt, Homo sapiens
caacggaaucccaaaagcagcug

SEQ ID NO: 10501 - RNA, 23 nt, Homo sapiens
aggaagcccuggaggggcuggag

SEQ ID NO: 10502 - RNA, 22 nt, Homo sapiens
auccgcgcucugacucucugcc

SEQ ID NO: 10503 - RNA, 21 nt, Homo sapiens
uacaguacugugauaacugaa

SEQ ID NO: 10504 - RNA, 21 nt, Homo sapiens
uuaggccgcagaucuggguga

SEQ ID NO: 10505 - RNA, 22 nt, Homo sapiens
uuuucaacucuaaugggagaga

SEQ ID NO: 10506 - RNA, 21 nt, Homo sapiens
uugugcuugaucuaaccaugu

SEQ ID NO: 10507 - RNA, 22 nt, Homo sapiens
gaggguuggguggaggcucucc

SEQ ID NO: 10508 - RNA, 23 nt, Homo sapiens
acuucaccugguccacuagccgu

SEQ ID NO: 10509 - RNA, 21 nt, Homo sapiens
guguugaaacaaucucuacug

SEQ ID NO: 10510 - RNA, 22 nt, Homo sapiens
ucuucucuguuuuggccaugug

SEQ ID NO: 10511 - RNA, 17 nt, Homo sapiens
gugggggagaggcuguc

SEQ ID NO: 10512 - RNA, 17 nt, Homo sapiens
ucccaccgcugccaccc

SEQ ID NO: 10513 - RNA, 21 nt, Homo sapiens
uggacugcccugaucuggaga

SEQ ID NO: 10514 - RNA, 25 nt, Homo sapiens
ugggaacggguuccggcagacgcug

SEQ ID NO: 10515 - RNA, 22 nt, Homo sapiens
caaucacuaacuccacugccau

SEQ ID NO: 10516 - RNA, 22 nt, Homo sapiens
uaaugccccuaaaaauccuuau

SEQ ID NO: 10517 - RNA, 19 nt, Homo sapiens
ugagcugcuguaccaaaau

SEQ ID NO: 10518 - RNA, 22 nt, Homo sapiens
ggggguccccggugcucggauc

SEQ ID NO: 10519 - RNA, 20 nt, Homo sapiens
ggggagcuguggaagcagua

SEQ ID NO: 10520 - RNA, 21 nt, Homo sapiens
cccggagccaggaugcagcuc

SEQ ID NO: 10521 - RNA, 18 nt, Homo sapiens
ucagcuggcccucauuuc

SEQ ID NO: 10522 - RNA, 17 nt, Homo sapiens
gugggggagaggcuguc

SEQ ID NO: 10523 - RNA, 23 nt, Homo sapiens
uggaguccaggaaucugcauuuu

SEQ ID NO: 10524 - RNA, 22 nt, Homo sapiens
uaacacugucugguaaagaugg

SEQ ID NO: 10525 - RNA, 23 nt, Homo sapiens
ucuggcuccgugucuucacuccc

SEQ ID NO: 10526 - RNA, 21 nt, Homo sapiens
cggcggggacggcgauugguc

SEQ ID NO: 10527 - RNA, 22 nt, Homo sapiens
uaacacugucugguaacgaugu

SEQ ID NO: 10528 - RNA, 22 nt, Homo sapiens
aagcugccaguugaagaacugu

SEQ ID NO: 10529 - RNA, 23 nt, Homo sapiens
ucccccaggugugauucugauuu

SEQ ID NO: 10530 - RNA, 19 nt, Homo sapiens
gggcgccugugaucccaac

SEQ ID NO: 10531 - RNA, 24 nt, Homo sapiens
acugggggcuuucgggcucugcgu

SEQ ID NO: 10532 - RNA, 24 nt, Homo sapiens
ugccugggucucuggccugcgcgu

SEQ ID NO: 10533 - RNA, 22 nt, Homo sapiens
aggcggggcgccgcgggaccgc

SEQ ID NO: 10534 - RNA, 22 nt, Homo sapiens
cuccugagccauucugagccuc

SEQ ID NO: 10535 - RNA, 21 nt, Homo sapiens
cccggagccaggaugcagcuc

SEQ ID NO: 10536 - RNA, 22 nt, Homo sapiens
acucggcguggcgucggucgug

SEQ ID NO: 10537 - RNA, 22 nt, Homo sapiens
cucggcgcggggcgcgggcucc

SEQ ID NO: 10538 - RNA, 23 nt, Homo sapiens
ugagcgccucgacgacagagccg

SEQ ID NO: 10539 - RNA, 23 nt, Homo sapiens
ucucacacagaaaucgcacccgu

SEQ ID NO: 10540 - RNA, 22 nt, Homo sapiens
aucacacaaaggcaacuuuugu

SEQ ID NO: 10541 - RNA, 23 nt, Homo sapiens
ugaggggcagagagcgagacuuu

SEQ ID NO: 10542 - RNA, 19 nt, Homo sapiens
ugagcugcuguaccaaaau

SEQ ID NO: 10543 - RNA, 19 nt, Homo sapiens
aagcagcugccucugaggc

SEQ ID NO: 10544 - RNA, 21 nt, Homo sapiens
uggaggagaaggaaggugaug

SEQ ID NO: 10545 - RNA, 22 nt, Homo sapiens
ugagguaguagguuguaugguu

SEQ ID NO: 10546 - RNA, 21 nt, Homo sapiens
cccggagccaggaugcagcuc

SEQ ID NO: 10547 - RNA, 22 nt, Homo sapiens
ugagaacugaauuccauggguu

SEQ ID NO: 10548 - RNA, 20 nt, Homo sapiens
guguguggaaaugcuucugc

SEQ ID NO: 10549 - RNA, 23 nt, Homo sapiens
ugagcgccucgacgacagagccg

SEQ ID NO: 10550 - RNA, 23 nt, Homo sapiens
aggaccugcgggacaagauucuu

SEQ ID NO: 10551 - RNA, 22 nt, Homo sapiens
cgucaacacuugcugguuuccu

SEQ ID NO: 10552 - RNA, 23 nt, Homo sapiens
ugagugugugugugugagugugu

SEQ ID NO: 10553 - RNA, 22 nt, Homo sapiens
cacacacugcaauuacuuuugc

SEQ ID NO: 10554 - RNA, 21 nt, Homo sapiens
agaccuggcccagaccucagc

SEQ ID NO: 10555 - RNA, 22 nt, Homo sapiens
uggagugugacaaugguguuug

SEQ ID NO: 10556 - RNA, 22 nt, Homo sapiens
acacagggcuguugugaagacu

SEQ ID NO: 10557 - RNA, 23 nt, Homo sapiens
ucccccaggugugauucugauuu

SEQ ID NO: 10558 - RNA, 22 nt, Homo sapiens
agaggcuggccgugaugaauuc

SEQ ID NO: 10559 - RNA, 23 nt, Homo sapiens
cacucagccuugagggcacuuuc

SEQ ID NO: 10560 - RNA, 18 nt, Homo sapiens
uucacagggaggugucau

SEQ ID NO: 10561 - RNA, 23 nt, Homo sapiens
caaagcgcuucucuuuagagugu

SEQ ID NO: 10562 - RNA, 21 nt, Homo sapiens
cuccagagggaaguacuuucu

SEQ ID NO: 10563 - RNA, 21 nt, Homo sapiens
cuccagagggaugcacuuucu

SEQ ID NO: 10564 - RNA, 24 nt, Homo sapiens
acugggggcuuucgggcucugcgu

SEQ ID NO: 10565 - RNA, 20 nt, Homo sapiens
guagaggagauggcgcaggg

SEQ ID NO: 10566 - RNA, 22 nt, Homo sapiens
uuuccggcucgcgugggugugu

SEQ ID NO: 10567 - RNA, 22 nt, Homo sapiens
ucaccagcccuguguucccuag

SEQ ID NO: 10568 - RNA, 21 nt, Homo sapiens
acggugcuggauguggccuuu

SEQ ID NO: 10569 - RNA, 23 nt, Homo sapiens
agcugguguugugaaucaggccg

SEQ ID NO: 10570 - RNA, 22 nt, Homo sapiens
ggagacgcggcccuguuggagu

SEQ ID NO: 10571 - RNA, 22 nt, Homo sapiens
uggcaguguauuguuagcuggu

SEQ ID NO: 10572 - RNA, 20 nt, Homo sapiens
acucaaacugugggggcacu

SEQ ID NO: 10573 - RNA, 22 nt, Homo sapiens
uagcaccaucugaaaucgguua

SEQ ID NO: 10574 - RNA, 21 nt, Homo sapiens
aggcaagaugcuggcauagcu

SEQ ID NO: 10575 - RNA, 22 nt, Homo sapiens
cuccuauaugaugccuuucuuc

SEQ ID NO: 10576 - RNA, 22 nt, Homo sapiens
cuuaugcaagauucccuucuac

SEQ ID NO: 10577 - RNA, 23 nt, Homo sapiens
uaauccuugcuaccugggugaga

SEQ ID NO: 10578 - RNA, 22 nt, Homo sapiens
ugagccccugugccgcccccag

SEQ ID NO: 10579 - RNA, 23 nt, Homo sapiens
agcuacauugucugcuggguuuc

SEQ ID NO: 10580 - RNA, 22 nt, Homo sapiens
agaggcuggccgugaugaauuc

SEQ ID NO: 10581 - RNA, 19 nt, Homo sapiens
agcugucugaaaaugucuu

SEQ ID NO: 10582 - RNA, 20 nt, Homo sapiens
accaggaggcugaggccccu

SEQ ID NO: 10583 - RNA, 22 nt, Homo sapiens
ugcggggcuagggcuaacagca

SEQ ID NO: 10584 - RNA, 20 nt, Homo sapiens
cggcucugggucugugggga

SEQ ID NO: 10585 - RNA, 23 nt, Homo sapiens
ccugcagcgacuugauggcuucc

SEQ ID NO: 10586 - RNA, 27 nt, Homo sapiens
accuucuuguauaagcacugugcuaaa

SEQ ID NO: 10587 - RNA, 24 nt, Homo sapiens
uugcagcugccugggagugacuuc

SEQ ID NO: 10588 - RNA, 24 nt, Homo sapiens
uugcagcugccugggagugacuuc

SEQ ID NO: 10589 - RNA, 22 nt, Homo sapiens
uaacagucuacagccauggucg

SEQ ID NO: 10590 - RNA, 23 nt, Homo sapiens
guccaguuuucccaggaaucccu

SEQ ID NO: 10591 - RNA, 22 nt, Homo sapiens
ugcccuguggacucaguucugg

SEQ ID NO: 10592 - RNA, 22 nt, Homo sapiens
caaagaauucuccuuuugggcu

SEQ ID NO: 10593 - RNA, 21 nt, Homo sapiens
caucccuugcaugguggaggg

SEQ ID NO: 10594 - RNA, 21 nt, Homo sapiens
cggcggggacggcgauugguc

SEQ ID NO: 10595 - RNA, 21 nt, Homo sapiens
uaacagucuccagucacggcc

SEQ ID NO: 10596 - RNA, 22 nt, Homo sapiens
acacagggcuguugugaagacu

SEQ ID NO: 10597 - RNA, 21 nt, Homo sapiens
agggcccccccucaauccugu

SEQ ID NO: 10598 - RNA, 22 nt, Homo sapiens
uuauaaagcaaugagacugauu

SEQ ID NO: 10599 - RNA, 22 nt, Homo sapiens
ucaggcucaguccccucccgau

SEQ ID NO: 10600 - RNA, 21 nt, Homo sapiens
cagcagcacacugugguuugu

SEQ ID NO: 10601 - RNA, 18 nt, Homo sapiens
uucacagggaggugucau

SEQ ID NO: 10602 - RNA, 22 nt, Homo sapiens
aggcggggcgccgcgggaccgc

SEQ ID NO: 10603 - RNA, 22 nt, Homo sapiens
ugcggggcuagggcuaacagca

SEQ ID NO: 10604 - RNA, 22 nt, Homo sapiens
uuuccggcucgcgugggugugu

SEQ ID NO: 10605 - RNA, 22 nt, Homo sapiens
ugagccccugugccgcccccag

SEQ ID NO: 10606 - RNA, 22 nt, Homo sapiens
acucggcguggcgucggucgug

SEQ ID NO: 10607 - RNA, 22 nt, Homo sapiens
cucggcgcggggcgcgggcucc

SEQ ID NO: 10608 - RNA, 22 nt, Homo sapiens
uggagagaaaggcaguuccuga

SEQ ID NO: 10609 - RNA, 21 nt, Homo sapiens
cggcggggacggcgauugguc

SEQ ID NO: 10610 - RNA, 21 nt, Homo sapiens
aggggugcuaucugugauuga

SEQ ID NO: 10611 - RNA, 22 nt, Homo sapiens
gaaagcgcuucccuuugcugga

SEQ ID NO: 10612 - RNA, 22 nt, Homo sapiens
caaagcgcuccccuuuagaggu

SEQ ID NO: 10613 - RNA, 23 nt, Homo sapiens
caaagcgcuucucuuuagagugu

SEQ ID NO: 10614 - RNA, 21 nt, Homo sapiens
caaagcgcuucccuuuggagc

SEQ ID NO: 10615 - RNA, 21 nt, Homo sapiens
gaaagcgcuucucuuuagagg

SEQ ID NO: 10616 - RNA, 22 nt, Homo sapiens
uccgagccugggucucccucuu

SEQ ID NO: 10617 - RNA, 22 nt, Homo sapiens
aggcggggcgccgcgggaccgc

SEQ ID NO: 10618 - RNA, 22 nt, Homo sapiens
gguggcccggccgugccugagg

SEQ ID NO: 10619 - RNA, 22 nt, Homo sapiens
ugcggggcuagggcuaacagca

SEQ ID NO: 10620 - RNA, 21 nt, Homo sapiens
cccggagccaggaugcagcuc

SEQ ID NO: 10621 - RNA, 23 nt, Homo sapiens
ucuggcuccgugucuucacuccc

SEQ ID NO: 10622 - RNA, 21 nt, Homo sapiens
cggcggggacggcgauugguc

SEQ ID NO: 10623 - RNA, 22 nt, Homo sapiens
uacccagagcaugcagugugaa

SEQ ID NO: 10624 - RNA, 22 nt, Homo sapiens
cccugugcccggcccacuucug

SEQ ID NO: 10625 - RNA, 22 nt, Homo sapiens
cauugcacuugucucggucuga

SEQ ID NO: 10626 - RNA, 22 nt, Homo sapiens
uguaaacauccuacacucagcu

SEQ ID NO: 10627 - RNA, 22 nt, Homo sapiens
aggcggggcgccgcgggaccgc

SEQ ID NO: 10628 - RNA, 22 nt, Homo sapiens
ugcggggcuagggcuaacagca

SEQ ID NO: 10629 - RNA, 20 nt, Homo sapiens
ggggagcuguggaagcagua

SEQ ID NO: 10630 - RNA, 24 nt, Homo sapiens
uggggagcugaggcucugggggug

SEQ ID NO: 10631 - RNA, 24 nt, Homo sapiens
uggggagcugaggcucugggggug

SEQ ID NO: 10632 - RNA, 22 nt, Homo sapiens
uguaaacauccucgacuggaag

SEQ ID NO: 10633 - RNA, 22 nt, Homo sapiens
uguaaacauccccgacuggaag

SEQ ID NO: 10634 - RNA, 22 nt, Homo sapiens
uguaaacauccuugacuggaag

SEQ ID NO: 10635 - RNA, 19 nt, Homo sapiens
aagugugcagggcacuggu

SEQ ID NO: 10636 - RNA, 22 nt, Homo sapiens
aggcagcgggguguaguggaua

SEQ ID NO: 10637 - RNA, 20 nt, Homo sapiens
ggggagcuguggaagcagua

SEQ ID NO: 10638 - RNA, 20 nt, Homo sapiens
ggggagcuguggaagcagua

SEQ ID NO: 10639 - RNA, 21 nt, Homo sapiens
ugcaggaccaagaugagcccu

SEQ ID NO: 10640 - RNA, 25 nt, Homo sapiens
ugggaacggguuccggcagacgcug

SEQ ID NO: 10641 - RNA, 22 nt, Homo sapiens
uuugguccccuucaaccagcug

SEQ ID NO: 10642 - RNA, 22 nt, Homo sapiens
uuugguccccuucaaccagcua

SEQ ID NO: 10643 - RNA, 23 nt, Homo sapiens
uaaggugcaucuagugcagauag

SEQ ID NO: 10644 - RNA, 23 nt, Homo sapiens
uaaggugcaucuagugcaguuag

SEQ ID NO: 10645 - RNA, 22 nt, Homo sapiens
ucugcccccuccgcugcugcca

SEQ ID NO: 10646 - RNA, 20 nt, Homo sapiens
acugccccaggugcugcugg

SEQ ID NO: 10647 - RNA, 21 nt, Homo sapiens
cggggcagcucaguacaggau

SEQ ID NO: 10648 - RNA, 17 nt, Homo sapiens
ucgccuccuccucuccc

SEQ ID NO: 10649 - RNA, 23 nt, Homo sapiens
ucuggcuccgugucuucacuccc

SEQ ID NO: 10650 - RNA, 21 nt, Homo sapiens
cggcggggacggcgauugguc

SEQ ID NO: 10651 - RNA, 21 nt, Homo sapiens
cggcggggacggcgauugguc

SEQ ID NO: 10652 - RNA, 23 nt, Homo sapiens
ugaggggcagagagcgagacuuu

SEQ ID NO: 10653 - RNA, 22 nt, Homo sapiens
aggcggggcgccgcgggaccgc

SEQ ID NO: 10654 - RNA, 22 nt, Homo sapiens
aggcggggcgccgcgggaccgc

SEQ ID NO: 10655 - RNA, 20 nt, Homo sapiens
ucugcaggguuugcuuugag

SEQ ID NO: 10656 - RNA, 18 nt, Homo sapiens
ucagcuggcccucauuuc

SEQ ID NO: 10657 - RNA, 17 nt, Homo sapiens
gugggggagaggcuguc

SEQ ID NO: 10658 - RNA, 22 nt, Homo sapiens
caaagaauucuccuuuugggcu

SEQ ID NO: 10659 - RNA, 21 nt, Homo sapiens
uaaagugcugacagugcagau

SEQ ID NO: 10660 - RNA, 23 nt, Homo sapiens
cagugcaaugauauugucaaagc

SEQ ID NO: 10661 - RNA, 23 nt, Homo sapiens
ucucacacagaaaucgcacccgu

SEQ ID NO: 10662 - RNA, 24 nt, Homo sapiens
acaaagugcuucccuuuagagugu

SEQ ID NO: 10663 - RNA, 22 nt, Homo sapiens
acaaagugcuucccuuuagagu

SEQ ID NO: 10664 - RNA, 21 nt, Homo sapiens
agggggaaaguucuauagucc

SEQ ID NO: 10665 - RNA, 21 nt, Homo sapiens
uggguuuacguugggagaacu

SEQ ID NO: 10666 - RNA, 23 nt, Homo sapiens
aggaagcccuggaggggcuggag

SEQ ID NO: 10667 - RNA, 17 nt, Homo sapiens
ucgccuccuccucuccc

SEQ ID NO: 10668 - RNA, 21 nt, Homo sapiens
ugcaggaccaagaugagcccu

SEQ ID NO: 10669 - RNA, 21 nt, Homo sapiens
ucgaggagcucacagucuagu

SEQ ID NO: 10670 - RNA, 23 nt, Homo sapiens
cggcccgggcugcugcuguuccu

SEQ ID NO: 10671 - RNA, 21 nt, Homo sapiens
uccugcgcgucccagaugccc

SEQ ID NO: 10672 - RNA, 22 nt, Homo sapiens
uggacggagaacugauaagggu

SEQ ID NO: 10673 - RNA, 21 nt, Homo sapiens
cggcggggacggcgauugguc

SEQ ID NO: 10674 - RNA, 22 nt, Homo sapiens
agacccuggucugcacucuauc

SEQ ID NO: 10675 - RNA, 21 nt, Homo sapiens
gaaggcgcuucccuuuggagu

SEQ ID NO: 10676 - RNA, 22 nt, Homo sapiens
gaaggcgcuucccuuuagagcg

SEQ ID NO: 10677 - RNA, 19 nt, Homo sapiens
gggcgccugugaucccaac

SEQ ID NO: 10678 - RNA, 22 nt, Homo sapiens
aggcggggcgccgcgggaccgc

SEQ ID NO: 10679 - RNA, 22 nt, Homo sapiens
ugcggggcuagggcuaacagca

SEQ ID NO: 10680 - RNA, 17 nt, Homo sapiens
ucgccuccuccucuccc

SEQ ID NO: 10681 - RNA, 22 nt, Homo sapiens
gcccgcguguggagccaggugu

SEQ ID NO: 10682 - RNA, 23 nt, Homo sapiens
ucuggcuccgugucuucacuccc

SEQ ID NO: 10683 - RNA, 21 nt, Homo sapiens
ucgaggagcucacagucuagu

SEQ ID NO: 10684 - RNA, 21 nt, Homo sapiens
uccugcgcgucccagaugccc

SEQ ID NO: 10685 - RNA, 21 nt, Homo sapiens
cggcggggacggcgauugguc

SEQ ID NO: 10686 - RNA, 22 nt, Homo sapiens
aaggagcucacagucuauugag

SEQ ID NO: 10687 - RNA, 23 nt, Homo sapiens
agugccugagggaguaagagccc

SEQ ID NO: 10688 - RNA, 22 nt, Homo sapiens
aggcggggcgccgcgggaccgc

SEQ ID NO: 10689 - RNA, 23 nt, Homo sapiens
aaggagcuuacaaucuagcuggg

SEQ ID NO: 10690 - RNA, 20 nt, Homo sapiens
cggcucugggucugugggga

SEQ ID NO: 10691 - RNA, 21 nt, Homo sapiens
uggaggagaaggaaggugaug

SEQ ID NO: 10692 - RNA, 18 nt, Homo sapiens
cgggcguggugguggggg

SEQ ID NO: 10693 - RNA, 22 nt, Homo sapiens
cucggcgcggggcgcgggcucc

SEQ ID NO: 10694 - RNA, 22 nt, Homo sapiens
aauugcacgguauccaucugua

SEQ ID NO: 10695 - RNA, 22 nt, Homo sapiens
aggcaguguauuguuagcuggc

SEQ ID NO: 10696 - RNA, 22 nt, Homo sapiens
cgucaacacuugcugguuuccu

SEQ ID NO: 10697 - RNA, 25 nt, Homo sapiens
aggggugguguugggacagcuccgu

SEQ ID NO: 10698 - RNA, 22 nt, Homo sapiens
gugaaauguuuaggaccacuag

SEQ ID NO: 10699 - RNA, 22 nt, Homo sapiens
uagcaccaucugaaaucgguua

SEQ ID NO: 10700 - RNA, 23 nt, Homo sapiens
ugagcgccucgacgacagagccg

SEQ ID NO: 10701 - RNA, 18 nt, Homo sapiens
uucacagggaggugucau

SEQ ID NO: 10702 - RNA, 21 nt, Homo sapiens
caaagaggaaggucccauuac

SEQ ID NO: 10703 - RNA, 22 nt, Homo sapiens
uacccauugcauaucggaguug

SEQ ID NO: 10704 - RNA, 20 nt, Homo sapiens
uaaagagcccuguggagaca

SEQ ID NO: 10705 - RNA, 17 nt, Homo sapiens
ucgccuccuccucuccc

SEQ ID NO: 10706 - RNA, 21 nt, Homo sapiens
cuuuuugcggucugggcuugc

SEQ ID NO: 10707 - RNA, 19 nt, Homo sapiens
gaugaugcugcugaugcug

SEQ ID NO: 10708 - RNA, 23 nt, Homo sapiens
acuccauuuguuuugaugaugga

SEQ ID NO: 10709 - RNA, 23 nt, Homo sapiens
uuauugcuuaagaauacgcguag

SEQ ID NO: 10710 - RNA, 22 nt, Homo sapiens
gcugacuccuaguccagggcuc

SEQ ID NO: 10711 - RNA, 22 nt, Homo sapiens
uuauaauacaaccugauaagug

SEQ ID NO: 10712 - RNA, 23 nt, Homo sapiens
uagcagcgggaacaguucugcag

SEQ ID NO: 10713 - RNA, 22 nt, Homo sapiens
uagcaaaaacugcaguuacuuu

SEQ ID NO: 10714 - RNA, 23 nt, Homo sapiens
uucauuugguauaaaccgcgauu

SEQ ID NO: 10715 - RNA, 25 nt, Homo sapiens
ggcggagggaaguagguccguuggu

SEQ ID NO: 10716 - RNA, 23 nt, Homo sapiens
uacccuguagaaccgaauuugug

SEQ ID NO: 10717 - RNA, 21 nt, Homo sapiens
uaggacacauggucuacuucu

SEQ ID NO: 10718 - RNA, 18 nt, Homo sapiens
aucccaccucugccacca

SEQ ID NO: 10719 - RNA, 17 nt, Homo sapiens
ucccaccgcugccaccc

SEQ ID NO: 10720 - RNA, 22 nt, Homo sapiens
ugagaacugaauuccauggguu

SEQ ID NO: 10721 - RNA, 22 nt, Homo sapiens
uauugcacauuacuaaguugca

SEQ ID NO: 10722 - RNA, 23 nt, Homo sapiens
gaacgcgcuucccuauagagggu

SEQ ID NO: 10723 - RNA, 23 nt, Homo sapiens
ggcagguucucacccucucuagg

SEQ ID NO: 10724 - RNA, 20 nt, Homo sapiens
ucugcaggguuugcuuugag

SEQ ID NO: 10725 - RNA, 24 nt, Homo sapiens
ucccugagacccuuuaaccuguga

SEQ ID NO: 10726 - RNA, 22 nt, Homo sapiens
ucccugagacccuaacuuguga

SEQ ID NO: 10727 - RNA, 23 nt, Homo sapiens
ccucagggcuguagaacagggcu

SEQ ID NO: 10728 - RNA, 22 nt, Homo sapiens
cucggcgcggggcgcgggcucc

SEQ ID NO: 10729 - RNA, 22 nt, Homo sapiens
uggagagaaaggcaguuccuga

SEQ ID NO: 10730 - RNA, 23 nt, Homo sapiens
uaaggugcaucuagugcagauag

SEQ ID NO: 10731 - RNA, 22 nt, Homo sapiens
aguggggaacccuuccaugagg

SEQ ID NO: 10732 - RNA, 21 nt, Homo sapiens
gaaggcgcuucccuuuggagu

SEQ ID NO: 10733 - RNA, 22 nt, Homo sapiens
gaaggcgcuucccuuuagagcg

SEQ ID NO: 10734 - RNA, 19 nt, Homo sapiens
gggcgccugugaucccaac

SEQ ID NO: 10735 - RNA, 23 nt, Homo sapiens
gacacgggcgacagcugcggccc

SEQ ID NO: 10736 - RNA, 25 nt, Homo sapiens
aggggugguguugggacagcuccgu

SEQ ID NO: 10737 - RNA, 22 nt, Homo sapiens
aggcggggcgccgcgggaccgc

SEQ ID NO: 10738 - RNA, 22 nt, Homo sapiens
ugcggggcuagggcuaacagca

SEQ ID NO: 10739 - RNA, 22 nt, Homo sapiens
cugcccuggcccgagggaccga

SEQ ID NO: 10740 - RNA, 20 nt, Homo sapiens
ggggagcuguggaagcagua

SEQ ID NO: 10741 - RNA, 22 nt, Homo sapiens
uggguggucuggagauuugugc

SEQ ID NO: 10742 - RNA, 21 nt, Homo sapiens
uaccacaggguagaaccacgg

SEQ ID NO: 10743 - RNA, 23 nt, Homo sapiens
uuaaugcuaaucgugauaggggu

SEQ ID NO: 10744 - RNA, 23 nt, Homo sapiens
caaagugcuuacagugcagguag

SEQ ID NO: 10745 - RNA, 22 nt, Homo sapiens
ugguuuaccgucccacauacau

SEQ ID NO: 10746 - RNA, 22 nt, Homo sapiens
uccagcaucagugauuuuguug

SEQ ID NO: 10747 - RNA, 22 nt, Homo sapiens
agaucagaaggugauuguggcu

SEQ ID NO: 10748 - RNA, 21 nt, Homo sapiens
cagcagcacacugugguuugu

SEQ ID NO: 10749 - RNA, 21 nt, Homo sapiens
auccuugcuaucugggugcua

SEQ ID NO: 10750 - RNA, 22 nt, Homo sapiens
uacugcagacguggcaaucaug

SEQ ID NO: 10751 - RNA, 21 nt, Homo sapiens
uacugcagacaguggcaauca

SEQ ID NO: 10752 - RNA, 22 nt, Homo sapiens
uacccauugcauaucggaguug

SEQ ID NO: 10753 - RNA, 22 nt, Homo sapiens
acuccagccccacagccucagc

SEQ ID NO: 10754 - RNA, 18 nt, Homo sapiens
cagggaggugaaugugau

SEQ ID NO: 10755 - RNA, 22 nt, Homo sapiens
gugacaucacauauacggcagc

SEQ ID NO: 10756 - RNA, 21 nt, Homo sapiens
uuaagacuugcagugauguuu

SEQ ID NO: 10757 - RNA, 22 nt, Homo sapiens
ugauugguacgucuguggguag

SEQ ID NO: 10758 - RNA, 21 nt, Homo sapiens
uggaggagaaggaaggugaug

SEQ ID NO: 10759 - RNA, 24 nt, Homo sapiens
uuuggcaaugguagaacucacacu

SEQ ID NO: 10760 - RNA, 22 nt, Homo sapiens
ucugcccccuccgcugcugcca

SEQ ID NO: 10761 - RNA, 20 nt, Homo sapiens
ccucugggcccuuccuccag

SEQ ID NO: 10762 - RNA, 22 nt, Homo sapiens
ucucugggccugugucuuaggc

SEQ ID NO: 10763 - RNA, 23 nt, Homo sapiens
ucccccaggugugauucugauuu

SEQ ID NO: 10764 - RNA, 21 nt, Homo sapiens
gugucuuuugcucugcaguca

SEQ ID NO: 10765 - RNA, 19 nt, Homo sapiens
ugagcugcuguaccaaaau

SEQ ID NO: 10766 - RNA, 24 nt, Homo sapiens
acugggggcuuucgggcucugcgu

SEQ ID NO: 10767 - RNA, 21 nt, Homo sapiens
uggaggagaaggaaggugaug

SEQ ID NO: 10768 - RNA, 18 nt, Homo sapiens
ucagcuggcccucauuuc

SEQ ID NO: 10769 - RNA, 25 nt, Homo sapiens
cccccacaaccgcgcuugacuagcu

SEQ ID NO: 10770 - RNA, 22 nt, Homo sapiens
uuggggaaacggccgcugagug

SEQ ID NO: 10771 - RNA, 22 nt, Homo sapiens
uggcagugucuuagcugguugu

SEQ ID NO: 10772 - RNA, 23 nt, Homo sapiens
aggcaguguaguuagcugauugc

SEQ ID NO: 10773 - RNA, 22 nt, Homo sapiens
uggcaguguauuguuagcuggu

SEQ ID NO: 10774 - RNA, 22 nt, Homo sapiens
aggcaguguauuguuagcuggc

SEQ ID NO: 10775 - RNA, 19 nt, Homo sapiens
ugucucugcugggguuucu

SEQ ID NO: 10776 - RNA, 23 nt, Homo sapiens
uauucauuuauccccagccuaca

SEQ ID NO: 10777 - RNA, 21 nt, Homo sapiens
gcccuccgcccgugcaccccg

SEQ ID NO: 10778 - RNA, 21 nt, Homo sapiens
cggcggggacggcgauugguc

SEQ ID NO: 10779 - RNA, 22 nt, Homo sapiens
ucugcccccuccgcugcugcca

SEQ ID NO: 10780 - RNA, 22 nt, Homo sapiens
cauugcacuugucucggucuga

SEQ ID NO: 10781 - RNA, 20 nt, Homo sapiens
acugccccaggugcugcugg

SEQ ID NO: 10782 - RNA, 20 nt, Homo sapiens
ccucugggcccuuccuccag

SEQ ID NO: 10783 - RNA, 22 nt, Homo sapiens
ucucugggccugugucuuaggc

SEQ ID NO: 10784 - RNA, 21 nt, Homo sapiens
cggggcagcucaguacaggau

SEQ ID NO: 10785 - RNA, 19 nt, Homo sapiens
aggcugcggaauucaggac

SEQ ID NO: 10786 - RNA, 22 nt, Homo sapiens
aggcggggcgccgcgggaccgc

SEQ ID NO: 10787 - RNA, 22 nt, Homo sapiens
ugcggggcuagggcuaacagca

SEQ ID NO: 10788 - RNA, 20 nt, Homo sapiens
ggggagcuguggaagcagua

SEQ ID NO: 10789 - RNA, 22 nt, Homo sapiens
uggagugugacaaugguguuug

SEQ ID NO: 10790 - RNA, 21 nt, Homo sapiens
acucuagcugccaaaggcgcu

SEQ ID NO: 10791 - RNA, 21 nt, Homo sapiens
cggcggggacggcgauugguc

SEQ ID NO: 10792 - RNA, 23 nt, Homo sapiens
ugaggggcagagagcgagacuuu

SEQ ID NO: 10793 - RNA, 22 nt, Homo sapiens
aggcggggcgccgcgggaccgc

SEQ ID NO: 10794 - RNA, 22 nt, Homo sapiens
uuugugaccugguccacuaacc

SEQ ID NO: 10795 - RNA, 21 nt, Homo sapiens
uaaagugcugacagugcagau

SEQ ID NO: 10796 - RNA, 18 nt, Homo sapiens
uccagugcccuccucucc

SEQ ID NO: 10797 - RNA, 19 nt, Homo sapiens
ugagcugcuguaccaaaau

SEQ ID NO: 10798 - RNA, 21 nt, Homo sapiens
uggguuuacguugggagaacu

SEQ ID NO: 10799 - RNA, 22 nt, Homo sapiens
auccgcgcucugacucucugcc

SEQ ID NO: 10800 - RNA, 24 nt, Homo sapiens
uggggagcugaggcucugggggug

SEQ ID NO: 10801 - RNA, 22 nt, Homo sapiens
uggagugugacaaugguguuug

SEQ ID NO: 10802 - RNA, 23 nt, Homo sapiens
ucuggcuccgugucuucacuccc

SEQ ID NO: 10803 - RNA, 23 nt, Homo sapiens
cggcccgggcugcugcuguuccu

SEQ ID NO: 10804 - RNA, 21 nt, Homo sapiens
cggcggggacggcgauugguc

SEQ ID NO: 10805 - RNA, 21 nt, Homo sapiens
agggcccccccucaauccugu

SEQ ID NO: 10806 - RNA, 22 nt, Homo sapiens
uaaugccccuaaaaauccuuau

SEQ ID NO: 10807 - RNA, 22 nt, Homo sapiens
aggcggggcgccgcgggaccgc

SEQ ID NO: 10808 - RNA, 22 nt, Homo sapiens
ugcggggcuagggcuaacagca

SEQ ID NO: 10809 - RNA, 21 nt, Homo sapiens
uggcagggaggcugggagggg

SEQ ID NO: 10810 - RNA, 19 nt, Homo sapiens
gugaggacucgggaggugg

SEQ ID NO: 10811 - RNA, 17 nt, Homo sapiens
ucgccuccuccucuccc

SEQ ID NO: 10812 - RNA, 22 nt, Homo sapiens
uggagagaaaggcaguuccuga

SEQ ID NO: 10813 - RNA, 21 nt, Homo sapiens
cggcggggacggcgauugguc

SEQ ID NO: 10814 - RNA, 22 nt, Homo sapiens
cgcaggggccgggugcucaccg

SEQ ID NO: 10815 - RNA, 21 nt, Homo sapiens
agggcccccccucaauccugu

SEQ ID NO: 10816 - RNA, 20 nt, Homo sapiens
ccucugggcccuuccuccag

SEQ ID NO: 10817 - RNA, 22 nt, Homo sapiens
ucucugggccugugucuuaggc

SEQ ID NO: 10818 - RNA, 22 nt, Homo sapiens
uuauaaagcaaugagacugauu

SEQ ID NO: 10819 - RNA, 23 nt, Homo sapiens
ucccccaggugugauucugauuu

SEQ ID NO: 10820 - RNA, 22 nt, Homo sapiens
agaggcuggccgugaugaauuc

SEQ ID NO: 10821 - RNA, 24 nt, Homo sapiens
acugggggcuuucgggcucugcgu

SEQ ID NO: 10822 - RNA, 22 nt, Homo sapiens
aggcggggcgccgcgggaccgc

SEQ ID NO: 10823 - RNA, 22 nt, Homo sapiens
uggagugugacaaugguguuug

SEQ ID NO: 10824 - RNA, 21 nt, Homo sapiens
gcccuccgcccgugcaccccg

SEQ ID NO: 10825 - RNA, 21 nt, Homo sapiens
cggcggggacggcgauugguc

SEQ ID NO: 10826 - RNA, 22 nt, Homo sapiens
uggugggcacagaaucuggacu

SEQ ID NO: 10827 - RNA, 22 nt, Homo sapiens
uggugggccgcagaacaugugc

SEQ ID NO: 10828 - RNA, 25 nt, Homo sapiens
ggcggagggaaguagguccguuggu

SEQ ID NO: 10829 - RNA, 23 nt, Homo sapiens
uggugcggagagggcccacagug

SEQ ID NO: 10830 - RNA, 22 nt, Homo sapiens
ugcggggcuagggcuaacagca

SEQ ID NO: 10831 - RNA, 23 nt, Homo sapiens
cacccggcugugugcacaugugc

SEQ ID NO: 10832 - RNA, 21 nt, Homo sapiens
gugccagcugcagugggggag

SEQ ID NO: 10833 - RNA, 22 nt, Homo sapiens
ugagccccugugccgcccccag

SEQ ID NO: 10834 - RNA, 22 nt, Homo sapiens
uggagugugacaaugguguuug

SEQ ID NO: 10835 - RNA, 22 nt, Homo sapiens
cuuggcaccuagcaagcacuca

SEQ ID NO: 10836 - RNA, 17 nt, Homo sapiens
ucgccuccuccucuccc

SEQ ID NO: 10837 - RNA, 18 nt, Homo sapiens
cagggaggugaaugugau

SEQ ID NO: 10838 - RNA, 23 nt, Homo sapiens
ucuggcuccgugucuucacuccc

SEQ ID NO: 10839 - RNA, 23 nt, Homo sapiens
cggcccgggcugcugcuguuccu

SEQ ID NO: 10840 - RNA, 22 nt, Homo sapiens
uggagagaaaggcaguuccuga

SEQ ID NO: 10841 - RNA, 21 nt, Homo sapiens
cggcggggacggcgauugguc

SEQ ID NO: 10842 - RNA, 22 nt, Homo sapiens
cauugcacuugucucggucuga

SEQ ID NO: 10843 - RNA, 23 nt, Homo sapiens
uucauuugguauaaaccgcgauu

SEQ ID NO: 10844 - RNA, 24 nt, Homo sapiens
ugccugggucucuggccugcgcgu

SEQ ID NO: 10845 - RNA, 22 nt, Homo sapiens
aggcggggcgccgcgggaccgc

SEQ ID NO: 10846 - RNA, 22 nt, Homo sapiens
ugcggggcuagggcuaacagca

SEQ ID NO: 10847 - RNA, 23 nt, Homo sapiens
uuuggcacuagcacauuuuugcu

SEQ ID NO: 10848 - RNA, 22 nt, Homo sapiens
ugagccccugugccgcccccag

SEQ ID NO: 10849 - RNA, 17 nt, Homo sapiens
gugggggagaggcuguc

SEQ ID NO: 10850 - RNA, 17 nt, Homo sapiens
ucgccuccuccucuccc

SEQ ID NO: 10851 - RNA, 21 nt, Homo sapiens
cucccacaugcaggguuugca

SEQ ID NO: 10852 - RNA, 21 nt, Homo sapiens
cggcggggacggcgauugguc

SEQ ID NO: 10853 - RNA, 22 nt, Homo sapiens
aacuggcccucaaagucccgcu

SEQ ID NO: 10854 - RNA, 22 nt, Homo sapiens
gugaaauguuuaggaccacuag

SEQ ID NO: 10855 - RNA, 22 nt, Homo sapiens
uccuucauuccaccggagucug

SEQ ID NO: 10856 - RNA, 22 nt, Homo sapiens
acagcaggcacagacaggcagu

SEQ ID NO: 10857 - RNA, 23 nt, Homo sapiens
agcuacauugucugcuggguuuc

SEQ ID NO: 10858 - RNA, 23 nt, Homo sapiens
ugagcgccucgacgacagagccg

SEQ ID NO: 10859 - RNA, 22 nt, Homo sapiens
gccugcugggguggaaccuggu

SEQ ID NO: 10860 - RNA, 21 nt, Homo sapiens
gaaggcgcuucccuuuggagu

SEQ ID NO: 10861 - RNA, 22 nt, Homo sapiens
gaaggcgcuucccuuuagagcg

SEQ ID NO: 10862 - RNA, 22 nt, Homo sapiens
ccucccacacccaaggcuugca

SEQ ID NO: 10863 - RNA, 23 nt, Homo sapiens
gaacgccuguucuugccaggugg

SEQ ID NO: 10864 - RNA, 22 nt, Homo sapiens
aggcggggcgccgcgggaccgc

SEQ ID NO: 10865 - RNA, 22 nt, Homo sapiens
caaagugccucccuuuagagug

SEQ ID NO: 10866 - RNA, 22 nt, Homo sapiens
ugugcgcagggagaccucuccc

SEQ ID NO: 10867 - RNA, 23 nt, Homo sapiens
cggcccgggcugcugcuguuccu

SEQ ID NO: 10868 - RNA, 18 nt, Homo sapiens
uccagugcccuccucucc

SEQ ID NO: 10869 - RNA, 23 nt, Homo sapiens
aagugccgccaucuuuugagugu

SEQ ID NO: 10870 - RNA, 22 nt, Homo sapiens
uccgagccugggucucccucuu

SEQ ID NO: 10871 - RNA, 21 nt, Homo sapiens
uggaggagaaggaaggugaug

SEQ ID NO: 10872 - RNA, 23 nt, Homo sapiens
ucuggcuccgugucuucacuccc

SEQ ID NO: 10873 - RNA, 22 nt, Homo sapiens
cgucaacacuugcugguuuccu

SEQ ID NO: 10874 - RNA, 20 nt, Homo sapiens
cuuccucgucugucugcccc

SEQ ID NO: 10875 - RNA, 22 nt, Homo sapiens
acucggcguggcgucggucgug

SEQ ID NO: 10876 - RNA, 22 nt, Homo sapiens
cucggcgcggggcgcgggcucc

SEQ ID NO: 10877 - RNA, 21 nt, Homo sapiens
ucgaggagcucacagucuagu

SEQ ID NO: 10878 - RNA, 21 nt, Homo sapiens
cggcggggacggcgauugguc

SEQ ID NO: 10879 - RNA, 21 nt, Homo sapiens
ugacaacuauggaugagcucu

SEQ ID NO: 10880 - RNA, 23 nt, Homo sapiens
ucccccaggugugauucugauuu

SEQ ID NO: 10881 - RNA, 22 nt, Homo sapiens
ugauugguacgucuguggguag

SEQ ID NO: 10882 - RNA, 21 nt, Homo sapiens
gaagugugccguggugugucu

SEQ ID NO: 10883 - RNA, 24 nt, Homo sapiens
acugggggcuuucgggcucugcgu

SEQ ID NO: 10884 - RNA, 19 nt, Homo sapiens
aagugugcagggcacuggu

SEQ ID NO: 10885 - RNA, 22 nt, Homo sapiens
cuugguucagggagggucccca

SEQ ID NO: 10886 - RNA, 22 nt, Homo sapiens
aggcggggcgccgcgggaccgc

SEQ ID NO: 10887 - RNA, 22 nt, Homo sapiens
ugcggggcuagggcuaacagca

SEQ ID NO: 10888 - RNA, 26 nt, Homo sapiens
gaugaugauggcagcaaauucugaaa

SEQ ID NO: 10889 - RNA, 24 nt, Homo sapiens
uugcagcugccugggagugacuuc

SEQ ID NO: 10890 - RNA, 23 nt, Homo sapiens
uauggcuuuuuauuccuauguga

SEQ ID NO: 10891 - RNA, 23 nt, Homo sapiens
uauggcuuuucauuccuauguga

SEQ ID NO: 10892 - RNA, 23 nt, Homo sapiens
uaagugcuuccauguuucagugg

SEQ ID NO: 10893 - RNA, 22 nt, Homo sapiens
aacuguuugcagaggaaacuga

SEQ ID NO: 10894 - RNA, 21 nt, Homo sapiens
uaauuuuauguauaagcuagu

SEQ ID NO: 10895 - RNA, 22 nt, Homo sapiens
acucggcguggcgucggucgug

SEQ ID NO: 10896 - RNA, 22 nt, Homo sapiens
cucccacugcuucacuugacua

SEQ ID NO: 10897 - RNA, 22 nt, Homo sapiens
cauugcacuugucucggucuga

SEQ ID NO: 10898 - RNA, 23 nt, Homo sapiens
cgcauccccuagggcauuggugu

SEQ ID NO: 10899 - RNA, 22 nt, Homo sapiens
aacuguuugcagaggaaacuga

SEQ ID NO: 10900 - RNA, 23 nt, Homo sapiens
agguuguccguggugaguucgca

SEQ ID NO: 10901 - RNA, 22 nt, Homo sapiens
gaaagcgcuucccuuugcugga

SEQ ID NO: 10902 - RNA, 22 nt, Homo sapiens
caaagcgcuccccuuuagaggu

SEQ ID NO: 10903 - RNA, 23 nt, Homo sapiens
caaagcgcuucucuuuagagugu

SEQ ID NO: 10904 - RNA, 21 nt, Homo sapiens
caaagcgcuucccuuuggagc

SEQ ID NO: 10905 - RNA, 21 nt, Homo sapiens
gaaagcgcuucucuuuagagg

SEQ ID NO: 10906 - RNA, 19 nt, Homo sapiens
gugucugcuuccuguggga

SEQ ID NO: 10907 - RNA, 22 nt, Homo sapiens
ucggccugaccacccaccccac

SEQ ID NO: 10908 - RNA, 22 nt, Homo sapiens
ugugagguuggcauuguugucu

SEQ ID NO: 10909 - RNA, 22 nt, Homo sapiens
uggagagaaaggcaguuccuga

SEQ ID NO: 10910 - RNA, 22 nt, Homo sapiens
ucaggccaggcacaguggcuca

SEQ ID NO: 10911 - RNA, 23 nt, Homo sapiens
agcuacauugucugcuggguuuc

SEQ ID NO: 10912 - RNA, 21 nt, Homo sapiens
gccccugggccuauccuagaa

SEQ ID NO: 10913 - RNA, 22 nt, Homo sapiens
agucauuggaggguuugagcag

SEQ ID NO: 10914 - RNA, 23 nt, Homo sapiens
uuuggcacuagcacauuuuugcu

SEQ ID NO: 10915 - RNA, 23 nt, Homo sapiens
ccugcagcgacuugauggcuucc

SEQ ID NO: 10916 - RNA, 20 nt, Homo sapiens
ucugcaggguuugcuuugag

SEQ ID NO: 10917 - RNA, 24 nt, Homo sapiens
uugcagcugccugggagugacuuc

SEQ ID NO: 10918 - RNA, 23 nt, Homo sapiens
uguaguguuuccuacuuuaugga

SEQ ID NO: 10919 - RNA, 22 nt, Homo sapiens
ugagaacugaauuccauggguu

SEQ ID NO: 10920 - RNA, 22 nt, Homo sapiens
uugcauagucacaaaagugauc

SEQ ID NO: 10921 - RNA, 21 nt, Homo sapiens
auguaugugugcaugugcaug

SEQ ID NO: 10922 - RNA, 21 nt, Homo sapiens
uugaaaggcuauuucuugguc

SEQ ID NO: 10923 - RNA, 19 nt, Homo sapiens
ugagcugcuguaccaaaau

SEQ ID NO: 10924 - RNA, 23 nt, Homo sapiens
gacacgggcgacagcugcggccc

SEQ ID NO: 10925 - RNA, 23 nt, Homo sapiens
uaaggugcaucuagugcaguuag

SEQ ID NO: 10926 - RNA, 22 nt, Homo sapiens
gauuagggugcuuagcuguuaa

SEQ ID NO: 10927 - RNA, 22 nt, Homo sapiens
uauguaauaugguccacaucuu

SEQ ID NO: 10928 - RNA, 23 nt, Homo sapiens
uucauuugguauaaaccgcgauu

SEQ ID NO: 10929 - RNA, 21 nt, Homo sapiens
uccuucugcuccgucccccag

SEQ ID NO: 10930 - RNA, 21 nt, Homo sapiens
acggugcuggauguggccuuu

SEQ ID NO: 10931 - RNA, 22 nt, Homo sapiens
uuugguccccuucaaccagcug

SEQ ID NO: 10932 - RNA, 22 nt, Homo sapiens
uuugguccccuucaaccagcua

SEQ ID NO: 10933 - RNA, 23 nt, Homo sapiens
agcuacauugucugcuggguuuc

SEQ ID NO: 10934 - RNA, 22 nt, Homo sapiens
cauugcacuugucucggucuga

SEQ ID NO: 10935 - RNA, 24 nt, Homo sapiens
agcagaagcagggagguucuccca

SEQ ID NO: 10936 - RNA, 23 nt, Homo sapiens
uaagugcuuccauguuuugguga

SEQ ID NO: 10937 - RNA, 23 nt, Homo sapiens
uaagugcuuccauguuuuaguag

SEQ ID NO: 10938 - RNA, 23 nt, Homo sapiens
uaagugcuuccauguuucagugg

SEQ ID NO: 10939 - RNA, 23 nt, Homo sapiens
uaagugcuuccauguuugagugu

SEQ ID NO: 10940 - RNA, 17 nt, Homo sapiens
uaagugcuuccaugcuu

SEQ ID NO: 10941 - RNA, 21 nt, Homo sapiens
gccccugggccuauccuagaa

SEQ ID NO: 10942 - RNA, 22 nt, Homo sapiens
uggcagugucuuagcugguugu

SEQ ID NO: 10943 - RNA, 23 nt, Homo sapiens
aaagugcugcgacauuugagcgu

SEQ ID NO: 10944 - RNA, 23 nt, Homo sapiens
gaagugcuucgauuuuggggugu

SEQ ID NO: 10945 - RNA, 22 nt, Homo sapiens
ugauugguacgucuguggguag

SEQ ID NO: 10946 - RNA, 22 nt, Homo sapiens
aaagugcuucccuuuggacugu

SEQ ID NO: 10947 - RNA, 21 nt, Homo sapiens
aaagugcuuccuuuuagaggg

SEQ ID NO: 10948 - RNA, 22 nt, Homo sapiens
aaagugcuuccuuuuagagggu

SEQ ID NO: 10949 - RNA, 22 nt, Homo sapiens
aaagugcuucucuuuggugggu

SEQ ID NO: 10950 - RNA, 21 nt, Homo sapiens
aaagugcuuccuuuuugaggg

SEQ ID NO: 10951 - RNA, 22 nt, Homo sapiens
aagugcuuccuuuuagaggguu

SEQ ID NO: 10952 - RNA, 23 nt, Homo sapiens
ugugcuugcucgucccgcccgca

SEQ ID NO: 10953 - RNA, 22 nt, Homo sapiens
gguggcccggccgugccugagg

SEQ ID NO: 10954 - RNA, 21 nt, Homo sapiens
uggaggagaaggaaggugaug

SEQ ID NO: 10955 - RNA, 22 nt, Homo sapiens
cuccugagccauucugagccuc

SEQ ID NO: 10956 - RNA, 20 nt, Homo sapiens
cgugccacccuuuuccccag

SEQ ID NO: 10957 - RNA, 22 nt, Homo sapiens
ccucuuccccuugucucuccag

SEQ ID NO: 10958 - RNA, 22 nt, Homo sapiens
acccgucccguucguccccgga

SEQ ID NO: 10959 - RNA, 22 nt, Homo sapiens
aggcauugacuucucacuagcu

SEQ ID NO: 10960 - RNA, 21 nt, Homo sapiens
cucccacaugcaggguuugca

SEQ ID NO: 10961 - RNA, 22 nt, Homo sapiens
uggcucaguucagcaggaacag

SEQ ID NO: 10962 - RNA, 22 nt, Homo sapiens
cauugcacuugucucggucuga

SEQ ID NO: 10963 - RNA, 22 nt, Homo sapiens
uauugcacauuacuaaguugca

SEQ ID NO: 10964 - RNA, 22 nt, Homo sapiens
aauugcacgguauccaucugua

SEQ ID NO: 10965 - RNA, 22 nt, Homo sapiens
aauugcacuuuagcaaugguga

SEQ ID NO: 10966 - RNA, 22 nt, Homo sapiens
aguggggaacccuuccaugagg

SEQ ID NO: 10967 - RNA, 25 nt, Homo sapiens
aggggugguguugggacagcuccgu

SEQ ID NO: 10968 - RNA, 22 nt, Homo sapiens
uauugcacuugucccggccugu

SEQ ID NO: 10969 - RNA, 20 nt, Homo sapiens
ggggagcuguggaagcagua

SEQ ID NO: 10970 - RNA, 22 nt, Homo sapiens
uauugcacucgucccggccucc

SEQ ID NO: 10971 - RNA, 22 nt, Homo sapiens
uauugcacucgucccggccucc

SEQ ID NO: 10972 - RNA, 22 nt, Homo sapiens
ucuucucuguuuuggccaugug

SEQ ID NO: 10973 - RNA, 21 nt, Homo sapiens
gugccagcugcagugggggag

SEQ ID NO: 10974 - RNA, 23 nt, Homo sapiens
cucucaccacugcccucccacag

SEQ ID NO: 10975 - RNA, 20 nt, Homo sapiens
uaaggcacgcggugaaugcc

SEQ ID NO: 10976 - RNA, 22 nt, Homo sapiens
agaaggaaauugaauucauuua

SEQ ID NO: 10977 - RNA, 22 nt, Homo sapiens
ucugggcaacaaagugagaccu

SEQ ID NO: 10978 - RNA, 24 nt, Homo sapiens
uggcccugacugaagaccagcagu

SEQ ID NO: 10979 - RNA, 22 nt, Homo sapiens
ugugagguuggcauuguugucu

SEQ ID NO: 10980 - RNA, 18 nt, Homo sapiens
uugagaaggaggcugcug

SEQ ID NO: 10981 - RNA, 22 nt, Homo sapiens
aaggagcucacagucuauugag

SEQ ID NO: 10982 - RNA, 21 nt, Homo sapiens
agggcccccccucaauccugu

SEQ ID NO: 10983 - RNA, 21 nt, Homo sapiens
uaaggcacccuucugaguaga

SEQ ID NO: 10984 - RNA, 23 nt, Homo sapiens
uacuccagagggcgucacucaug

SEQ ID NO: 10985 - RNA, 25 nt, Homo sapiens
gcugggcagggcuucugagcuccuu

SEQ ID NO: 10986 - RNA, 19 nt, Homo sapiens
aagcagcugccucugaggc

SEQ ID NO: 10987 - RNA, 23 nt, Homo sapiens
aaggagcuuacaaucuagcuggg

SEQ ID NO: 10988 - RNA, 22 nt, Homo sapiens
acuccagccccacagccucagc

SEQ ID NO: 10989 - RNA, 22 nt, Homo sapiens
ucuucucuguuuuggccaugug

SEQ ID NO: 10990 - RNA, 23 nt, Homo sapiens
aaaagugcuuacagugcagguag

SEQ ID NO: 10991 - RNA, 22 nt, Homo sapiens
aggcauugacuucucacuagcu

SEQ ID NO: 10992 - RNA, 17 nt, Homo sapiens
uucaaguaauucaggug

SEQ ID NO: 10993 - RNA, 22 nt, Homo sapiens
uauggcacugguagaauucacu

SEQ ID NO: 10994 - RNA, 21 nt, Homo sapiens
agcuacaucuggcuacugggu

SEQ ID NO: 10995 - RNA, 22 nt, Homo sapiens
cauugcacuugucucggucuga

SEQ ID NO: 10996 - RNA, 21 nt, Homo sapiens
uucaaguaauucaggauaggu

SEQ ID NO: 10997 - RNA, 22 nt, Homo sapiens
uauugcacauuacuaaguugca

SEQ ID NO: 10998 - RNA, 22 nt, Homo sapiens
aauugcacgguauccaucugua

SEQ ID NO: 10999 - RNA, 22 nt, Homo sapiens
aauugcacuuuagcaaugguga

SEQ ID NO: 11000 - RNA, 20 nt, Homo sapiens
cugcaaagggaagcccuuuc

SEQ ID NO: 11001 - RNA, 20 nt, Homo sapiens
cugcaaagggaagcccuuuc

SEQ ID NO: 11002 - RNA, 21 nt, Homo sapiens
caaagaggaaggucccauuac

SEQ ID NO: 11003 - RNA, 22 nt, Homo sapiens
agacuucccauuugaagguggc

SEQ ID NO: 11004 - RNA, 22 nt, Homo sapiens
uauugcacuugucccggccugu

SEQ ID NO: 11005 - RNA, 22 nt, Homo sapiens
uauugcacucgucccggccucc

SEQ ID NO: 11006 - RNA, 22 nt, Homo sapiens
acaguagagggaggaaucgcag

SEQ ID NO: 11007 - RNA, 21 nt, Homo sapiens
ccccaccuccucucuccucag

SEQ ID NO: 11008 - RNA, 20 nt, Homo sapiens
cgugccacccuuuuccccag

SEQ ID NO: 11009 - RNA, 24 nt, Homo sapiens
agccuggaagcuggagccugcagu

SEQ ID NO: 11010 - RNA, 18 nt, Homo sapiens
aucccaccucugccacca

SEQ ID NO: 11011 - RNA, 23 nt, Homo sapiens
agcugguguugugaaucaggccg

SEQ ID NO: 11012 - RNA, 22 nt, Homo sapiens
ucucccaacccuuguaccagug

SEQ ID NO: 11013 - RNA, 22 nt, Homo sapiens
ugauauguuugauauauuaggu

SEQ ID NO: 11014 - RNA, 24 nt, Homo sapiens
agcagaagcagggagguucuccca

SEQ ID NO: 11015 - RNA, 22 nt, Homo sapiens
uguaaacauccuacacucagcu

SEQ ID NO: 11016 - RNA, 23 nt, Homo sapiens
aaugacacgaucacucccguuga

SEQ ID NO: 11017 - RNA, 22 nt, Homo sapiens
ucaggcucaguccccucccgau

SEQ ID NO: 11018 - RNA, 21 nt, Homo sapiens
uuggccacaauggguuagaac

SEQ ID NO: 11019 - RNA, 22 nt, Homo sapiens
agacuucccauuugaagguggc

SEQ ID NO: 11020 - RNA, 23 nt, Homo sapiens
uauucauuuauccccagccuaca

SEQ ID NO: 11021 - RNA, 21 nt, Homo sapiens
uccugcgcgucccagaugccc

SEQ ID NO: 11022 - RNA, 22 nt, Homo sapiens
cgcaggggccgggugcucaccg

SEQ ID NO: 11023 - RNA, 22 nt, Homo sapiens
cccugugcccggcccacuucug

SEQ ID NO: 11024 - RNA, 22 nt, Homo sapiens
acacagggcuguugugaagacu

SEQ ID NO: 11025 - RNA, 22 nt, Homo sapiens
ugcggggcuagggcuaacagca

SEQ ID NO: 11026 - RNA, 22 nt, Homo sapiens
ugugcgcagggagaccucuccc

SEQ ID NO: 11027 - RNA, 22 nt, Homo sapiens
aacccguagauccgaucuugug

SEQ ID NO: 11028 - RNA, 22 nt, Homo sapiens
cacccguagaaccgaccuugcg

SEQ ID NO: 11029 - RNA, 22 nt, Homo sapiens
ccucuuccccuugucucuccag

SEQ ID NO: 11030 - RNA, 25 nt, Homo sapiens
ugggaacggguuccggcagacgcug

SEQ ID NO: 11031 - RNA, 23 nt, Homo sapiens
agguuacccgagcaacuuugcau

SEQ ID NO: 11032 - RNA, 22 nt, Homo sapiens
ugauugguacgucuguggguag

SEQ ID NO: 11033 - RNA, 22 nt, Homo sapiens
aaaaguaauugcgaguuuuacc

SEQ ID NO: 11034 - RNA, 22 nt, Homo sapiens
aaaaguaauugugguuuuggcc

SEQ ID NO: 11035 - RNA, 22 nt, Homo sapiens
aaaaguaauugcgguuuuugcc

SEQ ID NO: 11036 - RNA, 22 nt, Homo sapiens
aaaaguaauugugguuuuugcc

SEQ ID NO: 11037 - RNA, 22 nt, Homo sapiens
aaaaguaaucgcgguuuuuguc

SEQ ID NO: 11038 - RNA, 22 nt, Homo sapiens
aaaaguaauugcggauuuugcc

SEQ ID NO: 11039 - RNA, 22 nt, Homo sapiens
aaaaguaauugcggucuuuggu

SEQ ID NO: 11040 - RNA, 21 nt, Homo sapiens
uaaaguaaauaugcaccaaaa

SEQ ID NO: 11041 - RNA, 21 nt, Homo sapiens
uuggccacaauggguuagaac

SEQ ID NO: 11042 - RNA, 20 nt, Homo sapiens
guagaggagauggcgcaggg

SEQ ID NO: 11043 - RNA, 23 nt, Homo sapiens
gagggucuugggagggaugugac

SEQ ID NO: 11044 - RNA, 23 nt, Homo sapiens
aggaugagcaaagaaaguagauu

SEQ ID NO: 11045 - RNA, 22 nt, Homo sapiens
cggaugagcaaagaaagugguu

SEQ ID NO: 11046 - RNA, 18 nt, Homo sapiens
aucccaccucugccacca

SEQ ID NO: 11047 - RNA, 24 nt, Homo sapiens
uggcccugacugaagaccagcagu

SEQ ID NO: 11048 - RNA, 25 nt, Homo sapiens
ugggaacggguuccggcagacgcug

SEQ ID NO: 11049 - RNA, 21 nt, Homo sapiens
gcccuccgcccgugcaccccg

SEQ ID NO: 11050 - RNA, 22 nt, Homo sapiens
cgcaggggccgggugcucaccg

SEQ ID NO: 11051 - RNA, 22 nt, Homo sapiens
aacuggccuacaaagucccagu

SEQ ID NO: 11052 - RNA, 22 nt, Homo sapiens
aacuggcccucaaagucccgcu

SEQ ID NO: 11053 - RNA, 22 nt, Homo sapiens
acagcaggcacagacaggcagu

SEQ ID NO: 11054 - RNA, 21 nt, Homo sapiens
agggcccccccucaauccugu

SEQ ID NO: 11055 - RNA, 22 nt, Homo sapiens
aaaagcuggguugagagggcga

SEQ ID NO: 11056 - RNA, 22 nt, Homo sapiens
aaaagcuggguugagagggcaa

SEQ ID NO: 11057 - RNA, 20 nt, Homo sapiens
aaaagcuggguugagagggu

SEQ ID NO: 11058 - RNA, 19 nt, Homo sapiens
aaaagcuggguugagagga

SEQ ID NO: 11059 - RNA, 22 nt, Homo sapiens
gccugcugggguggaaccuggu

SEQ ID NO: 11060 - RNA, 22 nt, Homo sapiens
uucucaaggaggugucguuuau

SEQ ID NO: 11061 - RNA, 23 nt, Homo sapiens
cucuugagggaagcacuuucugu

SEQ ID NO: 11062 - RNA, 21 nt, Homo sapiens
agggggaaaguucuauagucc

SEQ ID NO: 11063 - RNA, 20 nt, Homo sapiens
ggggagcuguggaagcagua

SEQ ID NO: 11064 - RNA, 21 nt, Homo sapiens
uaccacaggguagaaccacgg

SEQ ID NO: 11065 - RNA, 23 nt, Homo sapiens
cccaguguucagacuaccuguuc

SEQ ID NO: 11066 - RNA, 23 nt, Homo sapiens
cccaguguuuagacuaucuguuc

SEQ ID NO: 11067 - RNA, 22 nt, Homo sapiens
acccgucccguucguccccgga

SEQ ID NO: 11068 - RNA, 22 nt, Homo sapiens
augggugaauuuguagaaggau

SEQ ID NO: 11069 - RNA, 22 nt, Homo sapiens
uuagggcccuggcuccaucucc

SEQ ID NO: 11070 - RNA, 21 nt, Homo sapiens
cggcggggacggcgauugguc

SEQ ID NO: 11071 - RNA, 22 nt, Homo sapiens
cauugcacuugucucggucuga

SEQ ID NO: 11072 - RNA, 25 nt, Homo sapiens
ggcggagggaaguagguccguuggu

SEQ ID NO: 11073 - RNA, 22 nt, Homo sapiens
aggcggggcgccgcgggaccgc

SEQ ID NO: 11074 - RNA, 21 nt, Homo sapiens
uggaggagaaggaaggugaug

SEQ ID NO: 11075 - RNA, 21 nt, Homo sapiens
cgcgggugcuuacugacccuu

SEQ ID NO: 11076 - RNA, 21 nt, Homo sapiens
cgcgggugcuuacugacccuu

SEQ ID NO: 11077 - RNA, 22 nt, Homo sapiens
uauugcacucgucccggccucc

SEQ ID NO: 11078 - RNA, 24 nt, Homo sapiens
uggggagcugaggcucugggggug

SEQ ID NO: 11079 - RNA, 19 nt, Homo sapiens
gugucugcuuccuguggga

SEQ ID NO: 11080 - RNA, 22 nt, Homo sapiens
aggcggggcgccgcgggaccgc

SEQ ID NO: 11081 - RNA, 24 nt, Homo sapiens
ucccugagacccuuuaaccuguga

SEQ ID NO: 11082 - RNA, 22 nt, Homo sapiens
ucccugagacccuaacuuguga

SEQ ID NO: 11083 - RNA, 18 nt, Homo sapiens
aucccaccucugccacca

SEQ ID NO: 11084 - RNA, 23 nt, Homo sapiens
ccucagggcuguagaacagggcu

SEQ ID NO: 11085 - RNA, 23 nt, Homo sapiens
cuggagauauggaagagcugugu

SEQ ID NO: 11086 - RNA, 22 nt, Homo sapiens
uuugguccccuucaaccagcug

SEQ ID NO: 11087 - RNA, 22 nt, Homo sapiens
uuugguccccuucaaccagcua

SEQ ID NO: 11088 - RNA, 23 nt, Homo sapiens
acuccauuuguuuugaugaugga

SEQ ID NO: 11089 - RNA, 23 nt, Homo sapiens
ucuggcuccgugucuucacuccc

SEQ ID NO: 11090 - RNA, 21 nt, Homo sapiens
uccugcgcgucccagaugccc

SEQ ID NO: 11091 - RNA, 21 nt, Homo sapiens
cggcggggacggcgauugguc

SEQ ID NO: 11092 - RNA, 22 nt, Homo sapiens
uagguaguuuccuguuguuggg

SEQ ID NO: 11093 - RNA, 22 nt, Homo sapiens
gguccagaggggagauagguuc

SEQ ID NO: 11094 - RNA, 22 nt, Homo sapiens
uguaaacauccuacacucagcu

SEQ ID NO: 11095 - RNA, 23 nt, Homo sapiens
caaagcgcuucucuuuagagugu

SEQ ID NO: 11096 - RNA, 21 nt, Homo sapiens
cuccagagggaaguacuuucu

SEQ ID NO: 11097 - RNA, 21 nt, Homo sapiens
cuccagagggaugcacuuucu

SEQ ID NO: 11098 - RNA, 22 nt, Homo sapiens
ccucccacacccaaggcuugca

SEQ ID NO: 11099 - RNA, 20 nt, Homo sapiens
auggagauagauauagaaau

SEQ ID NO: 11100 - RNA, 22 nt, Homo sapiens
aggcggggcgccgcgggaccgc

SEQ ID NO: 11101 - RNA, 22 nt, Homo sapiens
ugcggggcuagggcuaacagca

SEQ ID NO: 11102 - RNA, 22 nt, Homo sapiens
cuggacugagccgugcuacugg

SEQ ID NO: 11103 - RNA, 23 nt, Homo sapiens
ucuggcuccgugucuucacuccc

SEQ ID NO: 11104 - RNA, 21 nt, Homo sapiens
cggcggggacggcgauugguc

SEQ ID NO: 11105 - RNA, 22 nt, Homo sapiens
cccugugcccggcccacuucug

SEQ ID NO: 11106 - RNA, 21 nt, Homo sapiens
aggcaagaugcuggcauagcu

SEQ ID NO: 11107 - RNA, 23 nt, Homo sapiens
ucccccaggugugauucugauuu

SEQ ID NO: 11108 - RNA, 21 nt, Homo sapiens
gcaguccaugggcauauacac

SEQ ID NO: 11109 - RNA, 22 nt, Homo sapiens
caagaaccucaguugcuuuugu

SEQ ID NO: 11110 - RNA, 25 nt, Homo sapiens
aggggugguguugggacagcuccgu

SEQ ID NO: 11111 - RNA, 22 nt, Homo sapiens
ggggguccccggugcucggauc

SEQ ID NO: 11112 - RNA, 24 nt, Homo sapiens
acugggggcuuucgggcucugcgu

SEQ ID NO: 11113 - RNA, 22 nt, Homo sapiens
aggcggggcgccgcgggaccgc

SEQ ID NO: 11114 - RNA, 20 nt, Homo sapiens
ggggagcuguggaagcagua

SEQ ID NO: 11115 - RNA, 22 nt, Homo sapiens
uggagugugacaaugguguuug

SEQ ID NO: 11116 - RNA, 18 nt, Homo sapiens
cagggaggugaaugugau

SEQ ID NO: 11117 - RNA, 23 nt, Homo sapiens
ucuggcuccgugucuucacuccc

SEQ ID NO: 11118 - RNA, 21 nt, Homo sapiens
cggcggggacggcgauugguc

SEQ ID NO: 11119 - RNA, 19 nt, Homo sapiens
accgugcaaagguagcaua

SEQ ID NO: 11120 - RNA, 23 nt, Homo sapiens
ucccccaggugugauucugauuu

SEQ ID NO: 11121 - RNA, 20 nt, Homo sapiens
guccgcucggcgguggccca

SEQ ID NO: 11122 - RNA, 22 nt, Homo sapiens
aggcggggcgccgcgggaccgc

SEQ ID NO: 11123 - RNA, 20 nt, Homo sapiens
accaggaggcugaggccccu

SEQ ID NO: 11124 - RNA, 21 nt, Homo sapiens
uggcagggaggcugggagggg

SEQ ID NO: 11125 - RNA, 24 nt, Homo sapiens
uggcccugacugaagaccagcagu

SEQ ID NO: 11126 - RNA, 22 nt, Homo sapiens
uggguggucuggagauuugugc

SEQ ID NO: 11127 - RNA, 22 nt, Homo sapiens
cuggcccucucugcccuuccgu

SEQ ID NO: 11128 - RNA, 21 nt, Homo sapiens
gugucuuuugcucugcaguca

SEQ ID NO: 11129 - RNA, 18 nt, Homo sapiens
ugcuuccuuucagagggu

SEQ ID NO: 11130 - RNA, 22 nt, Homo sapiens
aucuggagguaagaagcacuuu

SEQ ID NO: 11131 - RNA, 22 nt, Homo sapiens
ugugacagauugauaacugaaa

SEQ ID NO: 11132 - RNA, 22 nt, Homo sapiens
uuugugaccugguccacuaacc

SEQ ID NO: 11133 - RNA, 23 nt, Homo sapiens
ucuuugguuaucuagcuguauga

SEQ ID NO: 11134 - RNA, 21 nt, Homo sapiens
aaggcagggcccccgcucccc

SEQ ID NO: 11135 - RNA, 18 nt, Homo sapiens
cgggcguggugguggggg

SEQ ID NO: 11136 - RNA, 17 nt, Homo sapiens
ucgccuccuccucuccc

SEQ ID NO: 11137 - RNA, 23 nt, Homo sapiens
cggcccgggcugcugcuguuccu

SEQ ID NO: 11138 - RNA, 21 nt, Homo sapiens
cggcggggacggcgauugguc

SEQ ID NO: 11139 - RNA, 21 nt, Homo sapiens
acuggacuuggagucagaagg

SEQ ID NO: 11140 - RNA, 23 nt, Homo sapiens
ugaggggcagagagcgagacuuu

SEQ ID NO: 11141 - RNA, 21 nt, Homo sapiens
aggguaagcugaaccucugau

SEQ ID NO: 11142 - RNA, 22 nt, Homo sapiens
aggcggggcgccgcgggaccgc

SEQ ID NO: 11143 - RNA, 20 nt, Homo sapiens
cggcucugggucugugggga

SEQ ID NO: 11144 - RNA, 21 nt, Homo sapiens
uggcagggaggcugggagggg

SEQ ID NO: 11145 - RNA, 22 nt, Homo sapiens
ucaccagcccuguguucccuag

SEQ ID NO: 11146 - RNA, 21 nt, Homo sapiens
uccuucugcuccgucccccag

SEQ ID NO: 11147 - RNA, 22 nt, Homo sapiens
ucugggcaacaaagugagaccu

SEQ ID NO: 11148 - RNA, 21 nt, Homo sapiens
ugcaggaccaagaugagcccu

SEQ ID NO: 11149 - RNA, 18 nt, Homo sapiens
cagggaggugaaugugau

SEQ ID NO: 11150 - RNA, 23 nt, Homo sapiens
agcugguguugugaaucaggccg

SEQ ID NO: 11151 - RNA, 21 nt, Homo sapiens
uaccacaggguagaaccacgg

SEQ ID NO: 11152 - RNA, 23 nt, Homo sapiens
ucuggcuccgugucuucacuccc

SEQ ID NO: 11153 - RNA, 22 nt, Homo sapiens
uggagagaaaggcaguuccuga

SEQ ID NO: 11154 - RNA, 22 nt, Homo sapiens
caaagaauucuccuuuugggcu

SEQ ID NO: 11155 - RNA, 22 nt, Homo sapiens
cccugugcccggcccacuucug

SEQ ID NO: 11156 - RNA, 22 nt, Homo sapiens
ucaggccaggcacaguggcuca

SEQ ID NO: 11157 - RNA, 22 nt, Homo sapiens
aaggagcucacagucuauugag

SEQ ID NO: 11158 - RNA, 20 nt, Homo sapiens
ccucugggcccuuccuccag

SEQ ID NO: 11159 - RNA, 22 nt, Homo sapiens
ucucugggccugugucuuaggc

SEQ ID NO: 11160 - RNA, 23 nt, Homo sapiens
ugaggggcagagagcgagacuuu

SEQ ID NO: 11161 - RNA, 21 nt, Homo sapiens
gugucuuuugcucugcaguca

SEQ ID NO: 11162 - RNA, 22 nt, Homo sapiens
auucugcauuuuuagcaaguuc

SEQ ID NO: 11163 - RNA, 25 nt, Homo sapiens
gcugggcagggcuucugagcuccuu

SEQ ID NO: 11164 - RNA, 22 nt, Homo sapiens
ggggguccccggugcucggauc

SEQ ID NO: 11165 - RNA, 19 nt, Homo sapiens
agcugucugaaaaugucuu

SEQ ID NO: 11166 - RNA, 23 nt, Homo sapiens
aaggagcuuacaaucuagcuggg

SEQ ID NO: 11167 - RNA, 22 nt, Homo sapiens
caaagugccucccuuuagagug

SEQ ID NO: 11168 - RNA, 20 nt, Homo sapiens
ggggagcuguggaagcagua

SEQ ID NO: 11169 - RNA, 22 nt, Homo sapiens
ucggccugaccacccaccccac

SEQ ID NO: 11170 - RNA, 17 nt, Homo sapiens
ucgccuccuccucuccc

SEQ ID NO: 11171 - RNA, 22 nt, Homo sapiens
acucggcguggcgucggucgug

SEQ ID NO: 11172 - RNA, 22 nt, Homo sapiens
uagcaccaucugaaaucgguua

SEQ ID NO: 11173 - RNA, 23 nt, Homo sapiens
uagcaccauuugaaaucaguguu

SEQ ID NO: 11174 - RNA, 22 nt, Homo sapiens
uagcaccauuugaaaucgguua

SEQ ID NO: 11175 - RNA, 22 nt, Homo sapiens
ugauugguacgucuguggguag

SEQ ID NO: 11176 - RNA, 19 nt, Homo sapiens
ugagcugcuguaccaaaau

SEQ ID NO: 11177 - RNA, 19 nt, Homo sapiens
aggcugcggaauucaggac

SEQ ID NO: 11178 - RNA, 21 nt, Homo sapiens
gugccagcugcagugggggag

SEQ ID NO: 11179 - RNA, 22 nt, Homo sapiens
cucggcgcggggcgcgggcucc

SEQ ID NO: 11180 - RNA, 23 nt, Homo sapiens
uaaggugcaucuagugcagauag

SEQ ID NO: 11181 - RNA, 22 nt, Homo sapiens
aaaucucugcaggcaaauguga

SEQ ID NO: 11182 - RNA, 23 nt, Homo sapiens
ugagcgccucgacgacagagccg

SEQ ID NO: 11183 - RNA, 23 nt, Homo sapiens
ugucugcccgcaugccugccucu

SEQ ID NO: 11184 - RNA, 19 nt, Homo sapiens
ugucucugcugggguuucu

SEQ ID NO: 11185 - RNA, 21 nt, Homo sapiens
guggcugcacucacuuccuuc

SEQ ID NO: 11186 - RNA, 20 nt, Homo sapiens
cggcucugggucugugggga

SEQ ID NO: 11187 - RNA, 22 nt, Homo sapiens
cugcccuggcccgagggaccga

SEQ ID NO: 11188 - RNA, 22 nt, Homo sapiens
uggagugugacaaugguguuug

SEQ ID NO: 11189 - RNA, 21 nt, Homo sapiens
acucuagcugccaaaggcgcu

SEQ ID NO: 11190 - RNA, 21 nt, Homo sapiens
caagucacuagugguuccguu

SEQ ID NO: 11191 - RNA, 22 nt, Homo sapiens
uaaugccccuaaaaauccuuau

SEQ ID NO: 11192 - RNA, 23 nt, Homo sapiens
ugaggggcagagagcgagacuuu

SEQ ID NO: 11193 - RNA, 22 nt, Homo sapiens
ugaaggucuacugugugccagg

SEQ ID NO: 11194 - RNA, 23 nt, Homo sapiens
aucgcugcgguugcgagcgcugu

SEQ ID NO: 11195 - RNA, 20 nt, Homo sapiens
accaggaggcugaggccccu

SEQ ID NO: 11196 - RNA, 21 nt, Homo sapiens
uccgguucucagggcuccacc

SEQ ID NO: 11197 - RNA, 18 nt, Homo sapiens
ugaggcaguagauugaau

SEQ ID NO: 11198 - RNA, 22 nt, Homo sapiens
uggcagugucuuagcugguugu

SEQ ID NO: 11199 - RNA, 23 nt, Homo sapiens
uagcagcgggaacaguucugcag

SEQ ID NO: 11200 - RNA, 21 nt, Homo sapiens
caaagaggaaggucccauuac

SEQ ID NO: 11201 - RNA, 21 nt, Homo sapiens
uggaggagaaggaaggugaug

SEQ ID NO: 11202 - RNA, 21 nt, Homo sapiens
aaggcagggcccccgcucccc

SEQ ID NO: 11203 - RNA, 21 nt, Homo sapiens
gugccagcugcagugggggag

SEQ ID NO: 11204 - RNA, 22 nt, Homo sapiens
uggagugugacaaugguguuug

SEQ ID NO: 11205 - RNA, 17 nt, Homo sapiens
ucgccuccuccucuccc

SEQ ID NO: 11206 - RNA, 23 nt, Homo sapiens
ucuggcuccgugucuucacuccc

SEQ ID NO: 11207 - RNA, 22 nt, Homo sapiens
uggagagaaaggcaguuccuga

SEQ ID NO: 11208 - RNA, 21 nt, Homo sapiens
cggcggggacggcgauugguc

SEQ ID NO: 11209 - RNA, 21 nt, Homo sapiens
auuugugcuuggcucugucac

SEQ ID NO: 11210 - RNA, 23 nt, Homo sapiens
ugaggggcagagagcgagacuuu

SEQ ID NO: 11211 - RNA, 22 nt, Homo sapiens
agaggcuggccgugaugaauuc

SEQ ID NO: 11212 - RNA, 24 nt, Homo sapiens
ugccugggucucuggccugcgcgu

SEQ ID NO: 11213 - RNA, 22 nt, Homo sapiens
aggcggggcgccgcgggaccgc

SEQ ID NO: 11214 - RNA, 23 nt, Homo sapiens
aggaagcccuggaggggcuggag

SEQ ID NO: 11215 - RNA, 22 nt, Homo sapiens
ugcggggcuagggcuaacagca

SEQ ID NO: 11216 - RNA, 21 nt, Homo sapiens
uggaggagaaggaaggugaug

SEQ ID NO: 11217 - RNA, 21 nt, Homo sapiens
aggguaagcugaaccucugau

SEQ ID NO: 11218 - RNA, 21 nt, Homo sapiens
uggaggagaaggaaggugaug

SEQ ID NO: 11219 - RNA, 22 nt, Homo sapiens
ccucuuccccuugucucuccag

SEQ ID NO: 11220 - RNA, 20 nt, Homo sapiens
uaaagagcccuguggagaca

SEQ ID NO: 11221 - RNA, 22 nt, Homo sapiens
uucauucggcuguccagaugua

SEQ ID NO: 11222 - RNA, 23 nt, Homo sapiens
ugaggggcagagagcgagacuuu

SEQ ID NO: 11223 - RNA, 22 nt, Homo sapiens
ugugacagauugauaacugaaa

SEQ ID NO: 11224 - RNA, 21 nt, Homo sapiens
agggggaaaguucuauagucc

SEQ ID NO: 11225 - RNA, 22 nt, Homo sapiens
acuccagccccacagccucagc

SEQ ID NO: 11226 - RNA, 20 nt, Homo sapiens
guagaggagauggcgcaggg

SEQ ID NO: 11227 - RNA, 20 nt, Homo sapiens
guagaggagauggcgcaggg

SEQ ID NO: 11228 - RNA, 24 nt, Homo sapiens
uggcccugacugaagaccagcagu

SEQ ID NO: 11229 - RNA, 24 nt, Homo sapiens
uggcccugacugaagaccagcagu

SEQ ID NO: 11230 - RNA, 22 nt, Homo sapiens
ugcccuguggacucaguucugg

SEQ ID NO: 11231 - RNA, 23 nt, Homo sapiens
ucuggcuccgugucuucacuccc

SEQ ID NO: 11232 - RNA, 22 nt, Homo sapiens
ucugcccccuccgcugcugcca

SEQ ID NO: 11233 - RNA, 21 nt, Homo sapiens
agggcccccccucaauccugu

SEQ ID NO: 11234 - RNA, 20 nt, Homo sapiens
acugccccaggugcugcugg

SEQ ID NO: 11235 - RNA, 23 nt, Homo sapiens
ucccuguccuccaggagcucacg

SEQ ID NO: 11236 - RNA, 22 nt, Homo sapiens
aauugcacgguauccaucugua

SEQ ID NO: 11237 - RNA, 21 nt, Homo sapiens
cggggcagcucaguacaggau

SEQ ID NO: 11238 - RNA, 22 nt, Homo sapiens
cgucaacacuugcugguuuccu

SEQ ID NO: 11239 - RNA, 22 nt, Homo sapiens
ccucccacacccaaggcuugca

SEQ ID NO: 11240 - RNA, 25 nt, Homo sapiens
aggggugguguugggacagcuccgu

SEQ ID NO: 11241 - RNA, 21 nt, Homo sapiens
cgcgggugcuuacugacccuu

SEQ ID NO: 11242 - RNA, 20 nt, Homo sapiens
ggggagcuguggaagcagua

SEQ ID NO: 11243 - RNA, 22 nt, Homo sapiens
uuuccggcucgcgugggugugu

SEQ ID NO: 11244 - RNA, 21 nt, Homo sapiens
aagugaucuaaaggccuacau

SEQ ID NO: 11245 - RNA, 22 nt, Homo sapiens
aucgugcauccuuuuagagugu

SEQ ID NO: 11246 - RNA, 22 nt, Homo sapiens
cccugugcccggcccacuucug

SEQ ID NO: 11247 - RNA, 22 nt, Homo sapiens
uaauacugccugguaaugauga

SEQ ID NO: 11248 - RNA, 23 nt, Homo sapiens
uaauacugccggguaaugaugga

SEQ ID NO: 11249 - RNA, 22 nt, Homo sapiens
acacagggcuguugugaagacu

SEQ ID NO: 11250 - RNA, 22 nt, Homo sapiens
uaauacugucugguaaaaccgu

SEQ ID NO: 11251 - RNA, 21 nt, Homo sapiens
gaaggcgcuucccuuuggagu

SEQ ID NO: 11252 - RNA, 22 nt, Homo sapiens
gaaggcgcuucccuuuagagcg

SEQ ID NO: 11253 - RNA, 22 nt, Homo sapiens
ugcaacuuaccugagucauuga

SEQ ID NO: 11254 - RNA, 22 nt, Homo sapiens
aacccguagauccgaucuugug

SEQ ID NO: 11255 - RNA, 22 nt, Homo sapiens
cacccguagaaccgaccuugcg

SEQ ID NO: 11256 - RNA, 21 nt, Homo sapiens
acucuagcugccaaaggcgcu

SEQ ID NO: 11257 - RNA, 22 nt, Homo sapiens
uggguggucuggagauuugugc

SEQ ID NO: 11258 - RNA, 22 nt, Homo sapiens
ggagacgcggcccuguuggagu

SEQ ID NO: 11259 - RNA, 22 nt, Homo sapiens
ucaggccaggcacaguggcuca

SEQ ID NO: 11260 - RNA, 23 nt, Homo sapiens
aggaccugcgggacaagauucuu

SEQ ID NO: 11261 - RNA, 22 nt, Homo sapiens
gaugagcucauuguaauaugag

SEQ ID NO: 11262 - RNA, 22 nt, Homo sapiens
uggugguuuacaaaguaauuca

SEQ ID NO: 11263 - RNA, 22 nt, Homo sapiens
uauggcacugguagaauucacu

SEQ ID NO: 11264 - RNA, 22 nt, Homo sapiens
uauggcacugguagaauucacu

SEQ ID NO: 11265 - RNA, 22 nt, Homo sapiens
uggagagaaaggcaguuccuga

SEQ ID NO: 11266 - RNA, 22 nt, Homo sapiens
uacccagagcaugcagugugaa

SEQ ID NO: 11267 - RNA, 22 nt, Homo sapiens
cuuaugcaagauucccuucuac

SEQ ID NO: 11268 - RNA, 22 nt, Homo sapiens
ucugggcaacaaagugagaccu

SEQ ID NO: 11269 - RNA, 22 nt, Homo sapiens
aacuggcccucaaagucccgcu

SEQ ID NO: 11270 - RNA, 21 nt, Homo sapiens
gguuugguccuagccuuucua

SEQ ID NO: 11271 - RNA, 23 nt, Homo sapiens
ucuuggaguaggucauugggugg

SEQ ID NO: 11272 - RNA, 24 nt, Homo sapiens
uucuccaaaagaaagcacuuucug

SEQ ID NO: 11273 - RNA, 22 nt, Homo sapiens
aagugccuccuuuuagaguguu

SEQ ID NO: 11274 - RNA, 25 nt, Homo sapiens
gcugggcagggcuucugagcuccuu

SEQ ID NO: 11275 - RNA, 23 nt, Homo sapiens
acuugggcacugaaacaaugucc

SEQ ID NO: 11276 - RNA, 22 nt, Homo sapiens
gucccucuccaaaugugucuug

SEQ ID NO: 11277 - RNA, 22 nt, Homo sapiens
ucgugucuuguguugcagccgg

SEQ ID NO: 11278 - RNA, 25 nt, Homo sapiens
cccccacaaccgcgcuugacuagcu

SEQ ID NO: 11279 - RNA, 22 nt, Homo sapiens
uguaaacauccuacacucagcu

SEQ ID NO: 11280 - RNA, 23 nt, Homo sapiens
ucaagagcaauaacgaaaaaugu

SEQ ID NO: 11281 - RNA, 23 nt, Homo sapiens
uuucaagccagggggcguuuuuc

SEQ ID NO: 11282 - RNA, 21 nt, Homo sapiens
gugucuuuugcucugcaguca

SEQ ID NO: 11283 - RNA, 21 nt, Homo sapiens
gaaggcgcuucccuuuggagu

SEQ ID NO: 11284 - RNA, 22 nt, Homo sapiens
gaaggcgcuucccuuuagagcg

SEQ ID NO: 11285 - RNA, 25 nt, Homo sapiens
agggaucgcgggcggguggcggccu

SEQ ID NO: 11286 - RNA, 21 nt, Homo sapiens
uggcagggaggcugggagggg

SEQ ID NO: 11287 - RNA, 21 nt, Homo sapiens
cggcggggacggcgauugguc

SEQ ID NO: 11288 - RNA, 22 nt, Homo sapiens
cgcaggggccgggugcucaccg

SEQ ID NO: 11289 - RNA, 22 nt, Homo sapiens
ucugcccccuccgcugcugcca

SEQ ID NO: 11290 - RNA, 20 nt, Homo sapiens
acugccccaggugcugcugg

SEQ ID NO: 11291 - RNA, 21 nt, Homo sapiens
cggggcagcucaguacaggau

SEQ ID NO: 11292 - RNA, 22 nt, Homo sapiens
gucccucuccaaaugugucuug

SEQ ID NO: 11293 - RNA, 22 nt, Homo sapiens
aggcggggcgccgcgggaccgc

SEQ ID NO: 11294 - RNA, 22 nt, Homo sapiens
ugcggggcuagggcuaacagca

SEQ ID NO: 11295 - RNA, 23 nt, Homo sapiens
ccugcagcgacuugauggcuucc

SEQ ID NO: 11296 - RNA, 23 nt, Homo sapiens
ccugcagcgacuugauggcuucc

SEQ ID NO: 11297 - RNA, 22 nt, Homo sapiens
acgcccuucccccccuucuuca

SEQ ID NO: 11298 - RNA, 21 nt, Homo sapiens
cggcggggacggcgauugguc

SEQ ID NO: 11299 - RNA, 23 nt, Homo sapiens
caacggaaucccaaaagcagcug

SEQ ID NO: 11300 - RNA, 23 nt, Homo sapiens
ugaggggcagagagcgagacuuu

SEQ ID NO: 11301 - RNA, 21 nt, Homo sapiens
auccuugcuaucugggugcua

SEQ ID NO: 11302 - RNA, 21 nt, Homo sapiens
ggcuagcaacagcgcuuaccu

SEQ ID NO: 11303 - RNA, 24 nt, Homo sapiens
ugccugggucucuggccugcgcgu

SEQ ID NO: 11304 - RNA, 22 nt, Homo sapiens
aggcggggcgccgcgggaccgc

SEQ ID NO: 11305 - RNA, 22 nt, Homo sapiens
ugcggggcuagggcuaacagca

SEQ ID NO: 11306 - RNA, 21 nt, Homo sapiens
uggcagggaggcugggagggg

SEQ ID NO: 11307 - RNA, 17 nt, Homo sapiens
ucgccuccuccucuccc

SEQ ID NO: 11308 - RNA, 18 nt, Homo sapiens
acguuggcucugguggug

SEQ ID NO: 11309 - RNA, 21 nt, Homo sapiens
cggcggggacggcgauugguc

SEQ ID NO: 11310 - RNA, 22 nt, Homo sapiens
ucugcccccuccgcugcugcca

SEQ ID NO: 11311 - RNA, 22 nt, Homo sapiens
uagcaccaucugaaaucgguua

SEQ ID NO: 11312 - RNA, 23 nt, Homo sapiens
uagcaccauuugaaaucaguguu

SEQ ID NO: 11313 - RNA, 22 nt, Homo sapiens
uagcaccauuugaaaucgguua

SEQ ID NO: 11314 - RNA, 20 nt, Homo sapiens
acugccccaggugcugcugg

SEQ ID NO: 11315 - RNA, 22 nt, Homo sapiens
aauugcacgguauccaucugua

SEQ ID NO: 11316 - RNA, 23 nt, Homo sapiens
ugaggggcagagagcgagacuuu

SEQ ID NO: 11317 - RNA, 21 nt, Homo sapiens
cggggcagcucaguacaggau

SEQ ID NO: 11318 - RNA, 22 nt, Homo sapiens
aggcggggcgccgcgggaccgc

SEQ ID NO: 11319 - RNA, 22 nt, Homo sapiens
ugcggggcuagggcuaacagca

SEQ ID NO: 11320 - RNA, 21 nt, Homo sapiens
ccccaccuccucucuccucag

SEQ ID NO: 11321 - RNA, 22 nt, Homo sapiens
uggagugugacaaugguguuug

SEQ ID NO: 11322 - RNA, 17 nt, Homo sapiens
ucccaccgcugccaccc

SEQ ID NO: 11323 - RNA, 21 nt, Homo sapiens
uugggacauacuuaugcuaaa

SEQ ID NO: 11324 - RNA, 22 nt, Homo sapiens
cauugcacuugucucggucuga

SEQ ID NO: 11325 - RNA, 22 nt, Homo sapiens
uaaugccccuaaaaauccuuau

SEQ ID NO: 11326 - RNA, 23 nt, Homo sapiens
ucuuggaguaggucauugggugg

SEQ ID NO: 11327 - RNA, 25 nt, Homo sapiens
ggcggagggaaguagguccguuggu

SEQ ID NO: 11328 - RNA, 20 nt, Homo sapiens
ggggagcuguggaagcagua

SEQ ID NO: 11329 - RNA, 22 nt, Homo sapiens
ugugagguuggcauuguugucu

SEQ ID NO: 11330 - RNA, 18 nt, Homo sapiens
uugagaaggaggcugcug

SEQ ID NO: 11331 - RNA, 22 nt, Homo sapiens
ucagugcaucacagaacuuugu

SEQ ID NO: 11332 - RNA, 22 nt, Homo sapiens
uagcagcacauaaugguuugug

SEQ ID NO: 11333 - RNA, 23 nt, Homo sapiens
uaaggugcaucuagugcagauag

SEQ ID NO: 11334 - RNA, 22 nt, Homo sapiens
cucccacugcuucacuugacua

SEQ ID NO: 11335 - RNA, 21 nt, Homo sapiens
gccccugggccuauccuagaa

SEQ ID NO: 11336 - RNA, 23 nt, Homo sapiens
gaacgcgcuucccuauagagggu

SEQ ID NO: 11337 - RNA, 22 nt, Homo sapiens
ccucccacacccaaggcuugca

SEQ ID NO: 11338 - RNA, 17 nt, Homo sapiens
ucucgcuggggccucca

SEQ ID NO: 11339 - RNA, 23 nt, Homo sapiens
ucaaaugcucagacuccuguggu

SEQ ID NO: 11340 - RNA, 22 nt, Homo sapiens
uggagugugacaaugguguuug

SEQ ID NO: 11341 - RNA, 17 nt, Homo sapiens
ucccaccgcugccaccc

SEQ ID NO: 11342 - RNA, 21 nt, Homo sapiens
uccugcgcgucccagaugccc

SEQ ID NO: 11343 - RNA, 21 nt, Homo sapiens
cggcggggacggcgauugguc

SEQ ID NO: 11344 - RNA, 22 nt, Homo sapiens
auauaauacaaccugcuaagug

SEQ ID NO: 11345 - RNA, 22 nt, Homo sapiens
uggugggcacagaaucuggacu

SEQ ID NO: 11346 - RNA, 22 nt, Homo sapiens
uggugggccgcagaacaugugc

SEQ ID NO: 11347 - RNA, 22 nt, Homo sapiens
aggcggggcgccgcgggaccgc

SEQ ID NO: 11348 - RNA, 22 nt, Homo sapiens
ugcggggcuagggcuaacagca

SEQ ID NO: 11349 - RNA, 22 nt, Homo sapiens
ucggauccgucugagcuuggcu

SEQ ID NO: 11350 - RNA, 23 nt, Homo sapiens
ucuggcuccgugucuucacuccc

SEQ ID NO: 11351 - RNA, 20 nt, Homo sapiens
ccccagggcgacgcggcggg

SEQ ID NO: 11352 - RNA, 22 nt, Homo sapiens
uuggggaaacggccgcugagug

SEQ ID NO: 11353 - RNA, 23 nt, Homo sapiens
agcuacauugucugcuggguuuc

SEQ ID NO: 11354 - RNA, 24 nt, Homo sapiens
aauccuuggaaccuaggugugagu

SEQ ID NO: 11355 - RNA, 21 nt, Homo sapiens
uugaaaggcuauuucuugguc

SEQ ID NO: 11356 - RNA, 22 nt, Homo sapiens
gaaagcgcuucccuuugcugga

SEQ ID NO: 11357 - RNA, 22 nt, Homo sapiens
caaagcgcuccccuuuagaggu

SEQ ID NO: 11358 - RNA, 23 nt, Homo sapiens
caaagcgcuucucuuuagagugu

SEQ ID NO: 11359 - RNA, 21 nt, Homo sapiens
caaagcgcuucccuuuggagc

SEQ ID NO: 11360 - RNA, 21 nt, Homo sapiens
aaagcgcuucccuucagagug

SEQ ID NO: 11361 - RNA, 21 nt, Homo sapiens
gaaagcgcuucucuuuagagg

SEQ ID NO: 11362 - RNA, 22 nt, Homo sapiens
ucagcaaacauuuauugugugc

SEQ ID NO: 11363 - RNA, 21 nt, Homo sapiens
uagauaaaauauugguaccug

SEQ ID NO: 11364 - RNA, 20 nt, Homo sapiens
uaaagagcccuguggagaca

SEQ ID NO: 11365 - RNA, 22 nt, Homo sapiens
uucccuuugucauccuaugccu

SEQ ID NO: 11366 - RNA, 22 nt, Homo sapiens
uucccuuugucauccuucgccu

SEQ ID NO: 11367 - RNA, 17 nt, Homo sapiens
uaauugcuuccauguuu

SEQ ID NO: 11368 - RNA, 22 nt, Homo sapiens
caaaguuuaagauccuugaagu

SEQ ID NO: 11369 - RNA, 22 nt, Homo sapiens
gucccucuccaaaugugucuug

SEQ ID NO: 11370 - RNA, 21 nt, Homo sapiens
ccuggaaacacugagguugug

SEQ ID NO: 11371 - RNA, 22 nt, Homo sapiens
agaaggaaauugaauucauuua

SEQ ID NO: 11372 - RNA, 18 nt, Homo sapiens
uugagaaggaggcugcug

SEQ ID NO: 11373 - RNA, 21 nt, Homo sapiens
cggcggggacggcgauugguc

SEQ ID NO: 11374 - RNA, 23 nt, Homo sapiens
ugagcgccucgacgacagagccg

SEQ ID NO: 11375 - RNA, 23 nt, Homo sapiens
ucccccaggugugauucugauuu

SEQ ID NO: 11376 - RNA, 21 nt, Homo sapiens
gaaggcgcuucccuuuggagu

SEQ ID NO: 11377 - RNA, 22 nt, Homo sapiens
gaaggcgcuucccuuuagagcg

SEQ ID NO: 11378 - RNA, 19 nt, Homo sapiens
gggcgccugugaucccaac

SEQ ID NO: 11379 - RNA, 19 nt, Homo sapiens
gagccaguuggacaggagc

SEQ ID NO: 11380 - RNA, 25 nt, Homo sapiens
ggcggagggaaguagguccguuggu

SEQ ID NO: 11381 - RNA, 24 nt, Homo sapiens
ugccugggucucuggccugcgcgu

SEQ ID NO: 11382 - RNA, 22 nt, Homo sapiens
aggcggggcgccgcgggaccgc

SEQ ID NO: 11383 - RNA, 22 nt, Homo sapiens
ugcggggcuagggcuaacagca

SEQ ID NO: 11384 - RNA, 21 nt, Homo sapiens
uggaggagaaggaaggugaug

SEQ ID NO: 11385 - RNA, 20 nt, Homo sapiens
ugagcccuguccucccgcag

SEQ ID NO: 11386 - RNA, 22 nt, Homo sapiens
uggguggucuggagauuugugc

SEQ ID NO: 11387 - RNA, 22 nt, Homo sapiens
aaaaccgucuaguuacaguugu

SEQ ID NO: 11388 - RNA, 21 nt, Homo sapiens
cucccacaugcaggguuugca

SEQ ID NO: 11389 - RNA, 22 nt, Homo sapiens
uucaccaccuucuccacccagc

SEQ ID NO: 11390 - RNA, 21 nt, Homo sapiens
ccaccaccgugucugacacuu

SEQ ID NO: 11391 - RNA, 21 nt, Homo sapiens
agggcccccccucaauccugu

SEQ ID NO: 11392 - RNA, 22 nt, Homo sapiens
uuauaauacaaccugauaagug

SEQ ID NO: 11393 - RNA, 22 nt, Homo sapiens
aaaccguuaccauuacugaguu

SEQ ID NO: 11394 - RNA, 25 nt, Homo sapiens
aggggugguguugggacagcuccgu

SEQ ID NO: 11395 - RNA, 22 nt, Homo sapiens
cuugguucagggagggucccca

SEQ ID NO: 11396 - RNA, 20 nt, Homo sapiens
ggggagcuguggaagcagua

SEQ ID NO: 11397 - RNA, 23 nt, Homo sapiens
aaaagugcuuacagugcagguag

SEQ ID NO: 11398 - RNA, 21 nt, Homo sapiens
uaaagugcugacagugcagau

SEQ ID NO: 11399 - RNA, 19 nt, Homo sapiens
gugaggacucgggaggugg

SEQ ID NO: 11400 - RNA, 22 nt, Homo sapiens
agaaggaaauugaauucauuua

SEQ ID NO: 11401 - RNA, 18 nt, Homo sapiens
aucccaccucugccacca

SEQ ID NO: 11402 - RNA, 22 nt, Homo sapiens
cuuggcaccuagcaagcacuca

SEQ ID NO: 11403 - RNA, 18 nt, Homo sapiens
acguuggcucugguggug

SEQ ID NO: 11404 - RNA, 23 nt, Homo sapiens
caaagugcuuacagugcagguag

SEQ ID NO: 11405 - RNA, 18 nt, Homo sapiens
ugaggcaguagauugaau

SEQ ID NO: 11406 - RNA, 23 nt, Homo sapiens
uaaagugcuuauagugcagguag

SEQ ID NO: 11407 - RNA, 23 nt, Homo sapiens
caaagugcucauagugcagguag

SEQ ID NO: 11408 - RNA, 22 nt, Homo sapiens
aagcugccaguugaagaacugu

SEQ ID NO: 11409 - RNA, 21 nt, Homo sapiens
gccccugggccuauccuagaa

SEQ ID NO: 11410 - RNA, 22 nt, Homo sapiens
uggcagugucuuagcugguugu

SEQ ID NO: 11411 - RNA, 22 nt, Homo sapiens
caaucacuaacuccacugccau

SEQ ID NO: 11412 - RNA, 23 nt, Homo sapiens
aggcaguguaguuagcugauugc

SEQ ID NO: 11413 - RNA, 23 nt, Homo sapiens
ucccccaggugugauucugauuu

SEQ ID NO: 11414 - RNA, 22 nt, Homo sapiens
uggcaguguauuguuagcuggu

SEQ ID NO: 11415 - RNA, 22 nt, Homo sapiens
aggcaguguauuguuagcuggc

SEQ ID NO: 11416 - RNA, 23 nt, Homo sapiens
aggaccugcgggacaagauucuu

SEQ ID NO: 11417 - RNA, 22 nt, Homo sapiens
caaagugccucccuuuagagug

SEQ ID NO: 11418 - RNA, 23 nt, Homo sapiens
cucuugagggaagcacuuucugu

SEQ ID NO: 11419 - RNA, 19 nt, Homo sapiens
ugagcugcuguaccaaaau

SEQ ID NO: 11420 - RNA, 25 nt, Homo sapiens
aggggugguguugggacagcuccgu

SEQ ID NO: 11421 - RNA, 21 nt, Homo sapiens
agaccuggcccagaccucagc

SEQ ID NO: 11422 - RNA, 24 nt, Homo sapiens
acugggggcuuucgggcucugcgu

SEQ ID NO: 11423 - RNA, 20 nt, Homo sapiens
ggggagcuguggaagcagua

SEQ ID NO: 11424 - RNA, 23 nt, Homo sapiens
caaagugcuguucgugcagguag

SEQ ID NO: 11425 - RNA, 23 nt, Homo sapiens
uuuggcacuagcacauuuuugcu

SEQ ID NO: 11426 - RNA, 21 nt, Homo sapiens
cccggagccaggaugcagcuc

SEQ ID NO: 11427 - RNA, 22 nt, Homo sapiens
agaaggaaauugaauucauuua

SEQ ID NO: 11428 - RNA, 19 nt, Homo sapiens
gagccaguuggacaggagc

SEQ ID NO: 11429 - RNA, 22 nt, Homo sapiens
cacuggcuccuuucuggguaga

SEQ ID NO: 11430 - RNA, 22 nt, Homo sapiens
ucuucucuguuuuggccaugug

SEQ ID NO: 11431 - RNA, 22 nt, Homo sapiens
uggagugugacaaugguguuug

SEQ ID NO: 11432 - RNA, 23 nt, Homo sapiens
guccaguuuucccaggaaucccu

SEQ ID NO: 11433 - RNA, 22 nt, Homo sapiens
cauugcacuugucucggucuga

SEQ ID NO: 11434 - RNA, 23 nt, Homo sapiens
ugagcgccucgacgacagagccg

SEQ ID NO: 11435 - RNA, 22 nt, Homo sapiens
gaaagcgcuucccuuugcugga

SEQ ID NO: 11436 - RNA, 22 nt, Homo sapiens
caaagcgcuccccuuuagaggu

SEQ ID NO: 11437 - RNA, 23 nt, Homo sapiens
caaagcgcuucucuuuagagugu

SEQ ID NO: 11438 - RNA, 21 nt, Homo sapiens
caaagcgcuucccuuuggagc

SEQ ID NO: 11439 - RNA, 21 nt, Homo sapiens
gaaagcgcuucucuuuagagg

SEQ ID NO: 11440 - RNA, 21 nt, Homo sapiens
acagucugcugagguuggagc

SEQ ID NO: 11441 - RNA, 25 nt, Homo sapiens
ggcggagggaaguagguccguuggu

SEQ ID NO: 11442 - RNA, 21 nt, Homo sapiens
uggaggagaaggaaggugaug

SEQ ID NO: 11443 - RNA, 20 nt, Homo sapiens
ggggagcuguggaagcagua

SEQ ID NO: 11444 - RNA, 21 nt, Homo sapiens
ucgaggagcucacagucuagu

SEQ ID NO: 11445 - RNA, 21 nt, Homo sapiens
cggcggggacggcgauugguc

SEQ ID NO: 11446 - RNA, 21 nt, Homo sapiens
gccccugggccuauccuagaa

SEQ ID NO: 11447 - RNA, 22 nt, Homo sapiens
uauguaauaugguccacaucuu

SEQ ID NO: 11448 - RNA, 23 nt, Homo sapiens
gaacgcgcuucccuauagagggu

SEQ ID NO: 11449 - RNA, 22 nt, Homo sapiens
aggcggggcgccgcgggaccgc

SEQ ID NO: 11450 - RNA, 22 nt, Homo sapiens
ugcggggcuagggcuaacagca

SEQ ID NO: 11451 - RNA, 22 nt, Homo sapiens
ucggccugaccacccaccccac

SEQ ID NO: 11452 - RNA, 21 nt, Homo sapiens
uccuucugcuccgucccccag

SEQ ID NO: 11453 - RNA, 22 nt, Homo sapiens
uucccuuugucauccuaugccu

SEQ ID NO: 11454 - RNA, 22 nt, Homo sapiens
uucccuuugucauccuucgccu

SEQ ID NO: 11455 - RNA, 21 nt, Homo sapiens
aggggugcuaucugugauuga

SEQ ID NO: 11456 - RNA, 20 nt, Homo sapiens
auuccuagaaauuguucaua

SEQ ID NO: 11457 - RNA, 22 nt, Homo sapiens
uagcaaaaacugcaguuacuuu

SEQ ID NO: 11458 - RNA, 21 nt, Homo sapiens
gcuaguccugacucagccagu

SEQ ID NO: 11459 - RNA, 23 nt, Homo sapiens
uggugcggagagggcccacagug

SEQ ID NO: 11460 - RNA, 22 nt, Homo sapiens
auccgcgcucugacucucugcc

SEQ ID NO: 11461 - RNA, 22 nt, Homo sapiens
aacccguagauccgaucuugug

SEQ ID NO: 11462 - RNA, 22 nt, Homo sapiens
cacccguagaaccgaccuugcg

SEQ ID NO: 11463 - RNA, 21 nt, Homo sapiens
ccgucgccgccacccgagccg

SEQ ID NO: 11464 - RNA, 22 nt, Homo sapiens
cagugcaaugaugaaagggcau

SEQ ID NO: 11465 - RNA, 21 nt, Homo sapiens
uccugcgcgucccagaugccc

SEQ ID NO: 11466 - RNA, 18 nt, Homo sapiens
ugaggcaguagauugaau

SEQ ID NO: 11467 - RNA, 22 nt, Homo sapiens
gaggguuggguggaggcucucc

SEQ ID NO: 11468 - RNA, 21 nt, Homo sapiens
caaagaggaaggucccauuac

SEQ ID NO: 11469 - RNA, 17 nt, Homo sapiens
ucucgcuggggccucca

SEQ ID NO: 11470 - RNA, 22 nt, Homo sapiens
ccucuuccccuugucucuccag

SEQ ID NO: 11471 - RNA, 17 nt, Homo sapiens
ucgccuccuccucuccc

SEQ ID NO: 11472 - RNA, 21 nt, Homo sapiens
cggcggggacggcgauugguc

SEQ ID NO: 11473 - RNA, 22 nt, Homo sapiens
cgcaggggccgggugcucaccg

SEQ ID NO: 11474 - RNA, 22 nt, Homo sapiens
uguaaacauccuacacucagcu

SEQ ID NO: 11475 - RNA, 22 nt, Homo sapiens
uaaugccccuaaaaauccuuau

SEQ ID NO: 11476 - RNA, 24 nt, Homo sapiens
uucuccaaaagaaagcacuuucug

SEQ ID NO: 11477 - RNA, 22 nt, Homo sapiens
gaaagcgcuucccuuugcugga

SEQ ID NO: 11478 - RNA, 22 nt, Homo sapiens
caaagcgcuccccuuuagaggu

SEQ ID NO: 11479 - RNA, 23 nt, Homo sapiens
caaagcgcuucucuuuagagugu

SEQ ID NO: 11480 - RNA, 21 nt, Homo sapiens
caaagcgcuucccuuuggagc

SEQ ID NO: 11481 - RNA, 21 nt, Homo sapiens
aaagcgcuucccuucagagug

SEQ ID NO: 11482 - RNA, 21 nt, Homo sapiens
gaaagcgcuucucuuuagagg

SEQ ID NO: 11483 - RNA, 22 nt, Homo sapiens
aagugccuccuuuuagaguguu

SEQ ID NO: 11484 - RNA, 19 nt, Homo sapiens
gggcgccugugaucccaac

SEQ ID NO: 11485 - RNA, 22 nt, Homo sapiens
aggcggggcgccgcgggaccgc

SEQ ID NO: 11486 - RNA, 21 nt, Homo sapiens
uggaggagaaggaaggugaug

SEQ ID NO: 11487 - RNA, 20 nt, Homo sapiens
guagaggagauggcgcaggg

SEQ ID NO: 11488 - RNA, 21 nt, Homo sapiens
ccccaccuccucucuccucag

SEQ ID NO: 11489 - RNA, 18 nt, Homo sapiens
uugagaaggaggcugcug

SEQ ID NO: 11490 - RNA, 22 nt, Homo sapiens
uaacacugucugguaaagaugg

SEQ ID NO: 11491 - RNA, 22 nt, Homo sapiens
uaacacugucugguaacgaugu

SEQ ID NO: 11492 - RNA, 20 nt, Homo sapiens
uguuuugauaacaguaaugu

SEQ ID NO: 11493 - RNA, 22 nt, Homo sapiens
acacagggcuguugugaagacu

SEQ ID NO: 11494 - RNA, 23 nt, Homo sapiens
gaagugcuucgauuuuggggugu

SEQ ID NO: 11495 - RNA, 18 nt, Homo sapiens
uucacagggaggugucau

SEQ ID NO: 11496 - RNA, 22 nt, Homo sapiens
uggugggcacagaaucuggacu

SEQ ID NO: 11497 - RNA, 22 nt, Homo sapiens
agucauuggaggguuugagcag

SEQ ID NO: 11498 - RNA, 22 nt, Homo sapiens
uggugggccgcagaacaugugc

SEQ ID NO: 11499 - RNA, 21 nt, Homo sapiens
ccuggaaacacugagguugug

SEQ ID NO: 11500 - RNA, 19 nt, Homo sapiens
uggauuuuuggaucaggga

SEQ ID NO: 11501 - RNA, 18 nt, Homo sapiens
cagggaggugaaugugau

SEQ ID NO: 11502 - RNA, 23 nt, Homo sapiens
ucuggcuccgugucuucacuccc

SEQ ID NO: 11503 - RNA, 18 nt, Homo sapiens
ugaggcaguagauugaau

SEQ ID NO: 11504 - RNA, 22 nt, Homo sapiens
caaagaauucuccuuuugggcu

SEQ ID NO: 11505 - RNA, 23 nt, Homo sapiens
gcaaagcacacggccugcagaga

SEQ ID NO: 11506 - RNA, 21 nt, Homo sapiens
acuggacuuggagucagaagg

SEQ ID NO: 11507 - RNA, 22 nt, Homo sapiens
caaaaaucucaauuacuuuugc

SEQ ID NO: 11508 - RNA, 19 nt, Homo sapiens
ugucucugcugggguuucu

SEQ ID NO: 11509 - RNA, 25 nt, Homo sapiens
aggggugguguugggacagcuccgu

SEQ ID NO: 11510 - RNA, 23 nt, Homo sapiens
aucccuugcaggggcuguugggu

SEQ ID NO: 11511 - RNA, 22 nt, Homo sapiens
ugagaccucuggguucugagcu

SEQ ID NO: 11512 - RNA, 20 nt, Homo sapiens
ggggagcuguggaagcagua

SEQ ID NO: 11513 - RNA, 23 nt, Homo sapiens
gagggucuugggagggaugugac

SEQ ID NO: 11514 - RNA, 22 nt, Homo sapiens
augggugaauuuguagaaggau

SEQ ID NO: 11515 - RNA, 22 nt, Homo sapiens
caggauguggucaaguguuguu

SEQ ID NO: 11516 - RNA, 24 nt, Homo sapiens
uggcccugacugaagaccagcagu

SEQ ID NO: 11517 - RNA, 24 nt, Homo sapiens
uggcccugacugaagaccagcagu

SEQ ID NO: 11518 - RNA, 23 nt, Homo sapiens
ucuggcuccgugucuucacuccc

SEQ ID NO: 11519 - RNA, 23 nt, Homo sapiens
uaaggugcaucuagugcagauag

SEQ ID NO: 11520 - RNA, 20 nt, Homo sapiens
ccccagggcgacgcggcggg

SEQ ID NO: 11521 - RNA, 25 nt, Homo sapiens
cccccacaaccgcgcuugacuagcu

SEQ ID NO: 11522 - RNA, 21 nt, Homo sapiens
uaaagugcugacagugcagau

SEQ ID NO: 11523 - RNA, 23 nt, Homo sapiens
cagugcaaugauauugucaaagc

SEQ ID NO: 11524 - RNA, 22 nt, Homo sapiens
agacccuggucugcacucuauc

SEQ ID NO: 11525 - RNA, 19 nt, Homo sapiens
agcugucugaaaaugucuu

SEQ ID NO: 11526 - RNA, 22 nt, Homo sapiens
augcugacauauuuacuagagg

SEQ ID NO: 11527 - RNA, 23 nt, Homo sapiens
gcagcagagaauaggacuacguc

SEQ ID NO: 11528 - RNA, 22 nt, Homo sapiens
ugugcgcagggagaccucuccc

SEQ ID NO: 11529 - RNA, 22 nt, Homo sapiens
ugcccuuaaaggugaacccagu

SEQ ID NO: 11530 - RNA, 21 nt, Homo sapiens
aaggcagggcccccgcucccc

SEQ ID NO: 11531 - RNA, 22 nt, Homo sapiens
cugaagcucagagggcucugau

SEQ ID NO: 11532 - RNA, 22 nt, Homo sapiens
uggagagaaaggcaguuccuga

SEQ ID NO: 11533 - RNA, 21 nt, Homo sapiens
cggcggggacggcgauugguc

SEQ ID NO: 11534 - RNA, 22 nt, Homo sapiens
uucccuuugucauccuaugccu

SEQ ID NO: 11535 - RNA, 22 nt, Homo sapiens
uucccuuugucauccuucgccu

SEQ ID NO: 11536 - RNA, 22 nt, Homo sapiens
uuauaaagcaaugagacugauu

SEQ ID NO: 11537 - RNA, 23 nt, Homo sapiens
uagcagcgggaacaguucugcag

SEQ ID NO: 11538 - RNA, 23 nt, Homo sapiens
aucgcugcgguugcgagcgcugu

SEQ ID NO: 11539 - RNA, 19 nt, Homo sapiens
aguguggcuuucuuagagc

SEQ ID NO: 11540 - RNA, 25 nt, Homo sapiens
ggcggagggaaguagguccguuggu

SEQ ID NO: 11541 - RNA, 22 nt, Homo sapiens
aggcggggcgccgcgggaccgc

SEQ ID NO: 11542 - RNA, 17 nt, Homo sapiens
ucucgcuggggccucca

SEQ ID NO: 11543 - RNA, 20 nt, Homo sapiens
agagucuugugaugucuugc

SEQ ID NO: 11544 - RNA, 22 nt, Homo sapiens
auccgcgcucugacucucugcc

SEQ ID NO: 11545 - RNA, 18 nt, Homo sapiens
cgggcguggugguggggg

SEQ ID NO: 11546 - RNA, 19 nt, Homo sapiens
uggauuuuuggaucaggga

SEQ ID NO: 11547 - RNA, 21 nt, Homo sapiens
cuuuuugcggucugggcuugc

SEQ ID NO: 11548 - RNA, 22 nt, Homo sapiens
acucggcguggcgucggucgug

SEQ ID NO: 11549 - RNA, 22 nt, Homo sapiens
ggagacgcggcccuguuggagu

SEQ ID NO: 11550 - RNA, 22 nt, Homo sapiens
aagcugccaguugaagaacugu

SEQ ID NO: 11551 - RNA, 21 nt, Homo sapiens
uucaaguaauucaggauaggu

SEQ ID NO: 11552 - RNA, 22 nt, Homo sapiens
uguaaacauccuacacucagcu

SEQ ID NO: 11553 - RNA, 22 nt, Homo sapiens
caaaaaucucaauuacuuuugc

SEQ ID NO: 11554 - RNA, 21 nt, Homo sapiens
uggguuuacguugggagaacu

SEQ ID NO: 11555 - RNA, 19 nt, Homo sapiens
aagcagcugccucugaggc

SEQ ID NO: 11556 - RNA, 22 nt, Homo sapiens
ucagugcacuacagaacuuugu

SEQ ID NO: 11557 - RNA, 22 nt, Homo sapiens
ucagugcaucacagaacuuugu

SEQ ID NO: 11558 - RNA, 21 nt, Homo sapiens
ucagugcaugacagaacuugg

SEQ ID NO: 11559 - RNA, 21 nt, Homo sapiens
agcuacaucuggcuacugggu

SEQ ID NO: 11560 - RNA, 23 nt, Homo sapiens
agcuacauugucugcuggguuuc

SEQ ID NO: 11561 - RNA, 23 nt, Homo sapiens
ugauuguagccuuuuggaguaga

SEQ ID NO: 11562 - RNA, 22 nt, Homo sapiens
agucauuggaggguuugagcag

SEQ ID NO: 11563 - RNA, 17 nt, Homo sapiens
ucccaccgcugccaccc

SEQ ID NO: 11564 - RNA, 21 nt, Homo sapiens
cuuuuugcggucugggcuugc

SEQ ID NO: 11565 - RNA, 22 nt, Homo sapiens
ugugacugguugaccagagggg

SEQ ID NO: 11566 - RNA, 21 nt, Homo sapiens
cggcggggacggcgauugguc

SEQ ID NO: 11567 - RNA, 21 nt, Homo sapiens
aucacauugccagggauuucc

SEQ ID NO: 11568 - RNA, 21 nt, Homo sapiens
aucacauugccagggauuacc

SEQ ID NO: 11569 - RNA, 20 nt, Homo sapiens
ccucugggcccuuccuccag

SEQ ID NO: 11570 - RNA, 22 nt, Homo sapiens
ucucugggccugugucuuaggc

SEQ ID NO: 11571 - RNA, 22 nt, Homo sapiens
aguggggaacccuuccaugagg

SEQ ID NO: 11572 - RNA, 22 nt, Homo sapiens
caaaaaccacaguuucuuuugc

SEQ ID NO: 11573 - RNA, 22 nt, Homo sapiens
gucccucuccaaaugugucuug

SEQ ID NO: 11574 - RNA, 21 nt, Homo sapiens
ucccacguuguggcccagcag

SEQ ID NO: 11575 - RNA, 22 nt, Homo sapiens
aggcggggcgccgcgggaccgc

SEQ ID NO: 11576 - RNA, 22 nt, Homo sapiens
ugcggggcuagggcuaacagca

SEQ ID NO: 11577 - RNA, 20 nt, Homo sapiens
ggggagcuguggaagcagua

SEQ ID NO: 11578 - RNA, 22 nt, Homo sapiens
acucggcguggcgucggucgug

SEQ ID NO: 11579 - RNA, 23 nt, Homo sapiens
ugaguaccgccaugucuguuggg

SEQ ID NO: 11580 - RNA, 21 nt, Homo sapiens
ucacuccucuccucccgucuu

SEQ ID NO: 11581 - RNA, 22 nt, Homo sapiens
agaggcuggccgugaugaauuc

SEQ ID NO: 11582 - RNA, 19 nt, Homo sapiens
ugagcugcuguaccaaaau

SEQ ID NO: 11583 - RNA, 21 nt, Homo sapiens
agaccuggcccagaccucagc

SEQ ID NO: 11584 - RNA, 22 nt, Homo sapiens
aggcagcgggguguaguggaua

SEQ ID NO: 11585 - RNA, 24 nt, Homo sapiens
uggggagcugaggcucugggggug

SEQ ID NO: 11586 - RNA, 17 nt, Homo sapiens
ucgccuccuccucuccc

SEQ ID NO: 11587 - RNA, 23 nt, Homo sapiens
ucuggcuccgugucuucacuccc

SEQ ID NO: 11588 - RNA, 21 nt, Homo sapiens
ucgaggagcucacagucuagu

SEQ ID NO: 11589 - RNA, 21 nt, Homo sapiens
cggcggggacggcgauugguc

SEQ ID NO: 11590 - RNA, 22 nt, Homo sapiens
ucugcccccuccgcugcugcca

SEQ ID NO: 11591 - RNA, 21 nt, Homo sapiens
agggcccccccucaauccugu

SEQ ID NO: 11592 - RNA, 20 nt, Homo sapiens
acugccccaggugcugcugg

SEQ ID NO: 11593 - RNA, 21 nt, Homo sapiens
cggggcagcucaguacaggau

SEQ ID NO: 11594 - RNA, 19 nt, Homo sapiens
aggcacggugucagcaggc

SEQ ID NO: 11595 - RNA, 19 nt, Homo sapiens
gggcgccugugaucccaac

SEQ ID NO: 11596 - RNA, 23 nt, Homo sapiens
acuugggcacugaaacaaugucc

SEQ ID NO: 11597 - RNA, 22 nt, Homo sapiens
aggcggggcgccgcgggaccgc

SEQ ID NO: 11598 - RNA, 22 nt, Homo sapiens
ugcggggcuagggcuaacagca

SEQ ID NO: 11599 - RNA, 21 nt, Homo sapiens
aguuaggauuaggucguggaa

SEQ ID NO: 11600 - RNA, 22 nt, Homo sapiens
acucggcguggcgucggucgug

SEQ ID NO: 11601 - RNA, 22 nt, Homo sapiens
cagugcaaugaugaaagggcau

SEQ ID NO: 11602 - RNA, 23 nt, Homo sapiens
ucuggcuccgugucuucacuccc

SEQ ID NO: 11603 - RNA, 21 nt, Homo sapiens
cggcggggacggcgauugguc

SEQ ID NO: 11604 - RNA, 21 nt, Homo sapiens
ccaguccugugccugccgccu

SEQ ID NO: 11605 - RNA, 22 nt, Homo sapiens
uguaacagcaacuccaugugga

SEQ ID NO: 11606 - RNA, 22 nt, Homo sapiens
cucccacugcuucacuugacua

SEQ ID NO: 11607 - RNA, 22 nt, Homo sapiens
uguaaacauccuacacucagcu

SEQ ID NO: 11608 - RNA, 22 nt, Homo sapiens
uggcagugucuuagcugguugu

SEQ ID NO: 11609 - RNA, 23 nt, Homo sapiens
aggcaguguaguuagcugauugc

SEQ ID NO: 11610 - RNA, 22 nt, Homo sapiens
uggcaguguauuguuagcuggu

SEQ ID NO: 11611 - RNA, 22 nt, Homo sapiens
aggcaguguauuguuagcuggc

SEQ ID NO: 11612 - RNA, 22 nt, Homo sapiens
ccucccacacccaaggcuugca

SEQ ID NO: 11613 - RNA, 21 nt, Homo sapiens
caaagaggaaggucccauuac

SEQ ID NO: 11614 - RNA, 22 nt, Homo sapiens
ggggguccccggugcucggauc

SEQ ID NO: 11615 - RNA, 22 nt, Homo sapiens
aggcggggcgccgcgggaccgc

SEQ ID NO: 11616 - RNA, 23 nt, Homo sapiens
aaaagugcuuacagugcagguag

SEQ ID NO: 11617 - RNA, 21 nt, Homo sapiens
uaaagugcugacagugcagau

SEQ ID NO: 11618 - RNA, 22 nt, Homo sapiens
ugagaacugaauuccauggguu

SEQ ID NO: 11619 - RNA, 23 nt, Homo sapiens
caaagugcuuacagugcagguag

SEQ ID NO: 11620 - RNA, 21 nt, Homo sapiens
ccaguccugugccugccgccu

SEQ ID NO: 11621 - RNA, 23 nt, Homo sapiens
uaaagugcuuauagugcagguag

SEQ ID NO: 11622 - RNA, 23 nt, Homo sapiens
caaagugcucauagugcagguag

SEQ ID NO: 11623 - RNA, 21 nt, Homo sapiens
uucacaguggcuaaguuccgc

SEQ ID NO: 11624 - RNA, 21 nt, Homo sapiens
uucacaguggcuaaguucugc

SEQ ID NO: 11625 - RNA, 23 nt, Homo sapiens
uaagugcuuccauguuuugguga

SEQ ID NO: 11626 - RNA, 23 nt, Homo sapiens
uaagugcuuccauguuuuaguag

SEQ ID NO: 11627 - RNA, 23 nt, Homo sapiens
uaagugcuuccauguuucagugg

SEQ ID NO: 11628 - RNA, 23 nt, Homo sapiens
uaagugcuuccauguuugagugu

SEQ ID NO: 11629 - RNA, 17 nt, Homo sapiens
uaagugcuuccaugcuu

SEQ ID NO: 11630 - RNA, 23 nt, Homo sapiens
aaagugcugcgacauuugagcgu

SEQ ID NO: 11631 - RNA, 23 nt, Homo sapiens
gaagugcuucgauuuuggggugu

SEQ ID NO: 11632 - RNA, 22 nt, Homo sapiens
caaagugccucccuuuagagug

SEQ ID NO: 11633 - RNA, 22 nt, Homo sapiens
aaagugcuucccuuuggacugu

SEQ ID NO: 11634 - RNA, 21 nt, Homo sapiens
aaagugcuuccuuuuagaggg

SEQ ID NO: 11635 - RNA, 22 nt, Homo sapiens
aaagugcuuccuuuuagagggu

SEQ ID NO: 11636 - RNA, 22 nt, Homo sapiens
aaagugcuucucuuuggugggu

SEQ ID NO: 11637 - RNA, 21 nt, Homo sapiens
aaagugcuuccuuuuugaggg

SEQ ID NO: 11638 - RNA, 24 nt, Homo sapiens
acaaagugcuucccuuuagagugu

SEQ ID NO: 11639 - RNA, 22 nt, Homo sapiens
acaaagugcuucccuuuagagu

SEQ ID NO: 11640 - RNA, 23 nt, Homo sapiens
cucuugagggaagcacuuucugu

SEQ ID NO: 11641 - RNA, 22 nt, Homo sapiens
aaccagcaccccaacuuuggac

SEQ ID NO: 11642 - RNA, 23 nt, Homo sapiens
caaagugcuguucgugcagguag

SEQ ID NO: 11643 - RNA, 20 nt, Homo sapiens
ucugcaggguuugcuuugag

SEQ ID NO: 11644 - RNA, 23 nt, Homo sapiens
caaagugcuuacagugcagguag

SEQ ID NO: 11645 - RNA, 22 nt, Homo sapiens
ucugcccccuccgcugcugcca

SEQ ID NO: 11646 - RNA, 22 nt, Homo sapiens
uguaacagcaacuccaugugga

SEQ ID NO: 11647 - RNA, 20 nt, Homo sapiens
acugccccaggugcugcugg

SEQ ID NO: 11648 - RNA, 22 nt, Homo sapiens
aauugcacgguauccaucugua

SEQ ID NO: 11649 - RNA, 21 nt, Homo sapiens
ugucuugcaggccgucaugca

SEQ ID NO: 11650 - RNA, 21 nt, Homo sapiens
cggggcagcucaguacaggau

SEQ ID NO: 11651 - RNA, 22 nt, Homo sapiens
uacugcagacguggcaaucaug

SEQ ID NO: 11652 - RNA, 21 nt, Homo sapiens
uacugcagacaguggcaauca

SEQ ID NO: 11653 - RNA, 22 nt, Homo sapiens
gaaagcgcuucccuuugcugga

SEQ ID NO: 11654 - RNA, 22 nt, Homo sapiens
caaagcgcuccccuuuagaggu

SEQ ID NO: 11655 - RNA, 23 nt, Homo sapiens
caaagcgcuucucuuuagagugu

SEQ ID NO: 11656 - RNA, 21 nt, Homo sapiens
caaagcgcuucccuuuggagc

SEQ ID NO: 11657 - RNA, 21 nt, Homo sapiens
aaagcgcuucccuucagagug

SEQ ID NO: 11658 - RNA, 21 nt, Homo sapiens
gaaagcgcuucucuuuagagg

SEQ ID NO: 11659 - RNA, 25 nt, Homo sapiens
aggggugguguugggacagcuccgu

SEQ ID NO: 11660 - RNA, 20 nt, Homo sapiens
agaccauggguucucauugu

SEQ ID NO: 11661 - RNA, 22 nt, Homo sapiens
uggagugugacaaugguguuug

SEQ ID NO: 11662 - RNA, 22 nt, Homo sapiens
ugagccccugugccgcccccag

SEQ ID NO: 11663 - RNA, 23 nt, Homo sapiens
cuggagauauggaagagcugugu

SEQ ID NO: 11664 - RNA, 17 nt, Homo sapiens
ucgccuccuccucuccc

SEQ ID NO: 11665 - RNA, 23 nt, Homo sapiens
acuccauuuguuuugaugaugga

SEQ ID NO: 11666 - RNA, 22 nt, Homo sapiens
cgcaggggccgggugcucaccg

SEQ ID NO: 11667 - RNA, 22 nt, Homo sapiens
acagcaggcacagacaggcagu

SEQ ID NO: 11668 - RNA, 22 nt, Homo sapiens
uggcucaguucagcaggaacag

SEQ ID NO: 11669 - RNA, 22 nt, Homo sapiens
gccugcugggguggaaccuggu

SEQ ID NO: 11670 - RNA, 23 nt, Homo sapiens
ugaggggcagagagcgagacuuu

SEQ ID NO: 11671 - RNA, 22 nt, Homo sapiens
aguggggaacccuuccaugagg

SEQ ID NO: 11672 - RNA, 21 nt, Homo sapiens
auccuugcuaucugggugcua

SEQ ID NO: 11673 - RNA, 25 nt, Homo sapiens
aggggugguguugggacagcuccgu

SEQ ID NO: 11674 - RNA, 20 nt, Homo sapiens
auggagauagauauagaaau

SEQ ID NO: 11675 - RNA, 21 nt, Homo sapiens
uggaggagaaggaaggugaug

SEQ ID NO: 11676 - RNA, 21 nt, Homo sapiens
uacucaaaaagcugucaguca

SEQ ID NO: 11677 - RNA, 20 nt, Homo sapiens
ggggagcuguggaagcagua

SEQ ID NO: 11678 - RNA, 22 nt, Homo sapiens
ugugcgcagggagaccucuccc

SEQ ID NO: 11679 - RNA, 22 nt, Homo sapiens
uacguagauauauauguauuuu

SEQ ID NO: 11680 - RNA, 21 nt, Homo sapiens
gcccuccgcccgugcaccccg

SEQ ID NO: 11681 - RNA, 21 nt, Homo sapiens
uucaaguaauucaggauaggu

SEQ ID NO: 11682 - RNA, 23 nt, Homo sapiens
ugaggggcagagagcgagacuuu

SEQ ID NO: 11683 - RNA, 22 nt, Homo sapiens
ucagcaaacauuuauugugugc

SEQ ID NO: 11684 - RNA, 22 nt, Homo sapiens
uagcaaaaacugcaguuacuuu

SEQ ID NO: 11685 - RNA, 21 nt, Homo sapiens
aagccugcccggcuccucggg

SEQ ID NO: 11686 - RNA, 23 nt, Homo sapiens
gaacgccuguucuugccaggugg

SEQ ID NO: 11687 - RNA, 21 nt, Homo sapiens
uccgguucucagggcuccacc

SEQ ID NO: 11688 - RNA, 20 nt, Homo sapiens
ggggagcuguggaagcagua

SEQ ID NO: 11689 - RNA, 22 nt, Homo sapiens
acgcccuucccccccuucuuca

SEQ ID NO: 11690 - RNA, 21 nt, Homo sapiens
uccugcgcgucccagaugccc

SEQ ID NO: 11691 - RNA, 21 nt, Homo sapiens
ccacaccguaucugacacuuu

SEQ ID NO: 11692 - RNA, 23 nt, Homo sapiens
uaagugcuuccauguuuugguga

SEQ ID NO: 11693 - RNA, 22 nt, Homo sapiens
uauguaauaugguccacaucuu

SEQ ID NO: 11694 - RNA, 22 nt, Homo sapiens
aaacaaacauggugcacuucuu

SEQ ID NO: 11695 - RNA, 22 nt, Homo sapiens
cgucaacacuugcugguuuccu

SEQ ID NO: 11696 - RNA, 22 nt, Homo sapiens
ugauugguacgucuguggguag

SEQ ID NO: 11697 - RNA, 22 nt, Homo sapiens
caagaaccucaguugcuuuugu

SEQ ID NO: 11698 - RNA, 19 nt, Homo sapiens
agguugacauacguuuccc

SEQ ID NO: 11699 - RNA, 22 nt, Homo sapiens
ugcccuuaaaggugaacccagu

SEQ ID NO: 11700 - RNA, 22 nt, Homo sapiens
uggagugugacaaugguguuug

SEQ ID NO: 11701 - RNA, 17 nt, Homo sapiens
gugggggagaggcuguc

SEQ ID NO: 11702 - RNA, 18 nt, Homo sapiens
cagggaggugaaugugau

SEQ ID NO: 11703 - RNA, 23 nt, Homo sapiens
ucuggcuccgugucuucacuccc

SEQ ID NO: 11704 - RNA, 22 nt, Homo sapiens
uggagagaaaggcaguuccuga

SEQ ID NO: 11705 - RNA, 21 nt, Homo sapiens
cggcggggacggcgauugguc

SEQ ID NO: 11706 - RNA, 20 nt, Homo sapiens
ccuccugcccuccuugcugu

SEQ ID NO: 11707 - RNA, 22 nt, Homo sapiens
gaggguuggguggaggcucucc

SEQ ID NO: 11708 - RNA, 23 nt, Homo sapiens
ugucugcccgcaugccugccucu

SEQ ID NO: 11709 - RNA, 21 nt, Homo sapiens
ugguagacuauggaacguagg

SEQ ID NO: 11710 - RNA, 22 nt, Homo sapiens
agaggcuggccgugaugaauuc

SEQ ID NO: 11711 - RNA, 19 nt, Homo sapiens
agcugucugaaaaugucuu

SEQ ID NO: 11712 - RNA, 22 nt, Homo sapiens
aggcggggcgccgcgggaccgc

SEQ ID NO: 11713 - RNA, 22 nt, Homo sapiens
caaagugccucccuuuagagug

SEQ ID NO: 11714 - RNA, 21 nt, Homo sapiens
aaggcagggcccccgcucccc

SEQ ID NO: 11715 - RNA, 24 nt, Homo sapiens
uggggagcugaggcucugggggug

SEQ ID NO: 11716 - RNA, 23 nt, Homo sapiens
cacccggcugugugcacaugugc

SEQ ID NO: 11717 - RNA, 22 nt, Homo sapiens
ugagccccugugccgcccccag

SEQ ID NO: 11718 - RNA, 21 nt, Homo sapiens
cauaaaguagaaagcacuacu

SEQ ID NO: 11719 - RNA, 23 nt, Homo sapiens
ucuggcuccgugucuucacuccc

SEQ ID NO: 11720 - RNA, 22 nt, Homo sapiens
ucugcccccuccgcugcugcca

SEQ ID NO: 11721 - RNA, 25 nt, Homo sapiens
cccccacaaccgcgcuugacuagcu

SEQ ID NO: 11722 - RNA, 22 nt, Homo sapiens
aagcugccaguugaagaacugu

SEQ ID NO: 11723 - RNA, 22 nt, Homo sapiens
uguaaacauccuacacucagcu

SEQ ID NO: 11724 - RNA, 20 nt, Homo sapiens
acugccccaggugcugcugg

SEQ ID NO: 11725 - RNA, 22 nt, Homo sapiens
aguggggaacccuuccaugagg

SEQ ID NO: 11726 - RNA, 22 nt, Homo sapiens
cgaaaacagcaauuaccuuugc

SEQ ID NO: 11727 - RNA, 21 nt, Homo sapiens
uggaggagaaggaaggugaug

SEQ ID NO: 11728 - RNA, 20 nt, Homo sapiens
ggggagcuguggaagcagua

SEQ ID NO: 11729 - RNA, 23 nt, Homo sapiens
uacccuguagaaccgaauuugug

SEQ ID NO: 11730 - RNA, 18 nt, Homo sapiens
ucagcuggcccucauuuc

SEQ ID NO: 11731 - RNA, 22 nt, Homo sapiens
ucaccagcccuguguucccuag

SEQ ID NO: 11732 - RNA, 17 nt, Homo sapiens
ucccaccgcugccaccc

SEQ ID NO: 11733 - RNA, 23 nt, Homo sapiens
agcugguguugugaaucaggccg

SEQ ID NO: 11734 - RNA, 21 nt, Homo sapiens
gcccuccgcccgugcaccccg

SEQ ID NO: 11735 - RNA, 22 nt, Homo sapiens
cgcaggggccgggugcucaccg

SEQ ID NO: 11736 - RNA, 23 nt, Homo sapiens
caacggaaucccaaaagcagcug

SEQ ID NO: 11737 - RNA, 22 nt, Homo sapiens
aagcugccaguugaagaacugu

SEQ ID NO: 11738 - RNA, 22 nt, Homo sapiens
cauugcacuugucucggucuga

SEQ ID NO: 11739 - RNA, 23 nt, Homo sapiens
gcgaggaccccucggggucugac

SEQ ID NO: 11740 - RNA, 22 nt, Homo sapiens
ggggguccccggugcucggauc

SEQ ID NO: 11741 - RNA, 21 nt, Homo sapiens
guggcugcacucacuuccuuc

SEQ ID NO: 11742 - RNA, 25 nt, Homo sapiens
ggcggagggaaguagguccguuggu

SEQ ID NO: 11743 - RNA, 20 nt, Homo sapiens
accaggaggcugaggccccu

SEQ ID NO: 11744 - RNA, 22 nt, Homo sapiens
ugcggggcuagggcuaacagca

SEQ ID NO: 11745 - RNA, 21 nt, Homo sapiens
gcccuccgcccgugcaccccg

SEQ ID NO: 11746 - RNA, 22 nt, Homo sapiens
ucucccaacccuuguaccagug

SEQ ID NO: 11747 - RNA, 22 nt, Homo sapiens
cucuagagggaagcacuuucug

SEQ ID NO: 11748 - RNA, 22 nt, Homo sapiens
uuggggaaacggccgcugagug

SEQ ID NO: 11749 - RNA, 22 nt, Homo sapiens
cauugcacuugucucggucuga

SEQ ID NO: 11750 - RNA, 22 nt, Homo sapiens
uguaaacauccuacacucagcu

SEQ ID NO: 11751 - RNA, 22 nt, Homo sapiens
aauugcacgguauccaucugua

SEQ ID NO: 11752 - RNA, 23 nt, Homo sapiens
ucuuggaguaggucauugggugg

SEQ ID NO: 11753 - RNA, 19 nt, Homo sapiens
aggcacggugucagcaggc

SEQ ID NO: 11754 - RNA, 21 nt, Homo sapiens
aagccugcccggcuccucggg

SEQ ID NO: 11755 - RNA, 25 nt, Homo sapiens
ggcggagggaaguagguccguuggu

SEQ ID NO: 11756 - RNA, 20 nt, Homo sapiens
cggcucugggucugugggga

SEQ ID NO: 11757 - RNA, 21 nt, Homo sapiens
ccgucgccgccacccgagccg

SEQ ID NO: 11758 - RNA, 21 nt, Homo sapiens
uggcagggaggcugggagggg

SEQ ID NO: 11759 - RNA, 22 nt, Homo sapiens
cucggcgcggggcgcgggcucc

SEQ ID NO: 11760 - RNA, 21 nt, Homo sapiens
uccugcgcgucccagaugccc

SEQ ID NO: 11761 - RNA, 22 nt, Homo sapiens
uggagagaaaggcaguuccuga

SEQ ID NO: 11762 - RNA, 22 nt, Homo sapiens
cgcaggggccgggugcucaccg

SEQ ID NO: 11763 - RNA, 19 nt, Homo sapiens
ugagcugcuguaccaaaau

SEQ ID NO: 11764 - RNA, 22 nt, Homo sapiens
uccgagccugggucucccucuu

SEQ ID NO: 11765 - RNA, 22 nt, Homo sapiens
ugcggggcuagggcuaacagca

SEQ ID NO: 11766 - RNA, 21 nt, Homo sapiens
ucacagugaaccggucucuuu

SEQ ID NO: 11767 - RNA, 22 nt, Homo sapiens
acucggcguggcgucggucgug

SEQ ID NO: 11768 - RNA, 22 nt, Homo sapiens
ugugacugguugaccagagggg

SEQ ID NO: 11769 - RNA, 23 nt, Homo sapiens
ugugcaaaucuaugcaaaacuga

SEQ ID NO: 11770 - RNA, 22 nt, Homo sapiens
aacaauauccuggugcugagug

SEQ ID NO: 11771 - RNA, 22 nt, Homo sapiens
agagguaguagguugcauaguu

SEQ ID NO: 11772 - RNA, 23 nt, Homo sapiens
agugccugagggaguaagagccc

SEQ ID NO: 11773 - RNA, 23 nt, Homo sapiens
ugucacucggcucggcccacuac

SEQ ID NO: 11774 - RNA, 23 nt, Homo sapiens
caguaacaaagauucauccuugu

SEQ ID NO: 11775 - RNA, 20 nt, Homo sapiens
ugagcccuguccucccgcag

SEQ ID NO: 11776 - RNA, 22 nt, Homo sapiens
ucggccugaccacccaccccac

SEQ ID NO: 11777 - RNA, 20 nt, Homo sapiens
cuuccucgucugucugcccc

SEQ ID NO: 11778 - RNA, 22 nt, Homo sapiens
acucggcguggcgucggucgug

SEQ ID NO: 11779 - RNA, 22 nt, Homo sapiens
acucggcguggcgucggucgug

SEQ ID NO: 11780 - RNA, 21 nt, Homo sapiens
gcccuccgcccgugcaccccg

SEQ ID NO: 11781 - RNA, 22 nt, Homo sapiens
cauugcacuugucucggucuga

SEQ ID NO: 11782 - RNA, 19 nt, Homo sapiens
aggcacggugucagcaggc

SEQ ID NO: 11783 - RNA, 22 nt, Homo sapiens
uccgagccugggucucccucuu

SEQ ID NO: 11784 - RNA, 22 nt, Homo sapiens
agacuucccauuugaagguggc

SEQ ID NO: 11785 - RNA, 25 nt, Homo sapiens
ggcggagggaaguagguccguuggu

SEQ ID NO: 11786 - RNA, 22 nt, Homo sapiens
cugcccuggcccgagggaccga

SEQ ID NO: 11787 - RNA, 18 nt, Homo sapiens
ucagcuggcccucauuuc

SEQ ID NO: 11788 - RNA, 21 nt, Homo sapiens
uaccacaggguagaaccacgg

SEQ ID NO: 11789 - RNA, 21 nt, Homo sapiens
cggcggggacggcgauugguc

SEQ ID NO: 11790 - RNA, 23 nt, Homo sapiens
ugaguaccgccaugucuguuggg

SEQ ID NO: 11791 - RNA, 22 nt, Homo sapiens
uggcucaguucagcaggaacag

SEQ ID NO: 11792 - RNA, 18 nt, Homo sapiens
ugcuuccuuucagagggu

SEQ ID NO: 11793 - RNA, 22 nt, Homo sapiens
aucuggagguaagaagcacuuu

SEQ ID NO: 11794 - RNA, 22 nt, Homo sapiens
aggcggggcgccgcgggaccgc

SEQ ID NO: 11795 - RNA, 22 nt, Homo sapiens
ugcggggcuagggcuaacagca

SEQ ID NO: 11796 - RNA, 22 nt, Homo sapiens
ucggccugaccacccaccccac

SEQ ID NO: 11797 - RNA, 23 nt, Homo sapiens
ucuggcuccgugucuucacuccc

SEQ ID NO: 11798 - RNA, 22 nt, Homo sapiens
ucucccaacccuuguaccagug

SEQ ID NO: 11799 - RNA, 21 nt, Homo sapiens
ucgaggagcucacagucuagu

SEQ ID NO: 11800 - RNA, 21 nt, Homo sapiens
cggcggggacggcgauugguc

SEQ ID NO: 11801 - RNA, 22 nt, Homo sapiens
uguaaacauccuacacucagcu

SEQ ID NO: 11802 - RNA, 23 nt, Homo sapiens
ucccccaggugugauucugauuu

SEQ ID NO: 11803 - RNA, 23 nt, Homo sapiens
gaacgcgcuucccuauagagggu

SEQ ID NO: 11804 - RNA, 25 nt, Homo sapiens
aggggugguguugggacagcuccgu

SEQ ID NO: 11805 - RNA, 21 nt, Homo sapiens
agggggaaaguucuauagucc

SEQ ID NO: 11806 - RNA, 24 nt, Homo sapiens
acugggggcuuucgggcucugcgu

SEQ ID NO: 11807 - RNA, 24 nt, Homo sapiens
ugccugggucucuggccugcgcgu

SEQ ID NO: 11808 - RNA, 22 nt, Homo sapiens
aggcggggcgccgcgggaccgc

SEQ ID NO: 11809 - RNA, 22 nt, Homo sapiens
caaagugccucccuuuagagug

SEQ ID NO: 11810 - RNA, 22 nt, Homo sapiens
uggagugugacaaugguguuug

SEQ ID NO: 11811 - RNA, 22 nt, Homo sapiens
ucucccaacccuuguaccagug

SEQ ID NO: 11812 - RNA, 22 nt, Homo sapiens
cucuagagggaagcacuuucug

SEQ ID NO: 11813 - RNA, 18 nt, Homo sapiens
uccagugcccuccucucc

SEQ ID NO: 11814 - RNA, 20 nt, Homo sapiens
ccuccugcccuccuugcugu

SEQ ID NO: 11815 - RNA, 22 nt, Homo sapiens
gaggguuggguggaggcucucc

SEQ ID NO: 11816 - RNA, 22 nt, Homo sapiens
uguaaacauccuacacucagcu

SEQ ID NO: 11817 - RNA, 23 nt, Homo sapiens
gcaaagcacacggccugcagaga

SEQ ID NO: 11818 - RNA, 22 nt, Homo sapiens
cgucaacacuugcugguuuccu

SEQ ID NO: 11819 - RNA, 22 nt, Homo sapiens
aagugcuuccuuuuagaggguu

SEQ ID NO: 11820 - RNA, 20 nt, Homo sapiens
aggguguuucucucaucucu

SEQ ID NO: 11821 - RNA, 21 nt, Homo sapiens
uggaggagaaggaaggugaug

SEQ ID NO: 11822 - RNA, 21 nt, Homo sapiens
cgcgggugcuuacugacccuu

SEQ ID NO: 11823 - RNA, 22 nt, Homo sapiens
caaagugccucccuuuagagug

SEQ ID NO: 11824 - RNA, 21 nt, Homo sapiens
aaggcagggcccccgcucccc

SEQ ID NO: 11825 - RNA, 23 nt, Homo sapiens
uacccuguagauccgaauuugug

SEQ ID NO: 11826 - RNA, 23 nt, Homo sapiens
uacccuguagaaccgaauuugug

SEQ ID NO: 11827 - RNA, 17 nt, Homo sapiens
ucccuguucgggcgcca

SEQ ID NO: 11828 - RNA, 23 nt, Homo sapiens
ucuggcuccgugucuucacuccc

SEQ ID NO: 11829 - RNA, 23 nt, Homo sapiens
uaaggugcaucuagugcagauag

SEQ ID NO: 11830 - RNA, 22 nt, Homo sapiens
acagcaggcacagacaggcagu

SEQ ID NO: 11831 - RNA, 22 nt, Homo sapiens
uaaugccccuaaaaauccuuau

SEQ ID NO: 11832 - RNA, 23 nt, Homo sapiens
aaugacacgaucacucccguuga

SEQ ID NO: 11833 - RNA, 22 nt, Homo sapiens
aguggggaacccuuccaugagg

SEQ ID NO: 11834 - RNA, 22 nt, Homo sapiens
agacccuggucugcacucuauc

SEQ ID NO: 11835 - RNA, 22 nt, Homo sapiens
aucuggagguaagaagcacuuu

SEQ ID NO: 11836 - RNA, 21 nt, Homo sapiens
guggcugcacucacuuccuuc

SEQ ID NO: 11837 - RNA, 21 nt, Homo sapiens
uggaggagaaggaaggugaug

SEQ ID NO: 11838 - RNA, 21 nt, Homo sapiens
gcaggaacuugugagucuccu

SEQ ID NO: 11839 - RNA, 22 nt, Homo sapiens
cugcccuggcccgagggaccga

SEQ ID NO: 11840 - RNA, 20 nt, Homo sapiens
ggggagcuguggaagcagua

SEQ ID NO: 11841 - RNA, 20 nt, Homo sapiens
ccucugggcccuuccuccag

SEQ ID NO: 11842 - RNA, 22 nt, Homo sapiens
ucucugggccugugucuuaggc

SEQ ID NO: 11843 - RNA, 22 nt, Homo sapiens
cagcagcaauucauguuuugaa

SEQ ID NO: 11844 - RNA, 22 nt, Homo sapiens
uuugugaccugguccacuaacc

SEQ ID NO: 11845 - RNA, 21 nt, Homo sapiens
uugggacauacuuaugcuaaa

SEQ ID NO: 11846 - RNA, 21 nt, Homo sapiens
ccaccaccgugucugacacuu

SEQ ID NO: 11847 - RNA, 22 nt, Homo sapiens
uauacaagggcagacucucucu

SEQ ID NO: 11848 - RNA, 22 nt, Homo sapiens
uauacaagggcaagcucucugu

SEQ ID NO: 11849 - RNA, 21 nt, Homo sapiens
agggggaaaguucuauagucc

SEQ ID NO: 11850 - RNA, 22 nt, Homo sapiens
acuuguaugcuagcucagguag

SEQ ID NO: 11851 - RNA, 21 nt, Homo sapiens
uggcagggaggcugggagggg

SEQ ID NO: 11852 - RNA, 24 nt, Homo sapiens
uggcccugacugaagaccagcagu

SEQ ID NO: 11853 - RNA, 22 nt, Homo sapiens
uuuagagacggggucuugcucu

SEQ ID NO: 11854 - RNA, 23 nt, Homo sapiens
agcuacauugucugcuggguuuc

SEQ ID NO: 11855 - RNA, 21 nt, Homo sapiens
agggcccccccucaauccugu

SEQ ID NO: 11856 - RNA, 22 nt, Homo sapiens
cuggcccucucugcccuuccgu

SEQ ID NO: 11857 - RNA, 20 nt, Homo sapiens
acucaaacugugggggcacu

SEQ ID NO: 11858 - RNA, 23 nt, Homo sapiens
aggaagcccuggaggggcuggag

SEQ ID NO: 11859 - RNA, 21 nt, Homo sapiens
uacucaaaaagcugucaguca

SEQ ID NO: 11860 - RNA, 21 nt, Homo sapiens
uaccacaggguagaaccacgg

SEQ ID NO: 11861 - RNA, 22 nt, Homo sapiens
uacccagagcaugcagugugaa

SEQ ID NO: 11862 - RNA, 22 nt, Homo sapiens
uagcuuaucagacugauguuga

SEQ ID NO: 11863 - RNA, 22 nt, Homo sapiens
aaacaaacauggugcacuucuu

SEQ ID NO: 11864 - RNA, 21 nt, Homo sapiens
cagcagcacacugugguuugu

SEQ ID NO: 11865 - RNA, 23 nt, Homo sapiens
agugccugagggaguaagagccc

SEQ ID NO: 11866 - RNA, 19 nt, Homo sapiens
aggcugcggaauucaggac

SEQ ID NO: 11867 - RNA, 22 nt, Homo sapiens
auccgcgcucugacucucugcc

SEQ ID NO: 11868 - RNA, 22 nt, Homo sapiens
acgcccuucccccccuucuuca

SEQ ID NO: 11869 - RNA, 22 nt, Homo sapiens
agaaggaaauugaauucauuua

SEQ ID NO: 11870 - RNA, 21 nt, Homo sapiens
cggcggggacggcgauugguc

SEQ ID NO: 11871 - RNA, 23 nt, Homo sapiens
caacggaaucccaaaagcagcug

SEQ ID NO: 11872 - RNA, 21 nt, Homo sapiens
aggggugcuaucugugauuga

SEQ ID NO: 11873 - RNA, 22 nt, Homo sapiens
aggcggggcgccgcgggaccgc

SEQ ID NO: 11874 - RNA, 22 nt, Homo sapiens
cugcccuggcccgagggaccga

SEQ ID NO: 11875 - RNA, 22 nt, Homo sapiens
cuccugagccauucugagccuc

SEQ ID NO: 11876 - RNA, 21 nt, Homo sapiens
gcccuccgcccgugcaccccg

SEQ ID NO: 11877 - RNA, 22 nt, Homo sapiens
uggagagaaaggcaguuccuga

SEQ ID NO: 11878 - RNA, 22 nt, Homo sapiens
cauugcacuugucucggucuga

SEQ ID NO: 11879 - RNA, 23 nt, Homo sapiens
gaagugcuucgauuuuggggugu

SEQ ID NO: 11880 - RNA, 21 nt, Homo sapiens
caaagaggaaggucccauuac

SEQ ID NO: 11881 - RNA, 22 nt, Homo sapiens
uacgucaucguugucaucguca

SEQ ID NO: 11882 - RNA, 22 nt, Homo sapiens
agucauuggaggguuugagcag

SEQ ID NO: 11883 - RNA, 22 nt, Homo sapiens
cuccugagccauucugagccuc

SEQ ID NO: 11884 - RNA, 22 nt, Homo sapiens
uggagagaaaggcaguuccuga

SEQ ID NO: 11885 - RNA, 21 nt, Homo sapiens
cucccacaugcaggguuugca

SEQ ID NO: 11886 - RNA, 22 nt, Homo sapiens
cgcaggggccgggugcucaccg

SEQ ID NO: 11887 - RNA, 22 nt, Homo sapiens
ucugcccccuccgcugcugcca

SEQ ID NO: 11888 - RNA, 20 nt, Homo sapiens
ccccagggcgacgcggcggg

SEQ ID NO: 11889 - RNA, 20 nt, Homo sapiens
acugccccaggugcugcugg

SEQ ID NO: 11890 - RNA, 20 nt, Homo sapiens
ccucugggcccuuccuccag

SEQ ID NO: 11891 - RNA, 22 nt, Homo sapiens
ucucugggccugugucuuaggc

SEQ ID NO: 11892 - RNA, 21 nt, Homo sapiens
gccccugggccuauccuagaa

SEQ ID NO: 11893 - RNA, 22 nt, Homo sapiens
uaaugccccuaaaaauccuuau

SEQ ID NO: 11894 - RNA, 22 nt, Homo sapiens
aggcaguguauuguuagcuggc

SEQ ID NO: 11895 - RNA, 21 nt, Homo sapiens
cggggcagcucaguacaggau

SEQ ID NO: 11896 - RNA, 22 nt, Homo sapiens
aagauguggaaaaauuggaauc

SEQ ID NO: 11897 - RNA, 22 nt, Homo sapiens
uccgagccugggucucccucuu

SEQ ID NO: 11898 - RNA, 22 nt, Homo sapiens
agacuucccauuugaagguggc

SEQ ID NO: 11899 - RNA, 22 nt, Homo sapiens
ugagaccucuggguucugagcu

SEQ ID NO: 11900 - RNA, 22 nt, Homo sapiens
ucuucucuguuuuggccaugug

SEQ ID NO: 11901 - RNA, 26 nt, Homo sapiens
aaguaguugguuuguaugagaugguu

SEQ ID NO: 11902 - RNA, 21 nt, Homo sapiens
cuuuuugcggucugggcuugc

SEQ ID NO: 11903 - RNA, 23 nt, Homo sapiens
guccaguuuucccaggaaucccu

SEQ ID NO: 11904 - RNA, 22 nt, Homo sapiens
ugcccuguggacucaguucugg

SEQ ID NO: 11905 - RNA, 22 nt, Homo sapiens
aaaagcuggguugagagggcga

SEQ ID NO: 11906 - RNA, 22 nt, Homo sapiens
aaaagcuggguugagagggcaa

SEQ ID NO: 11907 - RNA, 20 nt, Homo sapiens
aaaagcuggguugagagggu

SEQ ID NO: 11908 - RNA, 19 nt, Homo sapiens
aaaagcuggguugagagga

SEQ ID NO: 11909 - RNA, 22 nt, Homo sapiens
uccagcaucagugauuuuguug

SEQ ID NO: 11910 - RNA, 22 nt, Homo sapiens
gaugagcucauuguaauaugag

SEQ ID NO: 11911 - RNA, 23 nt, Homo sapiens
uucauuugguauaaaccgcgauu

SEQ ID NO: 11912 - RNA, 22 nt, Homo sapiens
aaccagcaccccaacuuuggac

SEQ ID NO: 11913 - RNA, 22 nt, Homo sapiens
uccauuacacuacccugccucu

SEQ ID NO: 11914 - RNA, 21 nt, Homo sapiens
uggcagggaggcugggagggg

SEQ ID NO: 11915 - RNA, 20 nt, Homo sapiens
cuuccucgucugucugcccc

SEQ ID NO: 11916 - RNA, 18 nt, Homo sapiens
aucccaccucugccacca

SEQ ID NO: 11917 - RNA, 17 nt, Homo sapiens
ucgccuccuccucuccc

SEQ ID NO: 11918 - RNA, 18 nt, Homo sapiens
cagggaggugaaugugau

SEQ ID NO: 11919 - RNA, 22 nt, Homo sapiens
cgcaggggccgggugcucaccg

SEQ ID NO: 11920 - RNA, 23 nt, Homo sapiens
ugaguaccgccaugucuguuggg

SEQ ID NO: 11921 - RNA, 22 nt, Homo sapiens
cccugugcccggcccacuucug

SEQ ID NO: 11922 - RNA, 22 nt, Homo sapiens
uguaaacauccuacacucagcu

SEQ ID NO: 11923 - RNA, 20 nt, Homo sapiens
ccucugggcccuuccuccag

SEQ ID NO: 11924 - RNA, 22 nt, Homo sapiens
ucucugggccugugucuuaggc

SEQ ID NO: 11925 - RNA, 21 nt, Homo sapiens
ugucuugcaggccgucaugca

SEQ ID NO: 11926 - RNA, 22 nt, Homo sapiens
uuuugcaauauguuccugaaua

SEQ ID NO: 11927 - RNA, 22 nt, Homo sapiens
caaaguuuaagauccuugaagu

SEQ ID NO: 11928 - RNA, 19 nt, Homo sapiens
ugucucugcugggguuucu

SEQ ID NO: 11929 - RNA, 25 nt, Homo sapiens
aggggugguguugggacagcuccgu

SEQ ID NO: 11930 - RNA, 20 nt, Homo sapiens
cggcucugggucugugggga

SEQ ID NO: 11931 - RNA, 23 nt, Homo sapiens
cuggagauauggaagagcugugu

SEQ ID NO: 11932 - RNA, 22 nt, Homo sapiens
ucagugcacuacagaacuuugu

SEQ ID NO: 11933 - RNA, 22 nt, Homo sapiens
ucagugcaucacagaacuuugu

SEQ ID NO: 11934 - RNA, 21 nt, Homo sapiens
ucagugcaugacagaacuugg

SEQ ID NO: 11935 - RNA, 21 nt, Homo sapiens
ccacaccguaucugacacuuu

SEQ ID NO: 11936 - RNA, 23 nt, Homo sapiens
aucaacagacauuaauugggcgc

SEQ ID NO: 11937 - RNA, 21 nt, Homo sapiens
acuggacuuggagucagaagg

SEQ ID NO: 11938 - RNA, 22 nt, Homo sapiens
acuggacuuagggucagaaggc

SEQ ID NO: 11939 - RNA, 23 nt, Homo sapiens
ucuuggaguaggucauugggugg

SEQ ID NO: 11940 - RNA, 23 nt, Homo sapiens
uacuccagagggcgucacucaug

SEQ ID NO: 11941 - RNA, 24 nt, Homo sapiens
uucuccaaaagaaagcacuuucug

SEQ ID NO: 11942 - RNA, 22 nt, Homo sapiens
aagugccuccuuuuagaguguu

SEQ ID NO: 11943 - RNA, 22 nt, Homo sapiens
caugccuugaguguaggaccgu

SEQ ID NO: 11944 - RNA, 22 nt, Homo sapiens
auucugcauuuuuagcaaguuc

SEQ ID NO: 11945 - RNA, 20 nt, Homo sapiens
auggagauagauauagaaau

SEQ ID NO: 11946 - RNA, 22 nt, Homo sapiens
acuccagccccacagccucagc

SEQ ID NO: 11947 - RNA, 21 nt, Homo sapiens
uacucaaaaagcugucaguca

SEQ ID NO: 11948 - RNA, 21 nt, Homo sapiens
uacuuggaaaggcaucaguug

SEQ ID NO: 11949 - RNA, 21 nt, Homo sapiens
uccuucugcuccgucccccag

SEQ ID NO: 11950 - RNA, 22 nt, Homo sapiens
ucugggcaacaaagugagaccu

SEQ ID NO: 11951 - RNA, 24 nt, Homo sapiens
agcagaagcagggagguucuccca

SEQ ID NO: 11952 - RNA, 22 nt, Homo sapiens
cuggcccucucugcccuuccgu

SEQ ID NO: 11953 - RNA, 21 nt, Homo sapiens
aucauagaggaaaauccacgu

SEQ ID NO: 11954 - RNA, 22 nt, Homo sapiens
aucauagaggaaaauccauguu

SEQ ID NO: 11955 - RNA, 22 nt, Homo sapiens
aauccuuugucccugggugaga

SEQ ID NO: 11956 - RNA, 20 nt, Homo sapiens
agaccauggguucucauugu

SEQ ID NO: 11957 - RNA, 25 nt, Homo sapiens
gcugggcagggcuucugagcuccuu

SEQ ID NO: 11958 - RNA, 21 nt, Homo sapiens
augauccaggaaccugccucu

SEQ ID NO: 11959 - RNA, 22 nt, Homo sapiens
gguggcccggccgugccugagg

SEQ ID NO: 11960 - RNA, 22 nt, Homo sapiens
acuccagccccacagccucagc

SEQ ID NO: 11961 - RNA, 23 nt, Homo sapiens
gcagcagagaauaggacuacguc

SEQ ID NO: 11962 - RNA, 18 nt, Homo sapiens
ucagcuggcccucauuuc

SEQ ID NO: 11963 - RNA, 22 nt, Homo sapiens
uggagugugacaaugguguuug

SEQ ID NO: 11964 - RNA, 23 nt, Homo sapiens
uagcagcgggaacaguucugcag

SEQ ID NO: 11965 - RNA, 21 nt, Homo sapiens
uggaggagaaggaaggugaug

SEQ ID NO: 11966 - RNA, 21 nt, Homo sapiens
ccuggaaacacugagguugug

SEQ ID NO: 11967 - RNA, 24 nt, Homo sapiens
uggggagcugaggcucugggggug

SEQ ID NO: 11968 - RNA, 21 nt, Homo sapiens
caucccuugcaugguggaggg

SEQ ID NO: 11969 - RNA, 22 nt, Homo sapiens
uggcaguguauuguuagcuggu

SEQ ID NO: 11970 - RNA, 21 nt, Homo sapiens
cacauuacacggucgaccucu

SEQ ID NO: 11971 - RNA, 21 nt, Homo sapiens
ugguagacuauggaacguagg

SEQ ID NO: 11972 - RNA, 21 nt, Homo sapiens
uaguagaccguauagcguacg

SEQ ID NO: 11973 - RNA, 22 nt, Homo sapiens
aggcaguguauuguuagcuggc

SEQ ID NO: 11974 - RNA, 22 nt, Homo sapiens
cgucaacacuugcugguuuccu

SEQ ID NO: 11975 - RNA, 21 nt, Homo sapiens
auugacacuucugugaguaga

SEQ ID NO: 11976 - RNA, 22 nt, Homo sapiens
caaaaaccacaguuucuuuugc

SEQ ID NO: 11977 - RNA, 22 nt, Homo sapiens
uugugucaauaugcgaugaugu

SEQ ID NO: 11978 - RNA, 23 nt, Homo sapiens
aucccuugcaggggcuguugggu

SEQ ID NO: 11979 - RNA, 20 nt, Homo sapiens
cggcucugggucugugggga

SEQ ID NO: 11980 - RNA, 21 nt, Homo sapiens
ucguggccuggucuccauuau

SEQ ID NO: 11981 - RNA, 22 nt, Homo sapiens
cauugcacuugucucggucuga

SEQ ID NO: 11982 - RNA, 22 nt, Homo sapiens
agaggcuggccgugaugaauuc

SEQ ID NO: 11983 - RNA, 22 nt, Homo sapiens
gguggcccggccgugccugagg

SEQ ID NO: 11984 - RNA, 27 nt, Homo sapiens
accuucuuguauaagcacugugcuaaa

SEQ ID NO: 11985 - RNA, 23 nt, Homo sapiens
guccaguuuucccaggaaucccu

SEQ ID NO: 11986 - RNA, 21 nt, Homo sapiens
cggcggggacggcgauugguc

SEQ ID NO: 11987 - RNA, 21 nt, Homo sapiens
cacauuacacggucgaccucu

SEQ ID NO: 11988 - RNA, 21 nt, Homo sapiens
gugcauuguaguugcauugca

SEQ ID NO: 11989 - RNA, 21 nt, Homo sapiens
cuucuugugcucuaggauugu

SEQ ID NO: 11990 - RNA, 22 nt, Homo sapiens
aggcggggcgccgcgggaccgc

SEQ ID NO: 11991 - RNA, 22 nt, Homo sapiens
ugcggggcuagggcuaacagca

SEQ ID NO: 11992 - RNA, 20 nt, Homo sapiens
uaaagagcccuguggagaca

SEQ ID NO: 11993 - RNA, 23 nt, Homo sapiens
uuauugcuuaagaauacgcguag

SEQ ID NO: 11994 - RNA, 21 nt, Homo sapiens
cuagacugaagcuccuugagg

SEQ ID NO: 11995 - RNA, 23 nt, Homo sapiens
aacauucaacgcugucggugagu

SEQ ID NO: 11996 - RNA, 23 nt, Homo sapiens
aacauucauugcugucggugggu

SEQ ID NO: 11997 - RNA, 22 nt, Homo sapiens
aacauucaaccugucggugagu

SEQ ID NO: 11998 - RNA, 23 nt, Homo sapiens
aacauucauuguugucggugggu

SEQ ID NO: 11999 - RNA, 21 nt, Homo sapiens
gguuugguccuagccuuucua

SEQ ID NO: 12000 - RNA, 23 nt, Homo sapiens
cccaguguucagacuaccuguuc

SEQ ID NO: 12001 - RNA, 23 nt, Homo sapiens
cccaguguuuagacuaucuguuc

SEQ ID NO: 12002 - RNA, 22 nt, Homo sapiens
acagcaggcacagacaggcagu

SEQ ID NO: 12003 - RNA, 22 nt, Homo sapiens
gaggguuggguggaggcucucc

SEQ ID NO: 12004 - RNA, 21 nt, Homo sapiens
gugcauuguaguugcauugca

SEQ ID NO: 12005 - RNA, 22 nt, Homo sapiens
caaucacuaacuccacugccau

SEQ ID NO: 12006 - RNA, 22 nt, Homo sapiens
gccugcugggguggaaccuggu

SEQ ID NO: 12007 - RNA, 21 nt, Homo sapiens
uaguagaccguauagcguacg

SEQ ID NO: 12008 - RNA, 22 nt, Homo sapiens
cgucaacacuugcugguuuccu

SEQ ID NO: 12009 - RNA, 22 nt, Homo sapiens
aaacauucgcggugcacuucuu

SEQ ID NO: 12010 - RNA, 19 nt, Homo sapiens
aagugugcagggcacuggu

SEQ ID NO: 12011 - RNA, 22 nt, Homo sapiens
ugucuacuacuggagacacugg

SEQ ID NO: 12012 - RNA, 21 nt, Homo sapiens
aaggcagggcccccgcucccc

SEQ ID NO: 12013 - RNA, 21 nt, Homo sapiens
cccggagccaggaugcagcuc

SEQ ID NO: 12014 - RNA, 18 nt, Homo sapiens
ucagcuggcccucauuuc

SEQ ID NO: 12015 - RNA, 20 nt, Homo sapiens
ugagcccuguccucccgcag

SEQ ID NO: 12016 - RNA, 17 nt, Homo sapiens
ucgccuccuccucuccc

SEQ ID NO: 12017 - RNA, 23 nt, Homo sapiens
ugaguaccgccaugucuguuggg

SEQ ID NO: 12018 - RNA, 19 nt, Homo sapiens
gggcgccugugaucccaac

SEQ ID NO: 12019 - RNA, 20 nt, Homo sapiens
accaggaggcugaggccccu

SEQ ID NO: 12020 - RNA, 17 nt, Homo sapiens
ucucgcuggggccucca

SEQ ID NO: 12021 - RNA, 21 nt, Homo sapiens
uugggacauacuuaugcuaaa

SEQ ID NO: 12022 - RNA, 21 nt, Homo sapiens
gcccuccgcccgugcaccccg

SEQ ID NO: 12023 - RNA, 21 nt, Homo sapiens
cggcggggacggcgauugguc

SEQ ID NO: 12024 - RNA, 20 nt, Homo sapiens
ccccagggcgacgcggcggg

SEQ ID NO: 12025 - RNA, 21 nt, Homo sapiens
aggggugcuaucugugauuga

SEQ ID NO: 12026 - RNA, 23 nt, Homo sapiens
aggaccugcgggacaagauucuu

SEQ ID NO: 12027 - RNA, 23 nt, Homo sapiens
uaaaucccauggugccuucuccu

SEQ ID NO: 12028 - RNA, 21 nt, Homo sapiens
cacaagguauugguauuaccu

SEQ ID NO: 12029 - RNA, 21 nt, Homo sapiens
agaccuggcccagaccucagc

SEQ ID NO: 12030 - RNA, 25 nt, Homo sapiens
ggcggagggaaguagguccguuggu

SEQ ID NO: 12031 - RNA, 22 nt, Homo sapiens
aggcggggcgccgcgggaccgc

SEQ ID NO: 12032 - RNA, 23 nt, Homo sapiens
uggugcggagagggcccacagug

SEQ ID NO: 12033 - RNA, 22 nt, Homo sapiens
ccucuuccccuugucucuccag

SEQ ID NO: 12034 - RNA, 22 nt, Homo sapiens
aggcauugacuucucacuagcu

SEQ ID NO: 12035 - RNA, 22 nt, Homo sapiens
ucucccaacccuuguaccagug

SEQ ID NO: 12036 - RNA, 23 nt, Homo sapiens
uaaggugcaucuagugcaguuag

SEQ ID NO: 12037 - RNA, 22 nt, Homo sapiens
uuggggaaacggccgcugagug

SEQ ID NO: 12038 - RNA, 23 nt, Homo sapiens
ucaagagcaauaacgaaaaaugu

SEQ ID NO: 12039 - RNA, 22 nt, Homo sapiens
uaaugccccuaaaaauccuuau

SEQ ID NO: 12040 - RNA, 23 nt, Homo sapiens
cacucagccuugagggcacuuuc

SEQ ID NO: 12041 - RNA, 20 nt, Homo sapiens
guagaggagauggcgcaggg

SEQ ID NO: 12042 - RNA, 23 nt, Homo sapiens
gcagcagagaauaggacuacguc

SEQ ID NO: 12043 - RNA, 22 nt, Homo sapiens
ucugggcaacaaagugagaccu

SEQ ID NO: 12044 - RNA, 22 nt, Homo sapiens
uuuagagacggggucuugcucu

SEQ ID NO: 12045 - RNA, 23 nt, Homo sapiens
agcuacauugucugcuggguuuc

SEQ ID NO: 12046 - RNA, 22 nt, Homo sapiens
uguaaacauccucgacuggaag

SEQ ID NO: 12047 - RNA, 22 nt, Homo sapiens
uguaaacauccccgacuggaag

SEQ ID NO: 12048 - RNA, 22 nt, Homo sapiens
uguaaacauccuugacuggaag

SEQ ID NO: 12049 - RNA, 22 nt, Homo sapiens
uaaugccccuaaaaauccuuau

SEQ ID NO: 12050 - RNA, 23 nt, Homo sapiens
ucuuggaguaggucauugggugg

SEQ ID NO: 12051 - RNA, 22 nt, Homo sapiens
caaccuggaggacuccaugcug

SEQ ID NO: 12052 - RNA, 24 nt, Homo sapiens
uucuccaaaagaaagcacuuucug

SEQ ID NO: 12053 - RNA, 22 nt, Homo sapiens
aagugccuccuuuuagaguguu

SEQ ID NO: 12054 - RNA, 21 nt, Homo sapiens
aacaggugacugguuagacaa

SEQ ID NO: 12055 - RNA, 25 nt, Homo sapiens
gcugggcagggcuucugagcuccuu

SEQ ID NO: 12056 - RNA, 22 nt, Homo sapiens
gucccucuccaaaugugucuug

SEQ ID NO: 12057 - RNA, 18 nt, Homo sapiens
ucagcuggcccucauuuc

SEQ ID NO: 12058 - RNA, 18 nt, Homo sapiens
ucagcuggcccucauuuc

SEQ ID NO: 12059 - RNA, 22 nt, Homo sapiens
uggagugugacaaugguguuug

SEQ ID NO: 12060 - RNA, 17 nt, Homo sapiens
ucgccuccuccucuccc

SEQ ID NO: 12061 - RNA, 23 nt, Homo sapiens
cggcccgggcugcugcuguuccu

SEQ ID NO: 12062 - RNA, 21 nt, Homo sapiens
cggcggggacggcgauugguc

SEQ ID NO: 12063 - RNA, 21 nt, Homo sapiens
cggcggggacggcgauugguc

SEQ ID NO: 12064 - RNA, 22 nt, Homo sapiens
cauugcacuugucucggucuga

SEQ ID NO: 12065 - RNA, 25 nt, Homo sapiens
aggggugguguugggacagcuccgu

SEQ ID NO: 12066 - RNA, 25 nt, Homo sapiens
ggcggagggaaguagguccguuggu

SEQ ID NO: 12067 - RNA, 22 nt, Homo sapiens
aggcggggcgccgcgggaccgc

SEQ ID NO: 12068 - RNA, 22 nt, Homo sapiens
aggcggggcgccgcgggaccgc

SEQ ID NO: 12069 - RNA, 22 nt, Homo sapiens
ugcggggcuagggcuaacagca

SEQ ID NO: 12070 - RNA, 22 nt, Homo sapiens
ucguaccgugaguaauaaugcg

SEQ ID NO: 12071 - RNA, 22 nt, Homo sapiens
uagcagcacaucaugguuuaca

SEQ ID NO: 12072 - RNA, 23 nt, Homo sapiens
ucaagagcaauaacgaaaaaugu

SEQ ID NO: 12073 - RNA, 23 nt, Homo sapiens
aaugacacgaucacucccguuga

SEQ ID NO: 12074 - RNA, 22 nt, Homo sapiens
aucaugaugggcuccucggugu

SEQ ID NO: 12075 - RNA, 23 nt, Homo sapiens
uaaauuucaccuuucugagaagg

SEQ ID NO: 12076 - RNA, 23 nt, Homo sapiens
ucugcucauaccccaugguuucu

SEQ ID NO: 12077 - RNA, 22 nt, Homo sapiens
aaauuauuguacaucggaugag

SEQ ID NO: 12078 - RNA, 22 nt, Homo sapiens
acucggcguggcgucggucgug

SEQ ID NO: 12079 - RNA, 21 nt, Homo sapiens
cggcggggacggcgauugguc

SEQ ID NO: 12080 - RNA, 22 nt, Homo sapiens
agaggcuggccgugaugaauuc

SEQ ID NO: 12081 - RNA, 21 nt, Homo sapiens
auugacacuucugugaguaga

SEQ ID NO: 12082 - RNA, 22 nt, Homo sapiens
aggcggggcgccgcgggaccgc

SEQ ID NO: 12083 - RNA, 22 nt, Homo sapiens
ugcggggcuagggcuaacagca

SEQ ID NO: 12084 - RNA, 21 nt, Homo sapiens
uggaggagaaggaaggugaug

SEQ ID NO: 12085 - RNA, 22 nt, Homo sapiens
uuuccggcucgcgugggugugu

SEQ ID NO: 12086 - RNA, 22 nt, Homo sapiens
uucuggaauucugugugaggga

SEQ ID NO: 12087 - RNA, 22 nt, Homo sapiens
aagcccuuaccccaaaaagcau

SEQ ID NO: 12088 - RNA, 22 nt, Homo sapiens
uuugguccccuucaaccagcug

SEQ ID NO: 12089 - RNA, 22 nt, Homo sapiens
uuugguccccuucaaccagcua

SEQ ID NO: 12090 - RNA, 23 nt, Homo sapiens
cggcccgggcugcugcuguuccu

SEQ ID NO: 12091 - RNA, 23 nt, Homo sapiens
cggcccgggcugcugcuguuccu

SEQ ID NO: 12092 - RNA, 21 nt, Homo sapiens
aucacauugccagggauuucc

SEQ ID NO: 12093 - RNA, 21 nt, Homo sapiens
aucacauugccagggauuacc

SEQ ID NO: 12094 - RNA, 23 nt, Homo sapiens
ugaggggcagagagcgagacuuu

SEQ ID NO: 12095 - RNA, 22 nt, Homo sapiens
uucucaaggaggugucguuuau

SEQ ID NO: 12096 - RNA, 21 nt, Homo sapiens
uuuccauaggugaugagucac

SEQ ID NO: 12097 - RNA, 22 nt, Homo sapiens
uccgagccugggucucccucuu

SEQ ID NO: 12098 - RNA, 23 nt, Homo sapiens
aucccuugcaggggcuguugggu

SEQ ID NO: 12099 - RNA, 22 nt, Homo sapiens
ugcggggcuagggcuaacagca

SEQ ID NO: 12100 - RNA, 22 nt, Homo sapiens
uuugugaccugguccacuaacc

SEQ ID NO: 12101 - RNA, 21 nt, Homo sapiens
ucguggccuggucuccauuau

SEQ ID NO: 12102 - RNA, 22 nt, Homo sapiens
uggagugugacaaugguguuug

SEQ ID NO: 12103 - RNA, 21 nt, Homo sapiens
uuaggccgcagaucuggguga

SEQ ID NO: 12104 - RNA, 22 nt, Homo sapiens
cucggcgcggggcgcgggcucc

SEQ ID NO: 12105 - RNA, 22 nt, Homo sapiens
ucaggccaggcacaguggcuca

SEQ ID NO: 12106 - RNA, 23 nt, Homo sapiens
ucggggaucaucaugucacgaga

SEQ ID NO: 12107 - RNA, 19 nt, Homo sapiens
aggcugcggaauucaggac

SEQ ID NO: 12108 - RNA, 22 nt, Homo sapiens
gucccucuccaaaugugucuug

SEQ ID NO: 12109 - RNA, 21 nt, Homo sapiens
guggcugcacucacuuccuuc

SEQ ID NO: 12110 - RNA, 24 nt, Homo sapiens
ugccugggucucuggccugcgcgu

SEQ ID NO: 12111 - RNA, 22 nt, Homo sapiens
ugcuggaucagugguucgaguc

SEQ ID NO: 12112 - RNA, 21 nt, Homo sapiens
uccugcgcgucccagaugccc

SEQ ID NO: 12113 - RNA, 21 nt, Homo sapiens
cggcggggacggcgauugguc

SEQ ID NO: 12114 - RNA, 22 nt, Homo sapiens
cgcaggggccgggugcucaccg

SEQ ID NO: 12115 - RNA, 23 nt, Homo sapiens
caacggaaucccaaaagcagcug

SEQ ID NO: 12116 - RNA, 23 nt, Homo sapiens
ugaguaccgccaugucuguuggg

SEQ ID NO: 12117 - RNA, 19 nt, Homo sapiens
accgugcaaagguagcaua

SEQ ID NO: 12118 - RNA, 22 nt, Homo sapiens
gaggguuggguggaggcucucc

SEQ ID NO: 12119 - RNA, 22 nt, Homo sapiens
caaccuggaggacuccaugcug

SEQ ID NO: 12120 - RNA, 22 nt, Homo sapiens
auucugcauuuuuagcaaguuc

SEQ ID NO: 12121 - RNA, 24 nt, Homo sapiens
gaccuggacauguuugugcccagu

SEQ ID NO: 12122 - RNA, 22 nt, Homo sapiens
aggcggggcgccgcgggaccgc

SEQ ID NO: 12123 - RNA, 22 nt, Homo sapiens
ugcggggcuagggcuaacagca

SEQ ID NO: 12124 - RNA, 22 nt, Homo sapiens
ugcaacuuaccugagucauuga

SEQ ID NO: 12125 - RNA, 21 nt, Homo sapiens
cccggagccaggaugcagcuc

SEQ ID NO: 12126 - RNA, 22 nt, Homo sapiens
acgcccuucccccccuucuuca

SEQ ID NO: 12127 - RNA, 21 nt, Homo sapiens
uccugcgcgucccagaugccc

SEQ ID NO: 12128 - RNA, 22 nt, Homo sapiens
cgcaggggccgggugcucaccg

SEQ ID NO: 12129 - RNA, 23 nt, Homo sapiens
ugaguaccgccaugucuguuggg

SEQ ID NO: 12130 - RNA, 22 nt, Homo sapiens
aacuggcccucaaagucccgcu

SEQ ID NO: 12131 - RNA, 22 nt, Homo sapiens
aauugcacgguauccaucugua

SEQ ID NO: 12132 - RNA, 25 nt, Homo sapiens
aggggugguguugggacagcuccgu

SEQ ID NO: 12133 - RNA, 22 nt, Homo sapiens
ugcccuuaaaggugaacccagu

SEQ ID NO: 12134 - RNA, 19 nt, Homo sapiens
gugaggacucgggaggugg

SEQ ID NO: 12135 - RNA, 22 nt, Homo sapiens
caaagaauucuccuuuugggcu

SEQ ID NO: 12136 - RNA, 22 nt, Homo sapiens
ugggucuuugcgggcgagauga

SEQ ID NO: 12137 - RNA, 23 nt, Homo sapiens
cccaguguucagacuaccuguuc

SEQ ID NO: 12138 - RNA, 23 nt, Homo sapiens
cccaguguuuagacuaucuguuc

SEQ ID NO: 12139 - RNA, 23 nt, Homo sapiens
ugugcaaaucuaugcaaaacuga

SEQ ID NO: 12140 - RNA, 22 nt, Homo sapiens
aacaauauccuggugcugagug

SEQ ID NO: 12141 - RNA, 22 nt, Homo sapiens
agagguaguagguugcauaguu

SEQ ID NO: 12142 - RNA, 22 nt, Homo sapiens
uauugcacauuacuaaguugca

SEQ ID NO: 12143 - RNA, 23 nt, Homo sapiens
acuucaccugguccacuagccgu

SEQ ID NO: 12144 - RNA, 22 nt, Homo sapiens
cagcagcaauucauguuuugaa

SEQ ID NO: 12145 - RNA, 23 nt, Homo sapiens
uaaauuucaccuuucugagaagg

SEQ ID NO: 12146 - RNA, 24 nt, Homo sapiens
cugaagugauguguaacugaucag

SEQ ID NO: 12147 - RNA, 21 nt, Homo sapiens
aggaggcagcgcucucaggac

SEQ ID NO: 12148 - RNA, 21 nt, Homo sapiens
uacaguacugugauaacugaa

SEQ ID NO: 12149 - RNA, 18 nt, Homo sapiens
ucagcuggcccucauuuc

SEQ ID NO: 12150 - RNA, 19 nt, Homo sapiens
gugaggacucgggaggugg

SEQ ID NO: 12151 - RNA, 17 nt, Homo sapiens
ucgccuccuccucuccc

SEQ ID NO: 12152 - RNA, 18 nt, Homo sapiens
cagggaggugaaugugau

SEQ ID NO: 12153 - RNA, 23 nt, Homo sapiens
ucuggcuccgugucuucacuccc

SEQ ID NO: 12154 - RNA, 21 nt, Homo sapiens
uccugcgcgucccagaugccc

SEQ ID NO: 12155 - RNA, 21 nt, Homo sapiens
cggcggggacggcgauugguc

SEQ ID NO: 12156 - RNA, 22 nt, Homo sapiens
aaggagcucacagucuauugag

SEQ ID NO: 12157 - RNA, 22 nt, Homo sapiens
aggcggggcgccgcgggaccgc

SEQ ID NO: 12158 - RNA, 23 nt, Homo sapiens
aaggagcuuacaaucuagcuggg

SEQ ID NO: 12159 - RNA, 24 nt, Homo sapiens
uggggagcugaggcucugggggug

SEQ ID NO: 12160 - RNA, 22 nt, Homo sapiens
ugugacugguugaccagagggg

SEQ ID NO: 12161 - RNA, 23 nt, Homo sapiens
ucuggcuccgugucuucacuccc

SEQ ID NO: 12162 - RNA, 23 nt, Homo sapiens
ucuggcuccgugucuucacuccc

SEQ ID NO: 12163 - RNA, 21 nt, Homo sapiens
ucgaggagcucacagucuagu

SEQ ID NO: 12164 - RNA, 23 nt, Homo sapiens
ugaguaccgccaugucuguuggg

SEQ ID NO: 12165 - RNA, 22 nt, Homo sapiens
uggcucaguucagcaggaacag

SEQ ID NO: 12166 - RNA, 22 nt, Homo sapiens
uguaaacauccuacacucagcu

SEQ ID NO: 12167 - RNA, 20 nt, Homo sapiens
ccucugggcccuuccuccag

SEQ ID NO: 12168 - RNA, 22 nt, Homo sapiens
ucucugggccugugucuuaggc

SEQ ID NO: 12169 - RNA, 23 nt, Homo sapiens
agcucggucugaggccccucagu

SEQ ID NO: 12170 - RNA, 22 nt, Homo sapiens
ucaggcucaguccccucccgau

SEQ ID NO: 12171 - RNA, 22 nt, Homo sapiens
agaggcuggccgugaugaauuc

SEQ ID NO: 12172 - RNA, 22 nt, Homo sapiens
cgucaacacuugcugguuuccu

SEQ ID NO: 12173 - RNA, 20 nt, Homo sapiens
cggcucugggucugugggga

SEQ ID NO: 12174 - RNA, 21 nt, Homo sapiens
uggaggagaaggaaggugaug

SEQ ID NO: 12175 - RNA, 20 nt, Homo sapiens
ccuccugcccuccuugcugu

SEQ ID NO: 12176 - RNA, 22 nt, Homo sapiens
acagcaggcacagacaggcagu

SEQ ID NO: 12177 - RNA, 21 nt, Homo sapiens
uucacaguggcuaaguuccgc

SEQ ID NO: 12178 - RNA, 22 nt, Homo sapiens
aaggagcucacagucuauugag

SEQ ID NO: 12179 - RNA, 22 nt, Homo sapiens
uuauaaagcaaugagacugauu

SEQ ID NO: 12180 - RNA, 22 nt, Homo sapiens
uggcagugucuuagcugguugu

SEQ ID NO: 12181 - RNA, 22 nt, Homo sapiens
gccugcugggguggaaccuggu

SEQ ID NO: 12182 - RNA, 22 nt, Homo sapiens
uucucaaggaggugucguuuau

SEQ ID NO: 12183 - RNA, 23 nt, Homo sapiens
cucuugagggaagcacuuucugu

SEQ ID NO: 12184 - RNA, 23 nt, Homo sapiens
aaggagcuuacaaucuagcuggg

SEQ ID NO: 12185 - RNA, 22 nt, Homo sapiens
ugugcgcagggagaccucuccc

SEQ ID NO: 12186 - RNA, 22 nt, Homo sapiens
ucguaccgugaguaauaaugcg

SEQ ID NO: 12187 - RNA, 22 nt, Homo sapiens
uggagagaaaggcaguuccuga

SEQ ID NO: 12188 - RNA, 22 nt, Homo sapiens
caaagaauucuccuuuugggcu

SEQ ID NO: 12189 - RNA, 23 nt, Homo sapiens
ugugcaaaucuaugcaaaacuga

SEQ ID NO: 12190 - RNA, 22 nt, Homo sapiens
aacaauauccuggugcugagug

SEQ ID NO: 12191 - RNA, 22 nt, Homo sapiens
agagguaguagguugcauaguu

SEQ ID NO: 12192 - RNA, 21 nt, Homo sapiens
gugcauuguaguugcauugca

SEQ ID NO: 12193 - RNA, 22 nt, Homo sapiens
uuuugcaauauguuccugaaua

SEQ ID NO: 12194 - RNA, 22 nt, Homo sapiens
uuuugcaauauguuccugaaua

SEQ ID NO: 12195 - RNA, 22 nt, Homo sapiens
aacuguuugcagaggaaacuga

SEQ ID NO: 12196 - RNA, 20 nt, Homo sapiens
agaccauggguucucauugu

SEQ ID NO: 12197 - RNA, 22 nt, Homo sapiens
uggagugugacaaugguguuug

SEQ ID NO: 12198 - RNA, 22 nt, Homo sapiens
ugcaacuuaccugagucauuga

SEQ ID NO: 12199 - RNA, 22 nt, Homo sapiens
aaauuauuguacaucggaugag

SEQ ID NO: 12200 - RNA, 22 nt, Homo sapiens
cuccugagccauucugagccuc

SEQ ID NO: 12201 - RNA, 22 nt, Homo sapiens
ugcuggaucagugguucgaguc

SEQ ID NO: 12202 - RNA, 23 nt, Homo sapiens
aacauucaacgcugucggugagu

SEQ ID NO: 12203 - RNA, 22 nt, Homo sapiens
ucugcccccuccgcugcugcca

SEQ ID NO: 12204 - RNA, 22 nt, Homo sapiens
acacagggcuguugugaagacu

SEQ ID NO: 12205 - RNA, 21 nt, Homo sapiens
aucacauugccagggauuucc

SEQ ID NO: 12206 - RNA, 21 nt, Homo sapiens
aucacauugccagggauuacc

SEQ ID NO: 12207 - RNA, 20 nt, Homo sapiens
acugccccaggugcugcugg

SEQ ID NO: 12208 - RNA, 23 nt, Homo sapiens
ucccccaggugugauucugauuu

SEQ ID NO: 12209 - RNA, 23 nt, Homo sapiens
ucuuggaguaggucauugggugg

SEQ ID NO: 12210 - RNA, 22 nt, Homo sapiens
agaggcuggccgugaugaauuc

SEQ ID NO: 12211 - RNA, 21 nt, Homo sapiens
cggggcagcucaguacaggau

SEQ ID NO: 12212 - RNA, 23 nt, Homo sapiens
aggaccugcgggacaagauucuu

SEQ ID NO: 12213 - RNA, 21 nt, Homo sapiens
agaccuggcccagaccucagc

SEQ ID NO: 12214 - RNA, 24 nt, Homo sapiens
acugggggcuuucgggcucugcgu

SEQ ID NO: 12215 - RNA, 21 nt, Homo sapiens
aggaggcagcgcucucaggac

SEQ ID NO: 12216 - RNA, 21 nt, Homo sapiens
gcaggaacuugugagucuccu

SEQ ID NO: 12217 - RNA, 22 nt, Homo sapiens
uagcagcacauaaugguuugug

SEQ ID NO: 12218 - RNA, 22 nt, Homo sapiens
uacccagagcaugcagugugaa

SEQ ID NO: 12219 - RNA, 22 nt, Homo sapiens
ucaggccaggcacaguggcuca

SEQ ID NO: 12220 - RNA, 20 nt, Homo sapiens
ccucugggcccuuccuccag

SEQ ID NO: 12221 - RNA, 22 nt, Homo sapiens
ucucugggccugugucuuaggc

SEQ ID NO: 12222 - RNA, 22 nt, Homo sapiens
gcugacuccuaguccagggcuc

SEQ ID NO: 12223 - RNA, 20 nt, Homo sapiens
acucaaacugugggggcacu

SEQ ID NO: 12224 - RNA, 22 nt, Homo sapiens
ggggguccccggugcucggauc

SEQ ID NO: 12225 - RNA, 19 nt, Homo sapiens
ucuaggcugguacugcuga

SEQ ID NO: 12226 - RNA, 22 nt, Homo sapiens
aggcggggcgccgcgggaccgc

SEQ ID NO: 12227 - RNA, 22 nt, Homo sapiens
gguggcccggccgugccugagg

SEQ ID NO: 12228 - RNA, 24 nt, Homo sapiens
uggggagcugaggcucugggggug

SEQ ID NO: 12229 - RNA, 26 nt, Homo sapiens
gaugaugauggcagcaaauucugaaa

SEQ ID NO: 12230 - RNA, 20 nt, Homo sapiens
ucugcaggguuugcuuugag

SEQ ID NO: 12231 - RNA, 23 nt, Homo sapiens
uaaggugcaucuagugcagauag

SEQ ID NO: 12232 - RNA, 23 nt, Homo sapiens
cccaguguucagacuaccuguuc

SEQ ID NO: 12233 - RNA, 23 nt, Homo sapiens
cccaguguuuagacuaucuguuc

SEQ ID NO: 12234 - RNA, 21 nt, Homo sapiens
uugugcuugaucuaaccaugu

SEQ ID NO: 12235 - RNA, 22 nt, Homo sapiens
ugucaguuugucaaauacccca

SEQ ID NO: 12236 - RNA, 24 nt, Homo sapiens
agcagaagcagggagguucuccca

SEQ ID NO: 12237 - RNA, 23 nt, Homo sapiens
gaagugcuucgauuuuggggugu

SEQ ID NO: 12238 - RNA, 22 nt, Homo sapiens
caaccuggaggacuccaugcug

SEQ ID NO: 12239 - RNA, 22 nt, Homo sapiens
gaugagcucauuguaauaugag

SEQ ID NO: 12240 - RNA, 22 nt, Homo sapiens
agucauuggaggguuugagcag

SEQ ID NO: 12241 - RNA, 21 nt, Homo sapiens
uggguuuacguugggagaacu

SEQ ID NO: 12242 - RNA, 22 nt, Homo sapiens
aguauucuguaccagggaaggu

SEQ ID NO: 12243 - RNA, 19 nt, Homo sapiens
ucuaggcugguacugcuga

SEQ ID NO: 12244 - RNA, 22 nt, Homo sapiens
uuugugaccugguccacuaacc

SEQ ID NO: 12245 - RNA, 21 nt, Homo sapiens
uacucaaaaagcugucaguca

SEQ ID NO: 12246 - RNA, 24 nt, Homo sapiens
ucccugagacccuuuaaccuguga

SEQ ID NO: 12247 - RNA, 22 nt, Homo sapiens
ucccugagacccuaacuuguga

SEQ ID NO: 12248 - RNA, 23 nt, Homo sapiens
ccucagggcuguagaacagggcu

SEQ ID NO: 12249 - RNA, 24 nt, Homo sapiens
uggcccugacugaagaccagcagu

SEQ ID NO: 12250 - RNA, 21 nt, Homo sapiens
cauaaaguagaaagcacuacu

SEQ ID NO: 12251 - RNA, 21 nt, Homo sapiens
agggcccccccucaauccugu

SEQ ID NO: 12252 - RNA, 22 nt, Homo sapiens
cuagguauggucccagggaucc

SEQ ID NO: 12253 - RNA, 21 nt, Homo sapiens
uugaaaggcuauuucuugguc

SEQ ID NO: 12254 - RNA, 22 nt, Homo sapiens
uacucaggagaguggcaaucac

SEQ ID NO: 12255 - RNA, 23 nt, Homo sapiens
uucauuugguauaaaccgcgauu

SEQ ID NO: 12256 - RNA, 20 nt, Homo sapiens
agaccauggguucucauugu

SEQ ID NO: 12257 - RNA, 22 nt, Homo sapiens
uggagugugacaaugguguuug

SEQ ID NO: 12258 - RNA, 17 nt, Homo sapiens
ucccaccgcugccaccc

SEQ ID NO: 12259 - RNA, 21 nt, Homo sapiens
gcccuccgcccgugcaccccg

SEQ ID NO: 12260 - RNA, 23 nt, Homo sapiens
cggcccgggcugcugcuguuccu

SEQ ID NO: 12261 - RNA, 22 nt, Homo sapiens
cauugcacuugucucggucuga

SEQ ID NO: 12262 - RNA, 19 nt, Homo sapiens
gggcgccugugaucccaac

SEQ ID NO: 12263 - RNA, 25 nt, Homo sapiens
ggcggagggaaguagguccguuggu

SEQ ID NO: 12264 - RNA, 20 nt, Homo sapiens
ggggagcuguggaagcagua

SEQ ID NO: 12265 - RNA, 20 nt, Homo sapiens
ugagcccuguccucccgcag

SEQ ID NO: 12266 - RNA, 22 nt, Homo sapiens
cugaagcucagagggcucugau

SEQ ID NO: 12267 - RNA, 22 nt, Homo sapiens
uucuggaauucugugugaggga

SEQ ID NO: 12268 - RNA, 22 nt, Homo sapiens
aagcccuuaccccaaaaagcau

SEQ ID NO: 12269 - RNA, 22 nt, Homo sapiens
aacuguuugcagaggaaacuga

SEQ ID NO: 12270 - RNA, 21 nt, Homo sapiens
uagcagcacagaaauauuggc

SEQ ID NO: 12271 - RNA, 22 nt, Homo sapiens
aaggagcucacagucuauugag

SEQ ID NO: 12272 - RNA, 23 nt, Homo sapiens
ucaagagcaauaacgaaaaaugu

SEQ ID NO: 12273 - RNA, 22 nt, Homo sapiens
aacaauauccuggugcugagug

SEQ ID NO: 12274 - RNA, 22 nt, Homo sapiens
aaaaguauuugcggguuuuguc

SEQ ID NO: 12275 - RNA, 22 nt, Homo sapiens
cgaaaacagcaauuaccuuugc

SEQ ID NO: 12276 - RNA, 19 nt, Homo sapiens
gugucugcuuccuguggga

SEQ ID NO: 12277 - RNA, 23 nt, Homo sapiens
aaggagcuuacaaucuagcuggg

SEQ ID NO: 12278 - RNA, 22 nt, Homo sapiens
ugcaacuuaccugagucauuga

SEQ ID NO: 12279 - RNA, 22 nt, Homo sapiens
ugcccuuaaaggugaacccagu

SEQ ID NO: 12280 - RNA, 21 nt, Homo sapiens
uugcucacuguucuucccuag

SEQ ID NO: 12281 - RNA, 26 nt, Homo sapiens
aaguaguugguuuguaugagaugguu

SEQ ID NO: 12282 - RNA, 22 nt, Homo sapiens
ucaaaacugaggggcauuuucu

SEQ ID NO: 12283 - RNA, 22 nt, Homo sapiens
aacuguuugcagaggaaacuga

SEQ ID NO: 12284 - RNA, 21 nt, Homo sapiens
uagcagcacagaaauauuggc

SEQ ID NO: 12285 - RNA, 23 nt, Homo sapiens
uaagugcuuccauguuucagugg

SEQ ID NO: 12286 - RNA, 21 nt, Homo sapiens
aauaauacaugguugaucuuu

SEQ ID NO: 12287 - RNA, 21 nt, Homo sapiens
gugucuuuugcucugcaguca

SEQ ID NO: 12288 - RNA, 22 nt, Homo sapiens
ccaaaacugcaguuacuuuugc

SEQ ID NO: 12289 - RNA, 21 nt, Homo sapiens
agagaagaagaucagccugca

SEQ ID NO: 12290 - RNA, 20 nt, Homo sapiens
uaaagagcccuguggagaca

SEQ ID NO: 12291 - RNA, 18 nt, Homo sapiens
uugagaaggaggcugcug

SEQ ID NO: 12292 - RNA, 22 nt, Homo sapiens
uguaacagcaacuccaugugga

SEQ ID NO: 12293 - RNA, 20 nt, Homo sapiens
uguuuugauaacaguaaugu

SEQ ID NO: 12294 - RNA, 22 nt, Homo sapiens
uaaugccccuaaaaauccuuau

SEQ ID NO: 12295 - RNA, 22 nt, Homo sapiens
gugacaucacauauacggcagc

SEQ ID NO: 12296 - RNA, 21 nt, Homo sapiens
gcgacccauacuugguuucag

SEQ ID NO: 12297 - RNA, 21 nt, Homo sapiens
gcccuccgcccgugcaccccg

SEQ ID NO: 12298 - RNA, 22 nt, Homo sapiens
cauugcacuugucucggucuga

SEQ ID NO: 12299 - RNA, 23 nt, Homo sapiens
uagcagcgggaacaguucugcag

SEQ ID NO: 12300 - RNA, 21 nt, Homo sapiens
uccgguucucagggcuccacc

SEQ ID NO: 12301 - RNA, 20 nt, Homo sapiens
cggcucugggucugugggga

SEQ ID NO: 12302 - RNA, 23 nt, Homo sapiens
uacccuguagaaccgaauuugug

SEQ ID NO: 12303 - RNA, 21 nt, Homo sapiens
ccgucgccgccacccgagccg

SEQ ID NO: 12304 - RNA, 21 nt, Homo sapiens
guucaaauccagaucuauaac

SEQ ID NO: 12305 - RNA, 22 nt, Homo sapiens
aacccguagauccgaucuugug

SEQ ID NO: 12306 - RNA, 22 nt, Homo sapiens
cacccguagaaccgaccuugcg

SEQ ID NO: 12307 - RNA, 23 nt, Homo sapiens
ucuggcuccgugucuucacuccc

SEQ ID NO: 12308 - RNA, 21 nt, Homo sapiens
uccugcgcgucccagaugccc

SEQ ID NO: 12309 - RNA, 21 nt, Homo sapiens
cggcggggacggcgauugguc

SEQ ID NO: 12310 - RNA, 21 nt, Homo sapiens
aucacauugccagggauuucc

SEQ ID NO: 12311 - RNA, 21 nt, Homo sapiens
aucacauugccagggauuacc

SEQ ID NO: 12312 - RNA, 23 nt, Homo sapiens
ugaggggcagagagcgagacuuu

SEQ ID NO: 12313 - RNA, 22 nt, Homo sapiens
aggcggggcgccgcgggaccgc

SEQ ID NO: 12314 - RNA, 22 nt, Homo sapiens
ugcggggcuagggcuaacagca

SEQ ID NO: 12315 - RNA, 26 nt, Homo sapiens
gaugaugauggcagcaaauucugaaa

SEQ ID NO: 12316 - RNA, 17 nt, Homo sapiens
ucgccuccuccucuccc

SEQ ID NO: 12317 - RNA, 22 nt, Homo sapiens
uguaacagcaacuccaugugga

SEQ ID NO: 12318 - RNA, 22 nt, Homo sapiens
cauugcacuugucucggucuga

SEQ ID NO: 12319 - RNA, 23 nt, Homo sapiens
ugagcgccucgacgacagagccg

SEQ ID NO: 12320 - RNA, 22 nt, Homo sapiens
aauugcacgguauccaucugua

SEQ ID NO: 12321 - RNA, 25 nt, Homo sapiens
aggggugguguugggacagcuccgu

SEQ ID NO: 12322 - RNA, 21 nt, Homo sapiens
ggcuagcaacagcgcuuaccu

SEQ ID NO: 12323 - RNA, 22 nt, Homo sapiens
gucccucuccaaaugugucuug

SEQ ID NO: 12324 - RNA, 22 nt, Homo sapiens
acuccagccccacagccucagc

SEQ ID NO: 12325 - RNA, 20 nt, Homo sapiens
ggggagcuguggaagcagua

SEQ ID NO: 12326 - RNA, 21 nt, Homo sapiens
gcccuccgcccgugcaccccg

SEQ ID NO: 12327 - RNA, 23 nt, Homo sapiens
ugaguaccgccaugucuguuggg

SEQ ID NO: 12328 - RNA, 22 nt, Homo sapiens
cauugcacuugucucggucuga

SEQ ID NO: 12329 - RNA, 19 nt, Homo sapiens
aggcugcggaauucaggac

SEQ ID NO: 12330 - RNA, 25 nt, Homo sapiens
ggcggagggaaguagguccguuggu

SEQ ID NO: 12331 - RNA, 21 nt, Homo sapiens
ucccacguuguggcccagcag

SEQ ID NO: 12332 - RNA, 20 nt, Homo sapiens
accaggaggcugaggccccu

SEQ ID NO: 12333 - RNA, 23 nt, Homo sapiens
cgggucggaguuagcucaagcgg

SEQ ID NO: 12334 - RNA, 22 nt, Homo sapiens
auccgcgcucugacucucugcc

SEQ ID NO: 12335 - RNA, 21 nt, Homo sapiens
uggcagggaggcugggagggg

SEQ ID NO: 12336 - RNA, 22 nt, Homo sapiens
uggagugugacaaugguguuug

SEQ ID NO: 12337 - RNA, 21 nt, Homo sapiens
uccugcgcgucccagaugccc

SEQ ID NO: 12338 - RNA, 18 nt, Homo sapiens
uccagugcccuccucucc

SEQ ID NO: 12339 - RNA, 23 nt, Homo sapiens
ugaguaccgccaugucuguuggg

SEQ ID NO: 12340 - RNA, 22 nt, Homo sapiens
cauugcacuugucucggucuga

SEQ ID NO: 12341 - RNA, 22 nt, Homo sapiens
cauugcacuugucucggucuga

SEQ ID NO: 12342 - RNA, 23 nt, Homo sapiens
ucccccaggugugauucugauuu

SEQ ID NO: 12343 - RNA, 25 nt, Homo sapiens
ggcggagggaaguagguccguuggu

SEQ ID NO: 12344 - RNA, 25 nt, Homo sapiens
ggcggagggaaguagguccguuggu

SEQ ID NO: 12345 - RNA, 23 nt, Homo sapiens
aggaagcccuggaggggcuggag

SEQ ID NO: 12346 - RNA, 21 nt, Homo sapiens
aaggcagggcccccgcucccc

SEQ ID NO: 12347 - RNA, 18 nt, Homo sapiens
uugagaaggaggcugcug

SEQ ID NO: 12348 - RNA, 21 nt, Homo sapiens
uaccacaggguagaaccacgg

SEQ ID NO: 12349 - RNA, 21 nt, Homo sapiens
ugacaacuauggaugagcucu

SEQ ID NO: 12350 - RNA, 22 nt, Homo sapiens
caaucacuaacuccacugccau

SEQ ID NO: 12351 - RNA, 21 nt, Homo sapiens
uaauuuuauguauaagcuagu

SEQ ID NO: 12352 - RNA, 21 nt, Homo sapiens
uaauuuuauguauaagcuagu

SEQ ID NO: 12353 - RNA, 17 nt, Homo sapiens
ucucgcuggggccucca

SEQ ID NO: 12354 - RNA, 23 nt, Homo sapiens
ucaaaugcucagacuccuguggu

SEQ ID NO: 12355 - RNA, 20 nt, Homo sapiens
ugagcccuguccucccgcag

SEQ ID NO: 12356 - RNA, 18 nt, Homo sapiens
cagggaggugaaugugau

SEQ ID NO: 12357 - RNA, 21 nt, Homo sapiens
gcccuccgcccgugcaccccg

SEQ ID NO: 12358 - RNA, 22 nt, Homo sapiens
uggacggagaacugauaagggu

SEQ ID NO: 12359 - RNA, 21 nt, Homo sapiens
agcuacaucuggcuacugggu

SEQ ID NO: 12360 - RNA, 23 nt, Homo sapiens
ugucugcccgcaugccugccucu

SEQ ID NO: 12361 - RNA, 19 nt, Homo sapiens
ugucucugcugggguuucu

SEQ ID NO: 12362 - RNA, 20 nt, Homo sapiens
ucugcaggguuugcuuugag

SEQ ID NO: 12363 - RNA, 17 nt, Homo sapiens
uucaaguaauucaggug

SEQ ID NO: 12364 - RNA, 22 nt, Homo sapiens
uucaaguaauccaggauaggcu

SEQ ID NO: 12365 - RNA, 21 nt, Homo sapiens
uucaaguaauucaggauaggu

SEQ ID NO: 12366 - RNA, 22 nt, Homo sapiens
ugauugguacgucuguggguag

SEQ ID NO: 12367 - RNA, 23 nt, Homo sapiens
uaaaucccauggugccuucuccu

SEQ ID NO: 12368 - RNA, 22 nt, Homo sapiens
uaugucugcugaccaucaccuu

SEQ ID NO: 12369 - RNA, 23 nt, Homo sapiens
uauucauuuauccccagccuaca

SEQ ID NO: 12370 - RNA, 20 nt, Homo sapiens
agaccauggguucucauugu

SEQ ID NO: 12371 - RNA, 22 nt, Homo sapiens
uggagugugacaaugguguuug

SEQ ID NO: 12372 - RNA, 22 nt, Homo sapiens
aaauuauuguacaucggaugag

SEQ ID NO: 12373 - RNA, 23 nt, Homo sapiens
ccugcagcgacuugauggcuucc

SEQ ID NO: 12374 - RNA, 20 nt, Homo sapiens
ucugcaggguuugcuuugag

SEQ ID NO: 12375 - RNA, 21 nt, Homo sapiens
uccuucugcuccgucccccag

SEQ ID NO: 12376 - RNA, 17 nt, Homo sapiens
ucgccuccuccucuccc

SEQ ID NO: 12377 - RNA, 20 nt, Homo sapiens
ccuccugcccuccuugcugu

SEQ ID NO: 12378 - RNA, 22 nt, Homo sapiens
cauugcacuugucucggucuga

SEQ ID NO: 12379 - RNA, 21 nt, Homo sapiens
acuggacuuggagucagaagg

SEQ ID NO: 12380 - RNA, 22 nt, Homo sapiens
acuggacuuagggucagaaggc

SEQ ID NO: 12381 - RNA, 22 nt, Homo sapiens
aggcaguguauuguuagcuggc

SEQ ID NO: 12382 - RNA, 23 nt, Homo sapiens
ggcagguucucacccucucuagg

SEQ ID NO: 12383 - RNA, 21 nt, Homo sapiens
uggaggagaaggaaggugaug

SEQ ID NO: 12384 - RNA, 23 nt, Homo sapiens
gcagcagagaauaggacuacguc

SEQ ID NO: 12385 - RNA, 22 nt, Homo sapiens
uggagugugacaaugguguuug

SEQ ID NO: 12386 - RNA, 22 nt, Homo sapiens
uucuggaauucugugugaggga

SEQ ID NO: 12387 - RNA, 22 nt, Homo sapiens
aagcccuuaccccaaaaagcau

SEQ ID NO: 12388 - RNA, 23 nt, Homo sapiens
ucuggcuccgugucuucacuccc

SEQ ID NO: 12389 - RNA, 21 nt, Homo sapiens
cggcggggacggcgauugguc

SEQ ID NO: 12390 - RNA, 23 nt, Homo sapiens
ugaguaccgccaugucuguuggg

SEQ ID NO: 12391 - RNA, 22 nt, Homo sapiens
cucccacugcuucacuugacua

SEQ ID NO: 12392 - RNA, 22 nt, Homo sapiens
cauugcacuugucucggucuga

SEQ ID NO: 12393 - RNA, 23 nt, Homo sapiens
ucccccaggugugauucugauuu

SEQ ID NO: 12394 - RNA, 21 nt, Homo sapiens
ucacuccucuccucccgucuu

SEQ ID NO: 12395 - RNA, 22 nt, Homo sapiens
cgucaacacuugcugguuuccu

SEQ ID NO: 12396 - RNA, 24 nt, Homo sapiens
acugggggcuuucgggcucugcgu

SEQ ID NO: 12397 - RNA, 22 nt, Homo sapiens
aggcggggcgccgcgggaccgc

SEQ ID NO: 12398 - RNA, 22 nt, Homo sapiens
ugcggggcuagggcuaacagca

SEQ ID NO: 12399 - RNA, 21 nt, Homo sapiens
uggaggagaaggaaggugaug

SEQ ID NO: 12400 - RNA, 20 nt, Homo sapiens
ggggagcuguggaagcagua

SEQ ID NO: 12401 - RNA, 18 nt, Homo sapiens
cgggcguggugguggggg

SEQ ID NO: 12402 - RNA, 21 nt, Homo sapiens
aagugaucuaaaggccuacau

SEQ ID NO: 12403 - RNA, 25 nt, Homo sapiens
cccccacaaccgcgcuugacuagcu

SEQ ID NO: 12404 - RNA, 22 nt, Homo sapiens
aguggggaacccuuccaugagg

SEQ ID NO: 12405 - RNA, 22 nt, Homo sapiens
ugugucacucgaugaccacugu

SEQ ID NO: 12406 - RNA, 25 nt, Homo sapiens
aggggugguguugggacagcuccgu

SEQ ID NO: 12407 - RNA, 23 nt, Homo sapiens
ucugcucauaccccaugguuucu

SEQ ID NO: 12408 - RNA, 20 nt, Homo sapiens
ggggagcuguggaagcagua

SEQ ID NO: 12409 - RNA, 23 nt, Homo sapiens
cggcccgggcugcugcuguuccu

SEQ ID NO: 12410 - RNA, 22 nt, Homo sapiens
gguccagaggggagauagguuc

SEQ ID NO: 12411 - RNA, 22 nt, Homo sapiens
uauguaauaugguccacaucuu

SEQ ID NO: 12412 - RNA, 23 nt, Homo sapiens
caaagcgcuucucuuuagagugu

SEQ ID NO: 12413 - RNA, 21 nt, Homo sapiens
cuccagagggaaguacuuucu

SEQ ID NO: 12414 - RNA, 21 nt, Homo sapiens
cuccagagggaugcacuuucu

SEQ ID NO: 12415 - RNA, 19 nt, Homo sapiens
agguugacauacguuuccc

SEQ ID NO: 12416 - RNA, 21 nt, Homo sapiens
agaccuggcccagaccucagc

SEQ ID NO: 12417 - RNA, 23 nt, Homo sapiens
acuugggcacugaaacaaugucc

SEQ ID NO: 12418 - RNA, 22 nt, Homo sapiens
aggcggggcgccgcgggaccgc

SEQ ID NO: 12419 - RNA, 23 nt, Homo sapiens
ugucacucggcucggcccacuac

SEQ ID NO: 12420 - RNA, 23 nt, Homo sapiens
cacccggcugugugcacaugugc

SEQ ID NO: 12421 - RNA, 21 nt, Homo sapiens
ucguggccuggucuccauuau

SEQ ID NO: 12422 - RNA, 22 nt, Homo sapiens
ugagccccugugccgcccccag

SEQ ID NO: 12423 - RNA, 18 nt, Homo sapiens
ugaggcaguagauugaau

SEQ ID NO: 12424 - RNA, 22 nt, Homo sapiens
ucugcccccuccgcugcugcca

SEQ ID NO: 12425 - RNA, 20 nt, Homo sapiens
acugccccaggugcugcugg

SEQ ID NO: 12426 - RNA, 21 nt, Homo sapiens
cggggcagcucaguacaggau

SEQ ID NO: 12427 - RNA, 23 nt, Homo sapiens
uggugcggagagggcccacagug

SEQ ID NO: 12428 - RNA, 22 nt, Homo sapiens
ugcggggcuagggcuaacagca

SEQ ID NO: 12429 - RNA, 22 nt, Homo sapiens
aggcagcgggguguaguggaua

SEQ ID NO: 12430 - RNA, 21 nt, Homo sapiens
aaggcagggcccccgcucccc

SEQ ID NO: 12431 - RNA, 23 nt, Homo sapiens
cacccggcugugugcacaugugc

SEQ ID NO: 12432 - RNA, 24 nt, Homo sapiens
agccuggaagcuggagccugcagu

SEQ ID NO: 12433 - RNA, 23 nt, Homo sapiens
ucuggcuccgugucuucacuccc

SEQ ID NO: 12434 - RNA, 22 nt, Homo sapiens
ucaggccaggcacaguggcuca

SEQ ID NO: 12435 - RNA, 21 nt, Homo sapiens
acuggacuuggagucagaagg

SEQ ID NO: 12436 - RNA, 23 nt, Homo sapiens
uacuccagagggcgucacucaug

SEQ ID NO: 12437 - RNA, 25 nt, Homo sapiens
aggggugguguugggacagcuccgu

SEQ ID NO: 12438 - RNA, 22 nt, Homo sapiens
gguggcccggccgugccugagg

SEQ ID NO: 12439 - RNA, 22 nt, Homo sapiens
ugagaacugaauuccauggguu

SEQ ID NO: 12440 - RNA, 22 nt, Homo sapiens
uggcaguguauuguuagcuggu

SEQ ID NO: 12441 - RNA, 22 nt, Homo sapiens
auauaauacaaccugcuaagug

SEQ ID NO: 12442 - RNA, 21 nt, Homo sapiens
aagccugcccggcuccucggg

SEQ ID NO: 12443 - RNA, 22 nt, Homo sapiens
aggcagcgggguguaguggaua

SEQ ID NO: 12444 - RNA, 21 nt, Homo sapiens
uggcagggaggcugggagggg

SEQ ID NO: 12445 - RNA, 22 nt, Homo sapiens
uucuggaauucugugugaggga

SEQ ID NO: 12446 - RNA, 22 nt, Homo sapiens
aagcccuuaccccaaaaagcau

SEQ ID NO: 12447 - RNA, 22 nt, Homo sapiens
cgcaggggccgggugcucaccg

SEQ ID NO: 12448 - RNA, 22 nt, Homo sapiens
agucauuggaggguuugagcag

SEQ ID NO: 12449 - RNA, 21 nt, Homo sapiens
cgcgggugcuuacugacccuu

SEQ ID NO: 12450 - RNA, 21 nt, Homo sapiens
gcccuccgcccgugcaccccg

SEQ ID NO: 12451 - RNA, 21 nt, Homo sapiens
cggcggggacggcgauugguc

SEQ ID NO: 12452 - RNA, 22 nt, Homo sapiens
aagcugccaguugaagaacugu

SEQ ID NO: 12453 - RNA, 22 nt, Homo sapiens
uuauaaagcaaugagacugauu

SEQ ID NO: 12454 - RNA, 23 nt, Homo sapiens
uucucgaggaaagaagcacuuuc

SEQ ID NO: 12455 - RNA, 25 nt, Homo sapiens
ggcggagggaaguagguccguuggu

SEQ ID NO: 12456 - RNA, 22 nt, Homo sapiens
aggcggggcgccgcgggaccgc

SEQ ID NO: 12457 - RNA, 22 nt, Homo sapiens
ugcggggcuagggcuaacagca

SEQ ID NO: 12458 - RNA, 21 nt, Homo sapiens
uaggacacauggucuacuucu

SEQ ID NO: 12459 - RNA, 18 nt, Homo sapiens
uugagaaggaggcugcug

SEQ ID NO: 12460 - RNA, 18 nt, Homo sapiens
gcaugggugguucagugg

SEQ ID NO: 12461 - RNA, 23 nt, Homo sapiens
ucuggcuccgugucuucacuccc

SEQ ID NO: 12462 - RNA, 18 nt, Homo sapiens
ugaggcaguagauugaau

SEQ ID NO: 12463 - RNA, 23 nt, Homo sapiens
uaaggugcaucuagugcagauag

SEQ ID NO: 12464 - RNA, 20 nt, Homo sapiens
ccuccugcccuccuugcugu

SEQ ID NO: 12465 - RNA, 21 nt, Homo sapiens
ucccacguuguggcccagcag

SEQ ID NO: 12466 - RNA, 21 nt, Homo sapiens
ccgucgccgccacccgagccg

SEQ ID NO: 12467 - RNA, 22 nt, Homo sapiens
ucggccugaccacccaccccac

SEQ ID NO: 12468 - RNA, 23 nt, Homo sapiens
cggcccgggcugcugcuguuccu

SEQ ID NO: 12469 - RNA, 22 nt, Homo sapiens
aaaagcuggguugagagggcga

SEQ ID NO: 12470 - RNA, 22 nt, Homo sapiens
aaaagcuggguugagagggcaa

SEQ ID NO: 12471 - RNA, 20 nt, Homo sapiens
aaaagcuggguugagagggu

SEQ ID NO: 12472 - RNA, 19 nt, Homo sapiens
aaaagcuggguugagagga

SEQ ID NO: 12473 - RNA, 19 nt, Homo sapiens
aggcugcggaauucaggac

SEQ ID NO: 12474 - RNA, 23 nt, Homo sapiens
cacccggcugugugcacaugugc

SEQ ID NO: 12475 - RNA, 23 nt, Homo sapiens
ucuggcuccgugucuucacuccc

SEQ ID NO: 12476 - RNA, 22 nt, Homo sapiens
cauugcacuugucucggucuga

SEQ ID NO: 12477 - RNA, 21 nt, Homo sapiens
agggcccccccucaauccugu

SEQ ID NO: 12478 - RNA, 22 nt, Homo sapiens
agaggcuggccgugaugaauuc

SEQ ID NO: 12479 - RNA, 23 nt, Homo sapiens
uagcagcgggaacaguucugcag

SEQ ID NO: 12480 - RNA, 19 nt, Homo sapiens
aggcugcggaauucaggac

SEQ ID NO: 12481 - RNA, 21 nt, Homo sapiens
uggcagggaggcugggagggg

SEQ ID NO: 12482 - RNA, 22 nt, Homo sapiens
uggagagaaaggcaguuccuga

SEQ ID NO: 12483 - RNA, 21 nt, Homo sapiens
cggcggggacggcgauugguc

SEQ ID NO: 12484 - RNA, 23 nt, Homo sapiens
ugagcgccucgacgacagagccg

SEQ ID NO: 12485 - RNA, 19 nt, Homo sapiens
aggcugcggaauucaggac

SEQ ID NO: 12486 - RNA, 22 nt, Homo sapiens
aggcggggcgccgcgggaccgc

SEQ ID NO: 12487 - RNA, 22 nt, Homo sapiens
ugcggggcuagggcuaacagca

SEQ ID NO: 12488 - RNA, 22 nt, Homo sapiens
caaagugccucccuuuagagug

SEQ ID NO: 12489 - RNA, 24 nt, Homo sapiens
uggggagcugaggcucugggggug

SEQ ID NO: 12490 - RNA, 21 nt, Homo sapiens
ccgucgccgccacccgagccg

SEQ ID NO: 12491 - RNA, 22 nt, Homo sapiens
uggacggagaacugauaagggu

SEQ ID NO: 12492 - RNA, 21 nt, Homo sapiens
aucacauugccagggauuucc

SEQ ID NO: 12493 - RNA, 21 nt, Homo sapiens
aucacauugccagggauuacc

SEQ ID NO: 12494 - RNA, 22 nt, Homo sapiens
ugaaggucuacugugugccagg

SEQ ID NO: 12495 - RNA, 19 nt, Homo sapiens
ugagcugcuguaccaaaau

SEQ ID NO: 12496 - RNA, 19 nt, Homo sapiens
aagcagcugccucugaggc

SEQ ID NO: 12497 - RNA, 22 nt, Homo sapiens
uauugcacucgucccggccucc

SEQ ID NO: 12498 - RNA, 17 nt, Homo sapiens
gugggggagaggcuguc

SEQ ID NO: 12499 - RNA, 18 nt, Homo sapiens
cagggaggugaaugugau

SEQ ID NO: 12500 - RNA, 21 nt, Homo sapiens
gcccuccgcccgugcaccccg

SEQ ID NO: 12501 - RNA, 21 nt, Homo sapiens
cggcggggacggcgauugguc

SEQ ID NO: 12502 - RNA, 20 nt, Homo sapiens
guccgcucggcgguggccca

SEQ ID NO: 12503 - RNA, 22 nt, Homo sapiens
gucccucuccaaaugugucuug

SEQ ID NO: 12504 - RNA, 22 nt, Homo sapiens
aggcggggcgccgcgggaccgc

SEQ ID NO: 12505 - RNA, 24 nt, Homo sapiens
uggggagcugaggcucugggggug

SEQ ID NO: 12506 - RNA, 18 nt, Homo sapiens
cgggcguggugguggggg

SEQ ID NO: 12507 - RNA, 21 nt, Homo sapiens
uccugcgcgucccagaugccc

SEQ ID NO: 12508 - RNA, 21 nt, Homo sapiens
cggcggggacggcgauugguc

SEQ ID NO: 12509 - RNA, 22 nt, Homo sapiens
cgcaggggccgggugcucaccg

SEQ ID NO: 12510 - RNA, 22 nt, Homo sapiens
cauugcacuugucucggucuga

SEQ ID NO: 12511 - RNA, 22 nt, Homo sapiens
aggcggggcgccgcgggaccgc

SEQ ID NO: 12512 - RNA, 22 nt, Homo sapiens
ugcggggcuagggcuaacagca

SEQ ID NO: 12513 - RNA, 22 nt, Homo sapiens
aggcagcgggguguaguggaua

SEQ ID NO: 12514 - RNA, 23 nt, Homo sapiens
uaaggugcaucuagugcaguuag

SEQ ID NO: 12515 - RNA, 21 nt, Homo sapiens
cggcggggacggcgauugguc

SEQ ID NO: 12516 - RNA, 21 nt, Homo sapiens
caagucacuagugguuccguu

SEQ ID NO: 12517 - RNA, 22 nt, Homo sapiens
aggcggggcgccgcgggaccgc

SEQ ID NO: 12518 - RNA, 23 nt, Homo sapiens
uggugcggagagggcccacagug

SEQ ID NO: 12519 - RNA, 22 nt, Homo sapiens
ugcggggcuagggcuaacagca

SEQ ID NO: 12520 - RNA, 23 nt, Homo sapiens
ucugcucauaccccaugguuucu

SEQ ID NO: 12521 - RNA, 21 nt, Homo sapiens
cgcgggugcuuacugacccuu

SEQ ID NO: 12522 - RNA, 21 nt, Homo sapiens
uaaagugcugacagugcagau

SEQ ID NO: 12523 - RNA, 17 nt, Homo sapiens
ucccaccgcugccaccc

SEQ ID NO: 12524 - RNA, 22 nt, Homo sapiens
acagcaggcacagacaggcagu

SEQ ID NO: 12525 - RNA, 22 nt, Homo sapiens
gccugcugggguggaaccuggu

SEQ ID NO: 12526 - RNA, 19 nt, Homo sapiens
aggcugcggaauucaggac

SEQ ID NO: 12527 - RNA, 22 nt, Homo sapiens
ugugcgcagggagaccucuccc

SEQ ID NO: 12528 - RNA, 22 nt, Homo sapiens
ugugcgcagggagaccucuccc

SEQ ID NO: 12529 - RNA, 18 nt, Homo sapiens
ucagcuggcccucauuuc

SEQ ID NO: 12530 - RNA, 22 nt, Homo sapiens
uggagugugacaaugguguuug

SEQ ID NO: 12531 - RNA, 20 nt, Homo sapiens
ccccagggcgacgcggcggg

SEQ ID NO: 12532 - RNA, 23 nt, Homo sapiens
ucucacacagaaaucgcacccgu

SEQ ID NO: 12533 - RNA, 22 nt, Homo sapiens
aucacacaaaggcaacuuuugu

SEQ ID NO: 12534 - RNA, 22 nt, Homo sapiens
caagaaccucaguugcuuuugu

SEQ ID NO: 12535 - RNA, 21 nt, Homo sapiens
cuucuugugcucuaggauugu

SEQ ID NO: 12536 - RNA, 21 nt, Homo sapiens
agagaagaagaucagccugca

SEQ ID NO: 12537 - RNA, 18 nt, Homo sapiens
uugagaaggaggcugcug

SEQ ID NO: 12538 - RNA, 22 nt, Homo sapiens
ucucccaacccuuguaccagug

SEQ ID NO: 12539 - RNA, 22 nt, Homo sapiens
caaagaauucuccuuuugggcu

SEQ ID NO: 12540 - RNA, 21 nt, Homo sapiens
caagucacuagugguuccguu

SEQ ID NO: 12541 - RNA, 22 nt, Homo sapiens
uguaaacauccuacacucagcu

SEQ ID NO: 12542 - RNA, 21 nt, Homo sapiens
ucacuccucuccucccgucuu

SEQ ID NO: 12543 - RNA, 22 nt, Homo sapiens
aaacauucgcggugcacuucuu

SEQ ID NO: 12544 - RNA, 23 nt, Homo sapiens
aggaagcccuggaggggcuggag

SEQ ID NO: 12545 - RNA, 21 nt, Homo sapiens
uggaggagaaggaaggugaug

SEQ ID NO: 12546 - RNA, 20 nt, Homo sapiens
guagaggagauggcgcaggg

SEQ ID NO: 12547 - RNA, 22 nt, Homo sapiens
ucgugucuuguguugcagccgg

SEQ ID NO: 12548 - RNA, 21 nt, Homo sapiens
cggcggggacggcgauugguc

SEQ ID NO: 12549 - RNA, 22 nt, Homo sapiens
aggcggggcgccgcgggaccgc

SEQ ID NO: 12550 - RNA, 22 nt, Homo sapiens
uggagugugacaaugguguuug

SEQ ID NO: 12551 - RNA, 18 nt, Homo sapiens
uugagaaggaggcugcug

SEQ ID NO: 12552 - RNA, 21 nt, Homo sapiens
auguaugugugcaugugcaug

SEQ ID NO: 12553 - RNA, 24 nt, Homo sapiens
aauccuuggaaccuaggugugagu

SEQ ID NO: 12554 - RNA, 23 nt, Homo sapiens
uucauuugguauaaaccgcgauu

SEQ ID NO: 12555 - RNA, 23 nt, Homo sapiens
aucccuugcaggggcuguugggu

SEQ ID NO: 12556 - RNA, 23 nt, Homo sapiens
ugucacucggcucggcccacuac

SEQ ID NO: 12557 - RNA, 21 nt, Homo sapiens
uccuucugcuccgucccccag

SEQ ID NO: 12558 - RNA, 22 nt, Homo sapiens
agaaggaaauugaauucauuua

SEQ ID NO: 12559 - RNA, 18 nt, Homo sapiens
uccagugcccuccucucc

SEQ ID NO: 12560 - RNA, 22 nt, Homo sapiens
uggagagaaaggcaguuccuga

SEQ ID NO: 12561 - RNA, 23 nt, Homo sapiens
caacggaaucccaaaagcagcug

SEQ ID NO: 12562 - RNA, 22 nt, Homo sapiens
ugggucuuugcgggcgagauga

SEQ ID NO: 12563 - RNA, 23 nt, Homo sapiens
uaauacugccggguaaugaugga

SEQ ID NO: 12564 - RNA, 21 nt, Homo sapiens
ccaccaccgugucugacacuu

SEQ ID NO: 12565 - RNA, 22 nt, Homo sapiens
uguaaacauccucgacuggaag

SEQ ID NO: 12566 - RNA, 22 nt, Homo sapiens
uguaaacauccccgacuggaag

SEQ ID NO: 12567 - RNA, 22 nt, Homo sapiens
uguaaacauccuugacuggaag

SEQ ID NO: 12568 - RNA, 23 nt, Homo sapiens
aagugccgccaucuuuugagugu

SEQ ID NO: 12569 - RNA, 21 nt, Homo sapiens
auccuugcuaucugggugcua

SEQ ID NO: 12570 - RNA, 23 nt, Homo sapiens
agugccugagggaguaagagccc

SEQ ID NO: 12571 - RNA, 21 nt, Homo sapiens
aggguaagcugaaccucugau

SEQ ID NO: 12572 - RNA, 23 nt, Homo sapiens
aguauguucuuccaggacagaac

SEQ ID NO: 12573 - RNA, 21 nt, Homo sapiens
guggcugcacucacuuccuuc

SEQ ID NO: 12574 - RNA, 21 nt, Homo sapiens
ccuggaaacacugagguugug

SEQ ID NO: 12575 - RNA, 22 nt, Homo sapiens
ccucuuccccuugucucuccag

SEQ ID NO: 12576 - RNA, 23 nt, Homo sapiens
cuggagauauggaagagcugugu

SEQ ID NO: 12577 - RNA, 22 nt, Homo sapiens
caaucacuaacuccacugccau

SEQ ID NO: 12578 - RNA, 22 nt, Homo sapiens
aaucacuaaccacacggccagg

SEQ ID NO: 12579 - RNA, 22 nt, Homo sapiens
aacuguuugcagaggaaacuga

SEQ ID NO: 12580 - RNA, 21 nt, Homo sapiens
uugaaaggcuauuucuugguc

SEQ ID NO: 12581 - RNA, 20 nt, Homo sapiens
auggagauagauauagaaau

SEQ ID NO: 12582 - RNA, 22 nt, Homo sapiens
acuccagccccacagccucagc

SEQ ID NO: 12583 - RNA, 20 nt, Homo sapiens
guagaggagauggcgcaggg

SEQ ID NO: 12584 - RNA, 21 nt, Homo sapiens
agaggauacccuuuguauguu

SEQ ID NO: 12585 - RNA, 22 nt, Homo sapiens
ccucuuccccuugucucuccag

SEQ ID NO: 12586 - RNA, 23 nt, Homo sapiens
caagucuuauuugagcaccuguu

SEQ ID NO: 12587 - RNA, 22 nt, Homo sapiens
uggguggucuggagauuugugc

SEQ ID NO: 12588 - RNA, 21 nt, Homo sapiens
cugaccuaugaauugacagcc

SEQ ID NO: 12589 - RNA, 21 nt, Homo sapiens
augaccuaugaauugacagac

SEQ ID NO: 12590 - RNA, 24 nt, Homo sapiens
aauccuuggaaccuaggugugagu

SEQ ID NO: 12591 - RNA, 21 nt, Homo sapiens
acuggacuuggagucagaagg

SEQ ID NO: 12592 - RNA, 21 nt, Homo sapiens
auccuugcuaucugggugcua

SEQ ID NO: 12593 - RNA, 20 nt, Homo sapiens
guagaggagauggcgcaggg

SEQ ID NO: 12594 - RNA, 22 nt, Homo sapiens
ccucuuccccuugucucuccag

SEQ ID NO: 12595 - RNA, 22 nt, Homo sapiens
acucggcguggcgucggucgug

SEQ ID NO: 12596 - RNA, 18 nt, Homo sapiens
cagggaggugaaugugau

SEQ ID NO: 12597 - RNA, 22 nt, Homo sapiens
cucggcgcggggcgcgggcucc

SEQ ID NO: 12598 - RNA, 23 nt, Homo sapiens
ucuggcuccgugucuucacuccc

SEQ ID NO: 12599 - RNA, 22 nt, Homo sapiens
uuggggaaacggccgcugagug

SEQ ID NO: 12600 - RNA, 21 nt, Homo sapiens
gccccugggccuauccuagaa

SEQ ID NO: 12601 - RNA, 22 nt, Homo sapiens
ucaggcucaguccccucccgau

SEQ ID NO: 12602 - RNA, 22 nt, Homo sapiens
aguggggaacccuuccaugagg

SEQ ID NO: 12603 - RNA, 25 nt, Homo sapiens
aggggugguguugggacagcuccgu

SEQ ID NO: 12604 - RNA, 22 nt, Homo sapiens
uccgagccugggucucccucuu

SEQ ID NO: 12605 - RNA, 22 nt, Homo sapiens
gucccucuccaaaugugucuug

SEQ ID NO: 12606 - RNA, 24 nt, Homo sapiens
ugccugggucucuggccugcgcgu

SEQ ID NO: 12607 - RNA, 21 nt, Homo sapiens
uggaggagaaggaaggugaug

SEQ ID NO: 12608 - RNA, 20 nt, Homo sapiens
ggggagcuguggaagcagua

SEQ ID NO: 12609 - RNA, 21 nt, Homo sapiens
ucguggccuggucuccauuau

SEQ ID NO: 12610 - RNA, 22 nt, Homo sapiens
ugagccccugugccgcccccag

SEQ ID NO: 12611 - RNA, 18 nt, Homo sapiens
cgggcguggugguggggg

SEQ ID NO: 12612 - RNA, 24 nt, Homo sapiens
uuuggcaaugguagaacucacacu

SEQ ID NO: 12613 - RNA, 21 nt, Homo sapiens
cggcggggacggcgauugguc

SEQ ID NO: 12614 - RNA, 21 nt, Homo sapiens
cggcggggacggcgauugguc

SEQ ID NO: 12615 - RNA, 19 nt, Homo sapiens
agcugucugaaaaugucuu

SEQ ID NO: 12616 - RNA, 22 nt, Homo sapiens
aggcggggcgccgcgggaccgc

SEQ ID NO: 12617 - RNA, 22 nt, Homo sapiens
aggcggggcgccgcgggaccgc

SEQ ID NO: 12618 - RNA, 20 nt, Homo sapiens
accaggaggcugaggccccu

SEQ ID NO: 12619 - RNA, 22 nt, Homo sapiens
ugcggggcuagggcuaacagca

SEQ ID NO: 12620 - RNA, 22 nt, Homo sapiens
ugcggggcuagggcuaacagca

SEQ ID NO: 12621 - RNA, 22 nt, Homo sapiens
ugcaacuuaccugagucauuga

SEQ ID NO: 12622 - RNA, 22 nt, Homo sapiens
ccucuuccccuugucucuccag

SEQ ID NO: 12623 - RNA, 21 nt, Homo sapiens
gcccuccgcccgugcaccccg

SEQ ID NO: 12624 - RNA, 23 nt, Homo sapiens
ucuggcuccgugucuucacuccc

SEQ ID NO: 12625 - RNA, 21 nt, Homo sapiens
cggcggggacggcgauugguc

SEQ ID NO: 12626 - RNA, 19 nt, Homo sapiens
accgugcaaagguagcaua

SEQ ID NO: 12627 - RNA, 25 nt, Homo sapiens
ggcggagggaaguagguccguuggu

SEQ ID NO: 12628 - RNA, 22 nt, Homo sapiens
aggcggggcgccgcgggaccgc

SEQ ID NO: 12629 - RNA, 22 nt, Homo sapiens
auccgcgcucugacucucugcc

SEQ ID NO: 12630 - RNA, 21 nt, Homo sapiens
uugcucacuguucuucccuag

SEQ ID NO: 12631 - RNA, 22 nt, Homo sapiens
agaaggaaauugaauucauuua

SEQ ID NO: 12632 - RNA, 22 nt, Homo sapiens
uggagagaaaggcaguuccuga

SEQ ID NO: 12633 - RNA, 21 nt, Homo sapiens
cggcggggacggcgauugguc

SEQ ID NO: 12634 - RNA, 22 nt, Homo sapiens
cccugugcccggcccacuucug

SEQ ID NO: 12635 - RNA, 23 nt, Homo sapiens
uaagugcuuccauguuuugguga

SEQ ID NO: 12636 - RNA, 23 nt, Homo sapiens
uaagugcuuccauguuuuaguag

SEQ ID NO: 12637 - RNA, 23 nt, Homo sapiens
uaagugcuuccauguuucagugg

SEQ ID NO: 12638 - RNA, 23 nt, Homo sapiens
uaagugcuuccauguuugagugu

SEQ ID NO: 12639 - RNA, 17 nt, Homo sapiens
uaagugcuuccaugcuu

SEQ ID NO: 12640 - RNA, 20 nt, Homo sapiens
ccucugggcccuuccuccag

SEQ ID NO: 12641 - RNA, 22 nt, Homo sapiens
ucucugggccugugucuuaggc

SEQ ID NO: 12642 - RNA, 23 nt, Homo sapiens
ucccccaggugugauucugauuu

SEQ ID NO: 12643 - RNA, 23 nt, Homo sapiens
aaagugcugcgacauuugagcgu

SEQ ID NO: 12644 - RNA, 23 nt, Homo sapiens
gaagugcuucgauuuuggggugu

SEQ ID NO: 12645 - RNA, 23 nt, Homo sapiens
uagcagcgggaacaguucugcag

SEQ ID NO: 12646 - RNA, 22 nt, Homo sapiens
aagugcugucauagcugagguc

SEQ ID NO: 12647 - RNA, 22 nt, Homo sapiens
aaagugcuucccuuuggacugu

SEQ ID NO: 12648 - RNA, 21 nt, Homo sapiens
aaagugcuuccuuuuagaggg

SEQ ID NO: 12649 - RNA, 22 nt, Homo sapiens
aaagugcuuccuuuuagagggu

SEQ ID NO: 12650 - RNA, 22 nt, Homo sapiens
aaagugcuucucuuuggugggu

SEQ ID NO: 12651 - RNA, 21 nt, Homo sapiens
aaagugcuuccuuuuugaggg

SEQ ID NO: 12652 - RNA, 25 nt, Homo sapiens
aggggugguguugggacagcuccgu

SEQ ID NO: 12653 - RNA, 24 nt, Homo sapiens
acugggggcuuucgggcucugcgu

SEQ ID NO: 12654 - RNA, 22 nt, Homo sapiens
aggcggggcgccgcgggaccgc

SEQ ID NO: 12655 - RNA, 23 nt, Homo sapiens
aggaagcccuggaggggcuggag

SEQ ID NO: 12656 - RNA, 23 nt, Homo sapiens
ucugcucauaccccaugguuucu

SEQ ID NO: 12657 - RNA, 20 nt, Homo sapiens
ggggagcuguggaagcagua

SEQ ID NO: 12658 - RNA, 22 nt, Homo sapiens
ucuucucuguuuuggccaugug

SEQ ID NO: 12659 - RNA, 22 nt, Homo sapiens
acccgucccguucguccccgga

SEQ ID NO: 12660 - RNA, 17 nt, Homo sapiens
ucccaccgcugccaccc

SEQ ID NO: 12661 - RNA, 17 nt, Homo sapiens
ucgccuccuccucuccc

SEQ ID NO: 12662 - RNA, 22 nt, Homo sapiens
acucggcguggcgucggucgug

SEQ ID NO: 12663 - RNA, 23 nt, Homo sapiens
cggcccgggcugcugcuguuccu

SEQ ID NO: 12664 - RNA, 22 nt, Homo sapiens
uggagagaaaggcaguuccuga

SEQ ID NO: 12665 - RNA, 21 nt, Homo sapiens
cggcggggacggcgauugguc

SEQ ID NO: 12666 - RNA, 23 nt, Homo sapiens
ucggggaucaucaugucacgaga

SEQ ID NO: 12667 - RNA, 19 nt, Homo sapiens
gggcgccugugaucccaac

SEQ ID NO: 12668 - RNA, 22 nt, Homo sapiens
aggcggggcgccgcgggaccgc

SEQ ID NO: 12669 - RNA, 22 nt, Homo sapiens
ugcggggcuagggcuaacagca

SEQ ID NO: 12670 - RNA, 21 nt, Homo sapiens
uggaggagaaggaaggugaug

SEQ ID NO: 12671 - RNA, 20 nt, Homo sapiens
ggggagcuguggaagcagua

SEQ ID NO: 12672 - RNA, 22 nt, Homo sapiens
uauugcacucgucccggccucc

SEQ ID NO: 12673 - RNA, 21 nt, Homo sapiens
gugccagcugcagugggggag

SEQ ID NO: 12674 - RNA, 22 nt, Homo sapiens
uggagagaaaggcaguuccuga

SEQ ID NO: 12675 - RNA, 22 nt, Homo sapiens
uggcucaguucagcaggaacag

SEQ ID NO: 12676 - RNA, 22 nt, Homo sapiens
aauugcacuuuagcaaugguga

SEQ ID NO: 12677 - RNA, 22 nt, Homo sapiens
ugauugguacgucuguggguag

SEQ ID NO: 12678 - RNA, 20 nt, Homo sapiens
accaggaggcugaggccccu

SEQ ID NO: 12679 - RNA, 22 nt, Homo sapiens
ugcggggcuagggcuaacagca

SEQ ID NO: 12680 - RNA, 22 nt, Homo sapiens
ugcggggcuagggcuaacagca

SEQ ID NO: 12681 - RNA, 22 nt, Homo sapiens
auccgcgcucugacucucugcc

SEQ ID NO: 12682 - RNA, 23 nt, Homo sapiens
ucaaaugcucagacuccuguggu

SEQ ID NO: 12683 - RNA, 21 nt, Homo sapiens
aagugaucuaaaggccuacau

SEQ ID NO: 12684 - RNA, 21 nt, Homo sapiens
ucgaggagcucacagucuagu

SEQ ID NO: 12685 - RNA, 22 nt, Homo sapiens
uaaugccccuaaaaauccuuau

SEQ ID NO: 12686 - RNA, 20 nt, Homo sapiens
guccgcucggcgguggccca

SEQ ID NO: 12687 - RNA, 23 nt, Homo sapiens
uacccuguagauccgaauuugug

SEQ ID NO: 12688 - RNA, 22 nt, Homo sapiens
ccucuuccccuugucucuccag

SEQ ID NO: 12689 - RNA, 21 nt, Homo sapiens
gcccuccgcccgugcaccccg

SEQ ID NO: 12690 - RNA, 22 nt, Homo sapiens
uggagagaaaggcaguuccuga

SEQ ID NO: 12691 - RNA, 21 nt, Homo sapiens
cggcggggacggcgauugguc

SEQ ID NO: 12692 - RNA, 23 nt, Homo sapiens
caacggaaucccaaaagcagcug

SEQ ID NO: 12693 - RNA, 23 nt, Homo sapiens
ugaggggcagagagcgagacuuu

SEQ ID NO: 12694 - RNA, 22 nt, Homo sapiens
agaggcuggccgugaugaauuc

SEQ ID NO: 12695 - RNA, 22 nt, Homo sapiens
agaggcuggccgugaugaauuc

SEQ ID NO: 12696 - RNA, 21 nt, Homo sapiens
auccuugcuaucugggugcua

SEQ ID NO: 12697 - RNA, 20 nt, Homo sapiens
agaccauggguucucauugu

SEQ ID NO: 12698 - RNA, 19 nt, Homo sapiens
aggcugcggaauucaggac

SEQ ID NO: 12699 - RNA, 22 nt, Homo sapiens
aggcggggcgccgcgggaccgc

SEQ ID NO: 12700 - RNA, 22 nt, Homo sapiens
ugcggggcuagggcuaacagca

SEQ ID NO: 12701 - RNA, 22 nt, Homo sapiens
acuccagccccacagccucagc

SEQ ID NO: 12702 - RNA, 20 nt, Homo sapiens
ggggagcuguggaagcagua

SEQ ID NO: 12703 - RNA, 22 nt, Homo sapiens
ugugcgcagggagaccucuccc

SEQ ID NO: 12704 - RNA, 22 nt, Homo sapiens
gguccagaggggagauagguuc

SEQ ID NO: 12705 - RNA, 21 nt, Homo sapiens
ccaccaccgugucugacacuu

SEQ ID NO: 12706 - RNA, 21 nt, Homo sapiens
aucauagaggaaaauccacgu

SEQ ID NO: 12707 - RNA, 22 nt, Homo sapiens
aucauagaggaaaauccauguu

SEQ ID NO: 12708 - RNA, 19 nt, Homo sapiens
aggcugcggaauucaggac

SEQ ID NO: 12709 - RNA, 25 nt, Homo sapiens
aggggugguguugggacagcuccgu

SEQ ID NO: 12710 - RNA, 23 nt, Homo sapiens
aaacucuacuuguccuucugagu

SEQ ID NO: 12711 - RNA, 21 nt, Homo sapiens
guggcugcacucacuuccuuc

SEQ ID NO: 12712 - RNA, 20 nt, Homo sapiens
ggggagcuguggaagcagua

SEQ ID NO: 12713 - RNA, 21 nt, Homo sapiens
uuaggccgcagaucuggguga

SEQ ID NO: 12714 - RNA, 23 nt, Homo sapiens
ugaggggcagagagcgagacuuu

SEQ ID NO: 12715 - RNA, 23 nt, Homo sapiens
gaacgcgcuucccuauagagggu

SEQ ID NO: 12716 - RNA, 19 nt, Homo sapiens
aggcugcggaauucaggac

SEQ ID NO: 12717 - RNA, 22 nt, Homo sapiens
uggugguuuacaaaguaauuca

SEQ ID NO: 12718 - RNA, 22 nt, Homo sapiens
augggugaauuuguagaaggau

SEQ ID NO: 12719 - RNA, 23 nt, Homo sapiens
uauggcuuuuuauuccuauguga

SEQ ID NO: 12720 - RNA, 23 nt, Homo sapiens
caaagugcuuacagugcagguag

SEQ ID NO: 12721 - RNA, 22 nt, Homo sapiens
uacccagagcaugcagugugaa

SEQ ID NO: 12722 - RNA, 22 nt, Homo sapiens
uuggggaaacggccgcugagug

SEQ ID NO: 12723 - RNA, 21 nt, Homo sapiens
aggggugcuaucugugauuga

SEQ ID NO: 12724 - RNA, 23 nt, Homo sapiens
ucccccaggugugauucugauuu

SEQ ID NO: 12725 - RNA, 22 nt, Homo sapiens
uacugcagacguggcaaucaug

SEQ ID NO: 12726 - RNA, 21 nt, Homo sapiens
uacugcagacaguggcaauca

SEQ ID NO: 12727 - RNA, 22 nt, Homo sapiens
aagugcugucauagcugagguc

SEQ ID NO: 12728 - RNA, 21 nt, Homo sapiens
uuggccacaauggguuagaac

SEQ ID NO: 12729 - RNA, 24 nt, Homo sapiens
acugggggcuuucgggcucugcgu

SEQ ID NO: 12730 - RNA, 24 nt, Homo sapiens
ugccugggucucuggccugcgcgu

SEQ ID NO: 12731 - RNA, 23 nt, Homo sapiens
uuuggcacuagcacauuuuugcu

SEQ ID NO: 12732 - RNA, 21 nt, Homo sapiens
ugcaggaccaagaugagcccu

SEQ ID NO: 12733 - RNA, 21 nt, Homo sapiens
uggacugcccugaucuggaga

SEQ ID NO: 12734 - RNA, 22 nt, Homo sapiens
cgcaggggccgggugcucaccg

SEQ ID NO: 12735 - RNA, 22 nt, Homo sapiens
cucccacugcuucacuugacua

SEQ ID NO: 12736 - RNA, 23 nt, Homo sapiens
agcuacauugucugcuggguuuc

SEQ ID NO: 12737 - RNA, 21 nt, Homo sapiens
aggggugcuaucugugauuga

SEQ ID NO: 12738 - RNA, 22 nt, Homo sapiens
uugggaucauuuugcauccaua

SEQ ID NO: 12739 - RNA, 22 nt, Homo sapiens
ggagaaauuauccuuggugugu

SEQ ID NO: 12740 - RNA, 21 nt, Homo sapiens
cacaagguauugguauuaccu

SEQ ID NO: 12741 - RNA, 23 nt, Homo sapiens
ggcagguucucacccucucuagg

SEQ ID NO: 12742 - RNA, 20 nt, Homo sapiens
accaggaggcugaggccccu

SEQ ID NO: 12743 - RNA, 23 nt, Homo sapiens
cugggaucuccggggucuugguu

SEQ ID NO: 12744 - RNA, 22 nt, Homo sapiens
ugagaccucuggguucugagcu

SEQ ID NO: 12745 - RNA, 21 nt, Homo sapiens
aaggcagggcccccgcucccc

SEQ ID NO: 12746 - RNA, 23 nt, Homo sapiens
ucaaaugcucagacuccuguggu

SEQ ID NO: 12747 - RNA, 22 nt, Homo sapiens
cuggacugagccgugcuacugg

SEQ ID NO: 12748 - RNA, 23 nt, Homo sapiens
uauggcuuuuuauuccuauguga

SEQ ID NO: 12749 - RNA, 23 nt, Homo sapiens
uauggcuuuucauuccuauguga

SEQ ID NO: 12750 - RNA, 23 nt, Homo sapiens
guguuaauuaaaccucuauuuac

SEQ ID NO: 12751 - RNA, 23 nt, Homo sapiens
uaagugcuuccauguuucagugg

SEQ ID NO: 12752 - RNA, 23 nt, Homo sapiens
gcaaagcacacggccugcagaga

SEQ ID NO: 12753 - RNA, 21 nt, Homo sapiens
gcaguccaugggcauauacac

SEQ ID NO: 12754 - RNA, 21 nt, Homo sapiens
aguuaaugaauccuggaaagu

SEQ ID NO: 12755 - RNA, 18 nt, Homo sapiens
gucccuguucaggcgcca

SEQ ID NO: 12756 - RNA, 22 nt, Homo sapiens
cugaagcucagagggcucugau

SEQ ID NO: 12757 - RNA, 20 nt, Homo sapiens
uaaagagcccuguggagaca

SEQ ID NO: 12758 - RNA, 18 nt, Homo sapiens
cagggaggugaaugugau

SEQ ID NO: 12759 - RNA, 23 nt, Homo sapiens
ucuggcuccgugucuucacuccc

SEQ ID NO: 12760 - RNA, 21 nt, Homo sapiens
cggcggggacggcgauugguc

SEQ ID NO: 12761 - RNA, 22 nt, Homo sapiens
cccugugcccggcccacuucug

SEQ ID NO: 12762 - RNA, 22 nt, Homo sapiens
aagcugccaguugaagaacugu

SEQ ID NO: 12763 - RNA, 22 nt, Homo sapiens
acacagggcuguugugaagacu

SEQ ID NO: 12764 - RNA, 21 nt, Homo sapiens
agggcccccccucaauccugu

SEQ ID NO: 12765 - RNA, 23 nt, Homo sapiens
ugaggggcagagagcgagacuuu

SEQ ID NO: 12766 - RNA, 22 nt, Homo sapiens
aacuguuugcagaggaaacuga

SEQ ID NO: 12767 - RNA, 23 nt, Homo sapiens
aggaccugcgggacaagauucuu

SEQ ID NO: 12768 - RNA, 22 nt, Homo sapiens
cgucaacacuugcugguuuccu

SEQ ID NO: 12769 - RNA, 22 nt, Homo sapiens
aggcggggcgccgcgggaccgc

SEQ ID NO: 12770 - RNA, 22 nt, Homo sapiens
ugcggggcuagggcuaacagca

SEQ ID NO: 12771 - RNA, 24 nt, Homo sapiens
uggggagcugaggcucugggggug

SEQ ID NO: 12772 - RNA, 18 nt, Homo sapiens
uugagaaggaggcugcug

SEQ ID NO: 12773 - RNA, 18 nt, Homo sapiens
acguuggcucugguggug

SEQ ID NO: 12774 - RNA, 23 nt, Homo sapiens
uaaggugcaucuagugcagauag

SEQ ID NO: 12775 - RNA, 22 nt, Homo sapiens
aagcugccaguugaagaacugu

SEQ ID NO: 12776 - RNA, 23 nt, Homo sapiens
ugagcgccucgacgacagagccg

SEQ ID NO: 12777 - RNA, 21 nt, Homo sapiens
acuggacuuggagucagaagg

SEQ ID NO: 12778 - RNA, 22 nt, Homo sapiens
acuggacuuagggucagaaggc

SEQ ID NO: 12779 - RNA, 22 nt, Homo sapiens
uucucaaggaggugucguuuau

SEQ ID NO: 12780 - RNA, 19 nt, Homo sapiens
ugagcugcuguaccaaaau

SEQ ID NO: 12781 - RNA, 22 nt, Homo sapiens
uccgagccugggucucccucuu

SEQ ID NO: 12782 - RNA, 23 nt, Homo sapiens
aucccuugcaggggcuguugggu

SEQ ID NO: 12783 - RNA, 20 nt, Homo sapiens
cggcucugggucugugggga

SEQ ID NO: 12784 - RNA, 22 nt, Homo sapiens
cugcccuggcccgagggaccga

SEQ ID NO: 12785 - RNA, 22 nt, Homo sapiens
ccucuuccccuugucucuccag

SEQ ID NO: 12786 - RNA, 17 nt, Homo sapiens
ucccaccgcugccaccc

SEQ ID NO: 12787 - RNA, 23 nt, Homo sapiens
ucuggcuccgugucuucacuccc

SEQ ID NO: 12788 - RNA, 21 nt, Homo sapiens
cggcggggacggcgauugguc

SEQ ID NO: 12789 - RNA, 22 nt, Homo sapiens
uggugggcacagaaucuggacu

SEQ ID NO: 12790 - RNA, 22 nt, Homo sapiens
uggugggccgcagaacaugugc

SEQ ID NO: 12791 - RNA, 22 nt, Homo sapiens
aggcggggcgccgcgggaccgc

SEQ ID NO: 12792 - RNA, 21 nt, Homo sapiens
uggaggagaaggaaggugaug

SEQ ID NO: 12793 - RNA, 20 nt, Homo sapiens
guagaggagauggcgcaggg

SEQ ID NO: 12794 - RNA, 23 nt, Homo sapiens
cgggucggaguuagcucaagcgg

SEQ ID NO: 12795 - RNA, 21 nt, Homo sapiens
cccggagccaggaugcagcuc

SEQ ID NO: 12796 - RNA, 18 nt, Homo sapiens
cgggcguggugguggggg

SEQ ID NO: 12797 - RNA, 22 nt, Homo sapiens
ugcuggaucagugguucgaguc

SEQ ID NO: 12798 - RNA, 22 nt, Homo sapiens
uccuucauuccaccggagucug

SEQ ID NO: 12799 - RNA, 21 nt, Homo sapiens
agggcccccccucaauccugu

SEQ ID NO: 12800 - RNA, 23 nt, Homo sapiens
ugagcgccucgacgacagagccg

SEQ ID NO: 12801 - RNA, 22 nt, Homo sapiens
ugauugguacgucuguggguag

SEQ ID NO: 12802 - RNA, 19 nt, Homo sapiens
gggcgccugugaucccaac

SEQ ID NO: 12803 - RNA, 24 nt, Homo sapiens
ugccugggucucuggccugcgcgu

SEQ ID NO: 12804 - RNA, 22 nt, Homo sapiens
ugcggggcuagggcuaacagca

SEQ ID NO: 12805 - RNA, 22 nt, Homo sapiens
ugcggggcuagggcuaacagca

SEQ ID NO: 12806 - RNA, 22 nt, Homo sapiens
aggcagcgggguguaguggaua

SEQ ID NO: 12807 - RNA, 21 nt, Homo sapiens
uaccacaggguagaaccacgg

SEQ ID NO: 12808 - RNA, 22 nt, Homo sapiens
gugugcggaaaugcuucugcua

SEQ ID NO: 12809 - RNA, 22 nt, Homo sapiens
gguccagaggggagauagguuc

SEQ ID NO: 12810 - RNA, 21 nt, Homo sapiens
ccacaccguaucugacacuuu

SEQ ID NO: 12811 - RNA, 23 nt, Homo sapiens
aucaacagacauuaauugggcgc

SEQ ID NO: 12812 - RNA, 22 nt, Homo sapiens
uggcaguguauuguuagcuggu

SEQ ID NO: 12813 - RNA, 22 nt, Homo sapiens
aacacaccugguuaaccucuuu

SEQ ID NO: 12814 - RNA, 23 nt, Homo sapiens
ucaagagcaauaacgaaaaaugu

SEQ ID NO: 12815 - RNA, 22 nt, Homo sapiens
aacacaccuauucaaggauuca

SEQ ID NO: 12816 - RNA, 23 nt, Homo sapiens
ugaggggcagagagcgagacuuu

SEQ ID NO: 12817 - RNA, 23 nt, Homo sapiens
aaugacacgaucacucccguuga

SEQ ID NO: 12818 - RNA, 23 nt, Homo sapiens
caaagcgcuucucuuuagagugu

SEQ ID NO: 12819 - RNA, 21 nt, Homo sapiens
cuccagagggaaguacuuucu

SEQ ID NO: 12820 - RNA, 21 nt, Homo sapiens
cuccagagggaugcacuuucu

SEQ ID NO: 12821 - RNA, 21 nt, Homo sapiens
caaagaggaaggucccauuac

SEQ ID NO: 12822 - RNA, 22 nt, Homo sapiens
uugugucaauaugcgaugaugu

SEQ ID NO: 12823 - RNA, 22 nt, Homo sapiens
uuuaggauaagcuugacuuuug

SEQ ID NO: 12824 - RNA, 21 nt, Homo sapiens
agagaagaagaucagccugca

SEQ ID NO: 12825 - RNA, 17 nt, Homo sapiens
ucgccuccuccucuccc

SEQ ID NO: 12826 - RNA, 22 nt, Homo sapiens
ucagugcacuacagaacuuugu

SEQ ID NO: 12827 - RNA, 22 nt, Homo sapiens
ucagugcaucacagaacuuugu

SEQ ID NO: 12828 - RNA, 21 nt, Homo sapiens
ucagugcaugacagaacuugg

SEQ ID NO: 12829 - RNA, 21 nt, Homo sapiens
uccugcgcgucccagaugccc

SEQ ID NO: 12830 - RNA, 20 nt, Homo sapiens
ccuccugcccuccuugcugu

SEQ ID NO: 12831 - RNA, 21 nt, Homo sapiens
agcuacaucuggcuacugggu

SEQ ID NO: 12832 - RNA, 22 nt, Homo sapiens
aggcagcgggguguaguggaua

SEQ ID NO: 12833 - RNA, 22 nt, Homo sapiens
ucuucucuguuuuggccaugug

SEQ ID NO: 12834 - RNA, 21 nt, Homo sapiens
uggacugcccugaucuggaga

SEQ ID NO: 12835 - RNA, 21 nt, Homo sapiens
uccugcgcgucccagaugccc

SEQ ID NO: 12836 - RNA, 21 nt, Homo sapiens
ccaguccugugccugccgccu

SEQ ID NO: 12837 - RNA, 22 nt, Homo sapiens
ugggucuuugcgggcgagauga

SEQ ID NO: 12838 - RNA, 21 nt, Homo sapiens
acuggacuuggagucagaagg

SEQ ID NO: 12839 - RNA, 23 nt, Homo sapiens
ucuuggaguaggucauugggugg

SEQ ID NO: 12840 - RNA, 21 nt, Homo sapiens
uccgguucucagggcuccacc

SEQ ID NO: 12841 - RNA, 23 nt, Homo sapiens
aggaagcccuggaggggcuggag

SEQ ID NO: 12842 - RNA, 21 nt, Homo sapiens
ucgaggagcucacagucuagu

SEQ ID NO: 12843 - RNA, 23 nt, Homo sapiens
cggcccgggcugcugcuguuccu

SEQ ID NO: 12844 - RNA, 23 nt, Homo sapiens
ugaguaccgccaugucuguuggg

SEQ ID NO: 12845 - RNA, 23 nt, Homo sapiens
ugaguaccgccaugucuguuggg

SEQ ID NO: 12846 - RNA, 19 nt, Homo sapiens
aggcugcggaauucaggac

SEQ ID NO: 12847 - RNA, 22 nt, Homo sapiens
uccgagccugggucucccucuu

SEQ ID NO: 12848 - RNA, 21 nt, Homo sapiens
uacaguacugugauaacugaa

SEQ ID NO: 12849 - RNA, 18 nt, Homo sapiens
aucccaccucugccacca

SEQ ID NO: 12850 - RNA, 22 nt, Homo sapiens
cgcaggggccgggugcucaccg

SEQ ID NO: 12851 - RNA, 21 nt, Homo sapiens
uucacaguggcuaaguucugc

SEQ ID NO: 12852 - RNA, 23 nt, Homo sapiens
gcaaagcacacggccugcagaga

SEQ ID NO: 12853 - RNA, 22 nt, Homo sapiens
auauaauacaaccugcuaagug

SEQ ID NO: 12854 - RNA, 22 nt, Homo sapiens
ccucccacacccaaggcuugca

SEQ ID NO: 12855 - RNA, 21 nt, Homo sapiens
uaauuuuauguauaagcuagu

SEQ ID NO: 12856 - RNA, 24 nt, Homo sapiens
uggggagcugaggcucugggggug

SEQ ID NO: 12857 - RNA, 23 nt, Homo sapiens
ucaaaugcucagacuccuguggu

SEQ ID NO: 12858 - RNA, 24 nt, Homo sapiens
uuuggcaaugguagaacucacacu

SEQ ID NO: 12859 - RNA, 22 nt, Homo sapiens
aacuggcccucaaagucccgcu

SEQ ID NO: 12860 - RNA, 21 nt, Homo sapiens
gugcauuguaguugcauugca

SEQ ID NO: 12861 - RNA, 22 nt, Homo sapiens
caaaaaccacaguuucuuuugc

SEQ ID NO: 12862 - RNA, 22 nt, Homo sapiens
agaaggaaauugaauucauuua

SEQ ID NO: 12863 - RNA, 22 nt, Homo sapiens
ucgugucuuguguugcagccgg

SEQ ID NO: 12864 - RNA, 22 nt, Homo sapiens
ucaggccaggcacaguggcuca

SEQ ID NO: 12865 - RNA, 22 nt, Homo sapiens
acagcaggcacagacaggcagu

SEQ ID NO: 12866 - RNA, 22 nt, Homo sapiens
gccugcugggguggaaccuggu

SEQ ID NO: 12867 - RNA, 21 nt, Homo sapiens
gugucuuuugcucugcaguca

SEQ ID NO: 12868 - RNA, 18 nt, Homo sapiens
ugcuuccuuucagagggu

SEQ ID NO: 12869 - RNA, 22 nt, Homo sapiens
aucuggagguaagaagcacuuu

SEQ ID NO: 12870 - RNA, 21 nt, Homo sapiens
aagccugcccggcuccucggg

SEQ ID NO: 12871 - RNA, 23 nt, Homo sapiens
aggaagcccuggaggggcuggag

SEQ ID NO: 12872 - RNA, 22 nt, Homo sapiens
ugcaacuuaccugagucauuga

SEQ ID NO: 12873 - RNA, 22 nt, Homo sapiens
aacccguagauccgaacuugug

SEQ ID NO: 12874 - RNA, 20 nt, Homo sapiens
ucugcaggguuugcuuugag

SEQ ID NO: 12875 - RNA, 22 nt, Homo sapiens
uggagugugacaaugguguuug

SEQ ID NO: 12876 - RNA, 21 nt, Homo sapiens
uggacugcccugaucuggaga

SEQ ID NO: 12877 - RNA, 22 nt, Homo sapiens
ucugcccccuccgcugcugcca

SEQ ID NO: 12878 - RNA, 24 nt, Homo sapiens
agcagaagcagggagguucuccca

SEQ ID NO: 12879 - RNA, 20 nt, Homo sapiens
acugccccaggugcugcugg

SEQ ID NO: 12880 - RNA, 21 nt, Homo sapiens
cggggcagcucaguacaggau

SEQ ID NO: 12881 - RNA, 22 nt, Homo sapiens
auucugcauuuuuagcaaguuc

SEQ ID NO: 12882 - RNA, 25 nt, Homo sapiens
ggcggagggaaguagguccguuggu

SEQ ID NO: 12883 - RNA, 22 nt, Homo sapiens
uggagugugacaaugguguuug

SEQ ID NO: 12884 - RNA, 24 nt, Homo sapiens
uugcagcugccugggagugacuuc

SEQ ID NO: 12885 - RNA, 19 nt, Homo sapiens
gaugaugcugcugaugcug

SEQ ID NO: 12886 - RNA, 21 nt, Homo sapiens
aauauaacacagauggccugu

SEQ ID NO: 12887 - RNA, 22 nt, Homo sapiens
uuuugcaauauguuccugaaua

SEQ ID NO: 12888 - RNA, 22 nt, Homo sapiens
uuuugcaauauguuccugaaua

SEQ ID NO: 12889 - RNA, 22 nt, Homo sapiens
agaggcuggccgugaugaauuc

SEQ ID NO: 12890 - RNA, 22 nt, Homo sapiens
ugaaacauacacgggaaaccuc

SEQ ID NO: 12891 - RNA, 20 nt, Homo sapiens
cugcaaagggaagcccuuuc

SEQ ID NO: 12892 - RNA, 20 nt, Homo sapiens
cugcaaagggaagcccuuuc

SEQ ID NO: 12893 - RNA, 20 nt, Homo sapiens
gugucugggcggacagcugc

SEQ ID NO: 12894 - RNA, 24 nt, Homo sapiens
ccagacagaauucuaugcacuuuc

SEQ ID NO: 12895 - RNA, 22 nt, Homo sapiens
ucagugcaucacagaacuuugu

SEQ ID NO: 12896 - RNA, 18 nt, Homo sapiens
ugaggcaguagauugaau

SEQ ID NO: 12897 - RNA, 22 nt, Homo sapiens
aagcugccaguugaagaacugu

SEQ ID NO: 12898 - RNA, 21 nt, Homo sapiens
uccuucugcuccgucccccag

SEQ ID NO: 12899 - RNA, 17 nt, Homo sapiens
ucgccuccuccucuccc

SEQ ID NO: 12900 - RNA, 21 nt, Homo sapiens
uccugcgcgucccagaugccc

SEQ ID NO: 12901 - RNA, 21 nt, Homo sapiens
cggcggggacggcgauugguc

SEQ ID NO: 12902 - RNA, 22 nt, Homo sapiens
uggcucaguucagcaggaacag

SEQ ID NO: 12903 - RNA, 23 nt, Homo sapiens
ugucugcccgcaugccugccucu

SEQ ID NO: 12904 - RNA, 22 nt, Homo sapiens
uaaugccccuaaaaauccuuau

SEQ ID NO: 12905 - RNA, 22 nt, Homo sapiens
aagacgggaggaaagaagggag

SEQ ID NO: 12906 - RNA, 22 nt, Homo sapiens
aggcggggcgccgcgggaccgc

SEQ ID NO: 12907 - RNA, 22 nt, Homo sapiens
ugcggggcuagggcuaacagca

SEQ ID NO: 12908 - RNA, 22 nt, Homo sapiens
ugagaccucuggguucugagcu

SEQ ID NO: 12909 - RNA, 22 nt, Homo sapiens
acccgucccguucguccccgga

SEQ ID NO: 12910 - RNA, 23 nt, Homo sapiens
ucuggcuccgugucuucacuccc

SEQ ID NO: 12911 - RNA, 21 nt, Homo sapiens
cggcggggacggcgauugguc

SEQ ID NO: 12912 - RNA, 20 nt, Homo sapiens
ccccagggcgacgcggcggg

SEQ ID NO: 12913 - RNA, 21 nt, Homo sapiens
gccccugggccuauccuagaa

SEQ ID NO: 12914 - RNA, 22 nt, Homo sapiens
uggcagugucuuagcugguugu

SEQ ID NO: 12915 - RNA, 21 nt, Homo sapiens
gcgacccacucuugguuucca

SEQ ID NO: 12916 - RNA, 21 nt, Homo sapiens
gcgacccauacuugguuucag

SEQ ID NO: 12917 - RNA, 19 nt, Homo sapiens
aggcugcggaauucaggac

SEQ ID NO: 12918 - RNA, 22 nt, Homo sapiens
aggcggggcgccgcgggaccgc

SEQ ID NO: 12919 - RNA, 22 nt, Homo sapiens
ugcggggcuagggcuaacagca

SEQ ID NO: 12920 - RNA, 22 nt, Homo sapiens
acuccagccccacagccucagc

SEQ ID NO: 12921 - RNA, 23 nt, Homo sapiens
cgggucggaguuagcucaagcgg

SEQ ID NO: 12922 - RNA, 22 nt, Homo sapiens
uauugcacucgucccggccucc

SEQ ID NO: 12923 - RNA, 18 nt, Homo sapiens
ucagcuggcccucauuuc

SEQ ID NO: 12924 - RNA, 24 nt, Homo sapiens
agccuggaagcuggagccugcagu

SEQ ID NO: 12925 - RNA, 20 nt, Homo sapiens
ucguuugccuuuuucugcuu

SEQ ID NO: 12926 - RNA, 21 nt, Homo sapiens
uugggacauacuuaugcuaaa

SEQ ID NO: 12927 - RNA, 22 nt, Homo sapiens
uggagagaaaggcaguuccuga

SEQ ID NO: 12928 - RNA, 22 nt, Homo sapiens
ucugcccccuccgcugcugcca

SEQ ID NO: 12929 - RNA, 20 nt, Homo sapiens
acugccccaggugcugcugg

SEQ ID NO: 12930 - RNA, 23 nt, Homo sapiens
ucccccaggugugauucugauuu

SEQ ID NO: 12931 - RNA, 21 nt, Homo sapiens
cggggcagcucaguacaggau

SEQ ID NO: 12932 - RNA, 25 nt, Homo sapiens
aggggugguguugggacagcuccgu

SEQ ID NO: 12933 - RNA, 24 nt, Homo sapiens
acugggggcuuucgggcucugcgu

SEQ ID NO: 12934 - RNA, 24 nt, Homo sapiens
ugccugggucucuggccugcgcgu

SEQ ID NO: 12935 - RNA, 20 nt, Homo sapiens
ggggagcuguggaagcagua

SEQ ID NO: 12936 - RNA, 17 nt, Homo sapiens
gugggggagaggcuguc

SEQ ID NO: 12937 - RNA, 18 nt, Homo sapiens
cagggaggugaaugugau

SEQ ID NO: 12938 - RNA, 18 nt, Homo sapiens
ugaggcaguagauugaau

SEQ ID NO: 12939 - RNA, 22 nt, Homo sapiens
cccugugcccggcccacuucug

SEQ ID NO: 12940 - RNA, 22 nt, Homo sapiens
uggcagugucuuagcugguugu

SEQ ID NO: 12941 - RNA, 23 nt, Homo sapiens
aggcaguguaguuagcugauugc

SEQ ID NO: 12942 - RNA, 23 nt, Homo sapiens
ucccccaggugugauucugauuu

SEQ ID NO: 12943 - RNA, 22 nt, Homo sapiens
uggcaguguauuguuagcuggu

SEQ ID NO: 12944 - RNA, 22 nt, Homo sapiens
aggcaguguauuguuagcuggc

SEQ ID NO: 12945 - RNA, 22 nt, Homo sapiens
aagugcugucauagcugagguc

SEQ ID NO: 12946 - RNA, 22 nt, Homo sapiens
ugugacagauugauaacugaaa

SEQ ID NO: 12947 - RNA, 24 nt, Homo sapiens
acugggggcuuucgggcucugcgu

SEQ ID NO: 12948 - RNA, 21 nt, Homo sapiens
ucccacguuguggcccagcag

SEQ ID NO: 12949 - RNA, 21 nt, Homo sapiens
uggaggagaaggaaggugaug

SEQ ID NO: 12950 - RNA, 20 nt, Homo sapiens
guagaggagauggcgcaggg

SEQ ID NO: 12951 - RNA, 21 nt, Homo sapiens
cggcggggacggcgauugguc

SEQ ID NO: 12952 - RNA, 21 nt, Homo sapiens
cggcggggacggcgauugguc

SEQ ID NO: 12953 - RNA, 21 nt, Homo sapiens
ccacaccguaucugacacuuu

SEQ ID NO: 12954 - RNA, 23 nt, Homo sapiens
aucaacagacauuaauugggcgc

SEQ ID NO: 12955 - RNA, 22 nt, Homo sapiens
caaaaaucucaauuacuuuugc

SEQ ID NO: 12956 - RNA, 22 nt, Homo sapiens
aggcggggcgccgcgggaccgc

SEQ ID NO: 12957 - RNA, 22 nt, Homo sapiens
aggcggggcgccgcgggaccgc

SEQ ID NO: 12958 - RNA, 22 nt, Homo sapiens
ugcggggcuagggcuaacagca

SEQ ID NO: 12959 - RNA, 22 nt, Homo sapiens
ugcggggcuagggcuaacagca

SEQ ID NO: 12960 - RNA, 21 nt, Homo sapiens
uggaggagaaggaaggugaug

SEQ ID NO: 12961 - RNA, 23 nt, Homo sapiens
ucuggcuccgugucuucacuccc

SEQ ID NO: 12962 - RNA, 23 nt, Homo sapiens
cggcccgggcugcugcuguuccu

SEQ ID NO: 12963 - RNA, 22 nt, Homo sapiens
uguaaacauccuacacucagcu

SEQ ID NO: 12964 - RNA, 23 nt, Homo sapiens
ucccccaggugugauucugauuu

SEQ ID NO: 12965 - RNA, 22 nt, Homo sapiens
uccgagccugggucucccucuu

SEQ ID NO: 12966 - RNA, 24 nt, Homo sapiens
acugggggcuuucgggcucugcgu

SEQ ID NO: 12967 - RNA, 20 nt, Homo sapiens
ggggagcuguggaagcagua

SEQ ID NO: 12968 - RNA, 21 nt, Homo sapiens
ccgucgccgccacccgagccg

SEQ ID NO: 12969 - RNA, 22 nt, Homo sapiens
uggagagaaaggcaguuccuga

SEQ ID NO: 12970 - RNA, 23 nt, Homo sapiens
uaaggugcaucuagugcaguuag

SEQ ID NO: 12971 - RNA, 21 nt, Homo sapiens
cggcggggacggcgauugguc

SEQ ID NO: 12972 - RNA, 23 nt, Homo sapiens
ucccccaggugugauucugauuu

SEQ ID NO: 12973 - RNA, 24 nt, Homo sapiens
acugggggcuuucgggcucugcgu

SEQ ID NO: 12974 - RNA, 24 nt, Homo sapiens
ugccugggucucuggccugcgcgu

SEQ ID NO: 12975 - RNA, 23 nt, Homo sapiens
aggaagcccuggaggggcuggag

SEQ ID NO: 12976 - RNA, 22 nt, Homo sapiens
ugcggggcuagggcuaacagca

SEQ ID NO: 12977 - RNA, 23 nt, Homo sapiens
cacccggcugugugcacaugugc

SEQ ID NO: 12978 - RNA, 17 nt, Homo sapiens
ucgccuccuccucuccc

SEQ ID NO: 12979 - RNA, 22 nt, Homo sapiens
acucggcguggcgucggucgug

SEQ ID NO: 12980 - RNA, 22 nt, Homo sapiens
cucggcgcggggcgcgggcucc

SEQ ID NO: 12981 - RNA, 22 nt, Homo sapiens
ucucccaacccuuguaccagug

SEQ ID NO: 12982 - RNA, 22 nt, Homo sapiens
uggagagaaaggcaguuccuga

SEQ ID NO: 12983 - RNA, 22 nt, Homo sapiens
caaagaauucuccuuuugggcu

SEQ ID NO: 12984 - RNA, 22 nt, Homo sapiens
caaagaauucuccuuuugggcu

SEQ ID NO: 12985 - RNA, 22 nt, Homo sapiens
uuauaaagcaaugagacugauu

SEQ ID NO: 12986 - RNA, 23 nt, Homo sapiens
ugucugcccgcaugccugccucu

SEQ ID NO: 12987 - RNA, 22 nt, Homo sapiens
aaaaguaauugcgaguuuuacc

SEQ ID NO: 12988 - RNA, 22 nt, Homo sapiens
aaaaguaauugugguuuuggcc

SEQ ID NO: 12989 - RNA, 22 nt, Homo sapiens
aaaaguaauugcgguuuuugcc

SEQ ID NO: 12990 - RNA, 22 nt, Homo sapiens
aaaaguaauugugguuuuugcc

SEQ ID NO: 12991 - RNA, 22 nt, Homo sapiens
aaaaguaaucgcgguuuuuguc

SEQ ID NO: 12992 - RNA, 22 nt, Homo sapiens
aaaaguaauugcggauuuugcc

SEQ ID NO: 12993 - RNA, 22 nt, Homo sapiens
aaaaguaauugcggucuuuggu

SEQ ID NO: 12994 - RNA, 21 nt, Homo sapiens
uaaaguaaauaugcaccaaaa

SEQ ID NO: 12995 - RNA, 19 nt, Homo sapiens
aggcugcggaauucaggac

SEQ ID NO: 12996 - RNA, 21 nt, Homo sapiens
ccccaccuccucucuccucag

SEQ ID NO: 12997 - RNA, 21 nt, Homo sapiens
cggcggggacggcgauugguc

SEQ ID NO: 12998 - RNA, 22 nt, Homo sapiens
uuuguucguucggcucgcguga

SEQ ID NO: 12999 - RNA, 22 nt, Homo sapiens
uggugggcacagaaucuggacu

SEQ ID NO: 13000 - RNA, 21 nt, Homo sapiens
agggggaaaguucuauagucc

SEQ ID NO: 13001 - RNA, 22 nt, Homo sapiens
uggugggccgcagaacaugugc

SEQ ID NO: 13002 - RNA, 22 nt, Homo sapiens
aggcggggcgccgcgggaccgc

SEQ ID NO: 13003 - RNA, 23 nt, Homo sapiens
aggaagcccuggaggggcuggag

SEQ ID NO: 13004 - RNA, 23 nt, Homo sapiens
uggugcggagagggcccacagug

SEQ ID NO: 13005 - RNA, 22 nt, Homo sapiens
ugcggggcuagggcuaacagca

SEQ ID NO: 13006 - RNA, 23 nt, Homo sapiens
ccugcagcgacuugauggcuucc

SEQ ID NO: 13007 - RNA, 20 nt, Homo sapiens
ucacaccugccucgcccccc

SEQ ID NO: 13008 - RNA, 21 nt, Homo sapiens
uggacugcccugaucuggaga

SEQ ID NO: 13009 - RNA, 24 nt, Homo sapiens
uugcagcugccugggagugacuuc

SEQ ID NO: 13010 - RNA, 23 nt, Homo sapiens
caaagugcuuacagugcagguag

SEQ ID NO: 13011 - RNA, 22 nt, Homo sapiens
uggagagaaaggcaguuccuga

SEQ ID NO: 13012 - RNA, 21 nt, Homo sapiens
ccaguccugugccugccgccu

SEQ ID NO: 13013 - RNA, 22 nt, Homo sapiens
uagcuuaucagacugauguuga

SEQ ID NO: 13014 - RNA, 22 nt, Homo sapiens
aacacaccugguuaaccucuuu

SEQ ID NO: 13015 - RNA, 22 nt, Homo sapiens
aacacaccuauucaaggauuca

SEQ ID NO: 13016 - RNA, 21 nt, Homo sapiens
uugaaaggcuauuucuugguc

SEQ ID NO: 13017 - RNA, 22 nt, Homo sapiens
uacugcagacguggcaaucaug

SEQ ID NO: 13018 - RNA, 21 nt, Homo sapiens
uacugcagacaguggcaauca

SEQ ID NO: 13019 - RNA, 19 nt, Homo sapiens
aagcagcugccucugaggc

SEQ ID NO: 13020 - RNA, 20 nt, Homo sapiens
accaggaggcugaggccccu

SEQ ID NO: 13021 - RNA, 22 nt, Homo sapiens
ccucuuccccuugucucuccag

SEQ ID NO: 13022 - RNA, 18 nt, Homo sapiens
uugagaaggaggcugcug

SEQ ID NO: 13023 - RNA, 22 nt, Homo sapiens
acucggcguggcgucggucgug

SEQ ID NO: 13024 - RNA, 22 nt, Homo sapiens
cucggcgcggggcgcgggcucc

SEQ ID NO: 13025 - RNA, 23 nt, Homo sapiens
ucuggcuccgugucuucacuccc

SEQ ID NO: 13026 - RNA, 21 nt, Homo sapiens
ucgaggagcucacagucuagu

SEQ ID NO: 13027 - RNA, 22 nt, Homo sapiens
aaggagcucacagucuauugag

SEQ ID NO: 13028 - RNA, 22 nt, Homo sapiens
aauugcacgguauccaucugua

SEQ ID NO: 13029 - RNA, 22 nt, Homo sapiens
uccgagccugggucucccucuu

SEQ ID NO: 13030 - RNA, 22 nt, Homo sapiens
gucccucuccaaaugugucuug

SEQ ID NO: 13031 - RNA, 23 nt, Homo sapiens
aaggagcuuacaaucuagcuggg

SEQ ID NO: 13032 - RNA, 21 nt, Homo sapiens
cgcgggugcuuacugacccuu

SEQ ID NO: 13033 - RNA, 23 nt, Homo sapiens
gcagcagagaauaggacuacguc

SEQ ID NO: 13034 - RNA, 22 nt, Homo sapiens
ucuucucuguuuuggccaugug

SEQ ID NO: 13035 - RNA, 22 nt, Homo sapiens
aacccguagauccgaacuugug

SEQ ID NO: 13036 - RNA, 22 nt, Homo sapiens
aacccguagauccgaacuugug

SEQ ID NO: 13037 - RNA, 22 nt, Homo sapiens
uuuccggcucgcgugggugugu

SEQ ID NO: 13038 - RNA, 21 nt, Homo sapiens
agcuacaucuggcuacugggu

SEQ ID NO: 13039 - RNA, 18 nt, Homo sapiens
ugcuuccuuucagagggu

SEQ ID NO: 13040 - RNA, 22 nt, Homo sapiens
aucuggagguaagaagcacuuu

SEQ ID NO: 13041 - RNA, 22 nt, Homo sapiens
gaaagcgcuucccuuugcugga

SEQ ID NO: 13042 - RNA, 22 nt, Homo sapiens
caaagcgcuccccuuuagaggu

SEQ ID NO: 13043 - RNA, 23 nt, Homo sapiens
caaagcgcuucucuuuagagugu

SEQ ID NO: 13044 - RNA, 21 nt, Homo sapiens
caaagcgcuucccuuuggagc

SEQ ID NO: 13045 - RNA, 21 nt, Homo sapiens
gaaagcgcuucucuuuagagg

SEQ ID NO: 13046 - RNA, 23 nt, Homo sapiens
aggaagcccuggaggggcuggag

SEQ ID NO: 13047 - RNA, 23 nt, Homo sapiens
ucuuugguuaucuagcuguauga

SEQ ID NO: 13048 - RNA, 24 nt, Homo sapiens
uggggagcugaggcucugggggug

SEQ ID NO: 13049 - RNA, 17 nt, Homo sapiens
gugggggagaggcuguc

SEQ ID NO: 13050 - RNA, 22 nt, Homo sapiens
acucggcguggcgucggucgug

SEQ ID NO: 13051 - RNA, 21 nt, Homo sapiens
cggcggggacggcgauugguc

SEQ ID NO: 13052 - RNA, 21 nt, Homo sapiens
agggcccccccucaauccugu

SEQ ID NO: 13053 - RNA, 23 nt, Homo sapiens
ucccccaggugugauucugauuu

SEQ ID NO: 13054 - RNA, 22 nt, Homo sapiens
ucaggcucaguccccucccgau

SEQ ID NO: 13055 - RNA, 20 nt, Homo sapiens
cuacaaagggaagcccuuuc

SEQ ID NO: 13056 - RNA, 22 nt, Homo sapiens
cuacaaagggaagcacuuucuc

SEQ ID NO: 13057 - RNA, 21 nt, Homo sapiens
ugacaacuauggaugagcucu

SEQ ID NO: 13058 - RNA, 21 nt, Homo sapiens
agggggaaaguucuauagucc

SEQ ID NO: 13059 - RNA, 24 nt, Homo sapiens
acugggggcuuucgggcucugcgu

SEQ ID NO: 13060 - RNA, 24 nt, Homo sapiens
ugccugggucucuggccugcgcgu

SEQ ID NO: 13061 - RNA, 22 nt, Homo sapiens
aggcggggcgccgcgggaccgc

SEQ ID NO: 13062 - RNA, 21 nt, Homo sapiens
gcaggaacuugugagucuccu

SEQ ID NO: 13063 - RNA, 21 nt, Homo sapiens
cccggagccaggaugcagcuc

SEQ ID NO: 13064 - RNA, 23 nt, Homo sapiens
cuggagauauggaagagcugugu

SEQ ID NO: 13065 - RNA, 21 nt, Homo sapiens
ucgaggagcucacagucuagu

SEQ ID NO: 13066 - RNA, 21 nt, Homo sapiens
cggcggggacggcgauugguc

SEQ ID NO: 13067 - RNA, 22 nt, Homo sapiens
uugugucaauaugcgaugaugu

SEQ ID NO: 13068 - RNA, 22 nt, Homo sapiens
ugugucacucgaugaccacugu

SEQ ID NO: 13069 - RNA, 25 nt, Homo sapiens
aggggugguguugggacagcuccgu

SEQ ID NO: 13070 - RNA, 22 nt, Homo sapiens
ggggguccccggugcucggauc

SEQ ID NO: 13071 - RNA, 20 nt, Homo sapiens
auggagauagauauagaaau

SEQ ID NO: 13072 - RNA, 22 nt, Homo sapiens
aggcggggcgccgcgggaccgc

SEQ ID NO: 13073 - RNA, 20 nt, Homo sapiens
cgugccacccuuuuccccag

SEQ ID NO: 13074 - RNA, 18 nt, Homo sapiens
cgggcguggugguggggg

SEQ ID NO: 13075 - RNA, 21 nt, Homo sapiens
ucacagugaaccggucucuuu

SEQ ID NO: 13076 - RNA, 22 nt, Homo sapiens
uaacacugucugguaaagaugg

SEQ ID NO: 13077 - RNA, 21 nt, Homo sapiens
gcccuccgcccgugcaccccg

SEQ ID NO: 13078 - RNA, 23 nt, Homo sapiens
ucuggcuccgugucuucacuccc

SEQ ID NO: 13079 - RNA, 22 nt, Homo sapiens
uaacacugucugguaacgaugu

SEQ ID NO: 13080 - RNA, 22 nt, Homo sapiens
aaggagcucacagucuauugag

SEQ ID NO: 13081 - RNA, 22 nt, Homo sapiens
uguaaacauccuacacucagcu

SEQ ID NO: 13082 - RNA, 23 nt, Homo sapiens
ugaggggcagagagcgagacuuu

SEQ ID NO: 13083 - RNA, 22 nt, Homo sapiens
cgucaacacuugcugguuuccu

SEQ ID NO: 13084 - RNA, 22 nt, Homo sapiens
caaaaaccacaguuucuuuugc

SEQ ID NO: 13085 - RNA, 23 nt, Homo sapiens
aaggagcuuacaaucuagcuggg

SEQ ID NO: 13086 - RNA, 21 nt, Homo sapiens
uggaggagaaggaaggugaug

SEQ ID NO: 13087 - RNA, 22 nt, Homo sapiens
uaacacugucugguaaagaugg

SEQ ID NO: 13088 - RNA, 22 nt, Homo sapiens
uaacacugucugguaacgaugu

SEQ ID NO: 13089 - RNA, 22 nt, Homo sapiens
aaaaguaauugcggauuuugcc

SEQ ID NO: 13090 - RNA, 21 nt, Homo sapiens
caagucacuagugguuccguu

SEQ ID NO: 13091 - RNA, 21 nt, Homo sapiens
caagucacuagugguuccguu

SEQ ID NO: 13092 - RNA, 20 nt, Homo sapiens
auuccuagaaauuguucaua

SEQ ID NO: 13093 - RNA, 23 nt, Homo sapiens
agguuacccgagcaacuuugcau

SEQ ID NO: 13094 - RNA, 22 nt, Homo sapiens
aaaaugguucccuuuagagugu

SEQ ID NO: 13095 - RNA, 22 nt, Homo sapiens
aaaaugguucccuuuagagugu

SEQ ID NO: 13096 - RNA, 21 nt, Homo sapiens
caaagguauuugugguuuuug

SEQ ID NO: 13097 - RNA, 22 nt, Homo sapiens
cuugguucagggagggucccca

SEQ ID NO: 13098 - RNA, 22 nt, Homo sapiens
uuuccggcucgcgugggugugu

SEQ ID NO: 13099 - RNA, 22 nt, Homo sapiens
cccugugcccggcccacuucug

SEQ ID NO: 13100 - RNA, 21 nt, Homo sapiens
aucacauugccagggauuucc

SEQ ID NO: 13101 - RNA, 21 nt, Homo sapiens
aucacauugccagggauuacc

SEQ ID NO: 13102 - RNA, 22 nt, Homo sapiens
uggcucaguucagcaggaacag

SEQ ID NO: 13103 - RNA, 21 nt, Homo sapiens
uaaagugcugacagugcagau

SEQ ID NO: 13104 - RNA, 23 nt, Homo sapiens
cagugcaaugauauugucaaagc

SEQ ID NO: 13105 - RNA, 23 nt, Homo sapiens
agcucggucugaggccccucagu

SEQ ID NO: 13106 - RNA, 22 nt, Homo sapiens
uccgagccugggucucccucuu

SEQ ID NO: 13107 - RNA, 21 nt, Homo sapiens
uggcagggaggcugggagggg

SEQ ID NO: 13108 - RNA, 22 nt, Homo sapiens
ugagccccugugccgcccccag

SEQ ID NO: 13109 - RNA, 23 nt, Homo sapiens
uauggcuuuuuauuccuauguga

SEQ ID NO: 13110 - RNA, 23 nt, Homo sapiens
ucuggcuccgugucuucacuccc

SEQ ID NO: 13111 - RNA, 22 nt, Homo sapiens
cgcaggggccgggugcucaccg

SEQ ID NO: 13112 - RNA, 22 nt, Homo sapiens
ucugcccccuccgcugcugcca

SEQ ID NO: 13113 - RNA, 20 nt, Homo sapiens
acugccccaggugcugcugg

SEQ ID NO: 13114 - RNA, 23 nt, Homo sapiens
ucccccaggugugauucugauuu

SEQ ID NO: 13115 - RNA, 23 nt, Homo sapiens
ugaggggcagagagcgagacuuu

SEQ ID NO: 13116 - RNA, 21 nt, Homo sapiens
cggggcagcucaguacaggau

SEQ ID NO: 13117 - RNA, 20 nt, Homo sapiens
agaccauggguucucauugu

SEQ ID NO: 13118 - RNA, 24 nt, Homo sapiens
acugggggcuuucgggcucugcgu

SEQ ID NO: 13119 - RNA, 23 nt, Homo sapiens
uggaagacuagugauuuuguugu

SEQ ID NO: 13120 - RNA, 20 nt, Homo sapiens
ggggagcuguggaagcagua

SEQ ID NO: 13121 - RNA, 17 nt, Homo sapiens
ucgccuccuccucuccc

SEQ ID NO: 13122 - RNA, 22 nt, Homo sapiens
cauugcacuugucucggucuga

SEQ ID NO: 13123 - RNA, 21 nt, Homo sapiens
aagccugcccggcuccucggg

SEQ ID NO: 13124 - RNA, 21 nt, Homo sapiens
ucguggccuggucuccauuau

SEQ ID NO: 13125 - RNA, 22 nt, Homo sapiens
uggagugugacaaugguguuug

SEQ ID NO: 13126 - RNA, 18 nt, Homo sapiens
cgggcguggugguggggg

SEQ ID NO: 13127 - RNA, 18 nt, Homo sapiens
cgggcguggugguggggg

SEQ ID NO: 13128 - RNA, 23 nt, Homo sapiens
ucuggcuccgugucuucacuccc

SEQ ID NO: 13129 - RNA, 21 nt, Homo sapiens
cggcggggacggcgauugguc

SEQ ID NO: 13130 - RNA, 21 nt, Homo sapiens
ccaguccugugccugccgccu

SEQ ID NO: 13131 - RNA, 22 nt, Homo sapiens
ucaggccaggcacaguggcuca

SEQ ID NO: 13132 - RNA, 21 nt, Homo sapiens
aggcaagaugcuggcauagcu

SEQ ID NO: 13133 - RNA, 23 nt, Homo sapiens
ugagcgccucgacgacagagccg

SEQ ID NO: 13134 - RNA, 21 nt, Homo sapiens
ugucuugcaggccgucaugca

SEQ ID NO: 13135 - RNA, 22 nt, Homo sapiens
aggcggggcgccgcgggaccgc

SEQ ID NO: 13136 - RNA, 22 nt, Homo sapiens
ugcggggcuagggcuaacagca

SEQ ID NO: 13137 - RNA, 18 nt, Homo sapiens
ugaggcaguagauugaau

SEQ ID NO: 13138 - RNA, 22 nt, Homo sapiens
uuauaaagcaaugagacugauu

SEQ ID NO: 13139 - RNA, 21 nt, Homo sapiens
aggaggcagcgcucucaggac

SEQ ID NO: 13140 - RNA, 21 nt, Homo sapiens
uggaggagaaggaaggugaug

SEQ ID NO: 13141 - RNA, 20 nt, Homo sapiens
guagaggagauggcgcaggg

SEQ ID NO: 13142 - RNA, 22 nt, Homo sapiens
aacccguagauccgaacuugug

SEQ ID NO: 13143 - RNA, 23 nt, Homo sapiens
ccugcagcgacuugauggcuucc

SEQ ID NO: 13144 - RNA, 17 nt, Homo sapiens
ucgccuccuccucuccc

SEQ ID NO: 13145 - RNA, 21 nt, Homo sapiens
cggcggggacggcgauugguc

SEQ ID NO: 13146 - RNA, 22 nt, Homo sapiens
cgcaggggccgggugcucaccg

SEQ ID NO: 13147 - RNA, 22 nt, Homo sapiens
uaaugccccuaaaaauccuuau

SEQ ID NO: 13148 - RNA, 22 nt, Homo sapiens
agacuucccauuugaagguggc

SEQ ID NO: 13149 - RNA, 22 nt, Homo sapiens
gguggcccggccgugccugagg

SEQ ID NO: 13150 - RNA, 22 nt, Homo sapiens
aacccguagauccgaucuugug

SEQ ID NO: 13151 - RNA, 22 nt, Homo sapiens
cacccguagaaccgaccuugcg

SEQ ID NO: 13152 - RNA, 23 nt, Homo sapiens
uacccuguagauccgaauuugug

SEQ ID NO: 13153 - RNA, 23 nt, Homo sapiens
uacccuguagaaccgaauuugug

SEQ ID NO: 13154 - RNA, 22 nt, Homo sapiens
ucuacaaaggaaagcgcuuucu

SEQ ID NO: 13155 - RNA, 23 nt, Homo sapiens
agcuacauugucugcuggguuuc

SEQ ID NO: 13156 - RNA, 23 nt, Homo sapiens
ucccuguccuccaggagcucacg

SEQ ID NO: 13157 - RNA, 22 nt, Homo sapiens
aucacacaaaggcaacuuuugu

SEQ ID NO: 13158 - RNA, 22 nt, Homo sapiens
aggcaguguauuguuagcuggc

SEQ ID NO: 13159 - RNA, 21 nt, Homo sapiens
ugaguuggccaucugagugag

SEQ ID NO: 13160 - RNA, 20 nt, Homo sapiens
aggguguuucucucaucucu

SEQ ID NO: 13161 - RNA, 20 nt, Homo sapiens
accaggaggcugaggccccu

SEQ ID NO: 13162 - RNA, 23 nt, Homo sapiens
aaggagcuuacaaucuagcuggg

SEQ ID NO: 13163 - RNA, 23 nt, Homo sapiens
gcagcagagaauaggacuacguc

SEQ ID NO: 13164 - RNA, 21 nt, Homo sapiens
uaggacacauggucuacuucu

SEQ ID NO: 13165 - RNA, 22 nt, Homo sapiens
cuccugagccauucugagccuc

SEQ ID NO: 13166 - RNA, 22 nt, Homo sapiens
acgcccuucccccccuucuuca

SEQ ID NO: 13167 - RNA, 23 nt, Homo sapiens
ucuggcuccgugucuucacuccc

SEQ ID NO: 13168 - RNA, 22 nt, Homo sapiens
uggcucaguucagcaggaacag

SEQ ID NO: 13169 - RNA, 23 nt, Homo sapiens
ugaggggcagagagcgagacuuu

SEQ ID NO: 13170 - RNA, 22 nt, Homo sapiens
caaaguuuaagauccuugaagu

SEQ ID NO: 13171 - RNA, 22 nt, Homo sapiens
ugcccuuaaaggugaacccagu

SEQ ID NO: 13172 - RNA, 22 nt, Homo sapiens
uggagugugacaaugguguuug

SEQ ID NO: 13173 - RNA, 18 nt, Homo sapiens
aucccaccucugccacca

SEQ ID NO: 13174 - RNA, 18 nt, Homo sapiens
aucccaccucugccacca

SEQ ID NO: 13175 - RNA, 21 nt, Homo sapiens
uugggacauacuuaugcuaaa

SEQ ID NO: 13176 - RNA, 22 nt, Homo sapiens
uacccagagcaugcagugugaa

SEQ ID NO: 13177 - RNA, 22 nt, Homo sapiens
ucugcccccuccgcugcugcca

SEQ ID NO: 13178 - RNA, 20 nt, Homo sapiens
acugccccaggugcugcugg

SEQ ID NO: 13179 - RNA, 21 nt, Homo sapiens
aauauaacacagauggccugu

SEQ ID NO: 13180 - RNA, 23 nt, Homo sapiens
aaugacacgaucacucccguuga

SEQ ID NO: 13181 - RNA, 21 nt, Homo sapiens
cggggcagcucaguacaggau

SEQ ID NO: 13182 - RNA, 22 nt, Homo sapiens
ccucccacacccaaggcuugca

SEQ ID NO: 13183 - RNA, 25 nt, Homo sapiens
aggggugguguugggacagcuccgu

SEQ ID NO: 13184 - RNA, 25 nt, Homo sapiens
aggggugguguugggacagcuccgu

SEQ ID NO: 13185 - RNA, 21 nt, Homo sapiens
aagugaucuaaaggccuacau

SEQ ID NO: 13186 - RNA, 22 nt, Homo sapiens
ugggucuuugcgggcgagauga

SEQ ID NO: 13187 - RNA, 21 nt, Homo sapiens
ugagaugaagcacuguagcuc

SEQ ID NO: 13188 - RNA, 21 nt, Homo sapiens
uaguagaccguauagcguacg

SEQ ID NO: 13189 - RNA, 22 nt, Homo sapiens
caaaaguaauuguggauuuugu

SEQ ID NO: 13190 - RNA, 22 nt, Homo sapiens
ucuucucuguuuuggccaugug

SEQ ID NO: 13191 - RNA, 22 nt, Homo sapiens
ugcuggaucagugguucgaguc

SEQ ID NO: 13192 - RNA, 22 nt, Homo sapiens
ugugacugguugaccagagggg

SEQ ID NO: 13193 - RNA, 22 nt, Homo sapiens
uauggcacugguagaauucacu

SEQ ID NO: 13194 - RNA, 21 nt, Homo sapiens
gccccugggccuauccuagaa

SEQ ID NO: 13195 - RNA, 23 nt, Homo sapiens
aaugacacgaucacucccguuga

SEQ ID NO: 13196 - RNA, 22 nt, Homo sapiens
uaugugccuuuggacuacaucg

SEQ ID NO: 13197 - RNA, 22 nt, Homo sapiens
auucuaauuucuccacgucuuu

SEQ ID NO: 13198 - RNA, 23 nt, Homo sapiens
uucauuugguauaaaccgcgauu

SEQ ID NO: 13199 - RNA, 22 nt, Homo sapiens
augcugacauauuuacuagagg

SEQ ID NO: 13200 - RNA, 21 nt, Homo sapiens
guggcugcacucacuuccuuc

SEQ ID NO: 13201 - RNA, 23 nt, Homo sapiens
ucugcucauaccccaugguuucu

SEQ ID NO: 13202 - RNA, 22 nt, Homo sapiens
cugcccuggcccgagggaccga

SEQ ID NO: 13203 - RNA, 22 nt, Homo sapiens
ugugcgcagggagaccucuccc

SEQ ID NO: 13204 - RNA, 21 nt, Homo sapiens
cugacuguugccguccuccag

SEQ ID NO: 13205 - RNA, 20 nt, Homo sapiens
ucugcaggguuugcuuugag

SEQ ID NO: 13206 - RNA, 24 nt, Homo sapiens
agccuggaagcuggagccugcagu

SEQ ID NO: 13207 - RNA, 24 nt, Homo sapiens
agccuggaagcuggagccugcagu

SEQ ID NO: 13208 - RNA, 17 nt, Homo sapiens
gugggggagaggcuguc

SEQ ID NO: 13209 - RNA, 21 nt, Homo sapiens
uaccacaggguagaaccacgg

SEQ ID NO: 13210 - RNA, 22 nt, Homo sapiens
ugagaacugaauuccauggguu

SEQ ID NO: 13211 - RNA, 22 nt, Homo sapiens
ugagaacugaauuccauaggcu

SEQ ID NO: 13212 - RNA, 23 nt, Homo sapiens
caaagugcuuacagugcagguag

SEQ ID NO: 13213 - RNA, 20 nt, Homo sapiens
ccccagggcgacgcggcggg

SEQ ID NO: 13214 - RNA, 21 nt, Homo sapiens
gccccugggccuauccuagaa

SEQ ID NO: 13215 - RNA, 23 nt, Homo sapiens
ucccccaggugugauucugauuu

SEQ ID NO: 13216 - RNA, 21 nt, Homo sapiens
acuggacuuggagucagaagg

SEQ ID NO: 13217 - RNA, 22 nt, Homo sapiens
acuggacuuagggucagaaggc

SEQ ID NO: 13218 - RNA, 22 nt, Homo sapiens
uacugcagacguggcaaucaug

SEQ ID NO: 13219 - RNA, 21 nt, Homo sapiens
uacugcagacaguggcaauca

SEQ ID NO: 13220 - RNA, 24 nt, Homo sapiens
acugggggcuuucgggcucugcgu

SEQ ID NO: 13221 - RNA, 23 nt, Homo sapiens
uauucauuuauccccagccuaca

SEQ ID NO: 13222 - RNA, 20 nt, Homo sapiens
uaaagagcccuguggagaca

SEQ ID NO: 13223 - RNA, 21 nt, Homo sapiens
cuuuuugcggucugggcuugc

SEQ ID NO: 13224 - RNA, 22 nt, Homo sapiens
acucggcguggcgucggucgug

SEQ ID NO: 13225 - RNA, 22 nt, Homo sapiens
cagugcaaugaugaaagggcau

SEQ ID NO: 13226 - RNA, 22 nt, Homo sapiens
ucugcccccuccgcugcugcca

SEQ ID NO: 13227 - RNA, 23 nt, Homo sapiens
uaagugcuuccauguuuuaguag

SEQ ID NO: 13228 - RNA, 23 nt, Homo sapiens
uaagugcuuccauguuugagugu

SEQ ID NO: 13229 - RNA, 20 nt, Homo sapiens
acugccccaggugcugcugg

SEQ ID NO: 13230 - RNA, 23 nt, Homo sapiens
ugagcgccucgacgacagagccg

SEQ ID NO: 13231 - RNA, 21 nt, Homo sapiens
cggggcagcucaguacaggau

SEQ ID NO: 13232 - RNA, 22 nt, Homo sapiens
aauccuuugucccugggugaga

SEQ ID NO: 13233 - RNA, 23 nt, Homo sapiens
gaacgcgcuucccuauagagggu

SEQ ID NO: 13234 - RNA, 21 nt, Homo sapiens
guggcugcacucacuuccuuc

SEQ ID NO: 13235 - RNA, 22 nt, Homo sapiens
cccugugcccggcccacuucug

SEQ ID NO: 13236 - RNA, 25 nt, Homo sapiens
aggggugguguugggacagcuccgu

SEQ ID NO: 13237 - RNA, 21 nt, Homo sapiens
guggcugcacucacuuccuuc

SEQ ID NO: 13238 - RNA, 24 nt, Homo sapiens
uugcagcugccugggagugacuuc

SEQ ID NO: 13239 - RNA, 21 nt, Homo sapiens
uccugcgcgucccagaugccc

SEQ ID NO: 13240 - RNA, 22 nt, Homo sapiens
ucugcccccuccgcugcugcca

SEQ ID NO: 13241 - RNA, 22 nt, Homo sapiens
aggugguccguggcgcguucgc

SEQ ID NO: 13242 - RNA, 20 nt, Homo sapiens
acugccccaggugcugcugg

SEQ ID NO: 13243 - RNA, 21 nt, Homo sapiens
cggggcagcucaguacaggau

SEQ ID NO: 13244 - RNA, 19 nt, Homo sapiens
ugagcugcuguaccaaaau

SEQ ID NO: 13245 - RNA, 20 nt, Homo sapiens
guccgcucggcgguggccca

SEQ ID NO: 13246 - RNA, 22 nt, Homo sapiens
aggcagcgggguguaguggaua

SEQ ID NO: 13247 - RNA, 22 nt, Homo sapiens
auccgcgcucugacucucugcc

SEQ ID NO: 13248 - RNA, 20 nt, Homo sapiens
gugucugggcggacagcugc

SEQ ID NO: 13249 - RNA, 21 nt, Homo sapiens
cgcgggugcuuacugacccuu

SEQ ID NO: 13250 - RNA, 22 nt, Homo sapiens
uggagugugacaaugguguuug

SEQ ID NO: 13251 - RNA, 22 nt, Homo sapiens
ugcccuguggacucaguucugg

SEQ ID NO: 13252 - RNA, 23 nt, Homo sapiens
ucuggcuccgugucuucacuccc

SEQ ID NO: 13253 - RNA, 22 nt, Homo sapiens
uggacggagaacugauaagggu

SEQ ID NO: 13254 - RNA, 20 nt, Homo sapiens
ccccagggcgacgcggcggg

SEQ ID NO: 13255 - RNA, 23 nt, Homo sapiens
ugagcgccucgacgacagagccg

SEQ ID NO: 13256 - RNA, 23 nt, Homo sapiens
ucccuguccuccaggagcucacg

SEQ ID NO: 13257 - RNA, 18 nt, Homo sapiens
ugcuuccuuucagagggu

SEQ ID NO: 13258 - RNA, 22 nt, Homo sapiens
aucuggagguaagaagcacuuu

SEQ ID NO: 13259 - RNA, 17 nt, Homo sapiens
gugggggagaggcuguc

SEQ ID NO: 13260 - RNA, 17 nt, Homo sapiens
ucccaccgcugccaccc

SEQ ID NO: 13261 - RNA, 18 nt, Homo sapiens
ugaggcaguagauugaau

SEQ ID NO: 13262 - RNA, 22 nt, Homo sapiens
aacuggcccucaaagucccgcu

SEQ ID NO: 13263 - RNA, 22 nt, Homo sapiens
caaucacuaacuccacugccau

SEQ ID NO: 13264 - RNA, 21 nt, Homo sapiens
agggggaaaguucuauagucc

SEQ ID NO: 13265 - RNA, 20 nt, Homo sapiens
accaggaggcugaggccccu

SEQ ID NO: 13266 - RNA, 23 nt, Homo sapiens
aggaagcccuggaggggcuggag

SEQ ID NO: 13267 - RNA, 20 nt, Homo sapiens
ggggagcuguggaagcagua

SEQ ID NO: 13268 - RNA, 23 nt, Homo sapiens
cacccggcugugugcacaugugc

SEQ ID NO: 13269 - RNA, 22 nt, Homo sapiens
augggugaauuuguagaaggau

SEQ ID NO: 13270 - RNA, 22 nt, Homo sapiens
gugugcggaaaugcuucugcua

SEQ ID NO: 13271 - RNA, 22 nt, Homo sapiens
ucgugucuuguguugcagccgg

SEQ ID NO: 13272 - RNA, 21 nt, Homo sapiens
cggcggggacggcgauugguc

SEQ ID NO: 13273 - RNA, 22 nt, Homo sapiens
aaggagcucacagucuauugag

SEQ ID NO: 13274 - RNA, 22 nt, Homo sapiens
uccuguacugagcugccccgag

SEQ ID NO: 13275 - RNA, 22 nt, Homo sapiens
aggcggggcgccgcgggaccgc

SEQ ID NO: 13276 - RNA, 23 nt, Homo sapiens
aaggagcuuacaaucuagcuggg

SEQ ID NO: 13277 - RNA, 23 nt, Homo sapiens
cacccggcugugugcacaugugc

SEQ ID NO: 13278 - RNA, 19 nt, Homo sapiens
gugaggacucgggaggugg

SEQ ID NO: 13279 - RNA, 22 nt, Homo sapiens
ugagccccugugccgcccccag

SEQ ID NO: 13280 - RNA, 21 nt, Homo sapiens
aagugaucuaaaggccuacau

SEQ ID NO: 13281 - RNA, 22 nt, Homo sapiens
ugcccuguggacucaguucugg

SEQ ID NO: 13282 - RNA, 20 nt, Homo sapiens
guguguggaaaugcuucugc

SEQ ID NO: 13283 - RNA, 23 nt, Homo sapiens
ucuggcuccgugucuucacuccc

SEQ ID NO: 13284 - RNA, 22 nt, Homo sapiens
ucaggccaggcacaguggcuca

SEQ ID NO: 13285 - RNA, 21 nt, Homo sapiens
aucacauugccagggauuucc

SEQ ID NO: 13286 - RNA, 21 nt, Homo sapiens
aucacauugccagggauuacc

SEQ ID NO: 13287 - RNA, 21 nt, Homo sapiens
agggcccccccucaauccugu

SEQ ID NO: 13288 - RNA, 21 nt, Homo sapiens
agggcccccccucaauccugu

SEQ ID NO: 13289 - RNA, 23 nt, Homo sapiens
ugaggggcagagagcgagacuuu

SEQ ID NO: 13290 - RNA, 22 nt, Homo sapiens
uugggaucauuuugcauccaua

SEQ ID NO: 13291 - RNA, 22 nt, Homo sapiens
caaccuggaggacuccaugcug

SEQ ID NO: 13292 - RNA, 22 nt, Homo sapiens
cgucaacacuugcugguuuccu

SEQ ID NO: 13293 - RNA, 20 nt, Homo sapiens
accaggaggcugaggccccu

SEQ ID NO: 13294 - RNA, 23 nt, Homo sapiens
cugggaucuccggggucuugguu

SEQ ID NO: 13295 - RNA, 22 nt, Homo sapiens
acgcccuucccccccuucuuca

SEQ ID NO: 13296 - RNA, 22 nt, Homo sapiens
caggauguggucaaguguuguu

SEQ ID NO: 13297 - RNA, 18 nt, Homo sapiens
cagggaggugaaugugau

SEQ ID NO: 13298 - RNA, 21 nt, Homo sapiens
cggcggggacggcgauugguc

SEQ ID NO: 13299 - RNA, 19 nt, Homo sapiens
aggcugcggaauucaggac

SEQ ID NO: 13300 - RNA, 21 nt, Homo sapiens
guggcugcacucacuuccuuc

SEQ ID NO: 13301 - RNA, 22 nt, Homo sapiens
aggcggggcgccgcgggaccgc

SEQ ID NO: 13302 - RNA, 22 nt, Homo sapiens
ugagaccucuggguucugagcu

SEQ ID NO: 13303 - RNA, 22 nt, Homo sapiens
ugugagguuggcauuguugucu

SEQ ID NO: 13304 - RNA, 18 nt, Homo sapiens
ugaggcaguagauugaau

SEQ ID NO: 13305 - RNA, 21 nt, Homo sapiens
cggcggggacggcgauugguc

SEQ ID NO: 13306 - RNA, 22 nt, Homo sapiens
ucugcccccuccgcugcugcca

SEQ ID NO: 13307 - RNA, 20 nt, Homo sapiens
ccccagggcgacgcggcggg

SEQ ID NO: 13308 - RNA, 23 nt, Homo sapiens
caacggaaucccaaaagcagcug

SEQ ID NO: 13309 - RNA, 20 nt, Homo sapiens
acugccccaggugcugcugg

SEQ ID NO: 13310 - RNA, 22 nt, Homo sapiens
uggcagugucuuagcugguugu

SEQ ID NO: 13311 - RNA, 22 nt, Homo sapiens
caaucacuaacuccacugccau

SEQ ID NO: 13312 - RNA, 23 nt, Homo sapiens
aggcaguguaguuagcugauugc

SEQ ID NO: 13313 - RNA, 22 nt, Homo sapiens
uggcaguguauuguuagcuggu

SEQ ID NO: 13314 - RNA, 22 nt, Homo sapiens
aggcaguguauuguuagcuggc

SEQ ID NO: 13315 - RNA, 21 nt, Homo sapiens
cggggcagcucaguacaggau

SEQ ID NO: 13316 - RNA, 22 nt, Homo sapiens
aguggggaacccuuccaugagg

SEQ ID NO: 13317 - RNA, 21 nt, Homo sapiens
aggaggcagcgcucucaggac

SEQ ID NO: 13318 - RNA, 22 nt, Homo sapiens
aggcggggcgccgcgggaccgc

SEQ ID NO: 13319 - RNA, 22 nt, Homo sapiens
ugcggggcuagggcuaacagca

SEQ ID NO: 13320 - RNA, 21 nt, Homo sapiens
aaggcagggcccccgcucccc

SEQ ID NO: 13321 - RNA, 21 nt, Homo sapiens
aagcauucuuucauugguugg

SEQ ID NO: 13322 - RNA, 20 nt, Homo sapiens
uaaggcacgcggugaaugcc

SEQ ID NO: 13323 - RNA, 18 nt, Homo sapiens
uugagaaggaggcugcug

SEQ ID NO: 13324 - RNA, 21 nt, Homo sapiens
uugugcuugaucuaaccaugu

SEQ ID NO: 13325 - RNA, 22 nt, Homo sapiens
uguaaacauccucgacuggaag

SEQ ID NO: 13326 - RNA, 22 nt, Homo sapiens
uguaaacauccccgacuggaag

SEQ ID NO: 13327 - RNA, 22 nt, Homo sapiens
uguaaacauccuugacuggaag

SEQ ID NO: 13328 - RNA, 22 nt, Homo sapiens
cuagguauggucccagggaucc

SEQ ID NO: 13329 - RNA, 20 nt, Homo sapiens
gugcauugcuguugcauugc

SEQ ID NO: 13330 - RNA, 22 nt, Homo sapiens
gaauguugcucggugaaccccu

SEQ ID NO: 13331 - RNA, 21 nt, Homo sapiens
uaaggcacccuucugaguaga

SEQ ID NO: 13332 - RNA, 22 nt, Homo sapiens
gagugccuucuuuuggagcguu

SEQ ID NO: 13333 - RNA, 20 nt, Homo sapiens
cugcaaagggaagcccuuuc

SEQ ID NO: 13334 - RNA, 22 nt, Homo sapiens
aagugccuccuuuuagaguguu

SEQ ID NO: 13335 - RNA, 20 nt, Homo sapiens
cugcaaagggaagcccuuuc

SEQ ID NO: 13336 - RNA, 22 nt, Homo sapiens
auucugcauuuuuagcaaguuc

SEQ ID NO: 13337 - RNA, 21 nt, Homo sapiens
ggcuagcaacagcgcuuaccu

SEQ ID NO: 13338 - RNA, 21 nt, Homo sapiens
uugcucacuguucuucccuag

SEQ ID NO: 13339 - RNA, 18 nt, Homo sapiens
cgggcguggugguggggg

SEQ ID NO: 13340 - RNA, 21 nt, Homo sapiens
ucacagugaaccggucucuuu

SEQ ID NO: 13341 - RNA, 20 nt, Homo sapiens
guguguggaaaugcuucugc

SEQ ID NO: 13342 - RNA, 23 nt, Homo sapiens
ucuggcuccgugucuucacuccc

SEQ ID NO: 13343 - RNA, 22 nt, Homo sapiens
uagcagcacaucaugguuuaca

SEQ ID NO: 13344 - RNA, 20 nt, Homo sapiens
ccccagggcgacgcggcggg

SEQ ID NO: 13345 - RNA, 22 nt, Homo sapiens
uguaacagcaacuccaugugga

SEQ ID NO: 13346 - RNA, 22 nt, Homo sapiens
acagcaggcacagacaggcagu

SEQ ID NO: 13347 - RNA, 22 nt, Homo sapiens
uguaaacauccuacacucagcu

SEQ ID NO: 13348 - RNA, 21 nt, Homo sapiens
gccccugggccuauccuagaa

SEQ ID NO: 13349 - RNA, 22 nt, Homo sapiens
gccugcugggguggaaccuggu

SEQ ID NO: 13350 - RNA, 23 nt, Homo sapiens
ugaggggcagagagcgagacuuu

SEQ ID NO: 13351 - RNA, 22 nt, Homo sapiens
aacccguagauccgaacuugug

SEQ ID NO: 13352 - RNA, 21 nt, Homo sapiens
uggcagggaggcugggagggg

SEQ ID NO: 13353 - RNA, 20 nt, Homo sapiens
ugagcccuguccucccgcag

SEQ ID NO: 13354 - RNA, 21 nt, Homo sapiens
acucuagcugccaaaggcgcu

SEQ ID NO: 13355 - RNA, 21 nt, Homo sapiens
gcccuccgcccgugcaccccg

SEQ ID NO: 13356 - RNA, 23 nt, Homo sapiens
cggcccgggcugcugcuguuccu

SEQ ID NO: 13357 - RNA, 22 nt, Homo sapiens
cgcaggggccgggugcucaccg

SEQ ID NO: 13358 - RNA, 22 nt, Homo sapiens
gaggguuggguggaggcucucc

SEQ ID NO: 13359 - RNA, 21 nt, Homo sapiens
agggcccccccucaauccugu

SEQ ID NO: 13360 - RNA, 18 nt, Homo sapiens
ugcuuccuuucagagggu

SEQ ID NO: 13361 - RNA, 22 nt, Homo sapiens
aucuggagguaagaagcacuuu

SEQ ID NO: 13362 - RNA, 19 nt, Homo sapiens
aggcugcggaauucaggac

SEQ ID NO: 13363 - RNA, 21 nt, Homo sapiens
guggcugcacucacuuccuuc

SEQ ID NO: 13364 - RNA, 21 nt, Homo sapiens
aggaggcagcgcucucaggac

SEQ ID NO: 13365 - RNA, 21 nt, Homo sapiens
uggaggagaaggaaggugaug

SEQ ID NO: 13366 - RNA, 22 nt, Homo sapiens
caaagugccucccuuuagagug

SEQ ID NO: 13367 - RNA, 21 nt, Homo sapiens
agagaagaagaucagccugca

SEQ ID NO: 13368 - RNA, 22 nt, Homo sapiens
uuagggcccuggcuccaucucc

SEQ ID NO: 13369 - RNA, 18 nt, Homo sapiens
uugagaaggaggcugcug

SEQ ID NO: 13370 - RNA, 21 nt, Homo sapiens
agggcccccccucaauccugu

SEQ ID NO: 13371 - RNA, 22 nt, Homo sapiens
uauugcacauuacuaaguugca

SEQ ID NO: 13372 - RNA, 23 nt, Homo sapiens
cgcauccccuagggcauuggugu

SEQ ID NO: 13373 - RNA, 21 nt, Homo sapiens
gugcauuguaguugcauugca

SEQ ID NO: 13374 - RNA, 23 nt, Homo sapiens
ugaggggcagagagcgagacuuu

SEQ ID NO: 13375 - RNA, 22 nt, Homo sapiens
ugaaacauacacgggaaaccuc

SEQ ID NO: 13376 - RNA, 22 nt, Homo sapiens
uugugucaauaugcgaugaugu

SEQ ID NO: 13377 - RNA, 20 nt, Homo sapiens
guugugucaguuuaucaaac

SEQ ID NO: 13378 - RNA, 25 nt, Homo sapiens
aggggugguguugggacagcuccgu

SEQ ID NO: 13379 - RNA, 20 nt, Homo sapiens
ggggagcuguggaagcagua

SEQ ID NO: 13380 - RNA, 21 nt, Homo sapiens
uggcagggaggcugggagggg

SEQ ID NO: 13381 - RNA, 21 nt, Homo sapiens
uccuucugcuccgucccccag

SEQ ID NO: 13382 - RNA, 22 nt, Homo sapiens
acgcccuucccccccuucuuca

SEQ ID NO: 13383 - RNA, 23 nt, Homo sapiens
ucuggcuccgugucuucacuccc

SEQ ID NO: 13384 - RNA, 23 nt, Homo sapiens
uaaggugcaucuagugcagauag

SEQ ID NO: 13385 - RNA, 22 nt, Homo sapiens
cgcaggggccgggugcucaccg

SEQ ID NO: 13386 - RNA, 23 nt, Homo sapiens
cgcauccccuagggcauuggugu

SEQ ID NO: 13387 - RNA, 17 nt, Homo sapiens
ucucgcuggggccucca

SEQ ID NO: 13388 - RNA, 18 nt, Homo sapiens
ucagcuggcccucauuuc

SEQ ID NO: 13389 - RNA, 22 nt, Homo sapiens
ucaccagcccuguguucccuag

SEQ ID NO: 13390 - RNA, 21 nt, Homo sapiens
agagaagaagaucagccugca

SEQ ID NO: 13391 - RNA, 18 nt, Homo sapiens
gucccuguucaggcgcca

SEQ ID NO: 13392 - RNA, 17 nt, Homo sapiens
ucccuguucgggcgcca

SEQ ID NO: 13393 - RNA, 24 nt, Homo sapiens
uugcagcugccugggagugacuuc

SEQ ID NO: 13394 - RNA, 18 nt, Homo sapiens
cagggaggugaaugugau

SEQ ID NO: 13395 - RNA, 23 nt, Homo sapiens
agcugguguugugaaucaggccg

SEQ ID NO: 13396 - RNA, 23 nt, Homo sapiens
ucuggcuccgugucuucacuccc

SEQ ID NO: 13397 - RNA, 22 nt, Homo sapiens
uggagagaaaggcaguuccuga

SEQ ID NO: 13398 - RNA, 23 nt, Homo sapiens
caacggaaucccaaaagcagcug

SEQ ID NO: 13399 - RNA, 22 nt, Homo sapiens
aggugguccguggcgcguucgc

SEQ ID NO: 13400 - RNA, 23 nt, Homo sapiens
ucccccaggugugauucugauuu

SEQ ID NO: 13401 - RNA, 23 nt, Homo sapiens
uaauccuugcuaccugggugaga

SEQ ID NO: 13402 - RNA, 22 nt, Homo sapiens
aucuggagguaagaagcacuuu

SEQ ID NO: 13403 - RNA, 22 nt, Homo sapiens
cgaaaacagcaauuaccuuugc

SEQ ID NO: 13404 - RNA, 24 nt, Homo sapiens
acugggggcuuucgggcucugcgu

SEQ ID NO: 13405 - RNA, 22 nt, Homo sapiens
ucuucucuguuuuggccaugug

SEQ ID NO: 13406 - RNA, 24 nt, Homo sapiens
agccugauuaaacacaugcucuga

SEQ ID NO: 13407 - RNA, 22 nt, Homo sapiens
ugauugguacgucuguggguag

SEQ ID NO: 13408 - RNA, 22 nt, Homo sapiens
caagaaccucaguugcuuuugu

SEQ ID NO: 13409 - RNA, 23 nt, Homo sapiens
uauucauuuauccccagccuaca

SEQ ID NO: 13410 - RNA, 21 nt, Homo sapiens
uggcagggaggcugggagggg

SEQ ID NO: 13411 - RNA, 22 nt, Homo sapiens
uggaauguaaggaagugugugg

SEQ ID NO: 13412 - RNA, 17 nt, Homo sapiens
ucgccuccuccucuccc

SEQ ID NO: 13413 - RNA, 23 nt, Homo sapiens
ucuggcuccgugucuucacuccc

SEQ ID NO: 13414 - RNA, 21 nt, Homo sapiens
cggcggggacggcgauugguc

SEQ ID NO: 13415 - RNA, 21 nt, Homo sapiens
aauauaacacagauggccugu

SEQ ID NO: 13416 - RNA, 21 nt, Homo sapiens
aggaggcagcgcucucaggac

SEQ ID NO: 13417 - RNA, 22 nt, Homo sapiens
aggcggggcgccgcgggaccgc

SEQ ID NO: 13418 - RNA, 21 nt, Homo sapiens
cgcgggugcuuacugacccuu

SEQ ID NO: 13419 - RNA, 21 nt, Homo sapiens
aaggcagggcccccgcucccc

SEQ ID NO: 13420 - RNA, 23 nt, Homo sapiens
cggcccgggcugcugcuguuccu

SEQ ID NO: 13421 - RNA, 23 nt, Homo sapiens
cggcccgggcugcugcuguuccu

SEQ ID NO: 13422 - RNA, 21 nt, Homo sapiens
cggcggggacggcgauugguc

SEQ ID NO: 13423 - RNA, 21 nt, Homo sapiens
agggcccccccucaauccugu

SEQ ID NO: 13424 - RNA, 23 nt, Homo sapiens
ugagcgccucgacgacagagccg

SEQ ID NO: 13425 - RNA, 22 nt, Homo sapiens
aggcggggcgccgcgggaccgc

SEQ ID NO: 13426 - RNA, 22 nt, Homo sapiens
ugcggggcuagggcuaacagca

SEQ ID NO: 13427 - RNA, 21 nt, Homo sapiens
uggaggagaaggaaggugaug

SEQ ID NO: 13428 - RNA, 22 nt, Homo sapiens
uggagugugacaaugguguuug

SEQ ID NO: 13429 - RNA, 22 nt, Homo sapiens
acgcccuucccccccuucuuca

SEQ ID NO: 13430 - RNA, 23 nt, Homo sapiens
cggcccgggcugcugcuguuccu

SEQ ID NO: 13431 - RNA, 21 nt, Homo sapiens
cggcggggacggcgauugguc

SEQ ID NO: 13432 - RNA, 22 nt, Homo sapiens
cauugcacuugucucggucuga

SEQ ID NO: 13433 - RNA, 19 nt, Homo sapiens
gagccaguuggacaggagc

SEQ ID NO: 13434 - RNA, 22 nt, Homo sapiens
aggcggggcgccgcgggaccgc

SEQ ID NO: 13435 - RNA, 22 nt, Homo sapiens
gguggcccggccgugccugagg

SEQ ID NO: 13436 - RNA, 21 nt, Homo sapiens
uggaggagaaggaaggugaug

SEQ ID NO: 13437 - RNA, 22 nt, Homo sapiens
acuccagccccacagccucagc

SEQ ID NO: 13438 - RNA, 22 nt, Homo sapiens
cugcccuggcccgagggaccga

SEQ ID NO: 13439 - RNA, 22 nt, Homo sapiens
cacuggcuccuuucuggguaga

SEQ ID NO: 13440 - RNA, 23 nt, Homo sapiens
ccugcagcgacuugauggcuucc

SEQ ID NO: 13441 - RNA, 20 nt, Homo sapiens
ucugcaggguuugcuuugag

SEQ ID NO: 13442 - RNA, 22 nt, Homo sapiens
ucguaccgugaguaauaaugcg

SEQ ID NO: 13443 - RNA, 23 nt, Homo sapiens
cggcccgggcugcugcuguuccu

SEQ ID NO: 13444 - RNA, 18 nt, Homo sapiens
uccagugcccuccucucc

SEQ ID NO: 13445 - RNA, 22 nt, Homo sapiens
uggcucaguucagcaggaacag

SEQ ID NO: 13446 - RNA, 22 nt, Homo sapiens
agacccuggucugcacucuauc

SEQ ID NO: 13447 - RNA, 22 nt, Homo sapiens
uccgagccugggucucccucuu

SEQ ID NO: 13448 - RNA, 22 nt, Homo sapiens
ugagccccugugccgcccccag

SEQ ID NO: 13449 - RNA, 18 nt, Homo sapiens
aucccaccucugccacca

SEQ ID NO: 13450 - RNA, 22 nt, Homo sapiens
acucggcguggcgucggucgug

SEQ ID NO: 13451 - RNA, 22 nt, Homo sapiens
cucggcgcggggcgcgggcucc

SEQ ID NO: 13452 - RNA, 21 nt, Homo sapiens
gcccuccgcccgugcaccccg

SEQ ID NO: 13453 - RNA, 21 nt, Homo sapiens
cggcggggacggcgauugguc

SEQ ID NO: 13454 - RNA, 22 nt, Homo sapiens
cauugcacuugucucggucuga

SEQ ID NO: 13455 - RNA, 22 nt, Homo sapiens
uguaaacauccuacacucagcu

SEQ ID NO: 13456 - RNA, 23 nt, Homo sapiens
ucccccaggugugauucugauuu

SEQ ID NO: 13457 - RNA, 23 nt, Homo sapiens
ugaggggcagagagcgagacuuu

SEQ ID NO: 13458 - RNA, 22 nt, Homo sapiens
ccucccacacccaaggcuugca

SEQ ID NO: 13459 - RNA, 25 nt, Homo sapiens
aggggugguguugggacagcuccgu

SEQ ID NO: 13460 - RNA, 22 nt, Homo sapiens
uccgagccugggucucccucuu

SEQ ID NO: 13461 - RNA, 24 nt, Homo sapiens
acugggggcuuucgggcucugcgu

SEQ ID NO: 13462 - RNA, 25 nt, Homo sapiens
ggcggagggaaguagguccguuggu

SEQ ID NO: 13463 - RNA, 22 nt, Homo sapiens
aggcggggcgccgcgggaccgc

SEQ ID NO: 13464 - RNA, 22 nt, Homo sapiens
ugcggggcuagggcuaacagca

SEQ ID NO: 13465 - RNA, 21 nt, Homo sapiens
uggaggagaaggaaggugaug

SEQ ID NO: 13466 - RNA, 23 nt, Homo sapiens
aaaagugcuuacagugcagguag

SEQ ID NO: 13467 - RNA, 21 nt, Homo sapiens
uaaagugcugacagugcagau

SEQ ID NO: 13468 - RNA, 22 nt, Homo sapiens
acucggcguggcgucggucgug

SEQ ID NO: 13469 - RNA, 22 nt, Homo sapiens
cagugguuuuacccuaugguag

SEQ ID NO: 13470 - RNA, 23 nt, Homo sapiens
ucuggcuccgugucuucacuccc

SEQ ID NO: 13471 - RNA, 23 nt, Homo sapiens
caaagugcuuacagugcagguag

SEQ ID NO: 13472 - RNA, 23 nt, Homo sapiens
uaaagugcuuauagugcagguag

SEQ ID NO: 13473 - RNA, 23 nt, Homo sapiens
caaagugcucauagugcagguag

SEQ ID NO: 13474 - RNA, 22 nt, Homo sapiens
agaucagaaggugauuguggcu

SEQ ID NO: 13475 - RNA, 21 nt, Homo sapiens
cagcagcacacugugguuugu

SEQ ID NO: 13476 - RNA, 22 nt, Homo sapiens
agacccuggucugcacucuauc

SEQ ID NO: 13477 - RNA, 23 nt, Homo sapiens
uaaauuucaccuuucugagaagg

SEQ ID NO: 13478 - RNA, 22 nt, Homo sapiens
aaagugcauccuuuuagagugu

SEQ ID NO: 13479 - RNA, 22 nt, Homo sapiens
aaagugcauccuuuuagagguu

SEQ ID NO: 13480 - RNA, 22 nt, Homo sapiens
aaagugcaucuuuuuagaggau

SEQ ID NO: 13481 - RNA, 22 nt, Homo sapiens
caaagugccucccuuuagagug

SEQ ID NO: 13482 - RNA, 23 nt, Homo sapiens
cucuugagggaagcacuuucugu

SEQ ID NO: 13483 - RNA, 23 nt, Homo sapiens
caaagugcuguucgugcagguag

SEQ ID NO: 13484 - RNA, 18 nt, Homo sapiens
aucccaccucugccacca

SEQ ID NO: 13485 - RNA, 17 nt, Homo sapiens
ucgccuccuccucuccc

SEQ ID NO: 13486 - RNA, 21 nt, Homo sapiens
cggcggggacggcgauugguc

SEQ ID NO: 13487 - RNA, 20 nt, Homo sapiens
guccgcucggcgguggccca

SEQ ID NO: 13488 - RNA, 25 nt, Homo sapiens
aggggugguguugggacagcuccgu

SEQ ID NO: 13489 - RNA, 22 nt, Homo sapiens
aggcggggcgccgcgggaccgc

SEQ ID NO: 13490 - RNA, 22 nt, Homo sapiens
aggcagcgggguguaguggaua

SEQ ID NO: 13491 - RNA, 24 nt, Homo sapiens
uggggagcugaggcucugggggug

SEQ ID NO: 13492 - RNA, 22 nt, Homo sapiens
ugugacugguugaccagagggg

SEQ ID NO: 13493 - RNA, 22 nt, Homo sapiens
aacuguuugcagaggaaacuga

SEQ ID NO: 13494 - RNA, 21 nt, Homo sapiens
uagcagcacagaaauauuggc

SEQ ID NO: 13495 - RNA, 22 nt, Homo sapiens
gugaaauguuuaggaccacuag

SEQ ID NO: 13496 - RNA, 22 nt, Homo sapiens
aacaauauccuggugcugagug

SEQ ID NO: 13497 - RNA, 21 nt, Homo sapiens
acuggacuuggagucagaagg

SEQ ID NO: 13498 - RNA, 23 nt, Homo sapiens
uacuccagagggcgucacucaug

SEQ ID NO: 13499 - RNA, 22 nt, Homo sapiens
aucuggagguaagaagcacuuu

SEQ ID NO: 13500 - RNA, 22 nt, Homo sapiens
ugugacagauugauaacugaaa

SEQ ID NO: 13501 - RNA, 21 nt, Homo sapiens
gcgacccauacuugguuucag

SEQ ID NO: 13502 - RNA, 23 nt, Homo sapiens
ugucacucggcucggcccacuac

SEQ ID NO: 13503 - RNA, 23 nt, Homo sapiens
ugucacucggcucggcccacuac

SEQ ID NO: 13504 - RNA, 21 nt, Homo sapiens
cugacuguugccguccuccag

SEQ ID NO: 13505 - RNA, 23 nt, Homo sapiens
ucuggcuccgugucuucacuccc

SEQ ID NO: 13506 - RNA, 20 nt, Homo sapiens
uguuuugauaacaguaaugu

SEQ ID NO: 13507 - RNA, 22 nt, Homo sapiens
uggcaguguauuguuagcuggu

SEQ ID NO: 13508 - RNA, 23 nt, Homo sapiens
gaagugcuucgauuuuggggugu

SEQ ID NO: 13509 - RNA, 22 nt, Homo sapiens
gucauacacggcucuccucucu

SEQ ID NO: 13510 - RNA, 22 nt, Homo sapiens
agucauuggaggguuugagcag

SEQ ID NO: 13511 - RNA, 21 nt, Homo sapiens
uggguuuacguugggagaacu

SEQ ID NO: 13512 - RNA, 21 nt, Homo sapiens
uacucaaaaagcugucaguca

SEQ ID NO: 13513 - RNA, 22 nt, Homo sapiens
ucuucucuguuuuggccaugug

SEQ ID NO: 13514 - RNA, 22 nt, Homo sapiens
acccgucccguucguccccgga

SEQ ID NO: 13515 - RNA, 18 nt, Homo sapiens
aucccaccucugccacca

SEQ ID NO: 13516 - RNA, 18 nt, Homo sapiens
gucccuguucaggcgcca

SEQ ID NO: 13517 - RNA, 22 nt, Homo sapiens
caaagaauucuccuuuugggcu

SEQ ID NO: 13518 - RNA, 23 nt, Homo sapiens
agcuacauugucugcuggguuuc

SEQ ID NO: 13519 - RNA, 23 nt, Homo sapiens
ucccuguccuccaggagcucacg

SEQ ID NO: 13520 - RNA, 22 nt, Homo sapiens
uggcagugucuuagcugguugu

SEQ ID NO: 13521 - RNA, 22 nt, Homo sapiens
caaucacuaacuccacugccau

SEQ ID NO: 13522 - RNA, 23 nt, Homo sapiens
aggcaguguaguuagcugauugc

SEQ ID NO: 13523 - RNA, 22 nt, Homo sapiens
uggcaguguauuguuagcuggu

SEQ ID NO: 13524 - RNA, 22 nt, Homo sapiens
aggcaguguauuguuagcuggc

SEQ ID NO: 13525 - RNA, 22 nt, Homo sapiens
uugggaucauuuugcauccaua

SEQ ID NO: 13526 - RNA, 22 nt, Homo sapiens
uugggaucauuuugcauccaua

SEQ ID NO: 13527 - RNA, 22 nt, Homo sapiens
agaggcuggccgugaugaauuc

SEQ ID NO: 13528 - RNA, 23 nt, Homo sapiens
uagcagcgggaacaguucugcag

SEQ ID NO: 13529 - RNA, 23 nt, Homo sapiens
uacuccagagggcgucacucaug

SEQ ID NO: 13530 - RNA, 21 nt, Homo sapiens
ggcuagcaacagcgcuuaccu

SEQ ID NO: 13531 - RNA, 23 nt, Homo sapiens
aucgcugcgguugcgagcgcugu

SEQ ID NO: 13532 - RNA, 23 nt, Homo sapiens
cugggaucuccggggucuugguu

SEQ ID NO: 13533 - RNA, 23 nt, Homo sapiens
cugggaucuccggggucuugguu

SEQ ID NO: 13534 - RNA, 22 nt, Homo sapiens
uauugcacucgucccggccucc

SEQ ID NO: 13535 - RNA, 22 nt, Homo sapiens
aguggggaacccuuccaugagg

SEQ ID NO: 13536 - RNA, 22 nt, Homo sapiens
auccgcgcucugacucucugcc

SEQ ID NO: 13537 - RNA, 21 nt, Homo sapiens
ucguggccuggucuccauuau

SEQ ID NO: 13538 - RNA, 22 nt, Homo sapiens
uggagugugacaaugguguuug

SEQ ID NO: 13539 - RNA, 22 nt, Homo sapiens
acccgucccguucguccccgga

SEQ ID NO: 13540 - RNA, 18 nt, Homo sapiens
cgggcguggugguggggg

SEQ ID NO: 13541 - RNA, 17 nt, Homo sapiens
ucccaccgcugccaccc

SEQ ID NO: 13542 - RNA, 21 nt, Homo sapiens
uuaggccgcagaucuggguga

SEQ ID NO: 13543 - RNA, 21 nt, Homo sapiens
cggcggggacggcgauugguc

SEQ ID NO: 13544 - RNA, 20 nt, Homo sapiens
ccccagggcgacgcggcggg

SEQ ID NO: 13545 - RNA, 22 nt, Homo sapiens
ucaggccaggcacaguggcuca

SEQ ID NO: 13546 - RNA, 21 nt, Homo sapiens
gccccugggccuauccuagaa

SEQ ID NO: 13547 - RNA, 22 nt, Homo sapiens
ucaggcucaguccccucccgau

SEQ ID NO: 13548 - RNA, 21 nt, Homo sapiens
aagccugcccggcuccucggg

SEQ ID NO: 13549 - RNA, 22 nt, Homo sapiens
aggcggggcgccgcgggaccgc

SEQ ID NO: 13550 - RNA, 22 nt, Homo sapiens
ugcggggcuagggcuaacagca

SEQ ID NO: 13551 - RNA, 17 nt, Homo sapiens
ucccuguucgggcgcca

SEQ ID NO: 13552 - RNA, 22 nt, Homo sapiens
ugagaacugaauuccauggguu

SEQ ID NO: 13553 - RNA, 22 nt, Homo sapiens
ugcccuguggacucaguucugg

SEQ ID NO: 13554 - RNA, 23 nt, Homo sapiens
ucuggcuccgugucuucacuccc

SEQ ID NO: 13555 - RNA, 21 nt, Homo sapiens
ucgaggagcucacagucuagu

SEQ ID NO: 13556 - RNA, 23 nt, Homo sapiens
cggcccgggcugcugcuguuccu

SEQ ID NO: 13557 - RNA, 22 nt, Homo sapiens
aacuggcccucaaagucccgcu

SEQ ID NO: 13558 - RNA, 22 nt, Homo sapiens
uccuucauuccaccggagucug

SEQ ID NO: 13559 - RNA, 22 nt, Homo sapiens
cauugcacuugucucggucuga

SEQ ID NO: 13560 - RNA, 22 nt, Homo sapiens
uaugugccuuuggacuacaucg

SEQ ID NO: 13561 - RNA, 21 nt, Homo sapiens
aggaggcagcgcucucaggac

SEQ ID NO: 13562 - RNA, 25 nt, Homo sapiens
ggcggagggaaguagguccguuggu

SEQ ID NO: 13563 - RNA, 22 nt, Homo sapiens
acuccagccccacagccucagc

SEQ ID NO: 13564 - RNA, 22 nt, Homo sapiens
uggauuucuuugugaaucacca

SEQ ID NO: 13565 - RNA, 23 nt, Homo sapiens
gcagcagagaauaggacuacguc

SEQ ID NO: 13566 - RNA, 20 nt, Homo sapiens
ggggagcuguggaagcagua

SEQ ID NO: 13567 - RNA, 18 nt, Homo sapiens
cagggaggugaaugugau

SEQ ID NO: 13568 - RNA, 22 nt, Homo sapiens
ugauauguuugauauauuaggu

SEQ ID NO: 13569 - RNA, 20 nt, Homo sapiens
ccuccugcccuccuugcugu

SEQ ID NO: 13570 - RNA, 22 nt, Homo sapiens
uuauaaagcaaugagacugauu

SEQ ID NO: 13571 - RNA, 22 nt, Homo sapiens
gcugacuccuaguccagggcuc

SEQ ID NO: 13572 - RNA, 22 nt, Homo sapiens
caaccuggaggacuccaugcug

SEQ ID NO: 13573 - RNA, 22 nt, Homo sapiens
aagugcugucauagcugagguc

SEQ ID NO: 13574 - RNA, 22 nt, Homo sapiens
aaaccuguguuguucaagaguc

SEQ ID NO: 13575 - RNA, 23 nt, Homo sapiens
ucugcucauaccccaugguuucu

SEQ ID NO: 13576 - RNA, 22 nt, Homo sapiens
cugcccuggcccgagggaccga

SEQ ID NO: 13577 - RNA, 23 nt, Homo sapiens
ucuuugguuaucuagcuguauga

SEQ ID NO: 13578 - RNA, 22 nt, Homo sapiens
acccgucccguucguccccgga

SEQ ID NO: 13579 - RNA, 21 nt, Homo sapiens
ugcaggaccaagaugagcccu

SEQ ID NO: 13580 - RNA, 23 nt, Homo sapiens
ucuggcuccgugucuucacuccc

SEQ ID NO: 13581 - RNA, 21 nt, Homo sapiens
cggcggggacggcgauugguc

SEQ ID NO: 13582 - RNA, 22 nt, Homo sapiens
uacccagagcaugcagugugaa

SEQ ID NO: 13583 - RNA, 22 nt, Homo sapiens
cccugugcccggcccacuucug

SEQ ID NO: 13584 - RNA, 22 nt, Homo sapiens
aacacaccugguuaaccucuuu

SEQ ID NO: 13585 - RNA, 22 nt, Homo sapiens
aacacaccuauucaaggauuca

SEQ ID NO: 13586 - RNA, 23 nt, Homo sapiens
ugaggggcagagagcgagacuuu

SEQ ID NO: 13587 - RNA, 19 nt, Homo sapiens
aggcugcggaauucaggac

SEQ ID NO: 13588 - RNA, 22 nt, Homo sapiens
aggcggggcgccgcgggaccgc

SEQ ID NO: 13589 - RNA, 20 nt, Homo sapiens
accaggaggcugaggccccu

SEQ ID NO: 13590 - RNA, 22 nt, Homo sapiens
ugcggggcuagggcuaacagca

SEQ ID NO: 13591 - RNA, 22 nt, Homo sapiens
acuccagccccacagccucagc

SEQ ID NO: 13592 - RNA, 22 nt, Homo sapiens
uauugcacucgucccggccucc

SEQ ID NO: 13593 - RNA, 21 nt, Homo sapiens
uggcagggaggcugggagggg

SEQ ID NO: 13594 - RNA, 22 nt, Homo sapiens
ugagccccugugccgcccccag

SEQ ID NO: 13595 - RNA, 20 nt, Homo sapiens
ugagcccuguccucccgcag

SEQ ID NO: 13596 - RNA, 21 nt, Homo sapiens
cggcggggacggcgauugguc

SEQ ID NO: 13597 - RNA, 22 nt, Homo sapiens
cauugcacuugucucggucuga

SEQ ID NO: 13598 - RNA, 23 nt, Homo sapiens
ugagcgccucgacgacagagccg

SEQ ID NO: 13599 - RNA, 22 nt, Homo sapiens
uccgagccugggucucccucuu

SEQ ID NO: 13600 - RNA, 22 nt, Homo sapiens
aggcggggcgccgcgggaccgc

SEQ ID NO: 13601 - RNA, 22 nt, Homo sapiens
ugcggggcuagggcuaacagca

SEQ ID NO: 13602 - RNA, 22 nt, Homo sapiens
ugagccccugugccgcccccag

SEQ ID NO: 13603 - RNA, 17 nt, Homo sapiens
ucccuguucgggcgcca

SEQ ID NO: 13604 - RNA, 18 nt, Homo sapiens
cagggaggugaaugugau

SEQ ID NO: 13605 - RNA, 22 nt, Homo sapiens
ugcccuguggacucaguucugg

SEQ ID NO: 13606 - RNA, 23 nt, Homo sapiens
ucuggcuccgugucuucacuccc

SEQ ID NO: 13607 - RNA, 23 nt, Homo sapiens
caacggaaucccaaaagcagcug

SEQ ID NO: 13608 - RNA, 21 nt, Homo sapiens
cugaccuaugaauugacagcc

SEQ ID NO: 13609 - RNA, 23 nt, Homo sapiens
ugagcgccucgacgacagagccg

SEQ ID NO: 13610 - RNA, 22 nt, Homo sapiens
uggcagugucuuagcugguugu

SEQ ID NO: 13611 - RNA, 23 nt, Homo sapiens
ugaggggcagagagcgagacuuu

SEQ ID NO: 13612 - RNA, 19 nt, Homo sapiens
aggcugcggaauucaggac

SEQ ID NO: 13613 - RNA, 22 nt, Homo sapiens
ggggguccccggugcucggauc

SEQ ID NO: 13614 - RNA, 21 nt, Homo sapiens
guggcugcacucacuuccuuc

SEQ ID NO: 13615 - RNA, 17 nt, Homo sapiens
ucucgcuggggccucca

SEQ ID NO: 13616 - RNA, 20 nt, Homo sapiens
cggcucugggucugugggga

SEQ ID NO: 13617 - RNA, 22 nt, Homo sapiens
auccgcgcucugacucucugcc

SEQ ID NO: 13618 - RNA, 21 nt, Homo sapiens
uggacugcccugaucuggaga

SEQ ID NO: 13619 - RNA, 18 nt, Homo sapiens
cagggaggugaaugugau

SEQ ID NO: 13620 - RNA, 22 nt, Homo sapiens
ucugcccccuccgcugcugcca

SEQ ID NO: 13621 - RNA, 22 nt, Homo sapiens
cauugcacuugucucggucuga

SEQ ID NO: 13622 - RNA, 20 nt, Homo sapiens
acugccccaggugcugcugg

SEQ ID NO: 13623 - RNA, 23 nt, Homo sapiens
ugaggggcagagagcgagacuuu

SEQ ID NO: 13624 - RNA, 21 nt, Homo sapiens
cggggcagcucaguacaggau

SEQ ID NO: 13625 - RNA, 25 nt, Homo sapiens
aggggugguguugggacagcuccgu

SEQ ID NO: 13626 - RNA, 21 nt, Homo sapiens
agggggaaaguucuauagucc

SEQ ID NO: 13627 - RNA, 19 nt, Homo sapiens
aguguggcuuucuuagagc

SEQ ID NO: 13628 - RNA, 22 nt, Homo sapiens
gguggcccggccgugccugagg

SEQ ID NO: 13629 - RNA, 21 nt, Homo sapiens
uggaggagaaggaaggugaug

SEQ ID NO: 13630 - RNA, 20 nt, Homo sapiens
ggggagcuguggaagcagua

SEQ ID NO: 13631 - RNA, 23 nt, Homo sapiens
aaaagugcuuacagugcagguag

SEQ ID NO: 13632 - RNA, 18 nt, Homo sapiens
ucagcuggcccucauuuc

SEQ ID NO: 13633 - RNA, 22 nt, Homo sapiens
ucaccagcccuguguucccuag

SEQ ID NO: 13634 - RNA, 22 nt, Homo sapiens
uaacagucuacagccauggucg

SEQ ID NO: 13635 - RNA, 23 nt, Homo sapiens
agcugguguugugaaucaggccg

SEQ ID NO: 13636 - RNA, 21 nt, Homo sapiens
uaacagucuccagucacggcc

SEQ ID NO: 13637 - RNA, 22 nt, Homo sapiens
auauaauacaaccugcuaagug

SEQ ID NO: 13638 - RNA, 22 nt, Homo sapiens
aacuguuugcagaggaaacuga

SEQ ID NO: 13639 - RNA, 22 nt, Homo sapiens
ucaggcucaguccccucccgau

SEQ ID NO: 13640 - RNA, 19 nt, Homo sapiens
ugagcugcuguaccaaaau

SEQ ID NO: 13641 - RNA, 22 nt, Homo sapiens
uugugucaauaugcgaugaugu

SEQ ID NO: 13642 - RNA, 22 nt, Homo sapiens
augcugacauauuuacuagagg

SEQ ID NO: 13643 - RNA, 19 nt, Homo sapiens
gugucugcuuccuguggga

SEQ ID NO: 13644 - RNA, 19 nt, Homo sapiens
aagcagcugccucugaggc

SEQ ID NO: 13645 - RNA, 21 nt, Homo sapiens
guggcugcacucacuuccuuc

SEQ ID NO: 13646 - RNA, 22 nt, Homo sapiens
ugugcgcagggagaccucuccc

SEQ ID NO: 13647 - RNA, 22 nt, Homo sapiens
cucggcgcggggcgcgggcucc

SEQ ID NO: 13648 - RNA, 26 nt, Homo sapiens
gaugaugauggcagcaaauucugaaa

SEQ ID NO: 13649 - RNA, 18 nt, Homo sapiens
uugagaaggaggcugcug

SEQ ID NO: 13650 - RNA, 22 nt, Homo sapiens
ucucccaacccuuguaccagug

SEQ ID NO: 13651 - RNA, 22 nt, Homo sapiens
aagcugccaguugaagaacugu

SEQ ID NO: 13652 - RNA, 23 nt, Homo sapiens
agcuacauugucugcuggguuuc

SEQ ID NO: 13653 - RNA, 21 nt, Homo sapiens
agcuacaucuggcuacugggu

SEQ ID NO: 13654 - RNA, 22 nt, Homo sapiens
uggcagugucuuagcugguugu

SEQ ID NO: 13655 - RNA, 21 nt, Homo sapiens
cuucuugugcucuaggauugu

SEQ ID NO: 13656 - RNA, 18 nt, Homo sapiens
ugaggcaguagauugaau

SEQ ID NO: 13657 - RNA, 22 nt, Homo sapiens
gucccucuccaaaugugucuug

SEQ ID NO: 13658 - RNA, 21 nt, Homo sapiens
aggaggcagcgcucucaggac

SEQ ID NO: 13659 - RNA, 22 nt, Homo sapiens
ugcaacgaaccugagccacuga

SEQ ID NO: 13660 - RNA, 24 nt, Homo sapiens
uuuggcaaugguagaacucacacu

SEQ ID NO: 13661 - RNA, 21 nt, Homo sapiens
cugaccuaugaauugacagcc

SEQ ID NO: 13662 - RNA, 22 nt, Homo sapiens
ugauugguacgucuguggguag

SEQ ID NO: 13663 - RNA, 18 nt, Homo sapiens
ugcuuccuuucagagggu

SEQ ID NO: 13664 - RNA, 22 nt, Homo sapiens
aucuggagguaagaagcacuuu

SEQ ID NO: 13665 - RNA, 21 nt, Homo sapiens
uuggccacaauggguuagaac

SEQ ID NO: 13666 - RNA, 21 nt, Homo sapiens
cggcggggacggcgauugguc

SEQ ID NO: 13667 - RNA, 22 nt, Homo sapiens
ggggguccccggugcucggauc

SEQ ID NO: 13668 - RNA, 22 nt, Homo sapiens
aggcggggcgccgcgggaccgc

SEQ ID NO: 13669 - RNA, 20 nt, Homo sapiens
cggcucugggucugugggga

SEQ ID NO: 13670 - RNA, 22 nt, Homo sapiens
aacccguagauccgaucuugug

SEQ ID NO: 13671 - RNA, 22 nt, Homo sapiens
cacccguagaaccgaccuugcg

SEQ ID NO: 13672 - RNA, 21 nt, Homo sapiens
cccggagccaggaugcagcuc

SEQ ID NO: 13673 - RNA, 22 nt, Homo sapiens
acucggcguggcgucggucgug

SEQ ID NO: 13674 - RNA, 22 nt, Homo sapiens
cucggcgcggggcgcgggcucc

SEQ ID NO: 13675 - RNA, 23 nt, Homo sapiens
cggcccgggcugcugcuguuccu

SEQ ID NO: 13676 - RNA, 22 nt, Homo sapiens
gguccagaggggagauagguuc

SEQ ID NO: 13677 - RNA, 23 nt, Homo sapiens
ugagcgccucgacgacagagccg

SEQ ID NO: 13678 - RNA, 22 nt, Homo sapiens
gccugcugggguggaaccuggu

SEQ ID NO: 13679 - RNA, 23 nt, Homo sapiens
caaagcgcuucucuuuagagugu

SEQ ID NO: 13680 - RNA, 21 nt, Homo sapiens
cuccagagggaaguacuuucu

SEQ ID NO: 13681 - RNA, 21 nt, Homo sapiens
cuccagagggaugcacuuucu

SEQ ID NO: 13682 - RNA, 21 nt, Homo sapiens
uuggccacaauggguuagaac

SEQ ID NO: 13683 - RNA, 22 nt, Homo sapiens
ugcggggcuagggcuaacagca

SEQ ID NO: 13684 - RNA, 21 nt, Homo sapiens
uccuucugcuccgucccccag

SEQ ID NO: 13685 - RNA, 21 nt, Homo sapiens
gcccuccgcccgugcaccccg

SEQ ID NO: 13686 - RNA, 22 nt, Homo sapiens
uggcucaguucagcaggaacag

SEQ ID NO: 13687 - RNA, 22 nt, Homo sapiens
cuuaugcaagauucccuucuac

SEQ ID NO: 13688 - RNA, 21 nt, Homo sapiens
ugagaugaagcacuguagcuc

SEQ ID NO: 13689 - RNA, 22 nt, Homo sapiens
aagcugccaguugaagaacugu

SEQ ID NO: 13690 - RNA, 21 nt, Homo sapiens
uaaagugcugacagugcagau

SEQ ID NO: 13691 - RNA, 23 nt, Homo sapiens
cagugcaaugauauugucaaagc

SEQ ID NO: 13692 - RNA, 21 nt, Homo sapiens
gaaggcgcuucccuuuggagu

SEQ ID NO: 13693 - RNA, 22 nt, Homo sapiens
gaaggcgcuucccuuuagagcg

SEQ ID NO: 13694 - RNA, 19 nt, Homo sapiens
gggcgccugugaucccaac

SEQ ID NO: 13695 - RNA, 25 nt, Homo sapiens
ggcggagggaaguagguccguuggu

SEQ ID NO: 13696 - RNA, 22 nt, Homo sapiens
gguggcccggccgugccugagg

SEQ ID NO: 13697 - RNA, 22 nt, Homo sapiens
ugcggggcuagggcuaacagca

SEQ ID NO: 13698 - RNA, 22 nt, Homo sapiens
aggcagcgggguguaguggaua

SEQ ID NO: 13699 - RNA, 22 nt, Homo sapiens
auccgcgcucugacucucugcc

SEQ ID NO: 13700 - RNA, 21 nt, Homo sapiens
uacaguacugugauaacugaa

SEQ ID NO: 13701 - RNA, 22 nt, Homo sapiens
ucggccugaccacccaccccac

SEQ ID NO: 13702 - RNA, 17 nt, Homo sapiens
ucgccuccuccucuccc

SEQ ID NO: 13703 - RNA, 22 nt, Homo sapiens
ugugagguuggcauuguugucu

SEQ ID NO: 13704 - RNA, 23 nt, Homo sapiens
ucuggcuccgugucuucacuccc

SEQ ID NO: 13705 - RNA, 23 nt, Homo sapiens
ucccuguccuccaggagcucacg

SEQ ID NO: 13706 - RNA, 21 nt, Homo sapiens
cgcgggugcuuacugacccuu

SEQ ID NO: 13707 - RNA, 23 nt, Homo sapiens
ccugcagcgacuugauggcuucc

SEQ ID NO: 13708 - RNA, 23 nt, Homo sapiens
ucuggcuccgugucuucacuccc

SEQ ID NO: 13709 - RNA, 23 nt, Homo sapiens
cggcccgggcugcugcuguuccu

SEQ ID NO: 13710 - RNA, 23 nt, Homo sapiens
ugaguaccgccaugucuguuggg

SEQ ID NO: 13711 - RNA, 20 nt, Homo sapiens
ccuccugcccuccuugcugu

SEQ ID NO: 13712 - RNA, 21 nt, Homo sapiens
aggggugcuaucugugauuga

SEQ ID NO: 13713 - RNA, 22 nt, Homo sapiens
agaggcuggccgugaugaauuc

SEQ ID NO: 13714 - RNA, 21 nt, Homo sapiens
uccgguucucagggcuccacc

SEQ ID NO: 13715 - RNA, 24 nt, Homo sapiens
uggggagcugaggcucugggggug

SEQ ID NO: 13716 - RNA, 23 nt, Homo sapiens
ucuggcuccgugucuucacuccc

SEQ ID NO: 13717 - RNA, 21 nt, Homo sapiens
cggcggggacggcgauugguc

SEQ ID NO: 13718 - RNA, 22 nt, Homo sapiens
acacagggcuguugugaagacu

SEQ ID NO: 13719 - RNA, 21 nt, Homo sapiens
ugucuugcaggccgucaugca

SEQ ID NO: 13720 - RNA, 23 nt, Homo sapiens
cacucagccuugagggcacuuuc

SEQ ID NO: 13721 - RNA, 22 nt, Homo sapiens
aggcggggcgccgcgggaccgc

SEQ ID NO: 13722 - RNA, 22 nt, Homo sapiens
ugcggggcuagggcuaacagca

SEQ ID NO: 13723 - RNA, 22 nt, Homo sapiens
ugugcgcagggagaccucuccc

SEQ ID NO: 13724 - RNA, 22 nt, Homo sapiens
uuuccggcucgcgugggugugu

SEQ ID NO: 13725 - RNA, 21 nt, Homo sapiens
uggcagggaggcugggagggg

SEQ ID NO: 13726 - RNA, 18 nt, Homo sapiens
aucccaccucugccacca

SEQ ID NO: 13727 - RNA, 17 nt, Homo sapiens
ucccaccgcugccaccc

SEQ ID NO: 13728 - RNA, 21 nt, Homo sapiens
uggacugcccugaucuggaga

SEQ ID NO: 13729 - RNA, 22 nt, Homo sapiens
acucggcguggcgucggucgug

SEQ ID NO: 13730 - RNA, 22 nt, Homo sapiens
ggagacgcggcccuguuggagu

SEQ ID NO: 13731 - RNA, 22 nt, Homo sapiens
agaauuguggcuggacaucugu

SEQ ID NO: 13732 - RNA, 21 nt, Homo sapiens
uaaagugcugacagugcagau

SEQ ID NO: 13733 - RNA, 23 nt, Homo sapiens
cagugcaaugauauugucaaagc

SEQ ID NO: 13734 - RNA, 20 nt, Homo sapiens
ccucugggcccuuccuccag

SEQ ID NO: 13735 - RNA, 22 nt, Homo sapiens
ucucugggccugugucuuaggc

SEQ ID NO: 13736 - RNA, 22 nt, Homo sapiens
ugcggggcuagggcuaacagca

SEQ ID NO: 13737 - RNA, 21 nt, Homo sapiens
aaggcagggcccccgcucccc

SEQ ID NO: 13738 - RNA, 22 nt, Homo sapiens
uggagugugacaaugguguuug

SEQ ID NO: 13739 - RNA, 23 nt, Homo sapiens
uaaggugcaucuagugcagauag

SEQ ID NO: 13740 - RNA, 21 nt, Homo sapiens
acuggacuuggagucagaagg

SEQ ID NO: 13741 - RNA, 21 nt, Homo sapiens
aauauaacacagauggccugu

SEQ ID NO: 13742 - RNA, 24 nt, Homo sapiens
ugccugggucucuggccugcgcgu

SEQ ID NO: 13743 - RNA, 22 nt, Homo sapiens
aggcagcgggguguaguggaua

SEQ ID NO: 13744 - RNA, 20 nt, Homo sapiens
ggggagcuguggaagcagua

SEQ ID NO: 13745 - RNA, 22 nt, Homo sapiens
ggagacgcggcccuguuggagu

SEQ ID NO: 13746 - RNA, 21 nt, Homo sapiens
cggcggggacggcgauugguc

SEQ ID NO: 13747 - RNA, 22 nt, Homo sapiens
aggcggggcgccgcgggaccgc

SEQ ID NO: 13748 - RNA, 23 nt, Homo sapiens
uggugcggagagggcccacagug

SEQ ID NO: 13749 - RNA, 24 nt, Homo sapiens
uggggagcugaggcucugggggug

SEQ ID NO: 13750 - RNA, 23 nt, Homo sapiens
cacccggcugugugcacaugugc

SEQ ID NO: 13751 - RNA, 18 nt, Homo sapiens
cagggaggugaaugugau

SEQ ID NO: 13752 - RNA, 23 nt, Homo sapiens
ucuggcuccgugucuucacuccc

SEQ ID NO: 13753 - RNA, 22 nt, Homo sapiens
uggagagaaaggcaguuccuga

SEQ ID NO: 13754 - RNA, 22 nt, Homo sapiens
cauugcacuugucucggucuga

SEQ ID NO: 13755 - RNA, 21 nt, Homo sapiens
uggaggagaaggaaggugaug

SEQ ID NO: 13756 - RNA, 21 nt, Homo sapiens
gcccuccgcccgugcaccccg

SEQ ID NO: 13757 - RNA, 21 nt, Homo sapiens
aggggugcuaucugugauuga

SEQ ID NO: 13758 - RNA, 25 nt, Homo sapiens
aggggugguguugggacagcuccgu

SEQ ID NO: 13759 - RNA, 22 nt, Homo sapiens
agacuucccauuugaagguggc

SEQ ID NO: 13760 - RNA, 23 nt, Homo sapiens
uggugcggagagggcccacagug

SEQ ID NO: 13761 - RNA, 20 nt, Homo sapiens
ggggagcuguggaagcagua

SEQ ID NO: 13762 - RNA, 21 nt, Homo sapiens
uugcucacuguucuucccuag

SEQ ID NO: 13763 - RNA, 23 nt, Homo sapiens
ucuggcuccgugucuucacuccc

SEQ ID NO: 13764 - RNA, 22 nt, Homo sapiens
cgcaggggccgggugcucaccg

SEQ ID NO: 13765 - RNA, 22 nt, Homo sapiens
uggcagugucuuagcugguugu

SEQ ID NO: 13766 - RNA, 22 nt, Homo sapiens
caaucacuaacuccacugccau

SEQ ID NO: 13767 - RNA, 23 nt, Homo sapiens
aggcaguguaguuagcugauugc

SEQ ID NO: 13768 - RNA, 22 nt, Homo sapiens
uggcaguguauuguuagcuggu

SEQ ID NO: 13769 - RNA, 22 nt, Homo sapiens
aggcaguguauuguuagcuggc

SEQ ID NO: 13770 - RNA, 22 nt, Homo sapiens
augcugacauauuuacuagagg

SEQ ID NO: 13771 - RNA, 20 nt, Homo sapiens
ggggagcuguggaagcagua

SEQ ID NO: 13772 - RNA, 23 nt, Homo sapiens
gcagcagagaauaggacuacguc

SEQ ID NO: 13773 - RNA, 22 nt, Homo sapiens
uauugcacucgucccggccucc

SEQ ID NO: 13774 - RNA, 22 nt, Homo sapiens
acgcccuucccccccuucuuca

SEQ ID NO: 13775 - RNA, 22 nt, Homo sapiens
cuuggcaccuagcaagcacuca

SEQ ID NO: 13776 - RNA, 23 nt, Homo sapiens
cggcccgggcugcugcuguuccu

SEQ ID NO: 13777 - RNA, 23 nt, Homo sapiens
uaaggugcaucuagugcagauag

SEQ ID NO: 13778 - RNA, 23 nt, Homo sapiens
uaaggugcaucuagugcaguuag

SEQ ID NO: 13779 - RNA, 21 nt, Homo sapiens
cggcggggacggcgauugguc

SEQ ID NO: 13780 - RNA, 22 nt, Homo sapiens
ugauugguacgucuguggguag

SEQ ID NO: 13781 - RNA, 21 nt, Homo sapiens
aaagcgcuucccuucagagug

SEQ ID NO: 13782 - RNA, 22 nt, Homo sapiens
aggcggggcgccgcgggaccgc

SEQ ID NO: 13783 - RNA, 24 nt, Homo sapiens
uggggagcugaggcucugggggug

SEQ ID NO: 13784 - RNA, 23 nt, Homo sapiens
uuuggcacuagcacauuuuugcu

SEQ ID NO: 13785 - RNA, 22 nt, Homo sapiens
uuuccggcucgcgugggugugu

SEQ ID NO: 13786 - RNA, 22 nt, Homo sapiens
ucaaaacugaggggcauuuucu

SEQ ID NO: 13787 - RNA, 21 nt, Homo sapiens
cggcggggacggcgauugguc

SEQ ID NO: 13788 - RNA, 22 nt, Homo sapiens
ccaaaacugcaguuacuuuugc

SEQ ID NO: 13789 - RNA, 22 nt, Homo sapiens
agacuucccauuugaagguggc

SEQ ID NO: 13790 - RNA, 22 nt, Homo sapiens
aggcggggcgccgcgggaccgc

SEQ ID NO: 13791 - RNA, 22 nt, Homo sapiens
ugcggggcuagggcuaacagca

SEQ ID NO: 13792 - RNA, 22 nt, Homo sapiens
ccucuuccccuugucucuccag

SEQ ID NO: 13793 - RNA, 23 nt, Homo sapiens
ugaggggcagagagcgagacuuu

SEQ ID NO: 13794 - RNA, 23 nt, Homo sapiens
gaacgccuguucuugccaggugg

SEQ ID NO: 13795 - RNA, 21 nt, Homo sapiens
uggguuuacguugggagaacu

SEQ ID NO: 13796 - RNA, 20 nt, Homo sapiens
guagaggagauggcgcaggg

SEQ ID NO: 13797 - RNA, 18 nt, Homo sapiens
ucagcuggcccucauuuc

SEQ ID NO: 13798 - RNA, 21 nt, Homo sapiens
uccuucugcuccgucccccag

SEQ ID NO: 13799 - RNA, 22 nt, Homo sapiens
agaaggaaauugaauucauuua

SEQ ID NO: 13800 - RNA, 20 nt, Homo sapiens
guguguggaaaugcuucugc

SEQ ID NO: 13801 - RNA, 22 nt, Homo sapiens
uggagagaaaggcaguuccuga

SEQ ID NO: 13802 - RNA, 22 nt, Homo sapiens
uggagagaaaggcaguuccuga

SEQ ID NO: 13803 - RNA, 22 nt, Homo sapiens
uagcaccaucugaaaucgguua

SEQ ID NO: 13804 - RNA, 22 nt, Homo sapiens
uggcagugucuuagcugguugu

SEQ ID NO: 13805 - RNA, 18 nt, Homo sapiens
ugcuuccuuucagagggu

SEQ ID NO: 13806 - RNA, 22 nt, Homo sapiens
aucuggagguaagaagcacuuu

SEQ ID NO: 13807 - RNA, 22 nt, Homo sapiens
caaaaaucucaauuacuuuugc

SEQ ID NO: 13808 - RNA, 19 nt, Homo sapiens
gggcgccugugaucccaac

SEQ ID NO: 13809 - RNA, 19 nt, Homo sapiens
aagcagcugccucugaggc

SEQ ID NO: 13810 - RNA, 21 nt, Homo sapiens
uggaggagaaggaaggugaug

SEQ ID NO: 13811 - RNA, 22 nt, Homo sapiens
ugugcgcagggagaccucuccc

SEQ ID NO: 13812 - RNA, 21 nt, Homo sapiens
aggggugcuaucugugauuga

SEQ ID NO: 13813 - RNA, 21 nt, Homo sapiens
guggcugcacucacuuccuuc

SEQ ID NO: 13814 - RNA, 22 nt, Homo sapiens
ugugcgcagggagaccucuccc

SEQ ID NO: 13815 - RNA, 21 nt, Homo sapiens
uaaagugcugacagugcagau

SEQ ID NO: 13816 - RNA, 21 nt, Homo sapiens
gugccagcugcagugggggag

SEQ ID NO: 13817 - RNA, 18 nt, Homo sapiens
aucccaccucugccacca

SEQ ID NO: 13818 - RNA, 18 nt, Homo sapiens
cgggcguggugguggggg

SEQ ID NO: 13819 - RNA, 22 nt, Homo sapiens
gcccgcguguggagccaggugu

SEQ ID NO: 13820 - RNA, 22 nt, Homo sapiens
uggcagugucuuagcugguugu

SEQ ID NO: 13821 - RNA, 23 nt, Homo sapiens
aggcaguguaguuagcugauugc

SEQ ID NO: 13822 - RNA, 22 nt, Homo sapiens
uggcaguguauuguuagcuggu

SEQ ID NO: 13823 - RNA, 22 nt, Homo sapiens
aggcaguguauuguuagcuggc

SEQ ID NO: 13824 - RNA, 22 nt, Homo sapiens
aucgugcaucccuuuagagugu

SEQ ID NO: 13825 - RNA, 22 nt, Homo sapiens
aucgugcauccuuuuagagugu

SEQ ID NO: 13826 - RNA, 22 nt, Homo sapiens
ccucccacacccaaggcuugca

SEQ ID NO: 13827 - RNA, 21 nt, Homo sapiens
gcgacccacucuugguuucca

SEQ ID NO: 13828 - RNA, 21 nt, Homo sapiens
gcgacccauacuugguuucag

SEQ ID NO: 13829 - RNA, 25 nt, Homo sapiens
aggggugguguugggacagcuccgu

SEQ ID NO: 13830 - RNA, 18 nt, Homo sapiens
aucccaccucugccacca

SEQ ID NO: 13831 - RNA, 21 nt, Homo sapiens
ugcaggaccaagaugagcccu

SEQ ID NO: 13832 - RNA, 21 nt, Homo sapiens
uugggacauacuuaugcuaaa

SEQ ID NO: 13833 - RNA, 22 nt, Homo sapiens
ucagugcaucacagaacuuugu

SEQ ID NO: 13834 - RNA, 23 nt, Homo sapiens
aacauucaacgcugucggugagu

SEQ ID NO: 13835 - RNA, 23 nt, Homo sapiens
aacauucauugcugucggugggu

SEQ ID NO: 13836 - RNA, 22 nt, Homo sapiens
aacauucaaccugucggugagu

SEQ ID NO: 13837 - RNA, 23 nt, Homo sapiens
aacauucauuguugucggugggu

SEQ ID NO: 13838 - RNA, 22 nt, Homo sapiens
uguaacagcaacuccaugugga

SEQ ID NO: 13839 - RNA, 22 nt, Homo sapiens
gugaaauguuuaggaccacuag

SEQ ID NO: 13840 - RNA, 23 nt, Homo sapiens
ugaggggcagagagcgagacuuu

SEQ ID NO: 13841 - RNA, 21 nt, Homo sapiens
auugacacuucugugaguaga

SEQ ID NO: 13842 - RNA, 22 nt, Homo sapiens
uaugcauuguauuuuuaggucc

SEQ ID NO: 13843 - RNA, 22 nt, Homo sapiens
uugugucaauaugcgaugaugu

SEQ ID NO: 13844 - RNA, 22 nt, Homo sapiens
agacuucccauuugaagguggc

SEQ ID NO: 13845 - RNA, 22 nt, Homo sapiens
caaagugccucccuuuagagug

SEQ ID NO: 13846 - RNA, 22 nt, Homo sapiens
ugagccccugugccgcccccag

SEQ ID NO: 13847 - RNA, 22 nt, Homo sapiens
uggagugugacaaugguguuug

SEQ ID NO: 13848 - RNA, 17 nt, Homo sapiens
ucccaccgcugccaccc

SEQ ID NO: 13849 - RNA, 23 nt, Homo sapiens
cggcccgggcugcugcuguuccu

SEQ ID NO: 13850 - RNA, 22 nt, Homo sapiens
gauuagggugcuuagcuguuaa

SEQ ID NO: 13851 - RNA, 21 nt, Homo sapiens
gccccugggccuauccuagaa

SEQ ID NO: 13852 - RNA, 22 nt, Homo sapiens
aauugcacgguauccaucugua

SEQ ID NO: 13853 - RNA, 22 nt, Homo sapiens
uggugggcacagaaucuggacu

SEQ ID NO: 13854 - RNA, 19 nt, Homo sapiens
aggcugcggaauucaggac

SEQ ID NO: 13855 - RNA, 22 nt, Homo sapiens
ggggguccccggugcucggauc

SEQ ID NO: 13856 - RNA, 21 nt, Homo sapiens
guggcugcacucacuuccuuc

SEQ ID NO: 13857 - RNA, 22 nt, Homo sapiens
uggugggccgcagaacaugugc

SEQ ID NO: 13858 - RNA, 20 nt, Homo sapiens
cggcucugggucugugggga

SEQ ID NO: 13859 - RNA, 21 nt, Homo sapiens
cgcgggugcuuacugacccuu

SEQ ID NO: 13860 - RNA, 23 nt, Homo sapiens
gagggucuugggagggaugugac

SEQ ID NO: 13861 - RNA, 23 nt, Homo sapiens
ccucagggcuguagaacagggcu

SEQ ID NO: 13862 - RNA, 23 nt, Homo sapiens
guccaguuuucccaggaaucccu

SEQ ID NO: 13863 - RNA, 22 nt, Homo sapiens
agacccuggucugcacucuauc

SEQ ID NO: 13864 - RNA, 21 nt, Homo sapiens
augauccaggaaccugccucu

SEQ ID NO: 13865 - RNA, 21 nt, Homo sapiens
cgcgggugcuuacugacccuu

SEQ ID NO: 13866 - RNA, 20 nt, Homo sapiens
ggggagcuguggaagcagua

SEQ ID NO: 13867 - RNA, 21 nt, Homo sapiens
ccccaccuccucucuccucag

SEQ ID NO: 13868 - RNA, 27 nt, Homo sapiens
accuucuuguauaagcacugugcuaaa

SEQ ID NO: 13869 - RNA, 22 nt, Homo sapiens
uuagggcccuggcuccaucucc

SEQ ID NO: 13870 - RNA, 18 nt, Homo sapiens
cagggaggugaaugugau

SEQ ID NO: 13871 - RNA, 23 nt, Homo sapiens
uauggcuuuucauuccuauguga

SEQ ID NO: 13872 - RNA, 23 nt, Homo sapiens
ucuggcuccgugucuucacuccc

SEQ ID NO: 13873 - RNA, 21 nt, Homo sapiens
agggcccccccucaauccugu

SEQ ID NO: 13874 - RNA, 20 nt, Homo sapiens
ggggagcuguggaagcagua

SEQ ID NO: 13875 - RNA, 22 nt, Homo sapiens
ugagguaguagguuguauaguu

SEQ ID NO: 13876 - RNA, 22 nt, Homo sapiens
ugagguaguagguugugugguu

SEQ ID NO: 13877 - RNA, 22 nt, Homo sapiens
ugagguaguagguuguaugguu

SEQ ID NO: 13878 - RNA, 22 nt, Homo sapiens
agagguaguagguugcauaguu

SEQ ID NO: 13879 - RNA, 22 nt, Homo sapiens
ugagguaggagguuguauaguu

SEQ ID NO: 13880 - RNA, 22 nt, Homo sapiens
ugagguaguagauuguauaguu

SEQ ID NO: 13881 - RNA, 22 nt, Homo sapiens
ugagguaguaguuuguacaguu

SEQ ID NO: 13882 - RNA, 22 nt, Homo sapiens
ugagguaguaguuugugcuguu

SEQ ID NO: 13883 - RNA, 22 nt, Homo sapiens
uagguaguuucauguuguuggg

SEQ ID NO: 13884 - RNA, 22 nt, Homo sapiens
uagguaguuuccuguuguuggg

SEQ ID NO: 13885 - RNA, 20 nt, Homo sapiens
ccucugggcccuuccuccag

SEQ ID NO: 13886 - RNA, 22 nt, Homo sapiens
ucucugggccugugucuuaggc

SEQ ID NO: 13887 - RNA, 22 nt, Homo sapiens
cuccuauaugaugccuuucuuc

SEQ ID NO: 13888 - RNA, 22 nt, Homo sapiens
uuauaaagcaaugagacugauu

SEQ ID NO: 13889 - RNA, 22 nt, Homo sapiens
aacuguuugcagaggaaacuga

SEQ ID NO: 13890 - RNA, 22 nt, Homo sapiens
cuuaugcaagauucccuucuac

SEQ ID NO: 13891 - RNA, 22 nt, Homo sapiens
ugauugguacgucuguggguag

SEQ ID NO: 13892 - RNA, 22 nt, Homo sapiens
aaaaguauuugcggguuuuguc

SEQ ID NO: 13893 - RNA, 22 nt, Homo sapiens
caaaaguaauuguggauuuugu

SEQ ID NO: 13894 - RNA, 20 nt, Homo sapiens
cggcucugggucugugggga

SEQ ID NO: 13895 - RNA, 22 nt, Homo sapiens
ugagguaguaaguuguauuguu

SEQ ID NO: 13896 - RNA, 21 nt, Homo sapiens
agugaaugauggguucugacc

SEQ ID NO: 13897 - RNA, 18 nt, Homo sapiens
cgggcguggugguggggg

SEQ ID NO: 13898 - RNA, 19 nt, Homo sapiens
gaugaugcugcugaugcug

SEQ ID NO: 13899 - RNA, 23 nt, Homo sapiens
ucuggcuccgugucuucacuccc

SEQ ID NO: 13900 - RNA, 22 nt, Homo sapiens
aguggggaacccuuccaugagg

SEQ ID NO: 13901 - RNA, 23 nt, Homo sapiens
uacuccagagggcgucacucaug

SEQ ID NO: 13902 - RNA, 25 nt, Homo sapiens
aggggugguguugggacagcuccgu

SEQ ID NO: 13903 - RNA, 21 nt, Homo sapiens
uggguuuacguugggagaacu

SEQ ID NO: 13904 - RNA, 21 nt, Homo sapiens
cccggagccaggaugcagcuc

SEQ ID NO: 13905 - RNA, 23 nt, Homo sapiens
ucuggcuccgugucuucacuccc

SEQ ID NO: 13906 - RNA, 22 nt, Homo sapiens
uacccagagcaugcagugugaa

SEQ ID NO: 13907 - RNA, 23 nt, Homo sapiens
ugguuguaguccgugcgagaaua

SEQ ID NO: 13908 - RNA, 22 nt, Homo sapiens
gugacaucacauauacggcagc

SEQ ID NO: 13909 - RNA, 22 nt, Homo sapiens
cgucaacacuugcugguuuccu

SEQ ID NO: 13910 - RNA, 19 nt, Homo sapiens
aggcugcggaauucaggac

SEQ ID NO: 13911 - RNA, 21 nt, Homo sapiens
uggcagggaggcugggagggg

SEQ ID NO: 13912 - RNA, 22 nt, Homo sapiens
agaaggaaauugaauucauuua

SEQ ID NO: 13913 - RNA, 22 nt, Homo sapiens
ucugggcaacaaagugagaccu

SEQ ID NO: 13914 - RNA, 22 nt, Homo sapiens
cgcaggggccgggugcucaccg

SEQ ID NO: 13915 - RNA, 22 nt, Homo sapiens
cauugcacuugucucggucuga

SEQ ID NO: 13916 - RNA, 22 nt, Homo sapiens
aauugcacgguauccaucugua

SEQ ID NO: 13917 - RNA, 19 nt, Homo sapiens
gagccaguuggacaggagc

SEQ ID NO: 13918 - RNA, 25 nt, Homo sapiens
aggggugguguugggacagcuccgu

SEQ ID NO: 13919 - RNA, 25 nt, Homo sapiens
gcugggcagggcuucugagcuccuu

SEQ ID NO: 13920 - RNA, 20 nt, Homo sapiens
guagaggagauggcgcaggg

SEQ ID NO: 13921 - RNA, 22 nt, Homo sapiens
cacuggcuccuuucuggguaga

SEQ ID NO: 13922 - RNA, 22 nt, Homo sapiens
ugagccccugugccgcccccag

SEQ ID NO: 13923 - RNA, 22 nt, Homo sapiens
acgcccuucccccccuucuuca

SEQ ID NO: 13924 - RNA, 17 nt, Homo sapiens
ucgccuccuccucuccc

SEQ ID NO: 13925 - RNA, 19 nt, Homo sapiens
gggcgccugugaucccaac

SEQ ID NO: 13926 - RNA, 21 nt, Homo sapiens
uuggccacaauggguuagaac

SEQ ID NO: 13927 - RNA, 22 nt, Homo sapiens
ugcggggcuagggcuaacagca

SEQ ID NO: 13928 - RNA, 20 nt, Homo sapiens
cggcucugggucugugggga

SEQ ID NO: 13929 - RNA, 21 nt, Homo sapiens
cgcgggugcuuacugacccuu

SEQ ID NO: 13930 - RNA, 21 nt, Homo sapiens
auauaugaugacuuagcuuuu

SEQ ID NO: 13931 - RNA, 22 nt, Homo sapiens
uuugguccccuucaaccagcug

SEQ ID NO: 13932 - RNA, 22 nt, Homo sapiens
uuugguccccuucaaccagcua

SEQ ID NO: 13933 - RNA, 23 nt, Homo sapiens
ucuggcuccgugucuucacuccc

SEQ ID NO: 13934 - RNA, 21 nt, Homo sapiens
cggcggggacggcgauugguc

SEQ ID NO: 13935 - RNA, 22 nt, Homo sapiens
cauugcacuugucucggucuga

SEQ ID NO: 13936 - RNA, 25 nt, Homo sapiens
aggggugguguugggacagcuccgu

SEQ ID NO: 13937 - RNA, 22 nt, Homo sapiens
aggcggggcgccgcgggaccgc

SEQ ID NO: 13938 - RNA, 22 nt, Homo sapiens
ugcggggcuagggcuaacagca

SEQ ID NO: 13939 - RNA, 20 nt, Homo sapiens
ggggagcuguggaagcagua

SEQ ID NO: 13940 - RNA, 22 nt, Homo sapiens
ccucuuccccuugucucuccag

SEQ ID NO: 13941 - RNA, 22 nt, Homo sapiens
cucccacugcuucacuugacua

SEQ ID NO: 13942 - RNA, 22 nt, Homo sapiens
uuggggaaacggccgcugagug

SEQ ID NO: 13943 - RNA, 22 nt, Homo sapiens
uuauaaagcaaugagacugauu

SEQ ID NO: 13944 - RNA, 20 nt, Homo sapiens
guagaggagauggcgcaggg

SEQ ID NO: 13945 - RNA, 17 nt, Homo sapiens
ucgccuccuccucuccc

SEQ ID NO: 13946 - RNA, 22 nt, Homo sapiens
cccugugcccggcccacuucug

SEQ ID NO: 13947 - RNA, 22 nt, Homo sapiens
aacuggcccucaaagucccgcu

SEQ ID NO: 13948 - RNA, 22 nt, Homo sapiens
ugguuuaccgucccacauacau

SEQ ID NO: 13949 - RNA, 21 nt, Homo sapiens
uggguuuacguugggagaacu

SEQ ID NO: 13950 - RNA, 25 nt, Homo sapiens
ggcggagggaaguagguccguuggu

SEQ ID NO: 13951 - RNA, 20 nt, Homo sapiens
uacaguauagaugauguacu

SEQ ID NO: 13952 - RNA, 22 nt, Homo sapiens
caaagaauucuccuuuugggcu

SEQ ID NO: 13953 - RNA, 21 nt, Homo sapiens
uucacaguggcuaaguuccgc

SEQ ID NO: 13954 - RNA, 22 nt, Homo sapiens
aaauuauuguacaucggaugag

SEQ ID NO: 13955 - RNA, 23 nt, Homo sapiens
uuuggcacuagcacauuuuugcu

SEQ ID NO: 13956 - RNA, 21 nt, Homo sapiens
ucguggccuggucuccauuau

SEQ ID NO: 13957 - RNA, 20 nt, Homo sapiens
ucacaccugccucgcccccc

SEQ ID NO: 13958 - RNA, 18 nt, Homo sapiens
cgggcguggugguggggg

SEQ ID NO: 13959 - RNA, 17 nt, Homo sapiens
ucgccuccuccucuccc

SEQ ID NO: 13960 - RNA, 22 nt, Homo sapiens
uguaaacauccuacacucagcu

SEQ ID NO: 13961 - RNA, 21 nt, Homo sapiens
uuggccacaauggguuagaac

SEQ ID NO: 13962 - RNA, 19 nt, Homo sapiens
aggcugcggaauucaggac

SEQ ID NO: 13963 - RNA, 19 nt, Homo sapiens
aguguggcuuucuuagagc

SEQ ID NO: 13964 - RNA, 22 nt, Homo sapiens
ucggauccgucugagcuuggcu

SEQ ID NO: 13965 - RNA, 21 nt, Homo sapiens
cuuuuugcggucugggcuugc

SEQ ID NO: 13966 - RNA, 22 nt, Homo sapiens
uucccuuugucauccuaugccu

SEQ ID NO: 13967 - RNA, 22 nt, Homo sapiens
uucccuuugucauccuucgccu

SEQ ID NO: 13968 - RNA, 23 nt, Homo sapiens
uacugcaucaggaacugauugga

SEQ ID NO: 13969 - RNA, 21 nt, Homo sapiens
uucacaguggcuaaguucugc

SEQ ID NO: 13970 - RNA, 22 nt, Homo sapiens
cacuagauugugagcuccugga

SEQ ID NO: 13971 - RNA, 22 nt, Homo sapiens
aaggagcucacagucuauugag

SEQ ID NO: 13972 - RNA, 22 nt, Homo sapiens
uugggaucauuuugcauccaua

SEQ ID NO: 13973 - RNA, 22 nt, Homo sapiens
caaaacuggcaauuacuuuugc

SEQ ID NO: 13974 - RNA, 22 nt, Homo sapiens
aaaaacugagacuacuuuugca

SEQ ID NO: 13975 - RNA, 19 nt, Homo sapiens
aaaaacuguaauuacuuuu

SEQ ID NO: 13976 - RNA, 22 nt, Homo sapiens
uaugcauuguauuuuuaggucc

SEQ ID NO: 13977 - RNA, 23 nt, Homo sapiens
aaggagcuuacaaucuagcuggg

SEQ ID NO: 13978 - RNA, 23 nt, Homo sapiens
aaggagcuuacaaucuagcuggg

SEQ ID NO: 13979 - RNA, 23 nt, Homo sapiens
cugggaucuccggggucuugguu

SEQ ID NO: 13980 - RNA, 22 nt, Homo sapiens
cugcccuggcccgagggaccga

SEQ ID NO: 13981 - RNA, 21 nt, Homo sapiens
aagcauucuuucauugguugg

SEQ ID NO: 13982 - RNA, 21 nt, Homo sapiens
aagcauucuuucauugguugg

SEQ ID NO: 13983 - RNA, 27 nt, Homo sapiens
cacuguaggugauggugagagugggca

SEQ ID NO: 13984 - RNA, 22 nt, Homo sapiens
ccucuuccccuugucucuccag

SEQ ID NO: 13985 - RNA, 23 nt, Homo sapiens
caagucuuauuugagcaccuguu

SEQ ID NO: 13986 - RNA, 20 nt, Homo sapiens
uaaagagcccuguggagaca

SEQ ID NO: 13987 - RNA, 18 nt, Homo sapiens
cagggaggugaaugugau

SEQ ID NO: 13988 - RNA, 22 nt, Homo sapiens
ucuacagugcacgugucuccag

SEQ ID NO: 13989 - RNA, 21 nt, Homo sapiens
uaccacaggguagaaccacgg

SEQ ID NO: 13990 - RNA, 23 nt, Homo sapiens
ucuggcuccgugucuucacuccc

SEQ ID NO: 13991 - RNA, 23 nt, Homo sapiens
uuaaugcuaaucgugauaggggu

SEQ ID NO: 13992 - RNA, 22 nt, Homo sapiens
uguaacagcaacuccaugugga

SEQ ID NO: 13993 - RNA, 22 nt, Homo sapiens
uucaccaccuucuccacccagc

SEQ ID NO: 13994 - RNA, 22 nt, Homo sapiens
cucccacugcuucacuugacua

SEQ ID NO: 13995 - RNA, 23 nt, Homo sapiens
uaauacugccggguaaugaugga

SEQ ID NO: 13996 - RNA, 22 nt, Homo sapiens
uucccuuugucauccuaugccu

SEQ ID NO: 13997 - RNA, 22 nt, Homo sapiens
uucccuuugucauccuucgccu

SEQ ID NO: 13998 - RNA, 22 nt, Homo sapiens
uauugcacauuacuaaguugca

SEQ ID NO: 13999 - RNA, 21 nt, Homo sapiens
uugaaaggcuauuucuugguc

SEQ ID NO: 14000 - RNA, 21 nt, Homo sapiens
uuaagacuugcagugauguuu

SEQ ID NO: 14001 - RNA, 23 nt, Homo sapiens
agugccugagggaguaagagccc

SEQ ID NO: 14002 - RNA, 24 nt, Homo sapiens
gaccuggacauguuugugcccagu

SEQ ID NO: 14003 - RNA, 21 nt, Homo sapiens
uggaggagaaggaaggugaug

SEQ ID NO: 14004 - RNA, 19 nt, Homo sapiens
gugaggacucgggaggugg

SEQ ID NO: 14005 - RNA, 22 nt, Homo sapiens
acucggcguggcgucggucgug

SEQ ID NO: 14006 - RNA, 22 nt, Homo sapiens
ugcccuguggacucaguucugg

SEQ ID NO: 14007 - RNA, 22 nt, Homo sapiens
acacagggcuguugugaagacu

SEQ ID NO: 14008 - RNA, 21 nt, Homo sapiens
aggggugcuaucugugauuga

SEQ ID NO: 14009 - RNA, 22 nt, Homo sapiens
uggugggcacagaaucuggacu

SEQ ID NO: 14010 - RNA, 23 nt, Homo sapiens
gcgaggaccccucggggucugac

SEQ ID NO: 14011 - RNA, 22 nt, Homo sapiens
uccgagccugggucucccucuu

SEQ ID NO: 14012 - RNA, 22 nt, Homo sapiens
uggugggccgcagaacaugugc

SEQ ID NO: 14013 - RNA, 24 nt, Homo sapiens
ugccugggucucuggccugcgcgu

SEQ ID NO: 14014 - RNA, 21 nt, Homo sapiens
cacaagguauugguauuaccu

SEQ ID NO: 14015 - RNA, 22 nt, Homo sapiens
ugagguaguaguuuguacaguu

SEQ ID NO: 14016 - RNA, 22 nt, Homo sapiens
caggauguggucaaguguuguu

SEQ ID NO: 14017 - RNA, 23 nt, Homo sapiens
acuucaccugguccacuagccgu

SEQ ID NO: 14018 - RNA, 22 nt, Homo sapiens
uaugugccuuuggacuacaucg

SEQ ID NO: 14019 - RNA, 23 nt, Homo sapiens
ugauuguagccuuuuggaguaga

SEQ ID NO: 14020 - RNA, 20 nt, Homo sapiens
cugcaaagggaagcccuuuc

SEQ ID NO: 14021 - RNA, 20 nt, Homo sapiens
cugcaaagggaagcccuuuc

SEQ ID NO: 14022 - RNA, 21 nt, Homo sapiens
uaggacacauggucuacuucu

SEQ ID NO: 14023 - RNA, 22 nt, Homo sapiens
ugugacugguugaccagagggg

SEQ ID NO: 14024 - RNA, 22 nt, Homo sapiens
ggagacgcggcccuguuggagu

SEQ ID NO: 14025 - RNA, 23 nt, Homo sapiens
ucuggcuccgugucuucacuccc

SEQ ID NO: 14026 - RNA, 21 nt, Homo sapiens
cggcggggacggcgauugguc

SEQ ID NO: 14027 - RNA, 21 nt, Homo sapiens
ugacaacuauggaugagcucu

SEQ ID NO: 14028 - RNA, 22 nt, Homo sapiens
aagcugccaguugaagaacugu

SEQ ID NO: 14029 - RNA, 22 nt, Homo sapiens
gaugagcucauuguaauaugag

SEQ ID NO: 14030 - RNA, 19 nt, Homo sapiens
ugagcugcuguaccaaaau

SEQ ID NO: 14031 - RNA, 21 nt, Homo sapiens
ugaguuggccaucugagugag

SEQ ID NO: 14032 - RNA, 22 nt, Homo sapiens
cuugguucagggagggucccca

SEQ ID NO: 14033 - RNA, 22 nt, Homo sapiens
aggcggggcgccgcgggaccgc

SEQ ID NO: 14034 - RNA, 21 nt, Homo sapiens
agugaaugauggguucugacc

SEQ ID NO: 14035 - RNA, 20 nt, Homo sapiens
uaaagagcccuguggagaca

SEQ ID NO: 14036 - RNA, 18 nt, Homo sapiens
cagggaggugaaugugau

SEQ ID NO: 14037 - RNA, 19 nt, Homo sapiens
gaugaugcugcugaugcug

SEQ ID NO: 14038 - RNA, 22 nt, Homo sapiens
aagcugccaguugaagaacugu

SEQ ID NO: 14039 - RNA, 22 nt, Homo sapiens
uagcaccaucugaaaucgguua

SEQ ID NO: 14040 - RNA, 23 nt, Homo sapiens
uagcaccauuugaaaucaguguu

SEQ ID NO: 14041 - RNA, 22 nt, Homo sapiens
uagcaccauuugaaaucgguua

SEQ ID NO: 14042 - RNA, 22 nt, Homo sapiens
cgucaacacuugcugguuuccu

SEQ ID NO: 14043 - RNA, 21 nt, Homo sapiens
aacaggugacugguuagacaa

SEQ ID NO: 14044 - RNA, 19 nt, Homo sapiens
ugagcugcuguaccaaaau

SEQ ID NO: 14045 - RNA, 22 nt, Homo sapiens
uaugcauuguauuuuuaggucc

SEQ ID NO: 14046 - RNA, 21 nt, Homo sapiens
aggaggcagcgcucucaggac

SEQ ID NO: 14047 - RNA, 22 nt, Homo sapiens
uggguggucuggagauuugugc

SEQ ID NO: 14048 - RNA, 21 nt, Homo sapiens
cggcggggacggcgauugguc

SEQ ID NO: 14049 - RNA, 21 nt, Homo sapiens
ccaccaccgugucugacacuu

SEQ ID NO: 14050 - RNA, 23 nt, Homo sapiens
ucccccaggugugauucugauuu

SEQ ID NO: 14051 - RNA, 23 nt, Homo sapiens
ucccccaggugugauucugauuu

SEQ ID NO: 14052 - RNA, 25 nt, Homo sapiens
aggggugguguugggacagcuccgu

SEQ ID NO: 14053 - RNA, 22 nt, Homo sapiens
ggggguccccggugcucggauc

SEQ ID NO: 14054 - RNA, 21 nt, Homo sapiens
uggguuuacguugggagaacu

SEQ ID NO: 14055 - RNA, 24 nt, Homo sapiens
acugggggcuuucgggcucugcgu

SEQ ID NO: 14056 - RNA, 24 nt, Homo sapiens
acugggggcuuucgggcucugcgu

SEQ ID NO: 14057 - RNA, 22 nt, Homo sapiens
aggcggggcgccgcgggaccgc

SEQ ID NO: 14058 - RNA, 22 nt, Homo sapiens
caaagugccucccuuuagagug

SEQ ID NO: 14059 - RNA, 21 nt, Homo sapiens
aagcauucuuucauugguugg

SEQ ID NO: 14060 - RNA, 17 nt, Homo sapiens
ucgccuccuccucuccc

SEQ ID NO: 14061 - RNA, 23 nt, Homo sapiens
ucuggcuccgugucuucacuccc

SEQ ID NO: 14062 - RNA, 22 nt, Homo sapiens
cgcaggggccgggugcucaccg

SEQ ID NO: 14063 - RNA, 22 nt, Homo sapiens
uagguaguuuccuguuguuggg

SEQ ID NO: 14064 - RNA, 22 nt, Homo sapiens
acagcaggcacagacaggcagu

SEQ ID NO: 14065 - RNA, 21 nt, Homo sapiens
agggcccccccucaauccugu

SEQ ID NO: 14066 - RNA, 21 nt, Homo sapiens
agggcccccccucaauccugu

SEQ ID NO: 14067 - RNA, 22 nt, Homo sapiens
aaaagcuggguugagagggcga

SEQ ID NO: 14068 - RNA, 22 nt, Homo sapiens
aaaagcuggguugagagggcaa

SEQ ID NO: 14069 - RNA, 20 nt, Homo sapiens
aaaagcuggguugagagggu

SEQ ID NO: 14070 - RNA, 19 nt, Homo sapiens
aaaagcuggguugagagga

SEQ ID NO: 14071 - RNA, 21 nt, Homo sapiens
ugguagacuauggaacguagg

SEQ ID NO: 14072 - RNA, 22 nt, Homo sapiens
uagcaaaaacugcaguuacuuu

SEQ ID NO: 14073 - RNA, 25 nt, Homo sapiens
agggaucgcgggcggguggcggccu

SEQ ID NO: 14074 - RNA, 23 nt, Homo sapiens
ccugcagcgacuugauggcuucc

SEQ ID NO: 14075 - RNA, 21 nt, Homo sapiens
uggcagggaggcugggagggg

SEQ ID NO: 14076 - RNA, 24 nt, Homo sapiens
uugcagcugccugggagugacuuc

SEQ ID NO: 14077 - RNA, 18 nt, Homo sapiens
cagggaggugaaugugau

SEQ ID NO: 14078 - RNA, 23 nt, Homo sapiens
ucuggcuccgugucuucacuccc

SEQ ID NO: 14079 - RNA, 22 nt, Homo sapiens
uggagagaaaggcaguuccuga

SEQ ID NO: 14080 - RNA, 22 nt, Homo sapiens
gaggguuggguggaggcucucc

SEQ ID NO: 14081 - RNA, 22 nt, Homo sapiens
uuauaaagcaaugagacugauu

SEQ ID NO: 14082 - RNA, 19 nt, Homo sapiens
ugagcugcuguaccaaaau

SEQ ID NO: 14083 - RNA, 23 nt, Homo sapiens
aucccuugcaggggcuguugggu

SEQ ID NO: 14084 - RNA, 21 nt, Homo sapiens
uggaggagaaggaaggugaug

SEQ ID NO: 14085 - RNA, 23 nt, Homo sapiens
cgggucggaguuagcucaagcgg

SEQ ID NO: 14086 - RNA, 22 nt, Homo sapiens
uauugcacucgucccggccucc

SEQ ID NO: 14087 - RNA, 18 nt, Homo sapiens
cgggcguggugguggggg

SEQ ID NO: 14088 - RNA, 17 nt, Homo sapiens
ucgccuccuccucuccc

SEQ ID NO: 14089 - RNA, 23 nt, Homo sapiens
ucuggcuccgugucuucacuccc

SEQ ID NO: 14090 - RNA, 23 nt, Homo sapiens
cggcccgggcugcugcuguuccu

SEQ ID NO: 14091 - RNA, 22 nt, Homo sapiens
aguggggaacccuuccaugagg

SEQ ID NO: 14092 - RNA, 23 nt, Homo sapiens
uagcagcgggaacaguucugcag

SEQ ID NO: 14093 - RNA, 17 nt, Homo sapiens
ucucgcuggggccucca

SEQ ID NO: 14094 - RNA, 22 nt, Homo sapiens
ugcggggcuagggcuaacagca

SEQ ID NO: 14095 - RNA, 21 nt, Homo sapiens
uggcagggaggcugggagggg

SEQ ID NO: 14096 - RNA, 22 nt, Homo sapiens
augggugaauuuguagaaggau

SEQ ID NO: 14097 - RNA, 22 nt, Homo sapiens
ugugagguuggcauuguugucu

SEQ ID NO: 14098 - RNA, 23 nt, Homo sapiens
agcuacauugucugcuggguuuc

SEQ ID NO: 14099 - RNA, 24 nt, Homo sapiens
agccugauuaaacacaugcucuga

SEQ ID NO: 14100 - RNA, 24 nt, Homo sapiens
ucccugagacccuuuaaccuguga

SEQ ID NO: 14101 - RNA, 22 nt, Homo sapiens
ucccugagacccuaacuuguga

SEQ ID NO: 14102 - RNA, 23 nt, Homo sapiens
ccucagggcuguagaacagggcu

SEQ ID NO: 14103 - RNA, 23 nt, Homo sapiens
ucuggcuccgugucuucacuccc

SEQ ID NO: 14104 - RNA, 22 nt, Homo sapiens
aacuggccuacaaagucccagu

SEQ ID NO: 14105 - RNA, 22 nt, Homo sapiens
aacuggcccucaaagucccgcu

SEQ ID NO: 14106 - RNA, 22 nt, Homo sapiens
ucaggccaggcacaguggcuca

SEQ ID NO: 14107 - RNA, 23 nt, Homo sapiens
ugguuguaguccgugcgagaaua

SEQ ID NO: 14108 - RNA, 22 nt, Homo sapiens
cucccacugcuucacuugacua

SEQ ID NO: 14109 - RNA, 22 nt, Homo sapiens
aagcugccaguugaagaacugu

SEQ ID NO: 14110 - RNA, 22 nt, Homo sapiens
aaggagcucacagucuauugag

SEQ ID NO: 14111 - RNA, 23 nt, Homo sapiens
cgcauccccuagggcauuggugu

SEQ ID NO: 14112 - RNA, 22 nt, Homo sapiens
uuauaaagcaaugagacugauu

SEQ ID NO: 14113 - RNA, 22 nt, Homo sapiens
ccucccacacccaaggcuugca

SEQ ID NO: 14114 - RNA, 19 nt, Homo sapiens
ugagcugcuguaccaaaau

SEQ ID NO: 14115 - RNA, 19 nt, Homo sapiens
aggcacggugucagcaggc

SEQ ID NO: 14116 - RNA, 23 nt, Homo sapiens
aaggagcuuacaaucuagcuggg

SEQ ID NO: 14117 - RNA, 21 nt, Homo sapiens
uggaggagaaggaaggugaug

SEQ ID NO: 14118 - RNA, 22 nt, Homo sapiens
acuccagccccacagccucagc

SEQ ID NO: 14119 - RNA, 18 nt, Homo sapiens
cgggcguggugguggggg

SEQ ID NO: 14120 - RNA, 17 nt, Homo sapiens
ucccaccgcugccaccc

SEQ ID NO: 14121 - RNA, 24 nt, Homo sapiens
uggcccugacugaagaccagcagu

SEQ ID NO: 14122 - RNA, 19 nt, Homo sapiens
gaugaugcugcugaugcug

SEQ ID NO: 14123 - RNA, 22 nt, Homo sapiens
cauugcacuugucucggucuga

SEQ ID NO: 14124 - RNA, 22 nt, Homo sapiens
cgucaacacuugcugguuuccu

SEQ ID NO: 14125 - RNA, 22 nt, Homo sapiens
gugagucucuaagaaaagagga

SEQ ID NO: 14126 - RNA, 22 nt, Homo sapiens
ugcggggcuagggcuaacagca

SEQ ID NO: 14127 - RNA, 20 nt, Homo sapiens
agagucuugugaugucuugc

SEQ ID NO: 14128 - RNA, 20 nt, Homo sapiens
ggggagcuguggaagcagua

SEQ ID NO: 14129 - RNA, 21 nt, Homo sapiens
cccggagccaggaugcagcuc

SEQ ID NO: 14130 - RNA, 18 nt, Homo sapiens
ucagcuggcccucauuuc

SEQ ID NO: 14131 - RNA, 21 nt, Homo sapiens
ccccaccuccucucuccucag

SEQ ID NO: 14132 - RNA, 22 nt, Homo sapiens
ucggccugaccacccaccccac

SEQ ID NO: 14133 - RNA, 17 nt, Homo sapiens
ucgccuccuccucuccc

SEQ ID NO: 14134 - RNA, 23 nt, Homo sapiens
ugagcgccucgacgacagagccg

SEQ ID NO: 14135 - RNA, 23 nt, Homo sapiens
uaauccuugcuaccugggugaga

SEQ ID NO: 14136 - RNA, 21 nt, Homo sapiens
uggaggagaaggaaggugaug

SEQ ID NO: 14137 - RNA, 22 nt, Homo sapiens
acuccagccccacagccucagc

SEQ ID NO: 14138 - RNA, 21 nt, Homo sapiens
ccgucgccgccacccgagccg

SEQ ID NO: 14139 - RNA, 21 nt, Homo sapiens
gugccagcugcagugggggag

SEQ ID NO: 14140 - RNA, 21 nt, Homo sapiens
uggcagggaggcugggagggg

SEQ ID NO: 14141 - RNA, 17 nt, Homo sapiens
ucgccuccuccucuccc

SEQ ID NO: 14142 - RNA, 21 nt, Homo sapiens
cggcggggacggcgauugguc

SEQ ID NO: 14143 - RNA, 22 nt, Homo sapiens
ucugcccccuccgcugcugcca

SEQ ID NO: 14144 - RNA, 22 nt, Homo sapiens
cauugcacuugucucggucuga

SEQ ID NO: 14145 - RNA, 20 nt, Homo sapiens
acugccccaggugcugcugg

SEQ ID NO: 14146 - RNA, 21 nt, Homo sapiens
cggggcagcucaguacaggau

SEQ ID NO: 14147 - RNA, 22 nt, Homo sapiens
agacccuggucugcacucuauc

SEQ ID NO: 14148 - RNA, 24 nt, Homo sapiens
acugggggcuuucgggcucugcgu

SEQ ID NO: 14149 - RNA, 24 nt, Homo sapiens
ugccugggucucuggccugcgcgu

SEQ ID NO: 14150 - RNA, 22 nt, Homo sapiens
aggcggggcgccgcgggaccgc

SEQ ID NO: 14151 - RNA, 17 nt, Homo sapiens
ucucgcuggggccucca

SEQ ID NO: 14152 - RNA, 23 nt, Homo sapiens
cgggucggaguuagcucaagcgg

SEQ ID NO: 14153 - RNA, 20 nt, Homo sapiens
ucugcaggguuugcuuugag

SEQ ID NO: 14154 - RNA, 20 nt, Homo sapiens
ucugcaggguuugcuuugag

SEQ ID NO: 14155 - RNA, 24 nt, Homo sapiens
uggcccugacugaagaccagcagu

SEQ ID NO: 14156 - RNA, 23 nt, Homo sapiens
ucuggcuccgugucuucacuccc

SEQ ID NO: 14157 - RNA, 22 nt, Homo sapiens
cucuagagggaagcacuuucug

SEQ ID NO: 14158 - RNA, 20 nt, Homo sapiens
ccuccugcccuccuugcugu

SEQ ID NO: 14159 - RNA, 21 nt, Homo sapiens
gugcauuguaguugcauugca

SEQ ID NO: 14160 - RNA, 20 nt, Homo sapiens
gugcauugcuguugcauugc

SEQ ID NO: 14161 - RNA, 23 nt, Homo sapiens
acuucaccugguccacuagccgu

SEQ ID NO: 14162 - RNA, 22 nt, Homo sapiens
ucaggcucaguccccucccgau

SEQ ID NO: 14163 - RNA, 22 nt, Homo sapiens
cgucaacacuugcugguuuccu

SEQ ID NO: 14164 - RNA, 22 nt, Homo sapiens
caugccuugaguguaggaccgu

SEQ ID NO: 14165 - RNA, 21 nt, Homo sapiens
aagccugcccggcuccucggg

SEQ ID NO: 14166 - RNA, 25 nt, Homo sapiens
aggggugguguugggacagcuccgu

SEQ ID NO: 14167 - RNA, 21 nt, Homo sapiens
guggcugcacucacuuccuuc

SEQ ID NO: 14168 - RNA, 24 nt, Homo sapiens
ugccugggucucuggccugcgcgu

SEQ ID NO: 14169 - RNA, 20 nt, Homo sapiens
ggggagcuguggaagcagua

SEQ ID NO: 14170 - RNA, 23 nt, Homo sapiens
acuccauuuguuuugaugaugga

SEQ ID NO: 14171 - RNA, 22 nt, Homo sapiens
ucagugcaucacagaacuuugu

SEQ ID NO: 14172 - RNA, 21 nt, Homo sapiens
uccugcgcgucccagaugccc

SEQ ID NO: 14173 - RNA, 21 nt, Homo sapiens
cggcggggacggcgauugguc

SEQ ID NO: 14174 - RNA, 23 nt, Homo sapiens
agcuacauugucugcuggguuuc

SEQ ID NO: 14175 - RNA, 21 nt, Homo sapiens
agcuacaucuggcuacugggu

SEQ ID NO: 14176 - RNA, 21 nt, Homo sapiens
ccacaccguaucugacacuuu

SEQ ID NO: 14177 - RNA, 23 nt, Homo sapiens
aucaacagacauuaauugggcgc

SEQ ID NO: 14178 - RNA, 22 nt, Homo sapiens
uaaugccccuaaaaauccuuau

SEQ ID NO: 14179 - RNA, 22 nt, Homo sapiens
aggcggggcgccgcgggaccgc

SEQ ID NO: 14180 - RNA, 22 nt, Homo sapiens
ugcggggcuagggcuaacagca

SEQ ID NO: 14181 - RNA, 22 nt, Homo sapiens
gugaacgggcgccaucccgagg

SEQ ID NO: 14182 - RNA, 22 nt, Homo sapiens
uuuccggcucgcgugggugugu

SEQ ID NO: 14183 - RNA, 21 nt, Homo sapiens
aggaggcagcgcucucaggac

SEQ ID NO: 14184 - RNA, 17 nt, Homo sapiens
ucucgcuggggccucca

SEQ ID NO: 14185 - RNA, 22 nt, Homo sapiens
ugugagguuggcauuguugucu

SEQ ID NO: 14186 - RNA, 18 nt, Homo sapiens
cagggaggugaaugugau

SEQ ID NO: 14187 - RNA, 21 nt, Homo sapiens
gcccuccgcccgugcaccccg

SEQ ID NO: 14188 - RNA, 23 nt, Homo sapiens
ucuggcuccgugucuucacuccc

SEQ ID NO: 14189 - RNA, 21 nt, Homo sapiens
uccugcgcgucccagaugccc

SEQ ID NO: 14190 - RNA, 23 nt, Homo sapiens
ugaguaccgccaugucuguuggg

SEQ ID NO: 14191 - RNA, 23 nt, Homo sapiens
aggaccugcgggacaagauucuu

SEQ ID NO: 14192 - RNA, 22 nt, Homo sapiens
gaaagcgcuucccuuugcugga

SEQ ID NO: 14193 - RNA, 22 nt, Homo sapiens
caaagcgcuccccuuuagaggu

SEQ ID NO: 14194 - RNA, 23 nt, Homo sapiens
caaagcgcuucucuuuagagugu

SEQ ID NO: 14195 - RNA, 21 nt, Homo sapiens
caaagcgcuucccuuuggagc

SEQ ID NO: 14196 - RNA, 21 nt, Homo sapiens
gaaagcgcuucucuuuagagg

SEQ ID NO: 14197 - RNA, 21 nt, Homo sapiens
aagccugcccggcuccucggg

SEQ ID NO: 14198 - RNA, 19 nt, Homo sapiens
aguguggcuuucuuagagc

SEQ ID NO: 14199 - RNA, 21 nt, Homo sapiens
guggcugcacucacuuccuuc

SEQ ID NO: 14200 - RNA, 22 nt, Homo sapiens
aggcagcgggguguaguggaua

SEQ ID NO: 14201 - RNA, 22 nt, Homo sapiens
ugagguaguagguuguaugguu

SEQ ID NO: 14202 - RNA, 21 nt, Homo sapiens
agagaagaagaucagccugca

SEQ ID NO: 14203 - RNA, 18 nt, Homo sapiens
cgggcguggugguggggg

SEQ ID NO: 14204 - RNA, 23 nt, Homo sapiens
acuccauuuguuuugaugaugga

SEQ ID NO: 14205 - RNA, 21 nt, Homo sapiens
cggcggggacggcgauugguc

SEQ ID NO: 14206 - RNA, 22 nt, Homo sapiens
cgcaggggccgggugcucaccg

SEQ ID NO: 14207 - RNA, 22 nt, Homo sapiens
uaaucucagcuggcaacuguga

SEQ ID NO: 14208 - RNA, 23 nt, Homo sapiens
gaagugcuucgauuuuggggugu

SEQ ID NO: 14209 - RNA, 23 nt, Homo sapiens
aaugacacgaucacucccguuga

SEQ ID NO: 14210 - RNA, 23 nt, Homo sapiens
uagcagcgggaacaguucugcag

SEQ ID NO: 14211 - RNA, 24 nt, Homo sapiens
uucuccaaaagaaagcacuuucug

SEQ ID NO: 14212 - RNA, 22 nt, Homo sapiens
aagugccuccuuuuagaguguu

SEQ ID NO: 14213 - RNA, 22 nt, Homo sapiens
agucauuggaggguuugagcag

SEQ ID NO: 14214 - RNA, 22 nt, Homo sapiens
aggcggggcgccgcgggaccgc

SEQ ID NO: 14215 - RNA, 21 nt, Homo sapiens
uacucaaaaagcugucaguca

SEQ ID NO: 14216 - RNA, 21 nt, Homo sapiens
gcccuccgcccgugcaccccg

SEQ ID NO: 14217 - RNA, 22 nt, Homo sapiens
cauugcacuugucucggucuga

SEQ ID NO: 14218 - RNA, 22 nt, Homo sapiens
uccgagccugggucucccucuu

SEQ ID NO: 14219 - RNA, 25 nt, Homo sapiens
agggaucgcgggcggguggcggccu

SEQ ID NO: 14220 - RNA, 23 nt, Homo sapiens
aucgcugcgguugcgagcgcugu

SEQ ID NO: 14221 - RNA, 25 nt, Homo sapiens
ggcggagggaaguagguccguuggu

SEQ ID NO: 14222 - RNA, 21 nt, Homo sapiens
cgcgggugcuuacugacccuu

SEQ ID NO: 14223 - RNA, 24 nt, Homo sapiens
uggggagcugaggcucugggggug

SEQ ID NO: 14224 - RNA, 22 nt, Homo sapiens
uggagagaaaggcaguuccuga

SEQ ID NO: 14225 - RNA, 22 nt, Homo sapiens
ucugcccccuccgcugcugcca

SEQ ID NO: 14226 - RNA, 20 nt, Homo sapiens
ccccagggcgacgcggcggg

SEQ ID NO: 14227 - RNA, 20 nt, Homo sapiens
acugccccaggugcugcugg

SEQ ID NO: 14228 - RNA, 23 nt, Homo sapiens
ugaggggcagagagcgagacuuu

SEQ ID NO: 14229 - RNA, 21 nt, Homo sapiens
cggggcagcucaguacaggau

SEQ ID NO: 14230 - RNA, 18 nt, Homo sapiens
ugcuuccuuucagagggu

SEQ ID NO: 14231 - RNA, 22 nt, Homo sapiens
aucuggagguaagaagcacuuu

SEQ ID NO: 14232 - RNA, 19 nt, Homo sapiens
aagcagcugccucugaggc

SEQ ID NO: 14233 - RNA, 21 nt, Homo sapiens
aaggcagggcccccgcucccc

SEQ ID NO: 14234 - RNA, 21 nt, Homo sapiens
uaaagugcugacagugcagau

SEQ ID NO: 14235 - RNA, 21 nt, Homo sapiens
gugccagcugcagugggggag

SEQ ID NO: 14236 - RNA, 18 nt, Homo sapiens
ucagcuggcccucauuuc

SEQ ID NO: 14237 - RNA, 22 nt, Homo sapiens
acccgucccguucguccccgga

SEQ ID NO: 14238 - RNA, 23 nt, Homo sapiens
ucuggcuccgugucuucacuccc

SEQ ID NO: 14239 - RNA, 22 nt, Homo sapiens
aagcugccaguugaagaacugu

SEQ ID NO: 14240 - RNA, 23 nt, Homo sapiens
ugaggggcagagagcgagacuuu

SEQ ID NO: 14241 - RNA, 21 nt, Homo sapiens
gaaggcgcuucccuuuggagu

SEQ ID NO: 14242 - RNA, 22 nt, Homo sapiens
gaaggcgcuucccuuuagagcg

SEQ ID NO: 14243 - RNA, 20 nt, Homo sapiens
ggggagcuguggaagcagua

SEQ ID NO: 14244 - RNA, 22 nt, Homo sapiens
ugugcgcagggagaccucuccc

SEQ ID NO: 14245 - RNA, 22 nt, Homo sapiens
uuagggcccuggcuccaucucc

SEQ ID NO: 14246 - RNA, 18 nt, Homo sapiens
ugaggcaguagauugaau

SEQ ID NO: 14247 - RNA, 21 nt, Homo sapiens
gaacggcuucauacaggaguu

SEQ ID NO: 14248 - RNA, 21 nt, Homo sapiens
aggaggcagcgcucucaggac

SEQ ID NO: 14249 - RNA, 21 nt, Homo sapiens
aaggcagggcccccgcucccc

SEQ ID NO: 14250 - RNA, 22 nt, Homo sapiens
cuccugagccauucugagccuc

SEQ ID NO: 14251 - RNA, 21 nt, Homo sapiens
ccuguugaaguguaaucccca

SEQ ID NO: 14252 - RNA, 22 nt, Homo sapiens
uuuucaacucuaaugggagaga

SEQ ID NO: 14253 - RNA, 22 nt, Homo sapiens
uucccuuugucauccuaugccu

SEQ ID NO: 14254 - RNA, 22 nt, Homo sapiens
uucccuuugucauccuucgccu

SEQ ID NO: 14255 - RNA, 23 nt, Homo sapiens
aucaacagacauuaauugggcgc

SEQ ID NO: 14256 - RNA, 22 nt, Homo sapiens
uuuugcaauauguuccugaaua

SEQ ID NO: 14257 - RNA, 22 nt, Homo sapiens
uuuugcaauauguuccugaaua

SEQ ID NO: 14258 - RNA, 22 nt, Homo sapiens
caaaguuuaagauccuugaagu

SEQ ID NO: 14259 - RNA, 24 nt, Homo sapiens
gaccuggacauguuugugcccagu

SEQ ID NO: 14260 - RNA, 21 nt, Homo sapiens
guguugaaacaaucucuacug

SEQ ID NO: 14261 - RNA, 23 nt, Homo sapiens
ugguuguaguccgugcgagaaua

SEQ ID NO: 14262 - RNA, 22 nt, Homo sapiens
aagcugccaguugaagaacugu

SEQ ID NO: 14263 - RNA, 22 nt, Homo sapiens
aaggagcucacagucuauugag

SEQ ID NO: 14264 - RNA, 23 nt, Homo sapiens
uagugcaauauugcuuauagggu

SEQ ID NO: 14265 - RNA, 22 nt, Homo sapiens
aucgugcaucccuuuagagugu

SEQ ID NO: 14266 - RNA, 22 nt, Homo sapiens
aucgugcauccuuuuagagugu

SEQ ID NO: 14267 - RNA, 23 nt, Homo sapiens
aaggagcuuacaaucuagcuggg

SEQ ID NO: 14268 - RNA, 21 nt, Homo sapiens
uggaggagaaggaaggugaug

SEQ ID NO: 14269 - RNA, 21 nt, Homo sapiens
uaaagugcugacagugcagau

SEQ ID NO: 14270 - RNA, 22 nt, Homo sapiens
ugugagguuggcauuguugucu

SEQ ID NO: 14271 - RNA, 22 nt, Homo sapiens
aacauucaaccugucggugagu

SEQ ID NO: 14272 - RNA, 18 nt, Homo sapiens
uccagugcccuccucucc

SEQ ID NO: 14273 - RNA, 22 nt, Homo sapiens
ucugcccccuccgcugcugcca

SEQ ID NO: 14274 - RNA, 22 nt, Homo sapiens
aacuggccuacaaagucccagu

SEQ ID NO: 14275 - RNA, 22 nt, Homo sapiens
aacuggcccucaaagucccgcu

SEQ ID NO: 14276 - RNA, 21 nt, Homo sapiens
uugugcuugaucuaaccaugu

SEQ ID NO: 14277 - RNA, 21 nt, Homo sapiens
ccaccaccgugucugacacuu

SEQ ID NO: 14278 - RNA, 20 nt, Homo sapiens
acugccccaggugcugcugg

SEQ ID NO: 14279 - RNA, 22 nt, Homo sapiens
ucaggcucaguccccucccgau

SEQ ID NO: 14280 - RNA, 21 nt, Homo sapiens
cggggcagcucaguacaggau

SEQ ID NO: 14281 - RNA, 21 nt, Homo sapiens
uuggccacaauggguuagaac

SEQ ID NO: 14282 - RNA, 21 nt, Homo sapiens
aagccugcccggcuccucggg

SEQ ID NO: 14283 - RNA, 23 nt, Homo sapiens
ugugcuugcucgucccgcccgca

SEQ ID NO: 14284 - RNA, 22 nt, Homo sapiens
acuccagccccacagccucagc

SEQ ID NO: 14285 - RNA, 20 nt, Homo sapiens
ggggagcuguggaagcagua

SEQ ID NO: 14286 - RNA, 21 nt, Homo sapiens
cccggagccaggaugcagcuc

SEQ ID NO: 14287 - RNA, 23 nt, Homo sapiens
ucuggcuccgugucuucacuccc

SEQ ID NO: 14288 - RNA, 23 nt, Homo sapiens
cggcccgggcugcugcuguuccu

SEQ ID NO: 14289 - RNA, 23 nt, Homo sapiens
cggcccgggcugcugcuguuccu

SEQ ID NO: 14290 - RNA, 22 nt, Homo sapiens
uggagagaaaggcaguuccuga

SEQ ID NO: 14291 - RNA, 22 nt, Homo sapiens
uggagagaaaggcaguuccuga

SEQ ID NO: 14292 - RNA, 21 nt, Homo sapiens
cggcggggacggcgauugguc

SEQ ID NO: 14293 - RNA, 21 nt, Homo sapiens
cggcggggacggcgauugguc

SEQ ID NO: 14294 - RNA, 21 nt, Homo sapiens
agggcccccccucaauccugu

SEQ ID NO: 14295 - RNA, 23 nt, Homo sapiens
ugagcgccucgacgacagagccg

SEQ ID NO: 14296 - RNA, 23 nt, Homo sapiens
ucccccaggugugauucugauuu

SEQ ID NO: 14297 - RNA, 22 nt, Homo sapiens
agaggcuggccgugaugaauuc

SEQ ID NO: 14298 - RNA, 19 nt, Homo sapiens
ugagcugcuguaccaaaau

SEQ ID NO: 14299 - RNA, 24 nt, Homo sapiens
acugggggcuuucgggcucugcgu

SEQ ID NO: 14300 - RNA, 19 nt, Homo sapiens
aagcagcugccucugaggc

SEQ ID NO: 14301 - RNA, 22 nt, Homo sapiens
aggcggggcgccgcgggaccgc

SEQ ID NO: 14302 - RNA, 22 nt, Homo sapiens
aggcggggcgccgcgggaccgc

SEQ ID NO: 14303 - RNA, 22 nt, Homo sapiens
ugcggggcuagggcuaacagca

SEQ ID NO: 14304 - RNA, 22 nt, Homo sapiens
uaacagucuacagccauggucg

SEQ ID NO: 14305 - RNA, 22 nt, Homo sapiens
ggagacgcggcccuguuggagu

SEQ ID NO: 14306 - RNA, 21 nt, Homo sapiens
gguuugguccuagccuuucua

SEQ ID NO: 14307 - RNA, 23 nt, Homo sapiens
uaaagugcuuauagugcagguag

SEQ ID NO: 14308 - RNA, 21 nt, Homo sapiens
uaacagucuccagucacggcc

SEQ ID NO: 14309 - RNA, 21 nt, Homo sapiens
ccacaccguaucugacacuuu

SEQ ID NO: 14310 - RNA, 21 nt, Homo sapiens
uuggccacaauggguuagaac

SEQ ID NO: 14311 - RNA, 19 nt, Homo sapiens
aguguggcuuucuuagagc

SEQ ID NO: 14312 - RNA, 22 nt, Homo sapiens
gugaaauguuuaggaccacuag

SEQ ID NO: 14313 - RNA, 22 nt, Homo sapiens
aaaaguaauugcggauuuugcc

SEQ ID NO: 14314 - RNA, 21 nt, Homo sapiens
caagucacuagugguuccguu

SEQ ID NO: 14315 - RNA, 21 nt, Homo sapiens
uucacaguggcuaaguuccgc

SEQ ID NO: 14316 - RNA, 22 nt, Homo sapiens
uggcaguguauuguuagcuggu

SEQ ID NO: 14317 - RNA, 22 nt, Homo sapiens
agaucagaaggugauuguggcu

SEQ ID NO: 14318 - RNA, 23 nt, Homo sapiens
gcaaagcacacggccugcagaga

SEQ ID NO: 14319 - RNA, 24 nt, Homo sapiens
aauccuuggaaccuaggugugagu

SEQ ID NO: 14320 - RNA, 22 nt, Homo sapiens
gaaguuguucgugguggauucg

SEQ ID NO: 14321 - RNA, 23 nt, Homo sapiens
uagugcaauauugcuuauagggu

SEQ ID NO: 14322 - RNA, 21 nt, Homo sapiens
uugaaaggcuauuucuugguc

SEQ ID NO: 14323 - RNA, 22 nt, Homo sapiens
aaaaugguucccuuuagagugu

SEQ ID NO: 14324 - RNA, 22 nt, Homo sapiens
ugugacagauugauaacugaaa

SEQ ID NO: 14325 - RNA, 23 nt, Homo sapiens
acuuacagacaagagccuugcuc

SEQ ID NO: 14326 - RNA, 23 nt, Homo sapiens
acuugggcacugaaacaaugucc

SEQ ID NO: 14327 - RNA, 19 nt, Homo sapiens
aagcagcugccucugaggc

SEQ ID NO: 14328 - RNA, 21 nt, Homo sapiens
ccgucgccgccacccgagccg

SEQ ID NO: 14329 - RNA, 18 nt, Homo sapiens
ucagcuggcccucauuuc

SEQ ID NO: 14330 - RNA, 18 nt, Homo sapiens
ucagcuggcccucauuuc

SEQ ID NO: 14331 - RNA, 23 nt, Homo sapiens
ucuggcuccgugucuucacuccc

SEQ ID NO: 14332 - RNA, 23 nt, Homo sapiens
ucuggcuccgugucuucacuccc

SEQ ID NO: 14333 - RNA, 22 nt, Homo sapiens
ucucccaacccuuguaccagug

SEQ ID NO: 14334 - RNA, 23 nt, Homo sapiens
uaauacugccggguaaugaugga

SEQ ID NO: 14335 - RNA, 22 nt, Homo sapiens
acagcaggcacagacaggcagu

SEQ ID NO: 14336 - RNA, 22 nt, Homo sapiens
uguaaacauccuacacucagcu

SEQ ID NO: 14337 - RNA, 22 nt, Homo sapiens
gccugcugggguggaaccuggu

SEQ ID NO: 14338 - RNA, 23 nt, Homo sapiens
agugccugagggaguaagagccc

SEQ ID NO: 14339 - RNA, 21 nt, Homo sapiens
uuuccauaggugaugagucac

SEQ ID NO: 14340 - RNA, 23 nt, Homo sapiens
uaaaucccauggugccuucuccu

SEQ ID NO: 14341 - RNA, 22 nt, Homo sapiens
acaguagagggaggaaucgcag

SEQ ID NO: 14342 - RNA, 22 nt, Homo sapiens
auccgcgcucugacucucugcc

SEQ ID NO: 14343 - RNA, 20 nt, Homo sapiens
ucugcaggguuugcuuugag

SEQ ID NO: 14344 - RNA, 20 nt, Homo sapiens
ucugcaggguuugcuuugag

SEQ ID NO: 14345 - RNA, 23 nt, Homo sapiens
acuccauuuguuuugaugaugga

SEQ ID NO: 14346 - RNA, 22 nt, Homo sapiens
uggagagaaaggcaguuccuga

SEQ ID NO: 14347 - RNA, 22 nt, Homo sapiens
uucaccaccuucuccacccagc

SEQ ID NO: 14348 - RNA, 22 nt, Homo sapiens
ugugacagauugauaacugaaa

SEQ ID NO: 14349 - RNA, 20 nt, Homo sapiens
guccgcucggcgguggccca

SEQ ID NO: 14350 - RNA, 20 nt, Homo sapiens
ggggagcuguggaagcagua

SEQ ID NO: 14351 - RNA, 21 nt, Homo sapiens
cccggagccaggaugcagcuc

SEQ ID NO: 14352 - RNA, 17 nt, Homo sapiens
ucgccuccuccucuccc

SEQ ID NO: 14353 - RNA, 17 nt, Homo sapiens
ucgccuccuccucuccc

SEQ ID NO: 14354 - RNA, 21 nt, Homo sapiens
gcccuccgcccgugcaccccg

SEQ ID NO: 14355 - RNA, 23 nt, Homo sapiens
cggcccgggcugcugcuguuccu

SEQ ID NO: 14356 - RNA, 18 nt, Homo sapiens
ugaggcaguagauugaau

SEQ ID NO: 14357 - RNA, 22 nt, Homo sapiens
cauugcacuugucucggucuga

SEQ ID NO: 14358 - RNA, 23 nt, Homo sapiens
ugaggggcagagagcgagacuuu

SEQ ID NO: 14359 - RNA, 21 nt, Homo sapiens
aggaggcagcgcucucaggac

SEQ ID NO: 14360 - RNA, 22 nt, Homo sapiens
gguggcccggccgugccugagg

SEQ ID NO: 14361 - RNA, 22 nt, Homo sapiens
aggcagcgggguguaguggaua

SEQ ID NO: 14362 - RNA, 24 nt, Homo sapiens
ucccugagacccuuuaaccuguga

SEQ ID NO: 14363 - RNA, 22 nt, Homo sapiens
ucccugagacccuaacuuguga

SEQ ID NO: 14364 - RNA, 23 nt, Homo sapiens
ccucagggcuguagaacagggcu

SEQ ID NO: 14365 - RNA, 22 nt, Homo sapiens
ugauauguuugauauauuaggu

SEQ ID NO: 14366 - RNA, 22 nt, Homo sapiens
acagcaggcacagacaggcagu

SEQ ID NO: 14367 - RNA, 22 nt, Homo sapiens
gccugcugggguggaaccuggu

SEQ ID NO: 14368 - RNA, 23 nt, Homo sapiens
aagugccgccaucuuuugagugu

SEQ ID NO: 14369 - RNA, 20 nt, Homo sapiens
aggguguuucucucaucucu

SEQ ID NO: 14370 - RNA, 22 nt, Homo sapiens
ugugcgcagggagaccucuccc

SEQ ID NO: 14371 - RNA, 22 nt, Homo sapiens
ugagccccugugccgcccccag

SEQ ID NO: 14372 - RNA, 21 nt, Homo sapiens
acggugcuggauguggccuuu

SEQ ID NO: 14373 - RNA, 21 nt, Homo sapiens
gcccuccgcccgugcaccccg

SEQ ID NO: 14374 - RNA, 23 nt, Homo sapiens
cggcccgggcugcugcuguuccu

SEQ ID NO: 14375 - RNA, 21 nt, Homo sapiens
cggcggggacggcgauugguc

SEQ ID NO: 14376 - RNA, 22 nt, Homo sapiens
ugggucuuugcgggcgagauga

SEQ ID NO: 14377 - RNA, 22 nt, Homo sapiens
uggcucaguucagcaggaacag

SEQ ID NO: 14378 - RNA, 19 nt, Homo sapiens
aagcagcugccucugaggc

SEQ ID NO: 14379 - RNA, 25 nt, Homo sapiens
ggcggagggaaguagguccguuggu

SEQ ID NO: 14380 - RNA, 22 nt, Homo sapiens
aggcggggcgccgcgggaccgc

SEQ ID NO: 14381 - RNA, 23 nt, Homo sapiens
uggugcggagagggcccacagug

SEQ ID NO: 14382 - RNA, 22 nt, Homo sapiens
ugcggggcuagggcuaacagca

SEQ ID NO: 14383 - RNA, 22 nt, Homo sapiens
ugagguaguagguuguauaguu

SEQ ID NO: 14384 - RNA, 22 nt, Homo sapiens
ugagguaguagguugugugguu

SEQ ID NO: 14385 - RNA, 19 nt, Homo sapiens
ugucucugcugggguuucu

SEQ ID NO: 14386 - RNA, 21 nt, Homo sapiens
agagaagaagaucagccugca

SEQ ID NO: 14387 - RNA, 18 nt, Homo sapiens
uugagaaggaggcugcug

SEQ ID NO: 14388 - RNA, 23 nt, Homo sapiens
ucuggcuccgugucuucacuccc

SEQ ID NO: 14389 - RNA, 22 nt, Homo sapiens
ugucaguuugucaaauacccca

SEQ ID NO: 14390 - RNA, 22 nt, Homo sapiens
aacaauauccuggugcugagug

SEQ ID NO: 14391 - RNA, 22 nt, Homo sapiens
cgucaacacuugcugguuuccu

SEQ ID NO: 14392 - RNA, 21 nt, Homo sapiens
uagauaaaauauugguaccug

SEQ ID NO: 14393 - RNA, 22 nt, Homo sapiens
ccucuuccccuugucucuccag

SEQ ID NO: 14394 - RNA, 23 nt, Homo sapiens
ugaggggcagagagcgagacuuu

SEQ ID NO: 14395 - RNA, 24 nt, Homo sapiens
ugccugggucucuggccugcgcgu

SEQ ID NO: 14396 - RNA, 21 nt, Homo sapiens
uugcucacuguucuucccuag

SEQ ID NO: 14397 - RNA, 21 nt, Homo sapiens
agaggauacccuuuguauguu

SEQ ID NO: 14398 - RNA, 22 nt, Homo sapiens
uugcauauguaggaugucccau

SEQ ID NO: 14399 - RNA, 22 nt, Homo sapiens
ggagaaauuauccuuggugugu

SEQ ID NO: 14400 - RNA, 21 nt, Homo sapiens
cccggagccaggaugcagcuc

SEQ ID NO: 14401 - RNA, 21 nt, Homo sapiens
ucguggccuggucuccauuau

SEQ ID NO: 14402 - RNA, 22 nt, Homo sapiens
ugagccccugugccgcccccag

SEQ ID NO: 14403 - RNA, 22 nt, Homo sapiens
acccgucccguucguccccgga

SEQ ID NO: 14404 - RNA, 18 nt, Homo sapiens
cgggcguggugguggggg

SEQ ID NO: 14405 - RNA, 17 nt, Homo sapiens
ucgccuccuccucuccc

SEQ ID NO: 14406 - RNA, 23 nt, Homo sapiens
ucuggcuccgugucuucacuccc

SEQ ID NO: 14407 - RNA, 21 nt, Homo sapiens
cggcggggacggcgauugguc

SEQ ID NO: 14408 - RNA, 22 nt, Homo sapiens
uggcucaguucagcaggaacag

SEQ ID NO: 14409 - RNA, 23 nt, Homo sapiens
aagugccgccaucuuuugagugu

SEQ ID NO: 14410 - RNA, 22 nt, Homo sapiens
aggcggggcgccgcgggaccgc

SEQ ID NO: 14411 - RNA, 20 nt, Homo sapiens
ugagcccuguccucccgcag

SEQ ID NO: 14412 - RNA, 22 nt, Homo sapiens
acccgucccguucguccccgga

SEQ ID NO: 14413 - RNA, 18 nt, Homo sapiens
acguuggcucugguggug

SEQ ID NO: 14414 - RNA, 22 nt, Homo sapiens
acucggcguggcgucggucgug

SEQ ID NO: 14415 - RNA, 18 nt, Homo sapiens
cagggaggugaaugugau

SEQ ID NO: 14416 - RNA, 22 nt, Homo sapiens
cucggcgcggggcgcgggcucc

SEQ ID NO: 14417 - RNA, 23 nt, Homo sapiens
ucuggcuccgugucuucacuccc

SEQ ID NO: 14418 - RNA, 21 nt, Homo sapiens
uccugcgcgucccagaugccc

SEQ ID NO: 14419 - RNA, 22 nt, Homo sapiens
ucugcccccuccgcugcugcca

SEQ ID NO: 14420 - RNA, 23 nt, Homo sapiens
caaagugcucauagugcagguag

SEQ ID NO: 14421 - RNA, 21 nt, Homo sapiens
ccacaccguaucugacacuuu

SEQ ID NO: 14422 - RNA, 23 nt, Homo sapiens
aucaacagacauuaauugggcgc

SEQ ID NO: 14423 - RNA, 20 nt, Homo sapiens
acugccccaggugcugcugg

SEQ ID NO: 14424 - RNA, 23 nt, Homo sapiens
ugaggggcagagagcgagacuuu

SEQ ID NO: 14425 - RNA, 22 nt, Homo sapiens
aaaccguuaccauuacugaguu

SEQ ID NO: 14426 - RNA, 21 nt, Homo sapiens
cggggcagcucaguacaggau

SEQ ID NO: 14427 - RNA, 22 nt, Homo sapiens
aggcagcgggguguaguggaua

SEQ ID NO: 14428 - RNA, 22 nt, Homo sapiens
uauugcacucgucccggccucc

SEQ ID NO: 14429 - RNA, 18 nt, Homo sapiens
ucagcuggcccucauuuc

SEQ ID NO: 14430 - RNA, 23 nt, Homo sapiens
ucuggcuccgugucuucacuccc

SEQ ID NO: 14431 - RNA, 22 nt, Homo sapiens
ucucccaacccuuguaccagug

SEQ ID NO: 14432 - RNA, 22 nt, Homo sapiens
uggagagaaaggcaguuccuga

SEQ ID NO: 14433 - RNA, 21 nt, Homo sapiens
cggcggggacggcgauugguc

SEQ ID NO: 14434 - RNA, 21 nt, Homo sapiens
ccaguccugugccugccgccu

SEQ ID NO: 14435 - RNA, 22 nt, Homo sapiens
uguaaacauccuacacucagcu

SEQ ID NO: 14436 - RNA, 22 nt, Homo sapiens
cuggcccucucugcccuuccgu

SEQ ID NO: 14437 - RNA, 21 nt, Homo sapiens
gccccugggccuauccuagaa

SEQ ID NO: 14438 - RNA, 21 nt, Homo sapiens
aggggugcuaucugugauuga

SEQ ID NO: 14439 - RNA, 23 nt, Homo sapiens
aaugacacgaucacucccguuga

SEQ ID NO: 14440 - RNA, 22 nt, Homo sapiens
caaaaaccacaguuucuuuugc

SEQ ID NO: 14441 - RNA, 25 nt, Homo sapiens
ggcggagggaaguagguccguuggu

SEQ ID NO: 14442 - RNA, 22 nt, Homo sapiens
aggcggggcgccgcgggaccgc

SEQ ID NO: 14443 - RNA, 22 nt, Homo sapiens
caaagugccucccuuuagagug

SEQ ID NO: 14444 - RNA, 24 nt, Homo sapiens
agccugauuaaacacaugcucuga

SEQ ID NO: 14445 - RNA, 22 nt, Homo sapiens
ugagccccugugccgcccccag

SEQ ID NO: 14446 - RNA, 23 nt, Homo sapiens
aggaugagcaaagaaaguagauu

SEQ ID NO: 14447 - RNA, 22 nt, Homo sapiens
cggaugagcaaagaaagugguu

SEQ ID NO: 14448 - RNA, 20 nt, Homo sapiens
ucguuugccuuuuucugcuu

SEQ ID NO: 14449 - RNA, 21 nt, Homo sapiens
ugguagacuauggaacguagg

SEQ ID NO: 14450 - RNA, 22 nt, Homo sapiens
uugggaucauuuugcauccaua

SEQ ID NO: 14451 - RNA, 22 nt, Homo sapiens
uucacaaggaggugucauuuau

SEQ ID NO: 14452 - RNA, 23 nt, Homo sapiens
gcgaggaccccucggggucugac

SEQ ID NO: 14453 - RNA, 21 nt, Homo sapiens
cacaagguauugguauuaccu

SEQ ID NO: 14454 - RNA, 19 nt, Homo sapiens
agcugucugaaaaugucuu

SEQ ID NO: 14455 - RNA, 25 nt, Homo sapiens
agggaucgcgggcggguggcggccu

SEQ ID NO: 14456 - RNA, 23 nt, Homo sapiens
cugggaucuccggggucuugguu

SEQ ID NO: 14457 - RNA, 17 nt, Homo sapiens
ucgccuccuccucuccc

SEQ ID NO: 14458 - RNA, 22 nt, Homo sapiens
ucucccaacccuuguaccagug

SEQ ID NO: 14459 - RNA, 22 nt, Homo sapiens
uggcagugucuuagcugguugu

SEQ ID NO: 14460 - RNA, 22 nt, Homo sapiens
aauugcacgguauccaucugua

SEQ ID NO: 14461 - RNA, 22 nt, Homo sapiens
agacuucccauuugaagguggc

SEQ ID NO: 14462 - RNA, 23 nt, Homo sapiens
aucgcugcgguugcgagcgcugu

SEQ ID NO: 14463 - RNA, 23 nt, Homo sapiens
gcagcagagaauaggacuacguc

SEQ ID NO: 14464 - RNA, 22 nt, Homo sapiens
ugugcgcagggagaccucuccc

SEQ ID NO: 14465 - RNA, 22 nt, Homo sapiens
auccgcgcucugacucucugcc

SEQ ID NO: 14466 - RNA, 21 nt, Homo sapiens
agagaagaagaucagccugca

SEQ ID NO: 14467 - RNA, 23 nt, Homo sapiens
ugaggggcagagagcgagacuuu

SEQ ID NO: 14468 - RNA, 22 nt, Homo sapiens
aucuggagguaagaagcacuuu

SEQ ID NO: 14469 - RNA, 19 nt, Homo sapiens
ugucucugcugggguuucu

SEQ ID NO: 14470 - RNA, 23 nt, Homo sapiens
uaaaucccauggugccuucuccu

SEQ ID NO: 14471 - RNA, 23 nt, Homo sapiens
cuggagauauggaagagcugugu

SEQ ID NO: 14472 - RNA, 23 nt, Homo sapiens
agcuacauugucugcuggguuuc

SEQ ID NO: 14473 - RNA, 21 nt, Homo sapiens
agcuacaucuggcuacugggu

SEQ ID NO: 14474 - RNA, 22 nt, Homo sapiens
ugucaguuugucaaauacccca

SEQ ID NO: 14475 - RNA, 22 nt, Homo sapiens
uguaaacauccucgacuggaag

SEQ ID NO: 14476 - RNA, 22 nt, Homo sapiens
uguaaacauccuacacucagcu

SEQ ID NO: 14477 - RNA, 23 nt, Homo sapiens
uguaaacauccuacacucucagc

SEQ ID NO: 14478 - RNA, 22 nt, Homo sapiens
uguaaacauccccgacuggaag

SEQ ID NO: 14479 - RNA, 22 nt, Homo sapiens
uguaaacauccuugacuggaag

SEQ ID NO: 14480 - RNA, 21 nt, Homo sapiens
aauaauacaugguugaucuuu

SEQ ID NO: 14481 - RNA, 22 nt, Homo sapiens
aacaucacagcaagucugugcu

SEQ ID NO: 14482 - RNA, 22 nt, Homo sapiens
aaaaguaauugcgaguuuuacc

SEQ ID NO: 14483 - RNA, 22 nt, Homo sapiens
aaaaguaauugugguuuuggcc

SEQ ID NO: 14484 - RNA, 22 nt, Homo sapiens
aaaaguaauugcgguuuuugcc

SEQ ID NO: 14485 - RNA, 22 nt, Homo sapiens
aaaaguaauugugguuuuugcc

SEQ ID NO: 14486 - RNA, 22 nt, Homo sapiens
aaaaguaaucgcgguuuuuguc

SEQ ID NO: 14487 - RNA, 22 nt, Homo sapiens
aaaaguaauugcggauuuugcc

SEQ ID NO: 14488 - RNA, 22 nt, Homo sapiens
aaaaguaauugcggucuuuggu

SEQ ID NO: 14489 - RNA, 22 nt, Homo sapiens
caaaaguaauuguggauuuugu

SEQ ID NO: 14490 - RNA, 21 nt, Homo sapiens
uaaaguaaauaugcaccaaaa

SEQ ID NO: 14491 - RNA, 20 nt, Homo sapiens
auggagauagauauagaaau

SEQ ID NO: 14492 - RNA, 22 nt, Homo sapiens
auaauacaugguuaaccucuuu

SEQ ID NO: 14493 - RNA, 23 nt, Homo sapiens
uauucauuuauccccagccuaca

SEQ ID NO: 14494 - RNA, 21 nt, Homo sapiens
cacuguguccuuucugcguag

SEQ ID NO: 14495 - RNA, 23 nt, Homo sapiens
cgggucggaguuagcucaagcgg

SEQ ID NO: 14496 - RNA, 17 nt, Homo sapiens
ucgccuccuccucuccc

SEQ ID NO: 14497 - RNA, 23 nt, Homo sapiens
ucuggcuccgugucuucacuccc

SEQ ID NO: 14498 - RNA, 23 nt, Homo sapiens
uagcagcgggaacaguucugcag

SEQ ID NO: 14499 - RNA, 22 nt, Homo sapiens
gaaagcgcuucccuuugcugga

SEQ ID NO: 14500 - RNA, 22 nt, Homo sapiens
caaagcgcuccccuuuagaggu

SEQ ID NO: 14501 - RNA, 23 nt, Homo sapiens
caaagcgcuucucuuuagagugu

SEQ ID NO: 14502 - RNA, 21 nt, Homo sapiens
caaagcgcuucccuuuggagc

SEQ ID NO: 14503 - RNA, 21 nt, Homo sapiens
gaaagcgcuucucuuuagagg

SEQ ID NO: 14504 - RNA, 19 nt, Homo sapiens
gggcgccugugaucccaac

SEQ ID NO: 14505 - RNA, 22 nt, Homo sapiens
ugcggggcuagggcuaacagca

SEQ ID NO: 14506 - RNA, 21 nt, Homo sapiens
cccggagccaggaugcagcuc

SEQ ID NO: 14507 - RNA, 22 nt, Homo sapiens
ucugcccccuccgcugcugcca

SEQ ID NO: 14508 - RNA, 20 nt, Homo sapiens
acugccccaggugcugcugg

SEQ ID NO: 14509 - RNA, 21 nt, Homo sapiens
cggggcagcucaguacaggau

SEQ ID NO: 14510 - RNA, 21 nt, Homo sapiens
uggcagggaggcugggagggg

SEQ ID NO: 14511 - RNA, 22 nt, Homo sapiens
ccucuuccccuugucucuccag

SEQ ID NO: 14512 - RNA, 22 nt, Homo sapiens
augggugaauuuguagaaggau

SEQ ID NO: 14513 - RNA, 21 nt, Homo sapiens
ugcaggaccaagaugagcccu

SEQ ID NO: 14514 - RNA, 21 nt, Homo sapiens
uccugcgcgucccagaugccc

SEQ ID NO: 14515 - RNA, 22 nt, Homo sapiens
cgcaggggccgggugcucaccg

SEQ ID NO: 14516 - RNA, 22 nt, Homo sapiens
uguaacagcaacuccaugugga

SEQ ID NO: 14517 - RNA, 22 nt, Homo sapiens
ugguuuaccgucccacauacau

SEQ ID NO: 14518 - RNA, 23 nt, Homo sapiens
gaagugcuucgauuuuggggugu

SEQ ID NO: 14519 - RNA, 22 nt, Homo sapiens
agucauuggaggguuugagcag

SEQ ID NO: 14520 - RNA, 23 nt, Homo sapiens
gagggucuugggagggaugugac

SEQ ID NO: 14521 - RNA, 22 nt, Homo sapiens
ucaccagcccuguguucccuag

SEQ ID NO: 14522 - RNA, 24 nt, Homo sapiens
ucccugagacccuuuaaccuguga

SEQ ID NO: 14523 - RNA, 22 nt, Homo sapiens
ucccugagacccuaacuuguga

SEQ ID NO: 14524 - RNA, 23 nt, Homo sapiens
ccucagggcuguagaacagggcu

SEQ ID NO: 14525 - RNA, 17 nt, Homo sapiens
ucgccuccuccucuccc

SEQ ID NO: 14526 - RNA, 22 nt, Homo sapiens
uggguggucuggagauuugugc

SEQ ID NO: 14527 - RNA, 23 nt, Homo sapiens
agcugguguugugaaucaggccg

SEQ ID NO: 14528 - RNA, 21 nt, Homo sapiens
cggcggggacggcgauugguc

SEQ ID NO: 14529 - RNA, 21 nt, Homo sapiens
cggcggggacggcgauugguc

SEQ ID NO: 14530 - RNA, 22 nt, Homo sapiens
uucaccaccuucuccacccagc

SEQ ID NO: 14531 - RNA, 22 nt, Homo sapiens
uucccuuugucauccuaugccu

SEQ ID NO: 14532 - RNA, 22 nt, Homo sapiens
uucccuuugucauccuucgccu

SEQ ID NO: 14533 - RNA, 21 nt, Homo sapiens
ccaccaccgugucugacacuu

SEQ ID NO: 14534 - RNA, 22 nt, Homo sapiens
agacccuggucugcacucuauc

SEQ ID NO: 14535 - RNA, 22 nt, Homo sapiens
cgucaacacuugcugguuuccu

SEQ ID NO: 14536 - RNA, 25 nt, Homo sapiens
aggggugguguugggacagcuccgu

SEQ ID NO: 14537 - RNA, 21 nt, Homo sapiens
uggguuuacguugggagaacu

SEQ ID NO: 14538 - RNA, 22 nt, Homo sapiens
aaccagcaccccaacuuuggac

SEQ ID NO: 14539 - RNA, 22 nt, Homo sapiens
aggcggggcgccgcgggaccgc

SEQ ID NO: 14540 - RNA, 22 nt, Homo sapiens
aggcggggcgccgcgggaccgc

SEQ ID NO: 14541 - RNA, 20 nt, Homo sapiens
accaggaggcugaggccccu

SEQ ID NO: 14542 - RNA, 22 nt, Homo sapiens
ugcggggcuagggcuaacagca

SEQ ID NO: 14543 - RNA, 21 nt, Homo sapiens
uggaggagaaggaaggugaug

SEQ ID NO: 14544 - RNA, 23 nt, Homo sapiens
gcagcagagaauaggacuacguc

SEQ ID NO: 14545 - RNA, 20 nt, Homo sapiens
ggggagcuguggaagcagua

SEQ ID NO: 14546 - RNA, 22 nt, Homo sapiens
ugugacugguugaccagagggg

SEQ ID NO: 14547 - RNA, 23 nt, Homo sapiens
ucaagagcaauaacgaaaaaugu

SEQ ID NO: 14548 - RNA, 22 nt, Homo sapiens
gucccucuccaaaugugucuug

SEQ ID NO: 14549 - RNA, 18 nt, Homo sapiens
ucagcuggcccucauuuc

SEQ ID NO: 14550 - RNA, 21 nt, Homo sapiens
cggcggggacggcgauugguc

SEQ ID NO: 14551 - RNA, 23 nt, Homo sapiens
ucccuguccuccaggagcucacg

SEQ ID NO: 14552 - RNA, 22 nt, Homo sapiens
agacccuggucugcacucuauc

SEQ ID NO: 14553 - RNA, 22 nt, Homo sapiens
aggcggggcgccgcgggaccgc

SEQ ID NO: 14554 - RNA, 23 nt, Homo sapiens
cacccggcugugugcacaugugc

SEQ ID NO: 14555 - RNA, 22 nt, Homo sapiens
ucugggcaacaaagugagaccu

SEQ ID NO: 14556 - RNA, 24 nt, Homo sapiens
uggcccugacugaagaccagcagu

SEQ ID NO: 14557 - RNA, 18 nt, Homo sapiens
cagggaggugaaugugau

SEQ ID NO: 14558 - RNA, 22 nt, Homo sapiens
uuugguccccuucaaccagcug

SEQ ID NO: 14559 - RNA, 22 nt, Homo sapiens
uuugguccccuucaaccagcua

SEQ ID NO: 14560 - RNA, 23 nt, Homo sapiens
ucuggcuccgugucuucacuccc

SEQ ID NO: 14561 - RNA, 22 nt, Homo sapiens
uggagagaaaggcaguuccuga

SEQ ID NO: 14562 - RNA, 20 nt, Homo sapiens
ccccagggcgacgcggcggg

SEQ ID NO: 14563 - RNA, 20 nt, Homo sapiens
ccuccugcccuccuugcugu

SEQ ID NO: 14564 - RNA, 23 nt, Homo sapiens
agcuacauugucugcuggguuuc

SEQ ID NO: 14565 - RNA, 21 nt, Homo sapiens
agggcccccccucaauccugu

SEQ ID NO: 14566 - RNA, 20 nt, Homo sapiens
ccucugggcccuuccuccag

SEQ ID NO: 14567 - RNA, 22 nt, Homo sapiens
ucucugggccugugucuuaggc

SEQ ID NO: 14568 - RNA, 20 nt, Homo sapiens
aaaguagcuguaccauuugc

SEQ ID NO: 14569 - RNA, 25 nt, Homo sapiens
gcugggcagggcuucugagcuccuu

SEQ ID NO: 14570 - RNA, 21 nt, Homo sapiens
guggcugcacucacuuccuuc

SEQ ID NO: 14571 - RNA, 23 nt, Homo sapiens
uauucauuuauccccagccuaca

SEQ ID NO: 14572 - RNA, 21 nt, Homo sapiens
cccggagccaggaugcagcuc

SEQ ID NO: 14573 - RNA, 21 nt, Homo sapiens
uggcagggaggcugggagggg

SEQ ID NO: 14574 - RNA, 22 nt, Homo sapiens
ugagccccugugccgcccccag

SEQ ID NO: 14575 - RNA, 27 nt, Homo sapiens
accuucuuguauaagcacugugcuaaa

SEQ ID NO: 14576 - RNA, 22 nt, Homo sapiens
acgcccuucccccccuucuuca

SEQ ID NO: 14577 - RNA, 22 nt, Homo sapiens
uggagagaaaggcaguuccuga

SEQ ID NO: 14578 - RNA, 21 nt, Homo sapiens
cggcggggacggcgauugguc

SEQ ID NO: 14579 - RNA, 21 nt, Homo sapiens
uucacaguggcuaaguuccgc

SEQ ID NO: 14580 - RNA, 21 nt, Homo sapiens
ugaguuggccaucugagugag

SEQ ID NO: 14581 - RNA, 21 nt, Homo sapiens
agggggaaaguucuauagucc

SEQ ID NO: 14582 - RNA, 22 nt, Homo sapiens
aggcggggcgccgcgggaccgc

SEQ ID NO: 14583 - RNA, 21 nt, Homo sapiens
uaccacaggguagaaccacgg

SEQ ID NO: 14584 - RNA, 21 nt, Homo sapiens
ccaguccugugccugccgccu

SEQ ID NO: 14585 - RNA, 21 nt, Homo sapiens
ugacaacuauggaugagcucu

SEQ ID NO: 14586 - RNA, 23 nt, Homo sapiens
agcuacauugucugcuggguuuc

SEQ ID NO: 14587 - RNA, 23 nt, Homo sapiens
ucaagagcaauaacgaaaaaugu

SEQ ID NO: 14588 - RNA, 22 nt, Homo sapiens
ggagaaauuauccuuggugugu

SEQ ID NO: 14589 - RNA, 22 nt, Homo sapiens
cuugguucagggagggucccca

SEQ ID NO: 14590 - RNA, 21 nt, Homo sapiens
uacucaaaaagcugucaguca

SEQ ID NO: 14591 - RNA, 27 nt, Homo sapiens
accuucuuguauaagcacugugcuaaa

SEQ ID NO: 14592 - RNA, 21 nt, Homo sapiens
cuuuuugcggucugggcuugc

SEQ ID NO: 14593 - RNA, 23 nt, Homo sapiens
uauggcuuuuuauuccuauguga

SEQ ID NO: 14594 - RNA, 23 nt, Homo sapiens
uuaaugcuaaucgugauaggggu

SEQ ID NO: 14595 - RNA, 22 nt, Homo sapiens
gguccagaggggagauagguuc

SEQ ID NO: 14596 - RNA, 22 nt, Homo sapiens
uagcaccaucugaaaucgguua

SEQ ID NO: 14597 - RNA, 18 nt, Homo sapiens
ugcuuccuuucagagggu

SEQ ID NO: 14598 - RNA, 22 nt, Homo sapiens
aucuggagguaagaagcacuuu

SEQ ID NO: 14599 - RNA, 22 nt, Homo sapiens
caugccuugaguguaggaccgu

SEQ ID NO: 14600 - RNA, 22 nt, Homo sapiens
uagcaaaaacugcaguuacuuu

SEQ ID NO: 14601 - RNA, 23 nt, Homo sapiens
aguauguucuuccaggacagaac

SEQ ID NO: 14602 - RNA, 21 nt, Homo sapiens
uaggacacauggucuacuucu

SEQ ID NO: 14603 - RNA, 21 nt, Homo sapiens
uccuucugcuccgucccccag

SEQ ID NO: 14604 - RNA, 21 nt, Homo sapiens
ugcaggaccaagaugagcccu

SEQ ID NO: 14605 - RNA, 22 nt, Homo sapiens
uuuagagacggggucuugcucu

SEQ ID NO: 14606 - RNA, 18 nt, Homo sapiens
ugaggcaguagauugaau

SEQ ID NO: 14607 - RNA, 21 nt, Homo sapiens
aggaggcagcgcucucaggac

SEQ ID NO: 14608 - RNA, 21 nt, Homo sapiens
aaggcagggcccccgcucccc

SEQ ID NO: 14609 - RNA, 22 nt, Homo sapiens
uggagagaaaggcaguuccuga

SEQ ID NO: 14610 - RNA, 21 nt, Homo sapiens
cggcggggacggcgauugguc

SEQ ID NO: 14611 - RNA, 22 nt, Homo sapiens
uguaacagcaacuccaugugga

SEQ ID NO: 14612 - RNA, 19 nt, Homo sapiens
accgugcaaagguagcaua

SEQ ID NO: 14613 - RNA, 22 nt, Homo sapiens
cauugcacuugucucggucuga

SEQ ID NO: 14614 - RNA, 22 nt, Homo sapiens
uauugcacauuacuaaguugca

SEQ ID NO: 14615 - RNA, 22 nt, Homo sapiens
aauugcacgguauccaucugua

SEQ ID NO: 14616 - RNA, 22 nt, Homo sapiens
aauugcacuuuagcaaugguga

SEQ ID NO: 14617 - RNA, 22 nt, Homo sapiens
aggcggggcgccgcgggaccgc

SEQ ID NO: 14618 - RNA, 22 nt, Homo sapiens
ugcggggcuagggcuaacagca

SEQ ID NO: 14619 - RNA, 22 nt, Homo sapiens
uauugcacuugucccggccugu

SEQ ID NO: 14620 - RNA, 22 nt, Homo sapiens
uauugcacucgucccggccucc

SEQ ID NO: 14621 - RNA, 21 nt, Homo sapiens
gugccagcugcagugggggag

SEQ ID NO: 14622 - RNA, 22 nt, Homo sapiens
cccugugcccggcccacuucug

SEQ ID NO: 14623 - RNA, 23 nt, Homo sapiens
caacggaaucccaaaagcagcug

SEQ ID NO: 14624 - RNA, 22 nt, Homo sapiens
aaaagcuggguugagagggcga

SEQ ID NO: 14625 - RNA, 22 nt, Homo sapiens
aaaagcuggguugagagggcaa

SEQ ID NO: 14626 - RNA, 20 nt, Homo sapiens
aaaagcuggguugagagggu

SEQ ID NO: 14627 - RNA, 19 nt, Homo sapiens
aaaagcuggguugagagga

SEQ ID NO: 14628 - RNA, 23 nt, Homo sapiens
ucaagagcaauaacgaaaaaugu

SEQ ID NO: 14629 - RNA, 22 nt, Homo sapiens
aauugcacgguauccaucugua

SEQ ID NO: 14630 - RNA, 25 nt, Homo sapiens
aggggugguguugggacagcuccgu

SEQ ID NO: 14631 - RNA, 22 nt, Homo sapiens
uuuccggcucgcgugggugugu

SEQ ID NO: 14632 - RNA, 22 nt, Homo sapiens
ccucuuccccuugucucuccag

SEQ ID NO: 14633 - RNA, 22 nt, Homo sapiens
acucggcguggcgucggucgug

SEQ ID NO: 14634 - RNA, 21 nt, Homo sapiens
ucgaggagcucacagucuagu

SEQ ID NO: 14635 - RNA, 23 nt, Homo sapiens
ugaguaccgccaugucuguuggg

SEQ ID NO: 14636 - RNA, 21 nt, Homo sapiens
gccccugggccuauccuagaa

SEQ ID NO: 14637 - RNA, 22 nt, Homo sapiens
agaggcuggccgugaugaauuc

SEQ ID NO: 14638 - RNA, 19 nt, Homo sapiens
aggcugcggaauucaggac

SEQ ID NO: 14639 - RNA, 22 nt, Homo sapiens
acuccagccccacagccucagc

SEQ ID NO: 14640 - RNA, 18 nt, Homo sapiens
ugaggcaguagauugaau

SEQ ID NO: 14641 - RNA, 23 nt, Homo sapiens
ugaguaccgccaugucuguuggg

SEQ ID NO: 14642 - RNA, 23 nt, Homo sapiens
uagugcaauauugcuuauagggu

SEQ ID NO: 14643 - RNA, 23 nt, Homo sapiens
cacucagccuugagggcacuuuc

SEQ ID NO: 14644 - RNA, 19 nt, Homo sapiens
aggcacggugucagcaggc

SEQ ID NO: 14645 - RNA, 23 nt, Homo sapiens
uggugcggagagggcccacagug

SEQ ID NO: 14646 - RNA, 22 nt, Homo sapiens
aggcagcgggguguaguggaua

SEQ ID NO: 14647 - RNA, 22 nt, Homo sapiens
uggagugugacaaugguguuug

SEQ ID NO: 14648 - RNA, 24 nt, Homo sapiens
uggcccugacugaagaccagcagu

SEQ ID NO: 14649 - RNA, 21 nt, Homo sapiens
cggcggggacggcgauugguc

SEQ ID NO: 14650 - RNA, 22 nt, Homo sapiens
ucugcccccuccgcugcugcca

SEQ ID NO: 14651 - RNA, 20 nt, Homo sapiens
ccccagggcgacgcggcggg

SEQ ID NO: 14652 - RNA, 20 nt, Homo sapiens
acugccccaggugcugcugg

SEQ ID NO: 14653 - RNA, 22 nt, Homo sapiens
cuggcccucucugcccuuccgu

SEQ ID NO: 14654 - RNA, 22 nt, Homo sapiens
uggcagugucuuagcugguugu

SEQ ID NO: 14655 - RNA, 23 nt, Homo sapiens
aggcaguguaguuagcugauugc

SEQ ID NO: 14656 - RNA, 22 nt, Homo sapiens
uaaugccccuaaaaauccuuau

SEQ ID NO: 14657 - RNA, 22 nt, Homo sapiens
uggcaguguauuguuagcuggu

SEQ ID NO: 14658 - RNA, 22 nt, Homo sapiens
aggcaguguauuguuagcuggc

SEQ ID NO: 14659 - RNA, 22 nt, Homo sapiens
aggcaguguauuguuagcuggc

SEQ ID NO: 14660 - RNA, 21 nt, Homo sapiens
cggggcagcucaguacaggau

SEQ ID NO: 14661 - RNA, 22 nt, Homo sapiens
uacucaggagaguggcaaucac

SEQ ID NO: 14662 - RNA, 19 nt, Homo sapiens
aguguggcuuucuuagagc

SEQ ID NO: 14663 - RNA, 21 nt, Homo sapiens
guggcugcacucacuuccuuc

SEQ ID NO: 14664 - RNA, 22 nt, Homo sapiens
aggcggggcgccgcgggaccgc

SEQ ID NO: 14665 - RNA, 20 nt, Homo sapiens
ggggagcuguggaagcagua

SEQ ID NO: 14666 - RNA, 22 nt, Homo sapiens
uuuccggcucgcgugggugugu

SEQ ID NO: 14667 - RNA, 22 nt, Homo sapiens
uuugaggcuacagugagaugug

SEQ ID NO: 14668 - RNA, 22 nt, Homo sapiens
uagguaguuucauguuguuggg

SEQ ID NO: 14669 - RNA, 22 nt, Homo sapiens
uagguaguuuccuguuguuggg

SEQ ID NO: 14670 - RNA, 22 nt, Homo sapiens
acagcaggcacagacaggcagu

SEQ ID NO: 14671 - RNA, 22 nt, Homo sapiens
uagcaccaucugaaaucgguua

SEQ ID NO: 14672 - RNA, 23 nt, Homo sapiens
uagcaccauuugaaaucaguguu

SEQ ID NO: 14673 - RNA, 22 nt, Homo sapiens
uagcaccauuugaaaucgguua

SEQ ID NO: 14674 - RNA, 22 nt, Homo sapiens
aauugcacgguauccaucugua

SEQ ID NO: 14675 - RNA, 22 nt, Homo sapiens
gccugcugggguggaaccuggu

SEQ ID NO: 14676 - RNA, 22 nt, Homo sapiens
uaacugguugaacaacugaacc

SEQ ID NO: 14677 - RNA, 24 nt, Homo sapiens
uggggagcugaggcucugggggug

SEQ ID NO: 14678 - RNA, 22 nt, Homo sapiens
ugagccccugugccgcccccag

SEQ ID NO: 14679 - RNA, 18 nt, Homo sapiens
acguuggcucugguggug

SEQ ID NO: 14680 - RNA, 22 nt, Homo sapiens
gcccgcguguggagccaggugu

SEQ ID NO: 14681 - RNA, 21 nt, Homo sapiens
cggcggggacggcgauugguc

SEQ ID NO: 14682 - RNA, 19 nt, Homo sapiens
aggcugcggaauucaggac

SEQ ID NO: 14683 - RNA, 23 nt, Homo sapiens
ggcagguucucacccucucuagg

SEQ ID NO: 14684 - RNA, 22 nt, Homo sapiens
aggcggggcgccgcgggaccgc

SEQ ID NO: 14685 - RNA, 22 nt, Homo sapiens
ugcggggcuagggcuaacagca

SEQ ID NO: 14686 - RNA, 22 nt, Homo sapiens
uuuccggcucgcgugggugugu

SEQ ID NO: 14687 - RNA, 23 nt, Homo sapiens
ccugcagcgacuugauggcuucc

SEQ ID NO: 14688 - RNA, 21 nt, Homo sapiens
ccccaccuccucucuccucag

SEQ ID NO: 14689 - RNA, 22 nt, Homo sapiens
uggguggucuggagauuugugc

SEQ ID NO: 14690 - RNA, 22 nt, Homo sapiens
cucccacugcuucacuugacua

SEQ ID NO: 14691 - RNA, 22 nt, Homo sapiens
cauugcacuugucucggucuga

SEQ ID NO: 14692 - RNA, 21 nt, Homo sapiens
ugguagacuauggaacguagg

SEQ ID NO: 14693 - RNA, 21 nt, Homo sapiens
ugucuugcaggccgucaugca

SEQ ID NO: 14694 - RNA, 23 nt, Homo sapiens
aggaccugcgggacaagauucuu

SEQ ID NO: 14695 - RNA, 23 nt, Homo sapiens
gaacgcgcuucccuauagagggu

SEQ ID NO: 14696 - RNA, 22 nt, Homo sapiens
ccucccacacccaaggcuugca

SEQ ID NO: 14697 - RNA, 22 nt, Homo sapiens
uggugggcacagaaucuggacu

SEQ ID NO: 14698 - RNA, 25 nt, Homo sapiens
aggggugguguugggacagcuccgu

SEQ ID NO: 14699 - RNA, 22 nt, Homo sapiens
uggugggccgcagaacaugugc

SEQ ID NO: 14700 - RNA, 25 nt, Homo sapiens
ggcggagggaaguagguccguuggu

SEQ ID NO: 14701 - RNA, 22 nt, Homo sapiens
uggagugugacaaugguguuug

SEQ ID NO: 14702 - RNA, 20 nt, Homo sapiens
ucguuugccuuuuucugcuu

SEQ ID NO: 14703 - RNA, 22 nt, Homo sapiens
ucugggcaacaaagugagaccu

SEQ ID NO: 14704 - RNA, 22 nt, Homo sapiens
ugagaaccacgucugcucugag

SEQ ID NO: 14705 - RNA, 25 nt, Homo sapiens
gcugggcagggcuucugagcuccuu

SEQ ID NO: 14706 - RNA, 22 nt, Homo sapiens
acuccagccccacagccucagc

SEQ ID NO: 14707 - RNA, 22 nt, Homo sapiens
uggagugugacaaugguguuug

SEQ ID NO: 14708 - RNA, 21 nt, Homo sapiens
aguuaggauuaggucguggaa

SEQ ID NO: 14709 - RNA, 21 nt, Homo sapiens
cggcggggacggcgauugguc

SEQ ID NO: 14710 - RNA, 22 nt, Homo sapiens
aggcggggcgccgcgggaccgc

SEQ ID NO: 14711 - RNA, 22 nt, Homo sapiens
ugagccccugugccgcccccag

SEQ ID NO: 14712 - RNA, 22 nt, Homo sapiens
uggagugugacaaugguguuug

SEQ ID NO: 14713 - RNA, 21 nt, Homo sapiens
ucccacguuguggcccagcag

SEQ ID NO: 14714 - RNA, 22 nt, Homo sapiens
auccgcgcucugacucucugcc

SEQ ID NO: 14715 - RNA, 22 nt, Homo sapiens
ugagguaguagguuguaugguu

SEQ ID NO: 14716 - RNA, 22 nt, Homo sapiens
uuuucaacucuaaugggagaga

SEQ ID NO: 14717 - RNA, 21 nt, Homo sapiens
uucacaguggcuaaguuccgc

SEQ ID NO: 14718 - RNA, 21 nt, Homo sapiens
uucacaguggcuaaguucugc

SEQ ID NO: 14719 - RNA, 22 nt, Homo sapiens
uggcaguguauuguuagcuggu

SEQ ID NO: 14720 - RNA, 22 nt, Homo sapiens
agaucagaaggugauuguggcu

SEQ ID NO: 14721 - RNA, 24 nt, Homo sapiens
uucuccaaaagaaagcacuuucug

SEQ ID NO: 14722 - RNA, 22 nt, Homo sapiens
aagugccuccuuuuagaguguu

SEQ ID NO: 14723 - RNA, 22 nt, Homo sapiens
augcugacauauuuacuagagg

SEQ ID NO: 14724 - RNA, 22 nt, Homo sapiens
cagugcaaugaugaaagggcau

SEQ ID NO: 14725 - RNA, 22 nt, Homo sapiens
cucccacugcuucacuugacua

SEQ ID NO: 14726 - RNA, 22 nt, Homo sapiens
uugggaucauuuugcauccaua

SEQ ID NO: 14727 - RNA, 22 nt, Homo sapiens
ccucccacacccaaggcuugca

SEQ ID NO: 14728 - RNA, 22 nt, Homo sapiens
caaaaguaauuguggauuuugu

SEQ ID NO: 14729 - RNA, 20 nt, Homo sapiens
guccgcucggcgguggccca

SEQ ID NO: 14730 - RNA, 23 nt, Homo sapiens
cugggaucuccggggucuugguu

SEQ ID NO: 14731 - RNA, 22 nt, Homo sapiens
ucugcccccuccgcugcugcca

SEQ ID NO: 14732 - RNA, 20 nt, Homo sapiens
acugccccaggugcugcugg

SEQ ID NO: 14733 - RNA, 22 nt, Homo sapiens
uaaugccccuaaaaauccuuau

SEQ ID NO: 14734 - RNA, 21 nt, Homo sapiens
cggggcagcucaguacaggau

SEQ ID NO: 14735 - RNA, 22 nt, Homo sapiens
uggagugugacaaugguguuug

SEQ ID NO: 14736 - RNA, 22 nt, Homo sapiens
ucagugcaucacagaacuuugu

SEQ ID NO: 14737 - RNA, 21 nt, Homo sapiens
cggcggggacggcgauugguc

SEQ ID NO: 14738 - RNA, 22 nt, Homo sapiens
ucugcccccuccgcugcugcca

SEQ ID NO: 14739 - RNA, 22 nt, Homo sapiens
uagcuuaucagacugauguuga

SEQ ID NO: 14740 - RNA, 20 nt, Homo sapiens
acugccccaggugcugcugg

SEQ ID NO: 14741 - RNA, 20 nt, Homo sapiens
acucaaacugugggggcacu

SEQ ID NO: 14742 - RNA, 23 nt, Homo sapiens
ugaggggcagagagcgagacuuu

SEQ ID NO: 14743 - RNA, 21 nt, Homo sapiens
cggggcagcucaguacaggau

SEQ ID NO: 14744 - RNA, 21 nt, Homo sapiens
ugaguuggccaucugagugag

SEQ ID NO: 14745 - RNA, 22 nt, Homo sapiens
aggcggggcgccgcgggaccgc

SEQ ID NO: 14746 - RNA, 22 nt, Homo sapiens
ugcggggcuagggcuaacagca

SEQ ID NO: 14747 - RNA, 21 nt, Homo sapiens
uacucaaaaagcugucaguca

SEQ ID NO: 14748 - RNA, 21 nt, Homo sapiens
agagaagaagaucagccugca

SEQ ID NO: 14749 - RNA, 22 nt, Homo sapiens
cuggacugagccgugcuacugg

SEQ ID NO: 14750 - RNA, 22 nt, Homo sapiens
aagcugccaguugaagaacugu

SEQ ID NO: 14751 - RNA, 22 nt, Homo sapiens
uguaaacauccucgacuggaag

SEQ ID NO: 14752 - RNA, 22 nt, Homo sapiens
uguaaacauccccgacuggaag

SEQ ID NO: 14753 - RNA, 22 nt, Homo sapiens
uguaaacauccuugacuggaag

SEQ ID NO: 14754 - RNA, 22 nt, Homo sapiens
aaaagcuggguugagagggcga

SEQ ID NO: 14755 - RNA, 22 nt, Homo sapiens
aaaagcuggguugagagggcaa

SEQ ID NO: 14756 - RNA, 20 nt, Homo sapiens
aaaagcuggguugagagggu

SEQ ID NO: 14757 - RNA, 19 nt, Homo sapiens
aaaagcuggguugagagga

SEQ ID NO: 14758 - RNA, 20 nt, Homo sapiens
ccucugggcccuuccuccag

SEQ ID NO: 14759 - RNA, 22 nt, Homo sapiens
ucucugggccugugucuuaggc

SEQ ID NO: 14760 - RNA, 22 nt, Homo sapiens
uaaugccccuaaaaauccuuau

SEQ ID NO: 14761 - RNA, 20 nt, Homo sapiens
acucaaacugugggggcacu

SEQ ID NO: 14762 - RNA, 21 nt, Homo sapiens
gcaguccaugggcauauacac

SEQ ID NO: 14763 - RNA, 22 nt, Homo sapiens
ucuucucuguuuuggccaugug

SEQ ID NO: 14764 - RNA, 21 nt, Homo sapiens
cccggagccaggaugcagcuc

SEQ ID NO: 14765 - RNA, 21 nt, Homo sapiens
ugagaugaagcacuguagcuc

SEQ ID NO: 14766 - RNA, 23 nt, Homo sapiens
ucuggcuccgugucuucacuccc

SEQ ID NO: 14767 - RNA, 22 nt, Homo sapiens
uguaacagcaacuccaugugga

SEQ ID NO: 14768 - RNA, 20 nt, Homo sapiens
ccucugggcccuuccuccag

SEQ ID NO: 14769 - RNA, 22 nt, Homo sapiens
ucucugggccugugucuuaggc

SEQ ID NO: 14770 - RNA, 19 nt, Homo sapiens
aggcacggugucagcaggc

SEQ ID NO: 14771 - RNA, 23 nt, Homo sapiens
aaaagugcuuacagugcagguag

SEQ ID NO: 14772 - RNA, 22 nt, Homo sapiens
ucggccugaccacccaccccac

SEQ ID NO: 14773 - RNA, 18 nt, Homo sapiens
gucccuguucaggcgcca

SEQ ID NO: 14774 - RNA, 24 nt, Homo sapiens
ccagacagaauucuaugcacuuuc

SEQ ID NO: 14775 - RNA, 22 nt, Homo sapiens
uaacacugucugguaaagaugg

SEQ ID NO: 14776 - RNA, 21 nt, Homo sapiens
uccugcgcgucccagaugccc

SEQ ID NO: 14777 - RNA, 22 nt, Homo sapiens
uaacacugucugguaacgaugu

SEQ ID NO: 14778 - RNA, 21 nt, Homo sapiens
auuugugcuuggcucugucac

SEQ ID NO: 14779 - RNA, 22 nt, Homo sapiens
cauugcacuugucucggucuga

SEQ ID NO: 14780 - RNA, 22 nt, Homo sapiens
uauugcacauuacuaaguugca

SEQ ID NO: 14781 - RNA, 23 nt, Homo sapiens
ucccuguccuccaggagcucacg

SEQ ID NO: 14782 - RNA, 22 nt, Homo sapiens
aauugcacgguauccaucugua

SEQ ID NO: 14783 - RNA, 22 nt, Homo sapiens
aauugcacuuuagcaaugguga

SEQ ID NO: 14784 - RNA, 22 nt, Homo sapiens
agacccuggucugcacucuauc

SEQ ID NO: 14785 - RNA, 25 nt, Homo sapiens
ggcggagggaaguagguccguuggu

SEQ ID NO: 14786 - RNA, 22 nt, Homo sapiens
uauugcacuugucccggccugu

SEQ ID NO: 14787 - RNA, 22 nt, Homo sapiens
uauugcacucgucccggccucc

SEQ ID NO: 14788 - RNA, 22 nt, Homo sapiens
uuuccggcucgcgugggugugu

SEQ ID NO: 14789 - RNA, 21 nt, Homo sapiens
ccgucgccgccacccgagccg

SEQ ID NO: 14790 - RNA, 21 nt, Homo sapiens
ccccaccuccucucuccucag

SEQ ID NO: 14791 - RNA, 18 nt, Homo sapiens
aucccaccucugccacca

SEQ ID NO: 14792 - RNA, 23 nt, Homo sapiens
ugaguaccgccaugucuguuggg

SEQ ID NO: 14793 - RNA, 22 nt, Homo sapiens
agaguugagucuggacgucccg

SEQ ID NO: 14794 - RNA, 20 nt, Homo sapiens
gugcauugcuguugcauugc

SEQ ID NO: 14795 - RNA, 22 nt, Homo sapiens
gagugccuucuuuuggagcguu

SEQ ID NO: 14796 - RNA, 22 nt, Homo sapiens
aagugccuccuuuuagaguguu

SEQ ID NO: 14797 - RNA, 20 nt, Homo sapiens
guagaggagauggcgcaggg

SEQ ID NO: 14798 - RNA, 17 nt, Homo sapiens
ucccaccgcugccaccc

SEQ ID NO: 14799 - RNA, 23 nt, Homo sapiens
ucuggcuccgugucuucacuccc

SEQ ID NO: 14800 - RNA, 22 nt, Homo sapiens
uggugggcacagaaucuggacu

SEQ ID NO: 14801 - RNA, 22 nt, Homo sapiens
uggugggccgcagaacaugugc

SEQ ID NO: 14802 - RNA, 22 nt, Homo sapiens
aggcggggcgccgcgggaccgc

SEQ ID NO: 14803 - RNA, 22 nt, Homo sapiens
ugcggggcuagggcuaacagca

SEQ ID NO: 14804 - RNA, 22 nt, Homo sapiens
acgcccuucccccccuucuuca

SEQ ID NO: 14805 - RNA, 22 nt, Homo sapiens
ucugggcaacaaagugagaccu

SEQ ID NO: 14806 - RNA, 23 nt, Homo sapiens
cgcauccccuagggcauuggugu

SEQ ID NO: 14807 - RNA, 22 nt, Homo sapiens
uccagcaucagugauuuuguug

SEQ ID NO: 14808 - RNA, 22 nt, Homo sapiens
aauugcacuuuagcaaugguga

SEQ ID NO: 14809 - RNA, 25 nt, Homo sapiens
gcugggcagggcuucugagcuccuu

SEQ ID NO: 14810 - RNA, 22 nt, Homo sapiens
aggcagcgggguguaguggaua

SEQ ID NO: 14811 - RNA, 22 nt, Homo sapiens
ugcccuuaaaggugaacccagu

SEQ ID NO: 14812 - RNA, 24 nt, Homo sapiens
agccuggaagcuggagccugcagu

SEQ ID NO: 14813 - RNA, 17 nt, Homo sapiens
gugggggagaggcuguc

SEQ ID NO: 14814 - RNA, 17 nt, Homo sapiens
ucgccuccuccucuccc

SEQ ID NO: 14815 - RNA, 19 nt, Homo sapiens
accgugcaaagguagcaua

SEQ ID NO: 14816 - RNA, 22 nt, Homo sapiens
cauugcacuugucucggucuga

SEQ ID NO: 14817 - RNA, 22 nt, Homo sapiens
ucgugcaucccuuuagaguguu

SEQ ID NO: 14818 - RNA, 21 nt, Homo sapiens
gaaggcgcuucccuuuggagu

SEQ ID NO: 14819 - RNA, 22 nt, Homo sapiens
gaaggcgcuucccuuuagagcg

SEQ ID NO: 14820 - RNA, 23 nt, Homo sapiens
acuugggcacugaaacaaugucc

SEQ ID NO: 14821 - RNA, 22 nt, Homo sapiens
acccgucccguucguccccgga

SEQ ID NO: 14822 - RNA, 23 nt, Homo sapiens
ucuggcuccgugucuucacuccc

SEQ ID NO: 14823 - RNA, 23 nt, Homo sapiens
uaaggugcaucuagugcagauag

SEQ ID NO: 14824 - RNA, 22 nt, Homo sapiens
agacccuggucugcacucuauc

SEQ ID NO: 14825 - RNA, 19 nt, Homo sapiens
aggcacggugucagcaggc

SEQ ID NO: 14826 - RNA, 20 nt, Homo sapiens
cggcucugggucugugggga

SEQ ID NO: 14827 - RNA, 23 nt, Homo sapiens
ucugcucauaccccaugguuucu

SEQ ID NO: 14828 - RNA, 22 nt, Homo sapiens
uauugcacucgucccggccucc

SEQ ID NO: 14829 - RNA, 20 nt, Homo sapiens
ugagcccuguccucccgcag

SEQ ID NO: 14830 - RNA, 22 nt, Homo sapiens
uucuggaauucugugugaggga

SEQ ID NO: 14831 - RNA, 21 nt, Homo sapiens
agggcccccccucaauccugu

SEQ ID NO: 14832 - RNA, 23 nt, Homo sapiens
ugaggggcagagagcgagacuuu

SEQ ID NO: 14833 - RNA, 23 nt, Homo sapiens
aggaccugcgggacaagauucuu

SEQ ID NO: 14834 - RNA, 23 nt, Homo sapiens
caaagcgcuucucuuuagagugu

SEQ ID NO: 14835 - RNA, 21 nt, Homo sapiens
cuccagagggaaguacuuucu

SEQ ID NO: 14836 - RNA, 21 nt, Homo sapiens
cuccagagggaugcacuuucu

SEQ ID NO: 14837 - RNA, 22 nt, Homo sapiens
agacuucccauuugaagguggc

SEQ ID NO: 14838 - RNA, 24 nt, Homo sapiens
gaccuggacauguuugugcccagu

SEQ ID NO: 14839 - RNA, 20 nt, Homo sapiens
cggcucugggucugugggga

SEQ ID NO: 14840 - RNA, 22 nt, Homo sapiens
cugcccuggcccgagggaccga

SEQ ID NO: 14841 - RNA, 22 nt, Homo sapiens
ugagccccugugccgcccccag

SEQ ID NO: 14842 - RNA, 22 nt, Homo sapiens
ggagacgcggcccuguuggagu

SEQ ID NO: 14843 - RNA, 23 nt, Homo sapiens
ucuggcuccgugucuucacuccc

SEQ ID NO: 14844 - RNA, 22 nt, Homo sapiens
ucugcccccuccgcugcugcca

SEQ ID NO: 14845 - RNA, 22 nt, Homo sapiens
uguaaacauccuacacucagcu

SEQ ID NO: 14846 - RNA, 20 nt, Homo sapiens
acugccccaggugcugcugg

SEQ ID NO: 14847 - RNA, 23 nt, Homo sapiens
ugucugcccgcaugccugccucu

SEQ ID NO: 14848 - RNA, 22 nt, Homo sapiens
agaggcuggccgugaugaauuc

SEQ ID NO: 14849 - RNA, 23 nt, Homo sapiens
caaagcgcuucucuuuagagugu

SEQ ID NO: 14850 - RNA, 21 nt, Homo sapiens
cuccagagggaaguacuuucu

SEQ ID NO: 14851 - RNA, 21 nt, Homo sapiens
cuccagagggaugcacuuucu

SEQ ID NO: 14852 - RNA, 21 nt, Homo sapiens
gcgacccauacuugguuucag

SEQ ID NO: 14853 - RNA, 21 nt, Homo sapiens
uuggccacaauggguuagaac

SEQ ID NO: 14854 - RNA, 21 nt, Homo sapiens
acagucugcugagguuggagc

SEQ ID NO: 14855 - RNA, 22 nt, Homo sapiens
aguauucuguaccagggaaggu

SEQ ID NO: 14856 - RNA, 20 nt, Homo sapiens
cggcucugggucugugggga

SEQ ID NO: 14857 - RNA, 23 nt, Homo sapiens
ucuggcuccgugucuucacuccc

SEQ ID NO: 14858 - RNA, 22 nt, Homo sapiens
caaagaauucuccuuuugggcu

SEQ ID NO: 14859 - RNA, 20 nt, Homo sapiens
ccccagggcgacgcggcggg

SEQ ID NO: 14860 - RNA, 21 nt, Homo sapiens
uaaagugcugacagugcagau

SEQ ID NO: 14861 - RNA, 23 nt, Homo sapiens
cagugcaaugauauugucaaagc

SEQ ID NO: 14862 - RNA, 22 nt, Homo sapiens
ccucccacacccaaggcuugca

SEQ ID NO: 14863 - RNA, 23 nt, Homo sapiens
gaacgccuguucuugccaggugg

SEQ ID NO: 14864 - RNA, 23 nt, Homo sapiens
uccaguaccacgugucagggcca

SEQ ID NO: 14865 - RNA, 22 nt, Homo sapiens
uggauuucuuugugaaucacca

SEQ ID NO: 14866 - RNA, 23 nt, Homo sapiens
ccugcagcgacuugauggcuucc

SEQ ID NO: 14867 - RNA, 20 nt, Homo sapiens
ucugcaggguuugcuuugag

SEQ ID NO: 14868 - RNA, 20 nt, Homo sapiens
ucugcaggguuugcuuugag

SEQ ID NO: 14869 - RNA, 20 nt, Homo sapiens
cgugccacccuuuuccccag

SEQ ID NO: 14870 - RNA, 18 nt, Homo sapiens
cgggcguggugguggggg

SEQ ID NO: 14871 - RNA, 23 nt, Homo sapiens
ucuggcuccgugucuucacuccc

SEQ ID NO: 14872 - RNA, 22 nt, Homo sapiens
aacauucaaccugucggugagu

SEQ ID NO: 14873 - RNA, 18 nt, Homo sapiens
uccagugcccuccucucc

SEQ ID NO: 14874 - RNA, 22 nt, Homo sapiens
ugauauguuugauauauuaggu

SEQ ID NO: 14875 - RNA, 23 nt, Homo sapiens
ucuuggaguaggucauugggugg

SEQ ID NO: 14876 - RNA, 21 nt, Homo sapiens
uggaggagaaggaaggugaug

SEQ ID NO: 14877 - RNA, 22 nt, Homo sapiens
ucuacaaaggaaagcgcuuucu

SEQ ID NO: 14878 - RNA, 23 nt, Homo sapiens
uauggcuuuucauuccuauguga

SEQ ID NO: 14879 - RNA, 22 nt, Homo sapiens
ucaggccaggcacaguggcuca

SEQ ID NO: 14880 - RNA, 21 nt, Homo sapiens
gccccugggccuauccuagaa

SEQ ID NO: 14881 - RNA, 23 nt, Homo sapiens
uagcagcgggaacaguucugcag

SEQ ID NO: 14882 - RNA, 24 nt, Homo sapiens
ugccugggucucuggccugcgcgu

SEQ ID NO: 14883 - RNA, 21 nt, Homo sapiens
ccuggaaacacugagguugug

SEQ ID NO: 14884 - RNA, 20 nt, Homo sapiens
ggggagcuguggaagcagua

SEQ ID NO: 14885 - RNA, 26 nt, Homo sapiens
gaugaugauggcagcaaauucugaaa

SEQ ID NO: 14886 - RNA, 22 nt, Homo sapiens
uaacacugucugguaaagaugg

SEQ ID NO: 14887 - RNA, 22 nt, Homo sapiens
uacccagagcaugcagugugaa

SEQ ID NO: 14888 - RNA, 22 nt, Homo sapiens
uccuucauuccaccggagucug

SEQ ID NO: 14889 - RNA, 23 nt, Homo sapiens
gcaaagcacacggccugcagaga

SEQ ID NO: 14890 - RNA, 23 nt, Homo sapiens
uagugcaauauugcuuauagggu

SEQ ID NO: 14891 - RNA, 23 nt, Homo sapiens
uaaauuucaccuuucugagaagg

SEQ ID NO: 14892 - RNA, 23 nt, Homo sapiens
gacacgggcgacagcugcggccc

SEQ ID NO: 14893 - RNA, 20 nt, Homo sapiens
agaccauggguucucauugu

SEQ ID NO: 14894 - RNA, 22 nt, Homo sapiens
uggagugugacaaugguguuug

SEQ ID NO: 14895 - RNA, 22 nt, Homo sapiens
ucuucucuguuuuggccaugug

SEQ ID NO: 14896 - RNA, 20 nt, Homo sapiens
ugagcccuguccucccgcag

SEQ ID NO: 14897 - RNA, 22 nt, Homo sapiens
uucuggaauucugugugaggga

SEQ ID NO: 14898 - RNA, 22 nt, Homo sapiens
aagcccuuaccccaaaaagcau

SEQ ID NO: 14899 - RNA, 21 nt, Homo sapiens
gcccuccgcccgugcaccccg

SEQ ID NO: 14900 - RNA, 23 nt, Homo sapiens
cggcccgggcugcugcuguuccu

SEQ ID NO: 14901 - RNA, 22 nt, Homo sapiens
cauugcacuugucucggucuga

SEQ ID NO: 14902 - RNA, 23 nt, Homo sapiens
ugaggggcagagagcgagacuuu

SEQ ID NO: 14903 - RNA, 25 nt, Homo sapiens
ggcggagggaaguagguccguuggu

SEQ ID NO: 14904 - RNA, 20 nt, Homo sapiens
ucacaccugccucgcccccc

SEQ ID NO: 14905 - RNA, 23 nt, Homo sapiens
ucuggcuccgugucuucacuccc

SEQ ID NO: 14906 - RNA, 20 nt, Homo sapiens
agagguauagggcaugggaa

SEQ ID NO: 14907 - RNA, 22 nt, Homo sapiens
uagcuuaucagacugauguuga

SEQ ID NO: 14908 - RNA, 22 nt, Homo sapiens
aacacaccugguuaaccucuuu

SEQ ID NO: 14909 - RNA, 21 nt, Homo sapiens
gugcauuguaguugcauugca

SEQ ID NO: 14910 - RNA, 21 nt, Homo sapiens
gugucuuuugcucugcaguca

SEQ ID NO: 14911 - RNA, 22 nt, Homo sapiens
caaaaguaauuguggauuuugu

SEQ ID NO: 14912 - RNA, 19 nt, Homo sapiens
gagccaguuggacaggagc

SEQ ID NO: 14913 - RNA, 21 nt, Homo sapiens
uggguuuacguugggagaacu

SEQ ID NO: 14914 - RNA, 22 nt, Homo sapiens
uauaccucaguuuuaucaggug

SEQ ID NO: 14915 - RNA, 22 nt, Homo sapiens
cacuggcuccuuucuggguaga

SEQ ID NO: 14916 - RNA, 20 nt, Homo sapiens
uaaggcacgcggugaaugcc

SEQ ID NO: 14917 - RNA, 17 nt, Homo sapiens
ucccaccgcugccaccc

SEQ ID NO: 14918 - RNA, 20 nt, Homo sapiens
ccccagggcgacgcggcggg

SEQ ID NO: 14919 - RNA, 22 nt, Homo sapiens
gguccagaggggagauagguuc

SEQ ID NO: 14920 - RNA, 22 nt, Homo sapiens
uagcuuaucagacugauguuga

SEQ ID NO: 14921 - RNA, 21 nt, Homo sapiens
uaaagugcugacagugcagau

SEQ ID NO: 14922 - RNA, 23 nt, Homo sapiens
cagugcaaugauauugucaaagc

SEQ ID NO: 14923 - RNA, 23 nt, Homo sapiens
uuucaagccagggggcguuuuuc

SEQ ID NO: 14924 - RNA, 21 nt, Homo sapiens
uaaggcacccuucugaguaga

SEQ ID NO: 14925 - RNA, 23 nt, Homo sapiens
caaagcgcuucucuuuagagugu

SEQ ID NO: 14926 - RNA, 21 nt, Homo sapiens
cuccagagggaaguacuuucu

SEQ ID NO: 14927 - RNA, 21 nt, Homo sapiens
cuccagagggaugcacuuucu

SEQ ID NO: 14928 - RNA, 21 nt, Homo sapiens
aggaggcagcgcucucaggac

SEQ ID NO: 14929 - RNA, 20 nt, Homo sapiens
accaggaggcugaggccccu

SEQ ID NO: 14930 - RNA, 21 nt, Homo sapiens
ccuggaaacacugagguugug

SEQ ID NO: 14931 - RNA, 23 nt, Homo sapiens
uauggcuuuuuauuccuauguga

SEQ ID NO: 14932 - RNA, 22 nt, Homo sapiens
ugagaacugaauuccauggguu

SEQ ID NO: 14933 - RNA, 22 nt, Homo sapiens
ugagaacugaauuccauaggcu

SEQ ID NO: 14934 - RNA, 22 nt, Homo sapiens
ucagugcacuacagaacuuugu

SEQ ID NO: 14935 - RNA, 22 nt, Homo sapiens
ucucccaacccuuguaccagug

SEQ ID NO: 14936 - RNA, 22 nt, Homo sapiens
uagcagcacauaaugguuugug

SEQ ID NO: 14937 - RNA, 23 nt, Homo sapiens
agcuacauugucugcuggguuuc

SEQ ID NO: 14938 - RNA, 21 nt, Homo sapiens
uaaagugcugacagugcagau

SEQ ID NO: 14939 - RNA, 23 nt, Homo sapiens
cagugcaaugauauugucaaagc

SEQ ID NO: 14940 - RNA, 23 nt, Homo sapiens
uagugcaauauugcuuauagggu

SEQ ID NO: 14941 - RNA, 22 nt, Homo sapiens
caaaaaucucaauuacuuuugc

SEQ ID NO: 14942 - RNA, 21 nt, Homo sapiens
gcgacccauacuugguuucag

SEQ ID NO: 14943 - RNA, 23 nt, Homo sapiens
ucuggcuccgugucuucacuccc

SEQ ID NO: 14944 - RNA, 22 nt, Homo sapiens
uggacggagaacugauaagggu

SEQ ID NO: 14945 - RNA, 22 nt, Homo sapiens
caaagaauucuccuuuugggcu

SEQ ID NO: 14946 - RNA, 21 nt, Homo sapiens
cggggcagcucaguacaggau

SEQ ID NO: 14947 - RNA, 18 nt, Homo sapiens
ugcuuccuuucagagggu

SEQ ID NO: 14948 - RNA, 22 nt, Homo sapiens
aucuggagguaagaagcacuuu

SEQ ID NO: 14949 - RNA, 23 nt, Homo sapiens
acuugggcacugaaacaaugucc

SEQ ID NO: 14950 - RNA, 21 nt, Homo sapiens
aaggcagggcccccgcucccc

SEQ ID NO: 14951 - RNA, 20 nt, Homo sapiens
ucguuugccuuuuucugcuu

SEQ ID NO: 14952 - RNA, 22 nt, Homo sapiens
ucuacaaaggaaagcgcuuucu

SEQ ID NO: 14953 - RNA, 22 nt, Homo sapiens
cagugcaauguuaaaagggcau

SEQ ID NO: 14954 - RNA, 22 nt, Homo sapiens
cagugcaaugaugaaagggcau

SEQ ID NO: 14955 - RNA, 22 nt, Homo sapiens
ucagugcacuacagaacuuugu

SEQ ID NO: 14956 - RNA, 22 nt, Homo sapiens
ucagugcaucacagaacuuugu

SEQ ID NO: 14957 - RNA, 21 nt, Homo sapiens
ucagugcaugacagaacuugg

SEQ ID NO: 14958 - RNA, 23 nt, Homo sapiens
ugugcaaaucuaugcaaaacuga

SEQ ID NO: 14959 - RNA, 23 nt, Homo sapiens
ugugcaaauccaugcaaaacuga

SEQ ID NO: 14960 - RNA, 22 nt, Homo sapiens
cauugcacuugucucggucuga

SEQ ID NO: 14961 - RNA, 21 nt, Homo sapiens
uucaaguaauucaggauaggu

SEQ ID NO: 14962 - RNA, 23 nt, Homo sapiens
cagugcaauaguauugucaaagc

SEQ ID NO: 14963 - RNA, 23 nt, Homo sapiens
cagugcaaugauauugucaaagc

SEQ ID NO: 14964 - RNA, 23 nt, Homo sapiens
uagugcaauauugcuuauagggu

SEQ ID NO: 14965 - RNA, 21 nt, Homo sapiens
uuuugcaccuuuuggagugaa

SEQ ID NO: 14966 - RNA, 23 nt, Homo sapiens
guuugcacgggugggccuugucu

SEQ ID NO: 14967 - RNA, 21 nt, Homo sapiens
cgcgggugcuuacugacccuu

SEQ ID NO: 14968 - RNA, 23 nt, Homo sapiens
uacccuguagauccgaauuugug

SEQ ID NO: 14969 - RNA, 23 nt, Homo sapiens
uacccuguagaaccgaauuugug

SEQ ID NO: 14970 - RNA, 21 nt, Homo sapiens
ccccaccuccucucuccucag

SEQ ID NO: 14971 - RNA, 22 nt, Homo sapiens
uggagugugacaaugguguuug

SEQ ID NO: 14972 - RNA, 22 nt, Homo sapiens
ucugggcaacaaagugagaccu

SEQ ID NO: 14973 - RNA, 22 nt, Homo sapiens
acucggcguggcgucggucgug

SEQ ID NO: 14974 - RNA, 22 nt, Homo sapiens
uggagagaaaggcaguuccuga

SEQ ID NO: 14975 - RNA, 22 nt, Homo sapiens
cauugcacuugucucggucuga

SEQ ID NO: 14976 - RNA, 21 nt, Homo sapiens
uucacaguggcuaaguuccgc

SEQ ID NO: 14977 - RNA, 23 nt, Homo sapiens
ucccuguccuccaggagcucacg

SEQ ID NO: 14978 - RNA, 23 nt, Homo sapiens
ugaggggcagagagcgagacuuu

SEQ ID NO: 14979 - RNA, 22 nt, Homo sapiens
uggugggcacagaaucuggacu

SEQ ID NO: 14980 - RNA, 21 nt, Homo sapiens
aggguaagcugaaccucugau

SEQ ID NO: 14981 - RNA, 20 nt, Homo sapiens
guccgcucggcgguggccca

SEQ ID NO: 14982 - RNA, 25 nt, Homo sapiens
gcugggcagggcuucugagcuccuu

SEQ ID NO: 14983 - RNA, 22 nt, Homo sapiens
uggugggccgcagaacaugugc

SEQ ID NO: 14984 - RNA, 17 nt, Homo sapiens
ucucgcuggggccucca

SEQ ID NO: 14985 - RNA, 23 nt, Homo sapiens
ucaaaugcucagacuccuguggu

SEQ ID NO: 14986 - RNA, 21 nt, Homo sapiens
aagcauucuuucauugguugg

SEQ ID NO: 14987 - RNA, 22 nt, Homo sapiens
ugagaacugaauuccauggguu

SEQ ID NO: 14988 - RNA, 22 nt, Homo sapiens
ugagaacugaauuccauaggcu

SEQ ID NO: 14989 - RNA, 22 nt, Homo sapiens
ucagugcacuacagaacuuugu

SEQ ID NO: 14990 - RNA, 22 nt, Homo sapiens
ucagugcacuacagaacuuugu

SEQ ID NO: 14991 - RNA, 22 nt, Homo sapiens
ucagugcaucacagaacuuugu

SEQ ID NO: 14992 - RNA, 21 nt, Homo sapiens
gccccugggccuauccuagaa

SEQ ID NO: 14993 - RNA, 22 nt, Homo sapiens
cuccuauaugaugccuuucuuc

SEQ ID NO: 14994 - RNA, 22 nt, Homo sapiens
uugcauauguaggaugucccau

SEQ ID NO: 14995 - RNA, 22 nt, Homo sapiens
ggagaaauuauccuuggugugu

SEQ ID NO: 14996 - RNA, 22 nt, Homo sapiens
uaugcauuguauuuuuaggucc

SEQ ID NO: 14997 - RNA, 23 nt, Homo sapiens
uauucauuuauccccagccuaca

SEQ ID NO: 14998 - RNA, 21 nt, Homo sapiens
ccuggaaacacugagguugug

SEQ ID NO: 14999 - RNA, 22 nt, Homo sapiens
uggauuucuuugugaaucacca

SEQ ID NO: 15000 - RNA, 23 nt, Homo sapiens
ucaaaugcucagacuccuguggu

SEQ ID NO: 15001 - RNA, 23 nt, Homo sapiens
ccugcagcgacuugauggcuucc

SEQ ID NO: 15002 - RNA, 21 nt, Homo sapiens
ugcaggaccaagaugagcccu

SEQ ID NO: 15003 - RNA, 23 nt, Homo sapiens
uggaguccaggaaucugcauuuu

SEQ ID NO: 15004 - RNA, 18 nt, Homo sapiens
acguuggcucugguggug

SEQ ID NO: 15005 - RNA, 19 nt, Homo sapiens
gaugaugcugcugaugcug

SEQ ID NO: 15006 - RNA, 21 nt, Homo sapiens
ucgaggagcucacagucuagu

SEQ ID NO: 15007 - RNA, 23 nt, Homo sapiens
ucccccaggugugauucugauuu

SEQ ID NO: 15008 - RNA, 22 nt, Homo sapiens
auucugcauuuuuagcaaguuc

SEQ ID NO: 15009 - RNA, 24 nt, Homo sapiens
acugggggcuuucgggcucugcgu

SEQ ID NO: 15010 - RNA, 23 nt, Homo sapiens
uggugcggagagggcccacagug

SEQ ID NO: 15011 - RNA, 21 nt, Homo sapiens
ucacuccucuccucccgucuu

SEQ ID NO: 15012 - RNA, 23 nt, Homo sapiens
aaaagugcuuacagugcagguag

SEQ ID NO: 15013 - RNA, 17 nt, Homo sapiens
gugggggagaggcuguc

SEQ ID NO: 15014 - RNA, 17 nt, Homo sapiens
gugggggagaggcuguc

SEQ ID NO: 15015 - RNA, 23 nt, Homo sapiens
ucuggcuccgugucuucacuccc

SEQ ID NO: 15016 - RNA, 21 nt, Homo sapiens
uccugcgcgucccagaugccc

SEQ ID NO: 15017 - RNA, 22 nt, Homo sapiens
ucugcccccuccgcugcugcca

SEQ ID NO: 15018 - RNA, 22 nt, Homo sapiens
uguaacagcaacuccaugugga

SEQ ID NO: 15019 - RNA, 22 nt, Homo sapiens
uguaacagcaacuccaugugga

SEQ ID NO: 15020 - RNA, 22 nt, Homo sapiens
aagcugccaguugaagaacugu

SEQ ID NO: 15021 - RNA, 20 nt, Homo sapiens
acugccccaggugcugcugg

SEQ ID NO: 15022 - RNA, 20 nt, Homo sapiens
ccucugggcccuuccuccag

SEQ ID NO: 15023 - RNA, 22 nt, Homo sapiens
ucucugggccugugucuuaggc

SEQ ID NO: 15024 - RNA, 22 nt, Homo sapiens
gcugacuccuaguccagggcuc

SEQ ID NO: 15025 - RNA, 22 nt, Homo sapiens
uggcagugucuuagcugguugu

SEQ ID NO: 15026 - RNA, 22 nt, Homo sapiens
caaucacuaacuccacugccau

SEQ ID NO: 15027 - RNA, 23 nt, Homo sapiens
aggcaguguaguuagcugauugc

SEQ ID NO: 15028 - RNA, 21 nt, Homo sapiens
acuggacuuggagucagaagg

SEQ ID NO: 15029 - RNA, 23 nt, Homo sapiens
ugaggggcagagagcgagacuuu

SEQ ID NO: 15030 - RNA, 22 nt, Homo sapiens
uggcaguguauuguuagcuggu

SEQ ID NO: 15031 - RNA, 22 nt, Homo sapiens
aggcaguguauuguuagcuggc

SEQ ID NO: 15032 - RNA, 21 nt, Homo sapiens
cggggcagcucaguacaggau

SEQ ID NO: 15033 - RNA, 19 nt, Homo sapiens
ucuaggcugguacugcuga

SEQ ID NO: 15034 - RNA, 22 nt, Homo sapiens
ugugcgcagggagaccucuccc

SEQ ID NO: 15035 - RNA, 24 nt, Homo sapiens
uggggagcugaggcucugggggug

SEQ ID NO: 15036 - RNA, 18 nt, Homo sapiens
ucagcuggcccucauuuc

SEQ ID NO: 15037 - RNA, 22 nt, Homo sapiens
ugagccccugugccgcccccag

SEQ ID NO: 15038 - RNA, 22 nt, Homo sapiens
uggaauguaaggaagugugugg

SEQ ID NO: 15039 - RNA, 17 nt, Homo sapiens
ucccaccgcugccaccc

SEQ ID NO: 15040 - RNA, 23 nt, Homo sapiens
ucccuguccuccaggagcucacg

SEQ ID NO: 15041 - RNA, 22 nt, Homo sapiens
uggcagugucuuagcugguugu

SEQ ID NO: 15042 - RNA, 23 nt, Homo sapiens
uggaagacuagugauuuuguugu

SEQ ID NO: 15043 - RNA, 20 nt, Homo sapiens
ggggagcuguggaagcagua

SEQ ID NO: 15044 - RNA, 22 nt, Homo sapiens
uaacacugucugguaaagaugg

SEQ ID NO: 15045 - RNA, 23 nt, Homo sapiens
guccaguuuucccaggaaucccu

SEQ ID NO: 15046 - RNA, 23 nt, Homo sapiens
uaaagugcuuauagugcagguag

SEQ ID NO: 15047 - RNA, 24 nt, Homo sapiens
agcagaagcagggagguucuccca

SEQ ID NO: 15048 - RNA, 22 nt, Homo sapiens
uccagcaucagugauuuuguug

SEQ ID NO: 15049 - RNA, 22 nt, Homo sapiens
agaucgaccguguuauauucgc

SEQ ID NO: 15050 - RNA, 22 nt, Homo sapiens
aagacgggaggaaagaagggag

SEQ ID NO: 15051 - RNA, 22 nt, Homo sapiens
auucugcauuuuuagcaaguuc

SEQ ID NO: 15052 - RNA, 21 nt, Homo sapiens
acagucugcugagguuggagc

SEQ ID NO: 15053 - RNA, 22 nt, Homo sapiens
aagugcuuccuuuuagaggguu

SEQ ID NO: 15054 - RNA, 22 nt, Homo sapiens
uggagugugacaaugguguuug

SEQ ID NO: 15055 - RNA, 22 nt, Homo sapiens
acucggcguggcgucggucgug

SEQ ID NO: 15056 - RNA, 22 nt, Homo sapiens
cucggcgcggggcgcgggcucc

SEQ ID NO: 15057 - RNA, 22 nt, Homo sapiens
uggagagaaaggcaguuccuga

SEQ ID NO: 15058 - RNA, 22 nt, Homo sapiens
cauugcacuugucucggucuga

SEQ ID NO: 15059 - RNA, 19 nt, Homo sapiens
aggcugcggaauucaggac

SEQ ID NO: 15060 - RNA, 25 nt, Homo sapiens
ggcggagggaaguagguccguuggu

SEQ ID NO: 15061 - RNA, 22 nt, Homo sapiens
aggcggggcgccgcgggaccgc

SEQ ID NO: 15062 - RNA, 21 nt, Homo sapiens
gugccagcugcagugggggag

SEQ ID NO: 15063 - RNA, 21 nt, Homo sapiens
cccggagccaggaugcagcuc

SEQ ID NO: 15064 - RNA, 22 nt, Homo sapiens
uggcagugucuuagcugguugu

SEQ ID NO: 15065 - RNA, 22 nt, Homo sapiens
cgucaacacuugcugguuuccu

SEQ ID NO: 15066 - RNA, 22 nt, Homo sapiens
acucggcguggcgucggucgug

SEQ ID NO: 15067 - RNA, 21 nt, Homo sapiens
uccugcgcgucccagaugccc

SEQ ID NO: 15068 - RNA, 22 nt, Homo sapiens
ucaggccaggcacaguggcuca

SEQ ID NO: 15069 - RNA, 23 nt, Homo sapiens
cgcauccccuagggcauuggugu

SEQ ID NO: 15070 - RNA, 23 nt, Homo sapiens
ucaagagcaauaacgaaaaaugu

SEQ ID NO: 15071 - RNA, 22 nt, Homo sapiens
uuuugcaauauguuccugaaua

SEQ ID NO: 15072 - RNA, 21 nt, Homo sapiens
cagcagcacacugugguuugu

SEQ ID NO: 15073 - RNA, 22 nt, Homo sapiens
cgaaaacagcaauuaccuuugc

SEQ ID NO: 15074 - RNA, 25 nt, Homo sapiens
agggaucgcgggcggguggcggccu

SEQ ID NO: 15075 - RNA, 19 nt, Homo sapiens
aguguggcuuucuuagagc

SEQ ID NO: 15076 - RNA, 22 nt, Homo sapiens
uggugguuuacaaaguaauuca

SEQ ID NO: 15077 - RNA, 22 nt, Homo sapiens
ugugcgcagggagaccucuccc

SEQ ID NO: 15078 - RNA, 23 nt, Homo sapiens
ucuggcuccgugucuucacuccc

SEQ ID NO: 15079 - RNA, 21 nt, Homo sapiens
cggcggggacggcgauugguc

SEQ ID NO: 15080 - RNA, 23 nt, Homo sapiens
caaagugcucauagugcagguag

SEQ ID NO: 15081 - RNA, 22 nt, Homo sapiens
aaggagcucacagucuauugag

SEQ ID NO: 15082 - RNA, 23 nt, Homo sapiens
ucccccaggugugauucugauuu

SEQ ID NO: 15083 - RNA, 19 nt, Homo sapiens
aggcugcggaauucaggac

SEQ ID NO: 15084 - RNA, 20 nt, Homo sapiens
accaggaggcugaggccccu

SEQ ID NO: 15085 - RNA, 23 nt, Homo sapiens
aaggagcuuacaaucuagcuggg

SEQ ID NO: 15086 - RNA, 22 nt, Homo sapiens
ugcggggcuagggcuaacagca

SEQ ID NO: 15087 - RNA, 17 nt, Homo sapiens
gugggggagaggcuguc

SEQ ID NO: 15088 - RNA, 23 nt, Homo sapiens
uggaguccaggaaucugcauuuu

SEQ ID NO: 15089 - RNA, 18 nt, Homo sapiens
uugagaaggaggcugcug

SEQ ID NO: 15090 - RNA, 23 nt, Homo sapiens
ucuggcuccgugucuucacuccc

SEQ ID NO: 15091 - RNA, 22 nt, Homo sapiens
uagcagcacauaaugguuugug

SEQ ID NO: 15092 - RNA, 22 nt, Homo sapiens
uggagagaaaggcaguuccuga

SEQ ID NO: 15093 - RNA, 21 nt, Homo sapiens
cggcggggacggcgauugguc

SEQ ID NO: 15094 - RNA, 23 nt, Homo sapiens
ugaggggcagagagcgagacuuu

SEQ ID NO: 15095 - RNA, 22 nt, Homo sapiens
aggcggggcgccgcgggaccgc

SEQ ID NO: 15096 - RNA, 24 nt, Homo sapiens
uggggagcugaggcucugggggug

SEQ ID NO: 15097 - RNA, 23 nt, Homo sapiens
ucuuggaguaggucauugggugg

SEQ ID NO: 15098 - RNA, 22 nt, Homo sapiens
gaaagcgcuucccuuugcugga

SEQ ID NO: 15099 - RNA, 22 nt, Homo sapiens
caaagcgcuccccuuuagaggu

SEQ ID NO: 15100 - RNA, 23 nt, Homo sapiens
caaagcgcuucucuuuagagugu

SEQ ID NO: 15101 - RNA, 21 nt, Homo sapiens
caaagcgcuucccuuuggagc

SEQ ID NO: 15102 - RNA, 21 nt, Homo sapiens
gaaagcgcuucucuuuagagg

SEQ ID NO: 15103 - RNA, 22 nt, Homo sapiens
ugagaaccacgucugcucugag

SEQ ID NO: 15104 - RNA, 21 nt, Homo sapiens
cgcgggugcuuacugacccuu

SEQ ID NO: 15105 - RNA, 20 nt, Homo sapiens
ggggagcuguggaagcagua

SEQ ID NO: 15106 - RNA, 21 nt, Homo sapiens
uaggacacauggucuacuucu

SEQ ID NO: 15107 - RNA, 21 nt, Homo sapiens
gugccagcugcagugggggag

SEQ ID NO: 15108 - RNA, 21 nt, Homo sapiens
agagaagaagaucagccugca

SEQ ID NO: 15109 - RNA, 24 nt, Homo sapiens
ucccugagacccuuuaaccuguga

SEQ ID NO: 15110 - RNA, 22 nt, Homo sapiens
ucccugagacccuaacuuguga

SEQ ID NO: 15111 - RNA, 23 nt, Homo sapiens
ccucagggcuguagaacagggcu

SEQ ID NO: 15112 - RNA, 18 nt, Homo sapiens
acguuggcucugguggug

SEQ ID NO: 15113 - RNA, 22 nt, Homo sapiens
ugauauguuugauauauuaggu

SEQ ID NO: 15114 - RNA, 22 nt, Homo sapiens
uggcucaguucagcaggaacag

SEQ ID NO: 15115 - RNA, 22 nt, Homo sapiens
uguaaacauccuacacucagcu

SEQ ID NO: 15116 - RNA, 20 nt, Homo sapiens
ccucugggcccuuccuccag

SEQ ID NO: 15117 - RNA, 22 nt, Homo sapiens
ucucugggccugugucuuaggc

SEQ ID NO: 15118 - RNA, 20 nt, Homo sapiens
uaaggcacgcggugaaugcc

SEQ ID NO: 15119 - RNA, 22 nt, Homo sapiens
cucuagagggaagcacuuucug

SEQ ID NO: 15120 - RNA, 21 nt, Homo sapiens
aaagcgcuucccuucagagug

SEQ ID NO: 15121 - RNA, 21 nt, Homo sapiens
gaaagcgcuucucuuuagagg

SEQ ID NO: 15122 - RNA, 22 nt, Homo sapiens
aaagugcauccuuuuagagugu

SEQ ID NO: 15123 - RNA, 22 nt, Homo sapiens
cucuagagggaagcgcuuucug

SEQ ID NO: 15124 - RNA, 22 nt, Homo sapiens
cucuagagggaagcgcuuucug

SEQ ID NO: 15125 - RNA, 22 nt, Homo sapiens
cucuagagggaagcacuuucug

SEQ ID NO: 15126 - RNA, 22 nt, Homo sapiens
aaaaugguucccuuuagagugu

SEQ ID NO: 15127 - RNA, 23 nt, Homo sapiens
gaacgcgcuucccuauagagggu

SEQ ID NO: 15128 - RNA, 22 nt, Homo sapiens
cucuagagggaagcacuuucug

SEQ ID NO: 15129 - RNA, 21 nt, Homo sapiens
ucccacguuguggcccagcag

SEQ ID NO: 15130 - RNA, 22 nt, Homo sapiens
ucuucucuguuuuggccaugug

SEQ ID NO: 15131 - RNA, 21 nt, Homo sapiens
uccuucugcuccgucccccag

SEQ ID NO: 15132 - RNA, 21 nt, Homo sapiens
gugccagcugcagugggggag

SEQ ID NO: 15133 - RNA, 22 nt, Homo sapiens
ucugggcaacaaagugagaccu

SEQ ID NO: 15134 - RNA, 21 nt, Homo sapiens
uggacugcccugaucuggaga

SEQ ID NO: 15135 - RNA, 18 nt, Homo sapiens
cagggaggugaaugugau

SEQ ID NO: 15136 - RNA, 23 nt, Homo sapiens
ucuggcuccgugucuucacuccc

SEQ ID NO: 15137 - RNA, 22 nt, Homo sapiens
uggagagaaaggcaguuccuga

SEQ ID NO: 15138 - RNA, 22 nt, Homo sapiens
ucugcccccuccgcugcugcca

SEQ ID NO: 15139 - RNA, 23 nt, Homo sapiens
caacggaaucccaaaagcagcug

SEQ ID NO: 15140 - RNA, 22 nt, Homo sapiens
uucccuuugucauccuaugccu

SEQ ID NO: 15141 - RNA, 22 nt, Homo sapiens
uucccuuugucauccuucgccu

SEQ ID NO: 15142 - RNA, 22 nt, Homo sapiens
uguaaacauccuacacucagcu

SEQ ID NO: 15143 - RNA, 20 nt, Homo sapiens
acugccccaggugcugcugg

SEQ ID NO: 15144 - RNA, 22 nt, Homo sapiens
uccagcaucagugauuuuguug

SEQ ID NO: 15145 - RNA, 21 nt, Homo sapiens
aggggugcuaucugugauuga

SEQ ID NO: 15146 - RNA, 22 nt, Homo sapiens
uuaucagaaucuccagggguac

SEQ ID NO: 15147 - RNA, 21 nt, Homo sapiens
cggggcagcucaguacaggau

SEQ ID NO: 15148 - RNA, 22 nt, Homo sapiens
aaugcacccgggcaaggauucu

SEQ ID NO: 15149 - RNA, 22 nt, Homo sapiens
aaugcaccugggcaaggauuca

SEQ ID NO: 15150 - RNA, 21 nt, Homo sapiens
aagccugcccggcuccucggg

SEQ ID NO: 15151 - RNA, 25 nt, Homo sapiens
gcugggcagggcuucugagcuccuu

SEQ ID NO: 15152 - RNA, 20 nt, Homo sapiens
ggggagcuguggaagcagua

SEQ ID NO: 15153 - RNA, 22 nt, Homo sapiens
uucacaaggaggugucauuuau

SEQ ID NO: 15154 - RNA, 20 nt, Homo sapiens
ggggagcuguggaagcagua

SEQ ID NO: 15155 - RNA, 21 nt, Homo sapiens
gugccagcugcagugggggag

SEQ ID NO: 15156 - RNA, 22 nt, Homo sapiens
acgcccuucccccccuucuuca

SEQ ID NO: 15157 - RNA, 18 nt, Homo sapiens
cgggcguggugguggggg

SEQ ID NO: 15158 - RNA, 24 nt, Homo sapiens
uggcccugacugaagaccagcagu

SEQ ID NO: 15159 - RNA, 22 nt, Homo sapiens
ucgugucuuguguugcagccgg

SEQ ID NO: 15160 - RNA, 22 nt, Homo sapiens
cauugcacuugucucggucuga

SEQ ID NO: 15161 - RNA, 21 nt, Homo sapiens
uucaaguaauucaggauaggu

SEQ ID NO: 15162 - RNA, 22 nt, Homo sapiens
cuggcccucucugcccuuccgu

SEQ ID NO: 15163 - RNA, 22 nt, Homo sapiens
ucaggcucaguccccucccgau

SEQ ID NO: 15164 - RNA, 22 nt, Homo sapiens
agaggcuggccgugaugaauuc

SEQ ID NO: 15165 - RNA, 22 nt, Homo sapiens
aucuggagguaagaagcacuuu

SEQ ID NO: 15166 - RNA, 23 nt, Homo sapiens
uauucauuuauccccagccuaca

SEQ ID NO: 15167 - RNA, 22 nt, Homo sapiens
aggcagcgggguguaguggaua

SEQ ID NO: 15168 - RNA, 23 nt, Homo sapiens
cgggucggaguuagcucaagcgg

SEQ ID NO: 15169 - RNA, 18 nt, Homo sapiens
cagggaggugaaugugau

SEQ ID NO: 15170 - RNA, 21 nt, Homo sapiens
gcccuccgcccgugcaccccg

SEQ ID NO: 15171 - RNA, 23 nt, Homo sapiens
ucuggcuccgugucuucacuccc

SEQ ID NO: 15172 - RNA, 22 nt, Homo sapiens
aauugcacgguauccaucugua

SEQ ID NO: 15173 - RNA, 20 nt, Homo sapiens
guccgcucggcgguggccca

SEQ ID NO: 15174 - RNA, 21 nt, Homo sapiens
agggggaaaguucuauagucc

SEQ ID NO: 15175 - RNA, 22 nt, Homo sapiens
gucccucuccaaaugugucuug

SEQ ID NO: 15176 - RNA, 21 nt, Homo sapiens
uggaggagaaggaaggugaug

SEQ ID NO: 15177 - RNA, 21 nt, Homo sapiens
cgcgggugcuuacugacccuu

SEQ ID NO: 15178 - RNA, 22 nt, Homo sapiens
ugagguaguaguuugugcuguu

SEQ ID NO: 15179 - RNA, 24 nt, Homo sapiens
uggcccugacugaagaccagcagu

SEQ ID NO: 15180 - RNA, 22 nt, Homo sapiens
ucgugucuuguguugcagccgg

SEQ ID NO: 15181 - RNA, 20 nt, Homo sapiens
ccccagggcgacgcggcggg

SEQ ID NO: 15182 - RNA, 22 nt, Homo sapiens
aacuggccuacaaagucccagu

SEQ ID NO: 15183 - RNA, 22 nt, Homo sapiens
aacuggcccucaaagucccgcu

SEQ ID NO: 15184 - RNA, 22 nt, Homo sapiens
cuggcccucucugcccuuccgu

SEQ ID NO: 15185 - RNA, 21 nt, Homo sapiens
gaacggcuucauacaggaguu

SEQ ID NO: 15186 - RNA, 19 nt, Homo sapiens
aagugugcagggcacuggu

SEQ ID NO: 15187 - RNA, 22 nt, Homo sapiens
ugugcgcagggagaccucuccc

SEQ ID NO: 15188 - RNA, 21 nt, Homo sapiens
gugccagcugcagugggggag

SEQ ID NO: 15189 - RNA, 21 nt, Homo sapiens
cccggagccaggaugcagcuc

SEQ ID NO: 15190 - RNA, 20 nt, Homo sapiens
ccccagggcgacgcggcggg

SEQ ID NO: 15191 - RNA, 21 nt, Homo sapiens
ugacaacuauggaugagcucu

SEQ ID NO: 15192 - RNA, 18 nt, Homo sapiens
ugcuuccuuucagagggu

SEQ ID NO: 15193 - RNA, 22 nt, Homo sapiens
aucuggagguaagaagcacuuu

SEQ ID NO: 15194 - RNA, 25 nt, Homo sapiens
ggcggagggaaguagguccguuggu

SEQ ID NO: 15195 - RNA, 22 nt, Homo sapiens
ugcggggcuagggcuaacagca

SEQ ID NO: 15196 - RNA, 22 nt, Homo sapiens
auccgcgcucugacucucugcc

SEQ ID NO: 15197 - RNA, 22 nt, Homo sapiens
uggagugugacaaugguguuug

SEQ ID NO: 15198 - RNA, 20 nt, Homo sapiens
uaaggcacgcggugaaugcc

SEQ ID NO: 15199 - RNA, 22 nt, Homo sapiens
uaacagucuacagccauggucg

SEQ ID NO: 15200 - RNA, 22 nt, Homo sapiens
ucgugucuuguguugcagccgg

SEQ ID NO: 15201 - RNA, 21 nt, Homo sapiens
uaacagucuccagucacggcc

SEQ ID NO: 15202 - RNA, 23 nt, Homo sapiens
gaagugcuucgauuuuggggugu

SEQ ID NO: 15203 - RNA, 22 nt, Homo sapiens
aacuguuugcagaggaaacuga

SEQ ID NO: 15204 - RNA, 21 nt, Homo sapiens
uaaggcacccuucugaguaga

SEQ ID NO: 15205 - RNA, 21 nt, Homo sapiens
gugucuuuugcucugcaguca

SEQ ID NO: 15206 - RNA, 24 nt, Homo sapiens
uucuccaaaagaaagcacuuucug

SEQ ID NO: 15207 - RNA, 22 nt, Homo sapiens
aagugccuccuuuuagaguguu

SEQ ID NO: 15208 - RNA, 22 nt, Homo sapiens
caaaaguaauuguggauuuugu

SEQ ID NO: 15209 - RNA, 22 nt, Homo sapiens
agucauuggaggguuugagcag

SEQ ID NO: 15210 - RNA, 22 nt, Homo sapiens
ccucuuccccuugucucuccag

SEQ ID NO: 15211 - RNA, 23 nt, Homo sapiens
ucuggcuccgugucuucacuccc

SEQ ID NO: 15212 - RNA, 23 nt, Homo sapiens
gaagugcuucgauuuuggggugu

SEQ ID NO: 15213 - RNA, 22 nt, Homo sapiens
uccuguacugagcugccccgag

SEQ ID NO: 15214 - RNA, 24 nt, Homo sapiens
uucuccaaaagaaagcacuuucug

SEQ ID NO: 15215 - RNA, 22 nt, Homo sapiens
aagugccuccuuuuagaguguu

SEQ ID NO: 15216 - RNA, 22 nt, Homo sapiens
agucauuggaggguuugagcag

SEQ ID NO: 15217 - RNA, 22 nt, Homo sapiens
gucccucuccaaaugugucuug

SEQ ID NO: 15218 - RNA, 21 nt, Homo sapiens
aaggcagggcccccgcucccc

SEQ ID NO: 15219 - RNA, 22 nt, Homo sapiens
uagcagcacauaaugguuugug

SEQ ID NO: 15220 - RNA, 22 nt, Homo sapiens
uagcagcacaucaugguuuaca

SEQ ID NO: 15221 - RNA, 22 nt, Homo sapiens
uagcagcacguaaauauuggcg

SEQ ID NO: 15222 - RNA, 21 nt, Homo sapiens
uagcagcacagaaauauuggc

SEQ ID NO: 15223 - RNA, 22 nt, Homo sapiens
ugguuuaccgucccacauacau

SEQ ID NO: 15224 - RNA, 22 nt, Homo sapiens
cagcagcaauucauguuuugaa

SEQ ID NO: 15225 - RNA, 21 nt, Homo sapiens
cagcagcacacugugguuugu

SEQ ID NO: 15226 - RNA, 23 nt, Homo sapiens
uagcagcgggaacaguucugcag

SEQ ID NO: 15227 - RNA, 22 nt, Homo sapiens
aggcagcgggguguaguggaua

SEQ ID NO: 15228 - RNA, 22 nt, Homo sapiens
uuuccggcucgcgugggugugu

SEQ ID NO: 15229 - RNA, 17 nt, Homo sapiens
gugggggagaggcuguc

SEQ ID NO: 15230 - RNA, 21 nt, Homo sapiens
ucgaggagcucacagucuagu

SEQ ID NO: 15231 - RNA, 21 nt, Homo sapiens
cucccacaugcaggguuugca

SEQ ID NO: 15232 - RNA, 23 nt, Homo sapiens
agcuacauugucugcuggguuuc

SEQ ID NO: 15233 - RNA, 23 nt, Homo sapiens
ucccccaggugugauucugauuu

SEQ ID NO: 15234 - RNA, 23 nt, Homo sapiens
uaauccuugcuaccugggugaga

SEQ ID NO: 15235 - RNA, 23 nt, Homo sapiens
uaauccuugcuaccugggugaga

SEQ ID NO: 15236 - RNA, 22 nt, Homo sapiens
aaugcacccgggcaaggauucu

SEQ ID NO: 15237 - RNA, 22 nt, Homo sapiens
aaugcaccugggcaaggauuca

SEQ ID NO: 15238 - RNA, 21 nt, Homo sapiens
aacaggugacugguuagacaa

SEQ ID NO: 15239 - RNA, 21 nt, Homo sapiens
agggggaaaguucuauagucc

SEQ ID NO: 15240 - RNA, 24 nt, Homo sapiens
acugggggcuuucgggcucugcgu

SEQ ID NO: 15241 - RNA, 19 nt, Homo sapiens
aguguggcuuucuuagagc

SEQ ID NO: 15242 - RNA, 22 nt, Homo sapiens
acgcccuucccccccuucuuca

SEQ ID NO: 15243 - RNA, 17 nt, Homo sapiens
ucgccuccuccucuccc

SEQ ID NO: 15244 - RNA, 23 nt, Homo sapiens
uggaguccaggaaucugcauuuu

SEQ ID NO: 15245 - RNA, 22 nt, Homo sapiens
ugagaacugaauuccauggguu

SEQ ID NO: 15246 - RNA, 22 nt, Homo sapiens
ugagaacugaauuccauaggcu

SEQ ID NO: 15247 - RNA, 21 nt, Homo sapiens
uccugcgcgucccagaugccc

SEQ ID NO: 15248 - RNA, 22 nt, Homo sapiens
uggagagaaaggcaguuccuga

SEQ ID NO: 15249 - RNA, 21 nt, Homo sapiens
cggcggggacggcgauugguc

SEQ ID NO: 15250 - RNA, 20 nt, Homo sapiens
ccuccugcccuccuugcugu

SEQ ID NO: 15251 - RNA, 20 nt, Homo sapiens
ccucugggcccuuccuccag

SEQ ID NO: 15252 - RNA, 22 nt, Homo sapiens
ucucugggccugugucuuaggc

SEQ ID NO: 15253 - RNA, 25 nt, Homo sapiens
aggggugguguugggacagcuccgu

SEQ ID NO: 15254 - RNA, 22 nt, Homo sapiens
aggcggggcgccgcgggaccgc

SEQ ID NO: 15255 - RNA, 22 nt, Homo sapiens
ugcggggcuagggcuaacagca

SEQ ID NO: 15256 - RNA, 20 nt, Homo sapiens
cggcucugggucugugggga

SEQ ID NO: 15257 - RNA, 20 nt, Homo sapiens
ggggagcuguggaagcagua

SEQ ID NO: 15258 - RNA, 23 nt, Homo sapiens
uacccuguagauccgaauuugug

SEQ ID NO: 15259 - RNA, 23 nt, Homo sapiens
uacccuguagaaccgaauuugug

SEQ ID NO: 15260 - RNA, 23 nt, Homo sapiens
gagggucuugggagggaugugac

SEQ ID NO: 15261 - RNA, 22 nt, Homo sapiens
ucugggcaacaaagugagaccu

SEQ ID NO: 15262 - RNA, 22 nt, Homo sapiens
uuuagagacggggucuugcucu

SEQ ID NO: 15263 - RNA, 22 nt, Homo sapiens
cagugcaaugaugaaagggcau

SEQ ID NO: 15264 - RNA, 24 nt, Homo sapiens
ccagacagaauucuaugcacuuuc

SEQ ID NO: 15265 - RNA, 22 nt, Homo sapiens
uagguaguuucauguuguuggg

SEQ ID NO: 15266 - RNA, 23 nt, Homo sapiens
ucccuguccuccaggagcucacg

SEQ ID NO: 15267 - RNA, 22 nt, Homo sapiens
aauugcacuuuagcaaugguga

SEQ ID NO: 15268 - RNA, 22 nt, Homo sapiens
agacccuggucugcacucuauc

SEQ ID NO: 15269 - RNA, 22 nt, Homo sapiens
ggagaaauuauccuuggugugu

SEQ ID NO: 15270 - RNA, 22 nt, Homo sapiens
aaaaguaauugcgaguuuuacc

SEQ ID NO: 15271 - RNA, 22 nt, Homo sapiens
aaaaguaauugugguuuuggcc

SEQ ID NO: 15272 - RNA, 22 nt, Homo sapiens
aaaaguaauugcgguuuuugcc

SEQ ID NO: 15273 - RNA, 22 nt, Homo sapiens
aaaaguaauugugguuuuugcc

SEQ ID NO: 15274 - RNA, 22 nt, Homo sapiens
aaaaguaaucgcgguuuuuguc

SEQ ID NO: 15275 - RNA, 22 nt, Homo sapiens
aaaaguaauugcggauuuugcc

SEQ ID NO: 15276 - RNA, 22 nt, Homo sapiens
aaaaguaauugcggucuuuggu

SEQ ID NO: 15277 - RNA, 22 nt, Homo sapiens
caaaaguaauuguggauuuugu

SEQ ID NO: 15278 - RNA, 21 nt, Homo sapiens
uaaaguaaauaugcaccaaaa

SEQ ID NO: 15279 - RNA, 25 nt, Homo sapiens
gcugggcagggcuucugagcuccuu

SEQ ID NO: 15280 - RNA, 19 nt, Homo sapiens
gugucugcuuccuguggga

SEQ ID NO: 15281 - RNA, 22 nt, Homo sapiens
ugcggggcuagggcuaacagca

SEQ ID NO: 15282 - RNA, 22 nt, Homo sapiens
ucggccugaccacccaccccac

SEQ ID NO: 15283 - RNA, 20 nt, Homo sapiens
uaaggcacgcggugaaugcc

SEQ ID NO: 15284 - RNA, 23 nt, Homo sapiens
caacggaaucccaaaagcagcug

SEQ ID NO: 15285 - RNA, 22 nt, Homo sapiens
uucaccaccuucuccacccagc

SEQ ID NO: 15286 - RNA, 23 nt, Homo sapiens
ugugcaaaucuaugcaaaacuga

SEQ ID NO: 15287 - RNA, 22 nt, Homo sapiens
aacaauauccuggugcugagug

SEQ ID NO: 15288 - RNA, 22 nt, Homo sapiens
agagguaguagguugcauaguu

SEQ ID NO: 15289 - RNA, 21 nt, Homo sapiens
ccaccaccgugucugacacuu

SEQ ID NO: 15290 - RNA, 22 nt, Homo sapiens
ugucaguuugucaaauacccca

SEQ ID NO: 15291 - RNA, 21 nt, Homo sapiens
uugaaaggcuauuucuugguc

SEQ ID NO: 15292 - RNA, 21 nt, Homo sapiens
uaaggcacccuucugaguaga

SEQ ID NO: 15293 - RNA, 23 nt, Homo sapiens
uucauuugguauaaaccgcgauu

SEQ ID NO: 15294 - RNA, 22 nt, Homo sapiens
uggagugugacaaugguguuug

SEQ ID NO: 15295 - RNA, 22 nt, Homo sapiens
augggugaauuuguagaaggau

SEQ ID NO: 15296 - RNA, 22 nt, Homo sapiens
uuugguccccuucaaccagcug

SEQ ID NO: 15297 - RNA, 22 nt, Homo sapiens
uuugguccccuucaaccagcua

SEQ ID NO: 15298 - RNA, 23 nt, Homo sapiens
cggcccgggcugcugcuguuccu

SEQ ID NO: 15299 - RNA, 21 nt, Homo sapiens
cggcggggacggcgauugguc

SEQ ID NO: 15300 - RNA, 22 nt, Homo sapiens
uacccagagcaugcagugugaa

SEQ ID NO: 15301 - RNA, 21 nt, Homo sapiens
agggcccccccucaauccugu

SEQ ID NO: 15302 - RNA, 22 nt, Homo sapiens
uggugggcacagaaucuggacu

SEQ ID NO: 15303 - RNA, 25 nt, Homo sapiens
aggggugguguugggacagcuccgu

SEQ ID NO: 15304 - RNA, 22 nt, Homo sapiens
uggugggccgcagaacaugugc

SEQ ID NO: 15305 - RNA, 22 nt, Homo sapiens
aggcggggcgccgcgggaccgc

SEQ ID NO: 15306 - RNA, 23 nt, Homo sapiens
uggugcggagagggcccacagug

SEQ ID NO: 15307 - RNA, 23 nt, Homo sapiens
ccugcagcgacuugauggcuucc

SEQ ID NO: 15308 - RNA, 20 nt, Homo sapiens
ucugcaggguuugcuuugag

SEQ ID NO: 15309 - RNA, 21 nt, Homo sapiens
agugaaugauggguucugacc

SEQ ID NO: 15310 - RNA, 24 nt, Homo sapiens
uggcccugacugaagaccagcagu

SEQ ID NO: 15311 - RNA, 18 nt, Homo sapiens
acguuggcucugguggug

SEQ ID NO: 15312 - RNA, 24 nt, Homo sapiens
uuuggcaaugguagaacucacacu

SEQ ID NO: 15313 - RNA, 20 nt, Homo sapiens
ccccagggcgacgcggcggg

SEQ ID NO: 15314 - RNA, 20 nt, Homo sapiens
ccccagggcgacgcggcggg

SEQ ID NO: 15315 - RNA, 20 nt, Homo sapiens
ccuccugcccuccuugcugu

SEQ ID NO: 15316 - RNA, 21 nt, Homo sapiens
gccccugggccuauccuagaa

SEQ ID NO: 15317 - RNA, 22 nt, Homo sapiens
cgucaacacuugcugguuuccu

SEQ ID NO: 15318 - RNA, 23 nt, Homo sapiens
uggugcggagagggcccacagug

SEQ ID NO: 15319 - RNA, 22 nt, Homo sapiens
ugcggggcuagggcuaacagca

SEQ ID NO: 15320 - RNA, 21 nt, Homo sapiens
cccggagccaggaugcagcuc

SEQ ID NO: 15321 - RNA, 21 nt, Homo sapiens
cccggagccaggaugcagcuc

SEQ ID NO: 15322 - RNA, 21 nt, Homo sapiens
ucguggccuggucuccauuau

SEQ ID NO: 15323 - RNA, 18 nt, Homo sapiens
ucagcuggcccucauuuc

SEQ ID NO: 15324 - RNA, 18 nt, Homo sapiens
cgggcguggugguggggg

SEQ ID NO: 15325 - RNA, 21 nt, Homo sapiens
gcccuccgcccgugcaccccg

SEQ ID NO: 15326 - RNA, 25 nt, Homo sapiens
cccccacaaccgcgcuugacuagcu

SEQ ID NO: 15327 - RNA, 20 nt, Homo sapiens
ccuccugcccuccuugcugu

SEQ ID NO: 15328 - RNA, 22 nt, Homo sapiens
cauugcacuugucucggucuga

SEQ ID NO: 15329 - RNA, 25 nt, Homo sapiens
ggcggagggaaguagguccguuggu

SEQ ID NO: 15330 - RNA, 22 nt, Homo sapiens
acccgucccguucguccccgga

SEQ ID NO: 15331 - RNA, 27 nt, Homo sapiens
accuucuuguauaagcacugugcuaaa

SEQ ID NO: 15332 - RNA, 21 nt, Homo sapiens
agagaagaagaucagccugca

SEQ ID NO: 15333 - RNA, 21 nt, Homo sapiens
agugaaugauggguucugacc

SEQ ID NO: 15334 - RNA, 22 nt, Homo sapiens
cagugcaaugaugaaagggcau

SEQ ID NO: 15335 - RNA, 22 nt, Homo sapiens
uggagagaaaggcaguuccuga

SEQ ID NO: 15336 - RNA, 22 nt, Homo sapiens
ucuucucuguuuuggccaugug

SEQ ID NO: 15337 - RNA, 20 nt, Homo sapiens
ugagcccuguccucccgcag

SEQ ID NO: 15338 - RNA, 18 nt, Homo sapiens
gucccuguucaggcgcca

SEQ ID NO: 15339 - RNA, 21 nt, Homo sapiens
cuuuuugcggucugggcuugc

SEQ ID NO: 15340 - RNA, 22 nt, Homo sapiens
gccugcugggguggaaccuggu

SEQ ID NO: 15341 - RNA, 23 nt, Homo sapiens
aggaccugcgggacaagauucuu

SEQ ID NO: 15342 - RNA, 22 nt, Homo sapiens
ugugacagauugauaacugaaa

SEQ ID NO: 15343 - RNA, 22 nt, Homo sapiens
caaaaaccacaguuucuuuugc

SEQ ID NO: 15344 - RNA, 22 nt, Homo sapiens
uccgagccugggucucccucuu

SEQ ID NO: 15345 - RNA, 23 nt, Homo sapiens
ugucacucggcucggcccacuac

SEQ ID NO: 15346 - RNA, 22 nt, Homo sapiens
aggcagcgggguguaguggaua

SEQ ID NO: 15347 - RNA, 23 nt, Homo sapiens
ccaguuaccgcuuccgcuaccgc

SEQ ID NO: 15348 - RNA, 21 nt, Homo sapiens
ccccaccuccucucuccucag

SEQ ID NO: 15349 - RNA, 18 nt, Homo sapiens
aucccaccucugccacca

SEQ ID NO: 15350 - RNA, 23 nt, Homo sapiens
ucuggcuccgugucuucacuccc

SEQ ID NO: 15351 - RNA, 22 nt, Homo sapiens
uggagagaaaggcaguuccuga

SEQ ID NO: 15352 - RNA, 22 nt, Homo sapiens
uucccuuugucauccuaugccu

SEQ ID NO: 15353 - RNA, 22 nt, Homo sapiens
uucccuuugucauccuucgccu

SEQ ID NO: 15354 - RNA, 22 nt, Homo sapiens
aagcugccaguugaagaacugu

SEQ ID NO: 15355 - RNA, 21 nt, Homo sapiens
uaaagugcugacagugcagau

SEQ ID NO: 15356 - RNA, 23 nt, Homo sapiens
cagugcaaugauauugucaaagc

SEQ ID NO: 15357 - RNA, 22 nt, Homo sapiens
cgucaacacuugcugguuuccu

SEQ ID NO: 15358 - RNA, 22 nt, Homo sapiens
ccucccacacccaaggcuugca

SEQ ID NO: 15359 - RNA, 19 nt, Homo sapiens
gagccaguuggacaggagc

SEQ ID NO: 15360 - RNA, 21 nt, Homo sapiens
ucccacguuguggcccagcag

SEQ ID NO: 15361 - RNA, 21 nt, Homo sapiens
uggaggagaaggaaggugaug

SEQ ID NO: 15362 - RNA, 22 nt, Homo sapiens
cacuggcuccuuucuggguaga

SEQ ID NO: 15363 - RNA, 22 nt, Homo sapiens
uuuccggcucgcgugggugugu

SEQ ID NO: 15364 - RNA, 18 nt, Homo sapiens
ucagcuggcccucauuuc

SEQ ID NO: 15365 - RNA, 20 nt, Homo sapiens
ugagcccuguccucccgcag

SEQ ID NO: 15366 - RNA, 24 nt, Homo sapiens
agccuggaagcuggagccugcagu

SEQ ID NO: 15367 - RNA, 18 nt, Homo sapiens
cgggcguggugguggggg

SEQ ID NO: 15368 - RNA, 23 nt, Homo sapiens
cuggagauauggaagagcugugu

SEQ ID NO: 15369 - RNA, 22 nt, Homo sapiens
cagugcaaugaugaaagggcau

SEQ ID NO: 15370 - RNA, 21 nt, Homo sapiens
uccugcgcgucccagaugccc

SEQ ID NO: 15371 - RNA, 21 nt, Homo sapiens
cggcggggacggcgauugguc

SEQ ID NO: 15372 - RNA, 19 nt, Homo sapiens
gggcgccugugaucccaac

SEQ ID NO: 15373 - RNA, 19 nt, Homo sapiens
gggcgccugugaucccaac

SEQ ID NO: 15374 - RNA, 20 nt, Homo sapiens
auggagauagauauagaaau

SEQ ID NO: 15375 - RNA, 22 nt, Homo sapiens
aggcggggcgccgcgggaccgc

SEQ ID NO: 15376 - RNA, 22 nt, Homo sapiens
ugcggggcuagggcuaacagca

SEQ ID NO: 15377 - RNA, 21 nt, Homo sapiens
uugcucacuguucuucccuag

SEQ ID NO: 15378 - RNA, 20 nt, Homo sapiens
ugagcccuguccucccgcag

SEQ ID NO: 15379 - RNA, 21 nt, Homo sapiens
uugggacauacuuaugcuaaa

SEQ ID NO: 15380 - RNA, 22 nt, Homo sapiens
uggagagaaaggcaguuccuga

SEQ ID NO: 15381 - RNA, 20 nt, Homo sapiens
ccccagggcgacgcggcggg

SEQ ID NO: 15382 - RNA, 20 nt, Homo sapiens
ccuccugcccuccuugcugu

SEQ ID NO: 15383 - RNA, 23 nt, Homo sapiens
cccaguguucagacuaccuguuc

SEQ ID NO: 15384 - RNA, 23 nt, Homo sapiens
cccaguguuuagacuaucuguuc

SEQ ID NO: 15385 - RNA, 23 nt, Homo sapiens
ugugcaaaucuaugcaaaacuga

SEQ ID NO: 15386 - RNA, 23 nt, Homo sapiens
ugugcaaauccaugcaaaacuga

SEQ ID NO: 15387 - RNA, 21 nt, Homo sapiens
agggcccccccucaauccugu

SEQ ID NO: 15388 - RNA, 21 nt, Homo sapiens
gccccugggccuauccuagaa

SEQ ID NO: 15389 - RNA, 23 nt, Homo sapiens
ucucacacagaaaucgcacccgu

SEQ ID NO: 15390 - RNA, 22 nt, Homo sapiens
aucacacaaaggcaacuuuugu

SEQ ID NO: 15391 - RNA, 21 nt, Homo sapiens
uuuugcaccuuuuggagugaa

SEQ ID NO: 15392 - RNA, 23 nt, Homo sapiens
guuugcacgggugggccuugucu

SEQ ID NO: 15393 - RNA, 20 nt, Homo sapiens
guagaggagauggcgcaggg

SEQ ID NO: 15394 - RNA, 20 nt, Homo sapiens
ggggagcuguggaagcagua

SEQ ID NO: 15395 - RNA, 22 nt, Homo sapiens
ugcccuuaaaggugaacccagu

SEQ ID NO: 15396 - RNA, 22 nt, Homo sapiens
acccgucccguucguccccgga

SEQ ID NO: 15397 - RNA, 24 nt, Homo sapiens
ucccugagacccuuuaaccuguga

SEQ ID NO: 15398 - RNA, 22 nt, Homo sapiens
ucccugagacccuaacuuguga

SEQ ID NO: 15399 - RNA, 18 nt, Homo sapiens
aucccaccucugccacca

SEQ ID NO: 15400 - RNA, 23 nt, Homo sapiens
ccucagggcuguagaacagggcu

SEQ ID NO: 15401 - RNA, 17 nt, Homo sapiens
ucccuguucgggcgcca

SEQ ID NO: 15402 - RNA, 18 nt, Homo sapiens
gcaugggugguucagugg

SEQ ID NO: 15403 - RNA, 23 nt, Homo sapiens
ucuggcuccgugucuucacuccc

SEQ ID NO: 15404 - RNA, 22 nt, Homo sapiens
ucugcccccuccgcugcugcca

SEQ ID NO: 15405 - RNA, 22 nt, Homo sapiens
cccugugcccggcccacuucug

SEQ ID NO: 15406 - RNA, 23 nt, Homo sapiens
ugugcaaaucuaugcaaaacuga

SEQ ID NO: 15407 - RNA, 22 nt, Homo sapiens
aacaauauccuggugcugagug

SEQ ID NO: 15408 - RNA, 22 nt, Homo sapiens
agagguaguagguugcauaguu

SEQ ID NO: 15409 - RNA, 20 nt, Homo sapiens
acugccccaggugcugcugg

SEQ ID NO: 15410 - RNA, 22 nt, Homo sapiens
caaucacuaacuccacugccau

SEQ ID NO: 15411 - RNA, 22 nt, Homo sapiens
uggcaguguauuguuagcuggu

SEQ ID NO: 15412 - RNA, 22 nt, Homo sapiens
aggcaguguauuguuagcuggc

SEQ ID NO: 15413 - RNA, 21 nt, Homo sapiens
cagcagcacacugugguuugu

SEQ ID NO: 15414 - RNA, 25 nt, Homo sapiens
aggggugguguugggacagcuccgu

SEQ ID NO: 15415 - RNA, 20 nt, Homo sapiens
accaggaggcugaggccccu

SEQ ID NO: 15416 - RNA, 22 nt, Homo sapiens
uggugguuuacaaaguaauuca

SEQ ID NO: 15417 - RNA, 22 nt, Homo sapiens
uauugcacucgucccggccucc

SEQ ID NO: 15418 - RNA, 24 nt, Homo sapiens
uggggagcugaggcucugggggug

SEQ ID NO: 15419 - RNA, 22 nt, Homo sapiens
uggagugugacaaugguguuug

SEQ ID NO: 15420 - RNA, 22 nt, Homo sapiens
acccgucccguucguccccgga

SEQ ID NO: 15421 - RNA, 20 nt, Homo sapiens
uacaguauagaugauguacu

SEQ ID NO: 15422 - RNA, 22 nt, Homo sapiens
ucagugcacuacagaacuuugu

SEQ ID NO: 15423 - RNA, 22 nt, Homo sapiens
ucagugcaucacagaacuuugu

SEQ ID NO: 15424 - RNA, 21 nt, Homo sapiens
ucagugcaugacagaacuugg

SEQ ID NO: 15425 - RNA, 22 nt, Homo sapiens
aucgugcauccuuuuagagugu

SEQ ID NO: 15426 - RNA, 23 nt, Homo sapiens
ugugcaaaucuaugcaaaacuga

SEQ ID NO: 15427 - RNA, 23 nt, Homo sapiens
ugugcaaauccaugcaaaacuga

SEQ ID NO: 15428 - RNA, 22 nt, Homo sapiens
uaauacugccugguaaugauga

SEQ ID NO: 15429 - RNA, 23 nt, Homo sapiens
uaauacugccggguaaugaugga

SEQ ID NO: 15430 - RNA, 22 nt, Homo sapiens
uaauacugucugguaaaaccgu

SEQ ID NO: 15431 - RNA, 21 nt, Homo sapiens
uuuugcaccuuuuggagugaa

SEQ ID NO: 15432 - RNA, 23 nt, Homo sapiens
guuugcacgggugggccuugucu

SEQ ID NO: 15433 - RNA, 23 nt, Homo sapiens
uaaaucccauggugccuucuccu

SEQ ID NO: 15434 - RNA, 25 nt, Homo sapiens
ggcggagggaaguagguccguuggu

SEQ ID NO: 15435 - RNA, 22 nt, Homo sapiens
ugcggggcuagggcuaacagca

SEQ ID NO: 15436 - RNA, 22 nt, Homo sapiens
uauugcacucgucccggccucc

SEQ ID NO: 15437 - RNA, 22 nt, Homo sapiens
ugugcgcagggagaccucuccc

SEQ ID NO: 15438 - RNA, 20 nt, Homo sapiens
gugucugggcggacagcugc

SEQ ID NO: 15439 - RNA, 24 nt, Homo sapiens
agccuggaagcuggagccugcagu

SEQ ID NO: 15440 - RNA, 24 nt, Homo sapiens
ccagacagaauucuaugcacuuuc

SEQ ID NO: 15441 - RNA, 19 nt, Homo sapiens
gagccaguuggacaggagc

SEQ ID NO: 15442 - RNA, 19 nt, Homo sapiens
agcugucugaaaaugucuu

SEQ ID NO: 15443 - RNA, 21 nt, Homo sapiens
cgcgggugcuuacugacccuu

SEQ ID NO: 15444 - RNA, 22 nt, Homo sapiens
cacuggcuccuuucuggguaga

SEQ ID NO: 15445 - RNA, 21 nt, Homo sapiens
uugcucacuguucuucccuag

SEQ ID NO: 15446 - RNA, 22 nt, Homo sapiens
cuccugagccauucugagccuc

SEQ ID NO: 15447 - RNA, 22 nt, Homo sapiens
uggagugugacaaugguguuug

SEQ ID NO: 15448 - RNA, 22 nt, Homo sapiens
ucucccaacccuuguaccagug

SEQ ID NO: 15449 - RNA, 21 nt, Homo sapiens
cggcggggacggcgauugguc

SEQ ID NO: 15450 - RNA, 22 nt, Homo sapiens
acacagggcuguugugaagacu

SEQ ID NO: 15451 - RNA, 22 nt, Homo sapiens
uacucaggagaguggcaaucac

SEQ ID NO: 15452 - RNA, 18 nt, Homo sapiens
uucacagggaggugucau

SEQ ID NO: 15453 - RNA, 22 nt, Homo sapiens
aggcggggcgccgcgggaccgc

SEQ ID NO: 15454 - RNA, 22 nt, Homo sapiens
ugcggggcuagggcuaacagca

SEQ ID NO: 15455 - RNA, 23 nt, Homo sapiens
ucugcucauaccccaugguuucu

SEQ ID NO: 15456 - RNA, 22 nt, Homo sapiens
ugcaacuuaccugagucauuga

SEQ ID NO: 15457 - RNA, 17 nt, Homo sapiens
ucgccuccuccucuccc

SEQ ID NO: 15458 - RNA, 19 nt, Homo sapiens
ugucucugcugggguuucu

SEQ ID NO: 15459 - RNA, 25 nt, Homo sapiens
ggcggagggaaguagguccguuggu

SEQ ID NO: 15460 - RNA, 22 nt, Homo sapiens
ugugcgcagggagaccucuccc

SEQ ID NO: 15461 - RNA, 22 nt, Homo sapiens
uggagugugacaaugguguuug

SEQ ID NO: 15462 - RNA, 22 nt, Homo sapiens
uggagugugacaaugguguuug

SEQ ID NO: 15463 - RNA, 21 nt, Homo sapiens
uggacugcccugaucuggaga

SEQ ID NO: 15464 - RNA, 22 nt, Homo sapiens
acucggcguggcgucggucgug

SEQ ID NO: 15465 - RNA, 21 nt, Homo sapiens
cggcggggacggcgauugguc

SEQ ID NO: 15466 - RNA, 22 nt, Homo sapiens
aaggagcucacagucuauugag

SEQ ID NO: 15467 - RNA, 22 nt, Homo sapiens
cuggcccucucugcccuuccgu

SEQ ID NO: 15468 - RNA, 22 nt, Homo sapiens
ucaggcucaguccccucccgau

SEQ ID NO: 15469 - RNA, 19 nt, Homo sapiens
aggcugcggaauucaggac

SEQ ID NO: 15470 - RNA, 22 nt, Homo sapiens
aggcggggcgccgcgggaccgc

SEQ ID NO: 15471 - RNA, 23 nt, Homo sapiens
aaggagcuuacaaucuagcuggg

SEQ ID NO: 15472 - RNA, 22 nt, Homo sapiens
ugcggggcuagggcuaacagca

SEQ ID NO: 15473 - RNA, 27 nt, Homo sapiens
accuucuuguauaagcacugugcuaaa

SEQ ID NO: 15474 - RNA, 22 nt, Homo sapiens
cucuagagggaagcacuuucug

SEQ ID NO: 15475 - RNA, 18 nt, Homo sapiens
ugaggcaguagauugaau

SEQ ID NO: 15476 - RNA, 22 nt, Homo sapiens
uggagagaaaggcaguuccuga

SEQ ID NO: 15477 - RNA, 22 nt, Homo sapiens
aacuggcccucaaagucccgcu

SEQ ID NO: 15478 - RNA, 22 nt, Homo sapiens
gaggguuggguggaggcucucc

SEQ ID NO: 15479 - RNA, 22 nt, Homo sapiens
uguaaacauccuacacucagcu

SEQ ID NO: 15480 - RNA, 23 nt, Homo sapiens
ucaagagcaauaacgaaaaaugu

SEQ ID NO: 15481 - RNA, 22 nt, Homo sapiens
ucagcaaacauuuauugugugc

SEQ ID NO: 15482 - RNA, 21 nt, Homo sapiens
aggaggcagcgcucucaggac

SEQ ID NO: 15483 - RNA, 22 nt, Homo sapiens
caaagugccucccuuuagagug

SEQ ID NO: 15484 - RNA, 21 nt, Homo sapiens
aaggcagggcccccgcucccc

SEQ ID NO: 15485 - RNA, 21 nt, Homo sapiens
cccggagccaggaugcagcuc

SEQ ID NO: 15486 - RNA, 18 nt, Homo sapiens
ucagcuggcccucauuuc

SEQ ID NO: 15487 - RNA, 17 nt, Homo sapiens
ucgccuccuccucuccc

SEQ ID NO: 15488 - RNA, 23 nt, Homo sapiens
uggaguccaggaaucugcauuuu

SEQ ID NO: 15489 - RNA, 23 nt, Homo sapiens
ucuggcuccgugucuucacuccc

SEQ ID NO: 15490 - RNA, 22 nt, Homo sapiens
uggagagaaaggcaguuccuga

SEQ ID NO: 15491 - RNA, 22 nt, Homo sapiens
uccgagccugggucucccucuu

SEQ ID NO: 15492 - RNA, 21 nt, Homo sapiens
agaccuggcccagaccucagc

SEQ ID NO: 15493 - RNA, 25 nt, Homo sapiens
ggcggagggaaguagguccguuggu

SEQ ID NO: 15494 - RNA, 23 nt, Homo sapiens
gagggucuugggagggaugugac

SEQ ID NO: 15495 - RNA, 22 nt, Homo sapiens
uaguacugugcauaucaucuau

SEQ ID NO: 15496 - RNA, 22 nt, Homo sapiens
uucuggaauucugugugaggga

SEQ ID NO: 15497 - RNA, 19 nt, Homo sapiens
uggauuuuuggaucaggga

SEQ ID NO: 15498 - RNA, 22 nt, Homo sapiens
aagcccuuaccccaaaaagcau

SEQ ID NO: 15499 - RNA, 22 nt, Homo sapiens
uagcagcacaucaugguuuaca

SEQ ID NO: 15500 - RNA, 22 nt, Homo sapiens
aaaaguacuugcggauuuugcu

SEQ ID NO: 15501 - RNA, 21 nt, Homo sapiens
uacuuggaaaggcaucaguug

SEQ ID NO: 15502 - RNA, 20 nt, Homo sapiens
ccccagggcgacgcggcggg

SEQ ID NO: 15503 - RNA, 23 nt, Homo sapiens
gaagugcuucgauuuuggggugu

SEQ ID NO: 15504 - RNA, 21 nt, Homo sapiens
aaaacggugagauuuuguuuu

SEQ ID NO: 15505 - RNA, 20 nt, Homo sapiens
guccgcucggcgguggccca

SEQ ID NO: 15506 - RNA, 22 nt, Homo sapiens
agucauuggaggguuugagcag

SEQ ID NO: 15507 - RNA, 25 nt, Homo sapiens
ggcggagggaaguagguccguuggu

SEQ ID NO: 15508 - RNA, 21 nt, Homo sapiens
uggaggagaaggaaggugaug

SEQ ID NO: 15509 - RNA, 22 nt, Homo sapiens
aggcagcgggguguaguggaua

SEQ ID NO: 15510 - RNA, 18 nt, Homo sapiens
ucagcuggcccucauuuc

SEQ ID NO: 15511 - RNA, 17 nt, Homo sapiens
gugggggagaggcuguc

SEQ ID NO: 15512 - RNA, 22 nt, Homo sapiens
acucggcguggcgucggucgug

SEQ ID NO: 15513 - RNA, 17 nt, Homo sapiens
uaauugcuuccauguuu

SEQ ID NO: 15514 - RNA, 23 nt, Homo sapiens
ucccccaggugugauucugauuu

SEQ ID NO: 15515 - RNA, 22 nt, Homo sapiens
aauugcacuuuagcaaugguga

SEQ ID NO: 15516 - RNA, 22 nt, Homo sapiens
uggugggcacagaaucuggacu

SEQ ID NO: 15517 - RNA, 24 nt, Homo sapiens
acugggggcuuucgggcucugcgu

SEQ ID NO: 15518 - RNA, 22 nt, Homo sapiens
uggugggccgcagaacaugugc

SEQ ID NO: 15519 - RNA, 22 nt, Homo sapiens
caaagaauucuccuuuugggcu

SEQ ID NO: 15520 - RNA, 21 nt, Homo sapiens
auguaugugugcaugugcaug

SEQ ID NO: 15521 - RNA, 21 nt, Homo sapiens
gugcauuguaguugcauugca

SEQ ID NO: 15522 - RNA, 23 nt, Homo sapiens
aguauguucuuccaggacagaac

SEQ ID NO: 15523 - RNA, 21 nt, Homo sapiens
agggggaaaguucuauagucc

SEQ ID NO: 15524 - RNA, 21 nt, Homo sapiens
ccccaccuccucucuccucag

SEQ ID NO: 15525 - RNA, 24 nt, Homo sapiens
ucccugagacccuuuaaccuguga

SEQ ID NO: 15526 - RNA, 22 nt, Homo sapiens
ucccugagacccuaacuuguga

SEQ ID NO: 15527 - RNA, 18 nt, Homo sapiens
aucccaccucugccacca

SEQ ID NO: 15528 - RNA, 23 nt, Homo sapiens
ccucagggcuguagaacagggcu

SEQ ID NO: 15529 - RNA, 17 nt, Homo sapiens
ucgccuccuccucuccc

SEQ ID NO: 15530 - RNA, 22 nt, Homo sapiens
uguaacagcaacuccaugugga

SEQ ID NO: 15531 - RNA, 22 nt, Homo sapiens
uggcucaguucagcaggaacag

SEQ ID NO: 15532 - RNA, 22 nt, Homo sapiens
uucacaaggaggugucauuuau

SEQ ID NO: 15533 - RNA, 19 nt, Homo sapiens
ugggcguaucuguaugcua

SEQ ID NO: 15534 - RNA, 21 nt, Homo sapiens
uggaggagaaggaaggugaug

SEQ ID NO: 15535 - RNA, 22 nt, Homo sapiens
acuccagccccacagccucagc

SEQ ID NO: 15536 - RNA, 22 nt, Homo sapiens
uuugguccccuucaaccagcug

SEQ ID NO: 15537 - RNA, 19 nt, Homo sapiens
auggauaaggcuuuggcuu

SEQ ID NO: 15538 - RNA, 19 nt, Homo sapiens
uggauuuuuggaucaggga

SEQ ID NO: 15539 - RNA, 23 nt, Homo sapiens
uaaaucccauggugccuucuccu

SEQ ID NO: 15540 - RNA, 20 nt, Homo sapiens
agaccauggguucucauugu

SEQ ID NO: 15541 - RNA, 22 nt, Homo sapiens
uggagugugacaaugguguuug

SEQ ID NO: 15542 - RNA, 21 nt, Homo sapiens
cccggagccaggaugcagcuc

SEQ ID NO: 15543 - RNA, 22 nt, Homo sapiens
uggagugugacaaugguguuug

SEQ ID NO: 15544 - RNA, 22 nt, Homo sapiens
uggguggucuggagauuugugc

SEQ ID NO: 15545 - RNA, 22 nt, Homo sapiens
aggugguccguggcgcguucgc

SEQ ID NO: 15546 - RNA, 25 nt, Homo sapiens
ggcggagggaaguagguccguuggu

SEQ ID NO: 15547 - RNA, 24 nt, Homo sapiens
ugccugggucucuggccugcgcgu

SEQ ID NO: 15548 - RNA, 22 nt, Homo sapiens
aggcggggcgccgcgggaccgc

SEQ ID NO: 15549 - RNA, 24 nt, Homo sapiens
ucccugagacccuuuaaccuguga

SEQ ID NO: 15550 - RNA, 22 nt, Homo sapiens
ucccugagacccuaacuuguga

SEQ ID NO: 15551 - RNA, 22 nt, Homo sapiens
uggaauguaaggaagugugugg

SEQ ID NO: 15552 - RNA, 23 nt, Homo sapiens
ccucagggcuguagaacagggcu

SEQ ID NO: 15553 - RNA, 18 nt, Homo sapiens
gucccuguucaggcgcca

SEQ ID NO: 15554 - RNA, 22 nt, Homo sapiens
ucugggcaacaaagugagaccu

SEQ ID NO: 15555 - RNA, 22 nt, Homo sapiens
ugauauguuugauauauuaggu

SEQ ID NO: 15556 - RNA, 23 nt, Homo sapiens
ucccuguccuccaggagcucacg

SEQ ID NO: 15557 - RNA, 22 nt, Homo sapiens
agaucagaaggugauuguggcu

SEQ ID NO: 15558 - RNA, 23 nt, Homo sapiens
aggaccugcgggacaagauucuu

SEQ ID NO: 15559 - RNA, 21 nt, Homo sapiens
aguuaaugaauccuggaaagu

SEQ ID NO: 15560 - RNA, 25 nt, Homo sapiens
gcugggcagggcuucugagcuccuu

SEQ ID NO: 15561 - RNA, 22 nt, Homo sapiens
gguggcccggccgugccugagg

SEQ ID NO: 15562 - RNA, 22 nt, Homo sapiens
ugcaacgaaccugagccacuga

SEQ ID NO: 15563 - RNA, 22 nt, Homo sapiens
ugagguaguagguuguaugguu

SEQ ID NO: 15564 - RNA, 22 nt, Homo sapiens
ucugggcaacaaagugagaccu

SEQ ID NO: 15565 - RNA, 22 nt, Homo sapiens
cgcaggggccgggugcucaccg

SEQ ID NO: 15566 - RNA, 22 nt, Homo sapiens
ucugcccccuccgcugcugcca

SEQ ID NO: 15567 - RNA, 22 nt, Homo sapiens
ucaggccaggcacaguggcuca

SEQ ID NO: 15568 - RNA, 22 nt, Homo sapiens
acagcaggcacagacaggcagu

SEQ ID NO: 15569 - RNA, 22 nt, Homo sapiens
aagcugccaguugaagaacugu

SEQ ID NO: 15570 - RNA, 20 nt, Homo sapiens
acugccccaggugcugcugg

SEQ ID NO: 15571 - RNA, 22 nt, Homo sapiens
gccugcugggguggaaccuggu

SEQ ID NO: 15572 - RNA, 22 nt, Homo sapiens
ucaggcucaguccccucccgau

SEQ ID NO: 15573 - RNA, 25 nt, Homo sapiens
gcugggcagggcuucugagcuccuu

SEQ ID NO: 15574 - RNA, 24 nt, Homo sapiens
ugccugggucucuggccugcgcgu

SEQ ID NO: 15575 - RNA, 22 nt, Homo sapiens
acuccagccccacagccucagc

SEQ ID NO: 15576 - RNA, 20 nt, Homo sapiens
ucugcaggguuugcuuugag

SEQ ID NO: 15577 - RNA, 22 nt, Homo sapiens
ucaccagcccuguguucccuag

SEQ ID NO: 15578 - RNA, 22 nt, Homo sapiens
uggagugugacaaugguguuug

SEQ ID NO: 15579 - RNA, 21 nt, Homo sapiens
uccuucugcuccgucccccag

SEQ ID NO: 15580 - RNA, 23 nt, Homo sapiens
agcugguguugugaaucaggccg

SEQ ID NO: 15581 - RNA, 23 nt, Homo sapiens
caaagugcuuacagugcagguag

SEQ ID NO: 15582 - RNA, 22 nt, Homo sapiens
uggacggagaacugauaagggu

SEQ ID NO: 15583 - RNA, 21 nt, Homo sapiens
cggcggggacggcgauugguc

SEQ ID NO: 15584 - RNA, 21 nt, Homo sapiens
ccaccaccgugucugacacuu

SEQ ID NO: 15585 - RNA, 22 nt, Homo sapiens
cauugcacuugucucggucuga

SEQ ID NO: 15586 - RNA, 24 nt, Homo sapiens
agcagaagcagggagguucuccca

SEQ ID NO: 15587 - RNA, 22 nt, Homo sapiens
uacugcagacguggcaaucaug

SEQ ID NO: 15588 - RNA, 21 nt, Homo sapiens
uacugcagacaguggcaauca

SEQ ID NO: 15589 - RNA, 21 nt, Homo sapiens
aaagcgcuucccuucagagug

SEQ ID NO: 15590 - RNA, 22 nt, Homo sapiens
uggugggcacagaaucuggacu

SEQ ID NO: 15591 - RNA, 22 nt, Homo sapiens
auucugcauuuuuagcaaguuc

SEQ ID NO: 15592 - RNA, 22 nt, Homo sapiens
uggugggccgcagaacaugugc

SEQ ID NO: 15593 - RNA, 22 nt, Homo sapiens
aggcggggcgccgcgggaccgc

SEQ ID NO: 15594 - RNA, 22 nt, Homo sapiens
ugcggggcuagggcuaacagca

SEQ ID NO: 15595 - RNA, 21 nt, Homo sapiens
aaggcagggcccccgcucccc

SEQ ID NO: 15596 - RNA, 19 nt, Homo sapiens
aauggauuuuuggagcagg

SEQ ID NO: 15597 - RNA, 21 nt, Homo sapiens
aagugaucuaaaggccuacau

SEQ ID NO: 15598 - RNA, 22 nt, Homo sapiens
uugcauauguaggaugucccau

SEQ ID NO: 15599 - RNA, 23 nt, Homo sapiens
agugccugagggaguaagagccc

SEQ ID NO: 15600 - RNA, 17 nt, Homo sapiens
ucgccuccuccucuccc

SEQ ID NO: 15601 - RNA, 21 nt, Homo sapiens
gcccuccgcccgugcaccccg

SEQ ID NO: 15602 - RNA, 22 nt, Homo sapiens
gcccgcguguggagccaggugu

SEQ ID NO: 15603 - RNA, 22 nt, Homo sapiens
uggagagaaaggcaguuccuga

SEQ ID NO: 15604 - RNA, 21 nt, Homo sapiens
cggcggggacggcgauugguc

SEQ ID NO: 15605 - RNA, 23 nt, Homo sapiens
ugaggggcagagagcgagacuuu

SEQ ID NO: 15606 - RNA, 19 nt, Homo sapiens
aggcacggugucagcaggc

SEQ ID NO: 15607 - RNA, 25 nt, Homo sapiens
ggcggagggaaguagguccguuggu

SEQ ID NO: 15608 - RNA, 22 nt, Homo sapiens
aggcggggcgccgcgggaccgc

SEQ ID NO: 15609 - RNA, 22 nt, Homo sapiens
ugcggggcuagggcuaacagca

SEQ ID NO: 15610 - RNA, 21 nt, Homo sapiens
acucuagcugccaaaggcgcu

SEQ ID NO: 15611 - RNA, 23 nt, Homo sapiens
ucuggcuccgugucuucacuccc

SEQ ID NO: 15612 - RNA, 21 nt, Homo sapiens
uccugcgcgucccagaugccc

SEQ ID NO: 15613 - RNA, 22 nt, Homo sapiens
cgcaggggccgggugcucaccg

SEQ ID NO: 15614 - RNA, 23 nt, Homo sapiens
ugaguaccgccaugucuguuggg

SEQ ID NO: 15615 - RNA, 22 nt, Homo sapiens
ugaaggucuacugugugccagg

SEQ ID NO: 15616 - RNA, 22 nt, Homo sapiens
ugagaccucuggguucugagcu

SEQ ID NO: 15617 - RNA, 17 nt, Homo sapiens
ucgccuccuccucuccc

SEQ ID NO: 15618 - RNA, 23 nt, Homo sapiens
uggaguccaggaaucugcauuuu

SEQ ID NO: 15619 - RNA, 20 nt, Homo sapiens
ccuccugcccuccuugcugu

SEQ ID NO: 15620 - RNA, 22 nt, Homo sapiens
acagcaggcacagacaggcagu

SEQ ID NO: 15621 - RNA, 22 nt, Homo sapiens
gccugcugggguggaaccuggu

SEQ ID NO: 15622 - RNA, 22 nt, Homo sapiens
cgucaacacuugcugguuuccu

SEQ ID NO: 15623 - RNA, 21 nt, Homo sapiens
caaagguauuugugguuuuug

SEQ ID NO: 15624 - RNA, 22 nt, Homo sapiens
acuccagccccacagccucagc

SEQ ID NO: 15625 - RNA, 22 nt, Homo sapiens
uggagugugacaaugguguuug

SEQ ID NO: 15626 - RNA, 22 nt, Homo sapiens
acgcccuucccccccuucuuca

SEQ ID NO: 15627 - RNA, 22 nt, Homo sapiens
cuggacugagccgugcuacugg

SEQ ID NO: 15628 - RNA, 22 nt, Homo sapiens
cagugcaauguuaaaagggcau

SEQ ID NO: 15629 - RNA, 22 nt, Homo sapiens
cagugcaaugaugaaagggcau

SEQ ID NO: 15630 - RNA, 20 nt, Homo sapiens
ggggagcuguggaagcagua

SEQ ID NO: 15631 - RNA, 23 nt, Homo sapiens
guccaguuuucccaggaaucccu

SEQ ID NO: 15632 - RNA, 22 nt, Homo sapiens
ucagugcacuacagaacuuugu

SEQ ID NO: 15633 - RNA, 22 nt, Homo sapiens
ucagugcaucacagaacuuugu

SEQ ID NO: 15634 - RNA, 21 nt, Homo sapiens
ucagugcaugacagaacuugg

SEQ ID NO: 15635 - RNA, 18 nt, Homo sapiens
uccagugcccuccucucc

SEQ ID NO: 15636 - RNA, 23 nt, Homo sapiens
caacggaaucccaaaagcagcug

SEQ ID NO: 15637 - RNA, 21 nt, Homo sapiens
cugaccuaugaauugacagcc

SEQ ID NO: 15638 - RNA, 21 nt, Homo sapiens
augaccuaugaauugacagac

SEQ ID NO: 15639 - RNA, 22 nt, Homo sapiens
cauugcacuugucucggucuga

SEQ ID NO: 15640 - RNA, 23 nt, Homo sapiens
cagugcaauaguauugucaaagc

SEQ ID NO: 15641 - RNA, 23 nt, Homo sapiens
cagugcaaugauauugucaaagc

SEQ ID NO: 15642 - RNA, 22 nt, Homo sapiens
uauugcacauuacuaaguugca

SEQ ID NO: 15643 - RNA, 22 nt, Homo sapiens
aauugcacgguauccaucugua

SEQ ID NO: 15644 - RNA, 22 nt, Homo sapiens
aauugcacuuuagcaaugguga

SEQ ID NO: 15645 - RNA, 21 nt, Homo sapiens
acuggacuuggagucagaagg

SEQ ID NO: 15646 - RNA, 22 nt, Homo sapiens
acuggacuuagggucagaaggc

SEQ ID NO: 15647 - RNA, 23 nt, Homo sapiens
uagugcaauauugcuuauagggu

SEQ ID NO: 15648 - RNA, 21 nt, Homo sapiens
gcaguccaugggcauauacac

SEQ ID NO: 15649 - RNA, 21 nt, Homo sapiens
gaagugugccguggugugucu

SEQ ID NO: 15650 - RNA, 20 nt, Homo sapiens
aggguguuucucucaucucu

SEQ ID NO: 15651 - RNA, 25 nt, Homo sapiens
ggcggagggaaguagguccguuggu

SEQ ID NO: 15652 - RNA, 22 nt, Homo sapiens
uauugcacuugucccggccugu

SEQ ID NO: 15653 - RNA, 22 nt, Homo sapiens
uauugcacucgucccggccucc

SEQ ID NO: 15654 - RNA, 21 nt, Homo sapiens
agaccuggcccagaccucagc

SEQ ID NO: 15655 - RNA, 22 nt, Homo sapiens
ucggccugaccacccaccccac

SEQ ID NO: 15656 - RNA, 22 nt, Homo sapiens
uucuggaauucugugugaggga

SEQ ID NO: 15657 - RNA, 23 nt, Homo sapiens
caaagugcucauagugcagguag

SEQ ID NO: 15658 - RNA, 22 nt, Homo sapiens
cauugcacuugucucggucuga

SEQ ID NO: 15659 - RNA, 22 nt, Homo sapiens
ugguuuaccgucccacauacau

SEQ ID NO: 15660 - RNA, 23 nt, Homo sapiens
ugaggggcagagagcgagacuuu

SEQ ID NO: 15661 - RNA, 22 nt, Homo sapiens
cgucaacacuugcugguuuccu

SEQ ID NO: 15662 - RNA, 18 nt, Homo sapiens
ugcuuccuuucagagggu

SEQ ID NO: 15663 - RNA, 22 nt, Homo sapiens
aucuggagguaagaagcacuuu

SEQ ID NO: 15664 - RNA, 23 nt, Homo sapiens
caaagcgcuucucuuuagagugu

SEQ ID NO: 15665 - RNA, 21 nt, Homo sapiens
aaagcgcuucccuucagagug

SEQ ID NO: 15666 - RNA, 21 nt, Homo sapiens
cuccagagggaaguacuuucu

SEQ ID NO: 15667 - RNA, 21 nt, Homo sapiens
cuccagagggaugcacuuucu

SEQ ID NO: 15668 - RNA, 21 nt, Homo sapiens
ucgaggagcucacagucuagu

SEQ ID NO: 15669 - RNA, 22 nt, Homo sapiens
aagcugccaguugaagaacugu

SEQ ID NO: 15670 - RNA, 21 nt, Homo sapiens
ccaccaccgugucugacacuu

SEQ ID NO: 15671 - RNA, 21 nt, Homo sapiens
ucacuccucuccucccgucuu

SEQ ID NO: 15672 - RNA, 23 nt, Homo sapiens
uuuggcacuagcacauuuuugcu

SEQ ID NO: 15673 - RNA, 17 nt, Homo sapiens
ucgccuccuccucuccc

SEQ ID NO: 15674 - RNA, 21 nt, Homo sapiens
cggcggggacggcgauugguc

SEQ ID NO: 15675 - RNA, 23 nt, Homo sapiens
ucucacacagaaaucgcacccgu

SEQ ID NO: 15676 - RNA, 22 nt, Homo sapiens
gcugacuccuaguccagggcuc

SEQ ID NO: 15677 - RNA, 22 nt, Homo sapiens
agaucgaccguguuauauucgc

SEQ ID NO: 15678 - RNA, 23 nt, Homo sapiens
gacacgggcgacagcugcggccc

SEQ ID NO: 15679 - RNA, 25 nt, Homo sapiens
agggaucgcgggcggguggcggccu

SEQ ID NO: 15680 - RNA, 22 nt, Homo sapiens
aggcggggcgccgcgggaccgc

SEQ ID NO: 15681 - RNA, 23 nt, Homo sapiens
aggaagcccuggaggggcuggag

SEQ ID NO: 15682 - RNA, 22 nt, Homo sapiens
ugcggggcuagggcuaacagca

SEQ ID NO: 15683 - RNA, 22 nt, Homo sapiens
auccgcgcucugacucucugcc

SEQ ID NO: 15684 - RNA, 22 nt, Homo sapiens
aagugcugucauagcugagguc

SEQ ID NO: 15685 - RNA, 22 nt, Homo sapiens
uggagagaaaggcaguuccuga

SEQ ID NO: 15686 - RNA, 21 nt, Homo sapiens
cccggagccaggaugcagcuc

SEQ ID NO: 15687 - RNA, 22 nt, Homo sapiens
uggagugugacaaugguguuug

SEQ ID NO: 15688 - RNA, 22 nt, Homo sapiens
uggagugugacaaugguguuug

SEQ ID NO: 15689 - RNA, 21 nt, Homo sapiens
cggcggggacggcgauugguc

SEQ ID NO: 15690 - RNA, 21 nt, Homo sapiens
cggcggggacggcgauugguc

SEQ ID NO: 15691 - RNA, 23 nt, Homo sapiens
uaaaucccauggugccuucuccu

SEQ ID NO: 15692 - RNA, 21 nt, Homo sapiens
ucccacguuguggcccagcag

SEQ ID NO: 15693 - RNA, 22 nt, Homo sapiens
aggcggggcgccgcgggaccgc

SEQ ID NO: 15694 - RNA, 22 nt, Homo sapiens
aggcggggcgccgcgggaccgc

SEQ ID NO: 15695 - RNA, 22 nt, Homo sapiens
ugcggggcuagggcuaacagca

SEQ ID NO: 15696 - RNA, 23 nt, Homo sapiens
ccugcagcgacuugauggcuucc

SEQ ID NO: 15697 - RNA, 23 nt, Homo sapiens
ccugcagcgacuugauggcuucc

SEQ ID NO: 15698 - RNA, 24 nt, Homo sapiens
uugcagcugccugggagugacuuc

SEQ ID NO: 15699 - RNA, 21 nt, Homo sapiens
uccugcgcgucccagaugccc

SEQ ID NO: 15700 - RNA, 21 nt, Homo sapiens
cggcggggacggcgauugguc

SEQ ID NO: 15701 - RNA, 22 nt, Homo sapiens
ucugcccccuccgcugcugcca

SEQ ID NO: 15702 - RNA, 22 nt, Homo sapiens
aagcugccaguugaagaacugu

SEQ ID NO: 15703 - RNA, 22 nt, Homo sapiens
uguaaacauccuacacucagcu

SEQ ID NO: 15704 - RNA, 20 nt, Homo sapiens
acugccccaggugcugcugg

SEQ ID NO: 15705 - RNA, 23 nt, Homo sapiens
ugagcgccucgacgacagagccg

SEQ ID NO: 15706 - RNA, 21 nt, Homo sapiens
cggggcagcucaguacaggau

SEQ ID NO: 15707 - RNA, 21 nt, Homo sapiens
aagccugcccggcuccucggg

SEQ ID NO: 15708 - RNA, 22 nt, Homo sapiens
aggcggggcgccgcgggaccgc

SEQ ID NO: 15709 - RNA, 22 nt, Homo sapiens
ugcggggcuagggcuaacagca

SEQ ID NO: 15710 - RNA, 21 nt, Homo sapiens
uggaggagaaggaaggugaug

SEQ ID NO: 15711 - RNA, 22 nt, Homo sapiens
uauugcacucgucccggccucc

SEQ ID NO: 15712 - RNA, 17 nt, Homo sapiens
ucgccuccuccucuccc

SEQ ID NO: 15713 - RNA, 18 nt, Homo sapiens
cagggaggugaaugugau

SEQ ID NO: 15714 - RNA, 22 nt, Homo sapiens
uggagagaaaggcaguuccuga

SEQ ID NO: 15715 - RNA, 22 nt, Homo sapiens
uggagagaaaggcaguuccuga

SEQ ID NO: 15716 - RNA, 20 nt, Homo sapiens
ccuccugcccuccuugcugu

SEQ ID NO: 15717 - RNA, 22 nt, Homo sapiens
cauugcacuugucucggucuga

SEQ ID NO: 15718 - RNA, 22 nt, Homo sapiens
aaaagcuggguugagagggcga

SEQ ID NO: 15719 - RNA, 22 nt, Homo sapiens
aaaagcuggguugagagggcaa

SEQ ID NO: 15720 - RNA, 20 nt, Homo sapiens
aaaagcuggguugagagggu

SEQ ID NO: 15721 - RNA, 19 nt, Homo sapiens
aaaagcuggguugagagga

SEQ ID NO: 15722 - RNA, 22 nt, Homo sapiens
agaggcuggccgugaugaauuc

SEQ ID NO: 15723 - RNA, 22 nt, Homo sapiens
cgucaacacuugcugguuuccu

SEQ ID NO: 15724 - RNA, 25 nt, Homo sapiens
ggcggagggaaguagguccguuggu

SEQ ID NO: 15725 - RNA, 22 nt, Homo sapiens
ugcggggcuagggcuaacagca

SEQ ID NO: 15726 - RNA, 21 nt, Homo sapiens
uggaggagaaggaaggugaug

SEQ ID NO: 15727 - RNA, 22 nt, Homo sapiens
uggagugugacaaugguguuug

SEQ ID NO: 15728 - RNA, 21 nt, Homo sapiens
cggcggggacggcgauugguc

SEQ ID NO: 15729 - RNA, 22 nt, Homo sapiens
uguaacagcaacuccaugugga

SEQ ID NO: 15730 - RNA, 23 nt, Homo sapiens
ugguuguaguccgugcgagaaua

SEQ ID NO: 15731 - RNA, 22 nt, Homo sapiens
ugaaggucuacugugugccagg

SEQ ID NO: 15732 - RNA, 22 nt, Homo sapiens
ggagaaauuauccuuggugugu

SEQ ID NO: 15733 - RNA, 21 nt, Homo sapiens
gcgacccauacuugguuucag

SEQ ID NO: 15734 - RNA, 22 nt, Homo sapiens
aggcggggcgccgcgggaccgc

SEQ ID NO: 15735 - RNA, 20 nt, Homo sapiens
ggggagcuguggaagcagua

SEQ ID NO: 15736 - RNA, 24 nt, Homo sapiens
uggggagcugaggcucugggggug

SEQ ID NO: 15737 - RNA, 23 nt, Homo sapiens
uacccuguagaaccgaauuugug

SEQ ID NO: 15738 - RNA, 21 nt, Homo sapiens
aagcauucuuucauugguugg

SEQ ID NO: 15739 - RNA, 22 nt, Homo sapiens
ucagugcacuacagaacuuugu

SEQ ID NO: 15740 - RNA, 22 nt, Homo sapiens
ucagugcaucacagaacuuugu

SEQ ID NO: 15741 - RNA, 21 nt, Homo sapiens
ucagugcaugacagaacuugg

SEQ ID NO: 15742 - RNA, 22 nt, Homo sapiens
uggagagaaaggcaguuccuga

SEQ ID NO: 15743 - RNA, 21 nt, Homo sapiens
cggcggggacggcgauugguc

SEQ ID NO: 15744 - RNA, 19 nt, Homo sapiens
aggcugcggaauucaggac

SEQ ID NO: 15745 - RNA, 22 nt, Homo sapiens
aggcggggcgccgcgggaccgc

SEQ ID NO: 15746 - RNA, 22 nt, Homo sapiens
ugcggggcuagggcuaacagca

SEQ ID NO: 15747 - RNA, 21 nt, Homo sapiens
uggcagggaggcugggagggg

SEQ ID NO: 15748 - RNA, 23 nt, Homo sapiens
gcgaggaccccucggggucugac

SEQ ID NO: 15749 - RNA, 18 nt, Homo sapiens
aucccaccucugccacca

SEQ ID NO: 15750 - RNA, 19 nt, Homo sapiens
uggauuuuuggaucaggga

SEQ ID NO: 15751 - RNA, 23 nt, Homo sapiens
ucuggcuccgugucuucacuccc

SEQ ID NO: 15752 - RNA, 22 nt, Homo sapiens
caaaaaucucaauuacuuuugc

SEQ ID NO: 15753 - RNA, 21 nt, Homo sapiens
aggguaagcugaaccucugau

SEQ ID NO: 15754 - RNA, 25 nt, Homo sapiens
aggggugguguugggacagcuccgu

SEQ ID NO: 15755 - RNA, 21 nt, Homo sapiens
aaggcagggcccccgcucccc

SEQ ID NO: 15756 - RNA, 22 nt, Homo sapiens
uuuccggcucgcgugggugugu

SEQ ID NO: 15757 - RNA, 21 nt, Homo sapiens
ccgucgccgccacccgagccg

SEQ ID NO: 15758 - RNA, 21 nt, Homo sapiens
ucguggccuggucuccauuau

SEQ ID NO: 15759 - RNA, 19 nt, Homo sapiens
gugaggacucgggaggugg

SEQ ID NO: 15760 - RNA, 18 nt, Homo sapiens
cgggcguggugguggggg

SEQ ID NO: 15761 - RNA, 24 nt, Homo sapiens
uggcccugacugaagaccagcagu

SEQ ID NO: 15762 - RNA, 21 nt, Homo sapiens
gccccugggccuauccuagaa

SEQ ID NO: 15763 - RNA, 23 nt, Homo sapiens
acuugggcacugaaacaaugucc

SEQ ID NO: 15764 - RNA, 22 nt, Homo sapiens
gguggcccggccgugccugagg

SEQ ID NO: 15765 - RNA, 23 nt, Homo sapiens
aggaagcccuggaggggcuggag

SEQ ID NO: 15766 - RNA, 21 nt, Homo sapiens
uaaagugcugacagugcagau

SEQ ID NO: 15767 - RNA, 21 nt, Homo sapiens
cccggagccaggaugcagcuc

SEQ ID NO: 15768 - RNA, 22 nt, Homo sapiens
ucugggcaacaaagugagaccu

SEQ ID NO: 15769 - RNA, 21 nt, Homo sapiens
uccugcgcgucccagaugccc

SEQ ID NO: 15770 - RNA, 23 nt, Homo sapiens
uaauccuugcuaccugggugaga

SEQ ID NO: 15771 - RNA, 22 nt, Homo sapiens
cgucaacacuugcugguuuccu

SEQ ID NO: 15772 - RNA, 22 nt, Homo sapiens
auucugcauuuuuagcaaguuc

SEQ ID NO: 15773 - RNA, 22 nt, Homo sapiens
cgaaaacagcaauuaccuuugc

SEQ ID NO: 15774 - RNA, 25 nt, Homo sapiens
gcugggcagggcuucugagcuccuu

SEQ ID NO: 15775 - RNA, 23 nt, Homo sapiens
acuugggcacugaaacaaugucc

SEQ ID NO: 15776 - RNA, 23 nt, Homo sapiens
aggaagcccuggaggggcuggag

SEQ ID NO: 15777 - RNA, 22 nt, Homo sapiens
ugugcgcagggagaccucuccc

SEQ ID NO: 15778 - RNA, 17 nt, Homo sapiens
ucgccuccuccucuccc

SEQ ID NO: 15779 - RNA, 21 nt, Homo sapiens
ugcaggaccaagaugagcccu

SEQ ID NO: 15780 - RNA, 25 nt, Homo sapiens
ugggaacggguuccggcagacgcug

SEQ ID NO: 15781 - RNA, 21 nt, Homo sapiens
cggcggggacggcgauugguc

SEQ ID NO: 15782 - RNA, 25 nt, Homo sapiens
ggcggagggaaguagguccguuggu

SEQ ID NO: 15783 - RNA, 22 nt, Homo sapiens
aggcggggcgccgcgggaccgc

SEQ ID NO: 15784 - RNA, 20 nt, Homo sapiens
cggcucugggucugugggga

SEQ ID NO: 15785 - RNA, 21 nt, Homo sapiens
uggaggagaaggaaggugaug

SEQ ID NO: 15786 - RNA, 21 nt, Homo sapiens
ucguggccuggucuccauuau

SEQ ID NO: 15787 - RNA, 21 nt, Homo sapiens
gcccuccgcccgugcaccccg

SEQ ID NO: 15788 - RNA, 20 nt, Homo sapiens
ccuccugcccuccuugcugu

SEQ ID NO: 15789 - RNA, 23 nt, Homo sapiens
agcuacauugucugcuggguuuc

SEQ ID NO: 15790 - RNA, 21 nt, Homo sapiens
aucacauugccagggauuucc

SEQ ID NO: 15791 - RNA, 21 nt, Homo sapiens
aucacauugccagggauuacc

SEQ ID NO: 15792 - RNA, 22 nt, Homo sapiens
aauugcacgguauccaucugua

SEQ ID NO: 15793 - RNA, 23 nt, Homo sapiens
aggaccugcgggacaagauucuu

SEQ ID NO: 15794 - RNA, 21 nt, Homo sapiens
uuggccacaauggguuagaac

SEQ ID NO: 15795 - RNA, 21 nt, Homo sapiens
uuggccacaauggguuagaac

SEQ ID NO: 15796 - RNA, 25 nt, Homo sapiens
aggggugguguugggacagcuccgu

SEQ ID NO: 15797 - RNA, 21 nt, Homo sapiens
agaccuggcccagaccucagc

SEQ ID NO: 15798 - RNA, 20 nt, Homo sapiens
guagaggagauggcgcaggg

SEQ ID NO: 15799 - RNA, 21 nt, Homo sapiens
cacuguguccuuucugcguag

SEQ ID NO: 15800 - RNA, 23 nt, Homo sapiens
cacccggcugugugcacaugugc

SEQ ID NO: 15801 - RNA, 20 nt, Homo sapiens
ucugcaggguuugcuuugag

SEQ ID NO: 15802 - RNA, 20 nt, Homo sapiens
ucugcaggguuugcuuugag

SEQ ID NO: 15803 - RNA, 20 nt, Homo sapiens
cuuccucgucugucugcccc

SEQ ID NO: 15804 - RNA, 20 nt, Homo sapiens
uaaggcacgcggugaaugcc

SEQ ID NO: 15805 - RNA, 22 nt, Homo sapiens
uucaccaccuucuccacccagc

SEQ ID NO: 15806 - RNA, 21 nt, Homo sapiens
aggcaagaugcuggcauagcu

SEQ ID NO: 15807 - RNA, 22 nt, Homo sapiens
uaugugccuuuggacuacaucg

SEQ ID NO: 15808 - RNA, 21 nt, Homo sapiens
uaaggcacccuucugaguaga

SEQ ID NO: 15809 - RNA, 18 nt, Homo sapiens
ugcuuccuuucagagggu

SEQ ID NO: 15810 - RNA, 23 nt, Homo sapiens
uucucgaggaaagaagcacuuuc

SEQ ID NO: 15811 - RNA, 22 nt, Homo sapiens
aucuggagguaagaagcacuuu

SEQ ID NO: 15812 - RNA, 19 nt, Homo sapiens
ugagcugcuguaccaaaau

SEQ ID NO: 15813 - RNA, 21 nt, Homo sapiens
agaccuggcccagaccucagc

SEQ ID NO: 15814 - RNA, 19 nt, Homo sapiens
aagcagcugccucugaggc

SEQ ID NO: 15815 - RNA, 21 nt, Homo sapiens
uacucaaaaagcugucaguca

SEQ ID NO: 15816 - RNA, 21 nt, Homo sapiens
ccuggaaacacugagguugug

SEQ ID NO: 15817 - RNA, 18 nt, Homo sapiens
gcaugggugguucagugg

SEQ ID NO: 15818 - RNA, 22 nt, Homo sapiens
ucucccaacccuuguaccagug

SEQ ID NO: 15819 - RNA, 22 nt, Homo sapiens
uggagagaaaggcaguuccuga

SEQ ID NO: 15820 - RNA, 21 nt, Homo sapiens
ccaguccugugccugccgccu

SEQ ID NO: 15821 - RNA, 22 nt, Homo sapiens
uguaacagcaacuccaugugga

SEQ ID NO: 15822 - RNA, 22 nt, Homo sapiens
ugucaguuugucaaauacccca

SEQ ID NO: 15823 - RNA, 21 nt, Homo sapiens
uaaagugcugacagugcagau

SEQ ID NO: 15824 - RNA, 23 nt, Homo sapiens
cagugcaaugauauugucaaagc

SEQ ID NO: 15825 - RNA, 23 nt, Homo sapiens
uuucaagccagggggcguuuuuc

SEQ ID NO: 15826 - RNA, 24 nt, Homo sapiens
aaagacauaggauagagucaccuc

SEQ ID NO: 15827 - RNA, 23 nt, Homo sapiens
gagggucuugggagggaugugac

SEQ ID NO: 15828 - RNA, 21 nt, Homo sapiens
acucuagcugccaaaggcgcu

SEQ ID NO: 15829 - RNA, 23 nt, Homo sapiens
ucuggcuccgugucuucacuccc

SEQ ID NO: 15830 - RNA, 23 nt, Homo sapiens
uaaggugcaucuagugcagauag

SEQ ID NO: 15831 - RNA, 22 nt, Homo sapiens
aacuggcccucaaagucccgcu

SEQ ID NO: 15832 - RNA, 22 nt, Homo sapiens
gguccagaggggagauagguuc

SEQ ID NO: 15833 - RNA, 21 nt, Homo sapiens
uucacaguggcuaaguuccgc

SEQ ID NO: 15834 - RNA, 21 nt, Homo sapiens
uucacaguggcuaaguucugc

SEQ ID NO: 15835 - RNA, 22 nt, Homo sapiens
aaaagcuggguugagagggcga

SEQ ID NO: 15836 - RNA, 22 nt, Homo sapiens
aaaagcuggguugagagggcaa

SEQ ID NO: 15837 - RNA, 20 nt, Homo sapiens
aaaagcuggguugagagggu

SEQ ID NO: 15838 - RNA, 19 nt, Homo sapiens
aaaagcuggguugagagga

SEQ ID NO: 15839 - RNA, 22 nt, Homo sapiens
uuuugcaauauguuccugaaua

SEQ ID NO: 15840 - RNA, 22 nt, Homo sapiens
aaaacuguaauuacuuuuguac

SEQ ID NO: 15841 - RNA, 21 nt, Homo sapiens
gcgacccauacuugguuucag

SEQ ID NO: 15842 - RNA, 19 nt, Homo sapiens
aagcagcugccucugaggc

SEQ ID NO: 15843 - RNA, 23 nt, Homo sapiens
uauucauuuauccccagccuaca

SEQ ID NO: 15844 - RNA, 20 nt, Homo sapiens
guagaggagauggcgcaggg

SEQ ID NO: 15845 - RNA, 21 nt, Homo sapiens
uaggacacauggucuacuucu

SEQ ID NO: 15846 - RNA, 22 nt, Homo sapiens
ucggccugaccacccaccccac

SEQ ID NO: 15847 - RNA, 17 nt, Homo sapiens
gugggggagaggcuguc

SEQ ID NO: 15848 - RNA, 21 nt, Homo sapiens
ucgaggagcucacagucuagu

SEQ ID NO: 15849 - RNA, 22 nt, Homo sapiens
ucugcccccuccgcugcugcca

SEQ ID NO: 15850 - RNA, 20 nt, Homo sapiens
ccuccugcccuccuugcugu

SEQ ID NO: 15851 - RNA, 20 nt, Homo sapiens
acugccccaggugcugcugg

SEQ ID NO: 15852 - RNA, 23 nt, Homo sapiens
ucccccaggugugauucugauuu

SEQ ID NO: 15853 - RNA, 22 nt, Homo sapiens
aucacacaaaggcaacuuuugu

SEQ ID NO: 15854 - RNA, 21 nt, Homo sapiens
cggggcagcucaguacaggau

SEQ ID NO: 15855 - RNA, 23 nt, Homo sapiens
uagcagcgggaacaguucugcag

SEQ ID NO: 15856 - RNA, 23 nt, Homo sapiens
uucauuugguauaaaccgcgauu

SEQ ID NO: 15857 - RNA, 21 nt, Homo sapiens
uggguuuacguugggagaacu

SEQ ID NO: 15858 - RNA, 24 nt, Homo sapiens
acugggggcuuucgggcucugcgu

SEQ ID NO: 15859 - RNA, 24 nt, Homo sapiens
ugccugggucucuggccugcgcgu

SEQ ID NO: 15860 - RNA, 21 nt, Homo sapiens
uggaggagaaggaaggugaug

SEQ ID NO: 15861 - RNA, 22 nt, Homo sapiens
acuccagccccacagccucagc

SEQ ID NO: 15862 - RNA, 22 nt, Homo sapiens
uugggaucauuuugcauccaua

SEQ ID NO: 15863 - RNA, 23 nt, Homo sapiens
cugggaucuccggggucuugguu

SEQ ID NO: 15864 - RNA, 21 nt, Homo sapiens
ccgucgccgccacccgagccg

SEQ ID NO: 15865 - RNA, 17 nt, Homo sapiens
ucgccuccuccucuccc

SEQ ID NO: 15866 - RNA, 22 nt, Homo sapiens
acucggcguggcgucggucgug

SEQ ID NO: 15867 - RNA, 20 nt, Homo sapiens
ccuccugcccuccuugcugu

SEQ ID NO: 15868 - RNA, 22 nt, Homo sapiens
uccgagccugggucucccucuu

SEQ ID NO: 15869 - RNA, 23 nt, Homo sapiens
ugucacucggcucggcccacuac

SEQ ID NO: 15870 - RNA, 20 nt, Homo sapiens
ucacaccugccucgcccccc

SEQ ID NO: 15871 - RNA, 23 nt, Homo sapiens
uggaguccaggaaucugcauuuu

SEQ ID NO: 15872 - RNA, 23 nt, Homo sapiens
cggcccgggcugcugcuguuccu

SEQ ID NO: 15873 - RNA, 22 nt, Homo sapiens
ucugcccccuccgcugcugcca

SEQ ID NO: 15874 - RNA, 22 nt, Homo sapiens
acagcaggcacagacaggcagu

SEQ ID NO: 15875 - RNA, 21 nt, Homo sapiens
agggcccccccucaauccugu

SEQ ID NO: 15876 - RNA, 20 nt, Homo sapiens
acugccccaggugcugcugg

SEQ ID NO: 15877 - RNA, 22 nt, Homo sapiens
gccugcugggguggaaccuggu

SEQ ID NO: 15878 - RNA, 21 nt, Homo sapiens
cggggcagcucaguacaggau

SEQ ID NO: 15879 - RNA, 18 nt, Homo sapiens
uucacagggaggugucau

SEQ ID NO: 15880 - RNA, 19 nt, Homo sapiens
aguguggcuuucuuagagc

SEQ ID NO: 15881 - RNA, 22 nt, Homo sapiens
aggcggggcgccgcgggaccgc

SEQ ID NO: 15882 - RNA, 22 nt, Homo sapiens
ugcggggcuagggcuaacagca

SEQ ID NO: 15883 - RNA, 22 nt, Homo sapiens
ucggauccgucugagcuuggcu

SEQ ID NO: 15884 - RNA, 21 nt, Homo sapiens
uuaggccgcagaucuggguga

SEQ ID NO: 15885 - RNA, 18 nt, Homo sapiens
cagggaggugaaugugau

SEQ ID NO: 15886 - RNA, 23 nt, Homo sapiens
ucuggcuccgugucuucacuccc

SEQ ID NO: 15887 - RNA, 21 nt, Homo sapiens
cggcggggacggcgauugguc

SEQ ID NO: 15888 - RNA, 22 nt, Homo sapiens
aagcugccaguugaagaacugu

SEQ ID NO: 15889 - RNA, 23 nt, Homo sapiens
aaugacacgaucacucccguuga

SEQ ID NO: 15890 - RNA, 23 nt, Homo sapiens
ucggggaucaucaugucacgaga

SEQ ID NO: 15891 - RNA, 22 nt, Homo sapiens
ugugucacucgaugaccacugu

SEQ ID NO: 15892 - RNA, 25 nt, Homo sapiens
aggggugguguugggacagcuccgu

SEQ ID NO: 15893 - RNA, 22 nt, Homo sapiens
aggcggggcgccgcgggaccgc

SEQ ID NO: 15894 - RNA, 21 nt, Homo sapiens
uacaguacugugauaacugaa

SEQ ID NO: 15895 - RNA, 23 nt, Homo sapiens
cucucaccacugcccucccacag

SEQ ID NO: 15896 - RNA, 22 nt, Homo sapiens
cgaaaacagcaauuaccuuugc

SEQ ID NO: 15897 - RNA, 20 nt, Homo sapiens
agaccauggguucucauugu

SEQ ID NO: 15898 - RNA, 22 nt, Homo sapiens
uggagugugacaaugguguuug

SEQ ID NO: 15899 - RNA, 21 nt, Homo sapiens
ucguggccuggucuccauuau

SEQ ID NO: 15900 - RNA, 19 nt, Homo sapiens
gugaggacucgggaggugg

SEQ ID NO: 15901 - RNA, 21 nt, Homo sapiens
agugaaugauggguucugacc

SEQ ID NO: 15902 - RNA, 18 nt, Homo sapiens
cagggaggugaaugugau

SEQ ID NO: 15903 - RNA, 23 nt, Homo sapiens
ucuggcuccgugucuucacuccc

SEQ ID NO: 15904 - RNA, 22 nt, Homo sapiens
uguaacagcaacuccaugugga

SEQ ID NO: 15905 - RNA, 21 nt, Homo sapiens
ugucuugcaggccgucaugca

SEQ ID NO: 15906 - RNA, 22 nt, Homo sapiens
caaccuggaggacuccaugcug

SEQ ID NO: 15907 - RNA, 23 nt, Homo sapiens
aggaagcccuggaggggcuggag

SEQ ID NO: 15908 - RNA, 22 nt, Homo sapiens
uuugugaccugguccacuaacc

SEQ ID NO: 15909 - RNA, 22 nt, Homo sapiens
ucugggcaacaaagugagaccu

SEQ ID NO: 15910 - RNA, 22 nt, Homo sapiens
uagcagcacauaaugguuugug

SEQ ID NO: 15911 - RNA, 22 nt, Homo sapiens
uagcagcacaucaugguuuaca

SEQ ID NO: 15912 - RNA, 22 nt, Homo sapiens
uagcagcacguaaauauuggcg

SEQ ID NO: 15913 - RNA, 22 nt, Homo sapiens
uggagagaaaggcaguuccuga

SEQ ID NO: 15914 - RNA, 21 nt, Homo sapiens
uagcagcacagaaauauuggc

SEQ ID NO: 15915 - RNA, 22 nt, Homo sapiens
uagguaguuuccuguuguuggg

SEQ ID NO: 15916 - RNA, 23 nt, Homo sapiens
agcuacauugucugcuggguuuc

SEQ ID NO: 15917 - RNA, 23 nt, Homo sapiens
gcaaagcacacggccugcagaga

SEQ ID NO: 15918 - RNA, 22 nt, Homo sapiens
cagcagcaauucauguuuugaa

SEQ ID NO: 15919 - RNA, 21 nt, Homo sapiens
cagcagcacacugugguuugu

SEQ ID NO: 15920 - RNA, 18 nt, Homo sapiens
ugcuuccuuucagagggu

SEQ ID NO: 15921 - RNA, 22 nt, Homo sapiens
aucuggagguaagaagcacuuu

SEQ ID NO: 15922 - RNA, 22 nt, Homo sapiens
ucagcaaacauuuauugugugc

SEQ ID NO: 15923 - RNA, 23 nt, Homo sapiens
acuuacagacaagagccuugcuc

SEQ ID NO: 15924 - RNA, 25 nt, Homo sapiens
gcugggcagggcuucugagcuccuu

SEQ ID NO: 15925 - RNA, 21 nt, Homo sapiens
agaccuggcccagaccucagc

SEQ ID NO: 15926 - RNA, 19 nt, Homo sapiens
aagcagcugccucugaggc

SEQ ID NO: 15927 - RNA, 22 nt, Homo sapiens
ugcaacgaaccugagccacuga

SEQ ID NO: 15928 - RNA, 21 nt, Homo sapiens
uaaagugcugacagugcagau

SEQ ID NO: 15929 - RNA, 17 nt, Homo sapiens
ucgccuccuccucuccc

SEQ ID NO: 15930 - RNA, 21 nt, Homo sapiens
uccugcgcgucccagaugccc

SEQ ID NO: 15931 - RNA, 22 nt, Homo sapiens
cccugugcccggcccacuucug

SEQ ID NO: 15932 - RNA, 23 nt, Homo sapiens
caaagugcucauagugcagguag

SEQ ID NO: 15933 - RNA, 20 nt, Homo sapiens
ggggagcuguggaagcagua

SEQ ID NO: 15934 - RNA, 18 nt, Homo sapiens
acguuggcucugguggug

SEQ ID NO: 15935 - RNA, 22 nt, Homo sapiens
gugugcggaaaugcuucugcua

SEQ ID NO: 15936 - RNA, 21 nt, Homo sapiens
uccugcgcgucccagaugccc

SEQ ID NO: 15937 - RNA, 22 nt, Homo sapiens
ucugcccccuccgcugcugcca

SEQ ID NO: 15938 - RNA, 22 nt, Homo sapiens
cccugugcccggcccacuucug

SEQ ID NO: 15939 - RNA, 22 nt, Homo sapiens
auaagacgagcaaaaagcuugu

SEQ ID NO: 15940 - RNA, 22 nt, Homo sapiens
auaagacgaacaaaagguuugu

SEQ ID NO: 15941 - RNA, 22 nt, Homo sapiens
acagcaggcacagacaggcagu

SEQ ID NO: 15942 - RNA, 22 nt, Homo sapiens
cauugcacuugucucggucuga

SEQ ID NO: 15943 - RNA, 24 nt, Homo sapiens
agcagaagcagggagguucuccca

SEQ ID NO: 15944 - RNA, 20 nt, Homo sapiens
acugccccaggugcugcugg

SEQ ID NO: 15945 - RNA, 22 nt, Homo sapiens
gccugcugggguggaaccuggu

SEQ ID NO: 15946 - RNA, 21 nt, Homo sapiens
cggggcagcucaguacaggau

SEQ ID NO: 15947 - RNA, 23 nt, Homo sapiens
aggaccugcgggacaagauucuu

SEQ ID NO: 15948 - RNA, 21 nt, Homo sapiens
uccgguucucagggcuccacc

SEQ ID NO: 15949 - RNA, 21 nt, Homo sapiens
gcaggaacuugugagucuccu

SEQ ID NO: 15950 - RNA, 22 nt, Homo sapiens
uacccagagcaugcagugugaa

SEQ ID NO: 15951 - RNA, 22 nt, Homo sapiens
uggcucaguucagcaggaacag

SEQ ID NO: 15952 - RNA, 20 nt, Homo sapiens
ccucugggcccuuccuccag

SEQ ID NO: 15953 - RNA, 22 nt, Homo sapiens
ucucugggccugugucuuaggc

SEQ ID NO: 15954 - RNA, 23 nt, Homo sapiens
ugaggggcagagagcgagacuuu

SEQ ID NO: 15955 - RNA, 21 nt, Homo sapiens
ucguggccuggucuccauuau

SEQ ID NO: 15956 - RNA, 22 nt, Homo sapiens
ugagccccugugccgcccccag

SEQ ID NO: 15957 - RNA, 22 nt, Homo sapiens
acucggcguggcgucggucgug

SEQ ID NO: 15958 - RNA, 22 nt, Homo sapiens
aucacacaaaggcaacuuuugu

SEQ ID NO: 15959 - RNA, 22 nt, Homo sapiens
uauguaauaugguccacaucuu

SEQ ID NO: 15960 - RNA, 19 nt, Homo sapiens
agguugacauacguuuccc

SEQ ID NO: 15961 - RNA, 22 nt, Homo sapiens
uccgagccugggucucccucuu

SEQ ID NO: 15962 - RNA, 22 nt, Homo sapiens
agucauuggaggguuugagcag

SEQ ID NO: 15963 - RNA, 22 nt, Homo sapiens
agaaggaaauugaauucauuua

SEQ ID NO: 15964 - RNA, 21 nt, Homo sapiens
agagaagaagaucagccugca

SEQ ID NO: 15965 - RNA, 22 nt, Homo sapiens
uagcagcacauaaugguuugug

SEQ ID NO: 15966 - RNA, 22 nt, Homo sapiens
uagcagcacaucaugguuuaca

SEQ ID NO: 15967 - RNA, 22 nt, Homo sapiens
uagcagcacguaaauauuggcg

SEQ ID NO: 15968 - RNA, 22 nt, Homo sapiens
uguaacagcaacuccaugugga

SEQ ID NO: 15969 - RNA, 21 nt, Homo sapiens
uagcagcacagaaauauuggc

SEQ ID NO: 15970 - RNA, 22 nt, Homo sapiens
cucccacugcuucacuugacua

SEQ ID NO: 15971 - RNA, 21 nt, Homo sapiens
uaaagugcugacagugcagau

SEQ ID NO: 15972 - RNA, 23 nt, Homo sapiens
cagugcaaugauauugucaaagc

SEQ ID NO: 15973 - RNA, 22 nt, Homo sapiens
cagcagcaauucauguuuugaa

SEQ ID NO: 15974 - RNA, 21 nt, Homo sapiens
cagcagcacacugugguuugu

SEQ ID NO: 15975 - RNA, 23 nt, Homo sapiens
uacuccagagggcgucacucaug

SEQ ID NO: 15976 - RNA, 22 nt, Homo sapiens
aagugcugucauagcugagguc

SEQ ID NO: 15977 - RNA, 18 nt, Homo sapiens
ugcuuccuuucagagggu

SEQ ID NO: 15978 - RNA, 22 nt, Homo sapiens
aucuggagguaagaagcacuuu

SEQ ID NO: 15979 - RNA, 22 nt, Homo sapiens
aucuggagguaagaagcacuuu

SEQ ID NO: 15980 - RNA, 23 nt, Homo sapiens
caaagcgcuucucuuuagagugu

SEQ ID NO: 15981 - RNA, 21 nt, Homo sapiens
cuccagagggaaguacuuucu

SEQ ID NO: 15982 - RNA, 21 nt, Homo sapiens
cuccagagggaugcacuuucu

SEQ ID NO: 15983 - RNA, 22 nt, Homo sapiens
ccucccacacccaaggcuugca

SEQ ID NO: 15984 - RNA, 19 nt, Homo sapiens
gagccaguuggacaggagc

SEQ ID NO: 15985 - RNA, 23 nt, Homo sapiens
ucugcucauaccccaugguuucu

SEQ ID NO: 15986 - RNA, 22 nt, Homo sapiens
cacuggcuccuuucuggguaga

SEQ ID NO: 15987 - RNA, 22 nt, Homo sapiens
ucuucucuguuuuggccaugug

SEQ ID NO: 15988 - RNA, 21 nt, Homo sapiens
uaaagugcugacagugcagau

SEQ ID NO: 15989 - RNA, 22 nt, Homo sapiens
gguccagaggggagauagguuc

SEQ ID NO: 15990 - RNA, 22 nt, Homo sapiens
cauugcacuugucucggucuga

SEQ ID NO: 15991 - RNA, 23 nt, Homo sapiens
caaagcgcuucucuuuagagugu

SEQ ID NO: 15992 - RNA, 21 nt, Homo sapiens
cuccagagggaaguacuuucu

SEQ ID NO: 15993 - RNA, 21 nt, Homo sapiens
cuccagagggaugcacuuucu

SEQ ID NO: 15994 - RNA, 22 nt, Homo sapiens
cugcccuggcccgagggaccga

SEQ ID NO: 15995 - RNA, 21 nt, Homo sapiens
ccuggaaacacugagguugug

SEQ ID NO: 15996 - RNA, 20 nt, Homo sapiens
ggggagcuguggaagcagua

SEQ ID NO: 15997 - RNA, 22 nt, Homo sapiens
uuuccggcucgcgugggugugu

SEQ ID NO: 15998 - RNA, 21 nt, Homo sapiens
acucuagcugccaaaggcgcu

SEQ ID NO: 15999 - RNA, 22 nt, Homo sapiens
agaaggaaauugaauucauuua

SEQ ID NO: 16000 - RNA, 22 nt, Homo sapiens
cagugcaaugaugaaagggcau

SEQ ID NO: 16001 - RNA, 22 nt, Homo sapiens
ugaguauuacauggccaaucuc

SEQ ID NO: 16002 - RNA, 21 nt, Homo sapiens
caaagaggaaggucccauuac

SEQ ID NO: 16003 - RNA, 25 nt, Homo sapiens
ggcggagggaaguagguccguuggu

SEQ ID NO: 16004 - RNA, 22 nt, Homo sapiens
uauugcacucgucccggccucc

SEQ ID NO: 16005 - RNA, 22 nt, Homo sapiens
auccgcgcucugacucucugcc

SEQ ID NO: 16006 - RNA, 22 nt, Homo sapiens
ugagccccugugccgcccccag

SEQ ID NO: 16007 - RNA, 22 nt, Homo sapiens
ugucaguuugucaaauacccca

SEQ ID NO: 16008 - RNA, 22 nt, Homo sapiens
uggcagugucuuagcugguugu

SEQ ID NO: 16009 - RNA, 23 nt, Homo sapiens
aggcaguguaguuagcugauugc

SEQ ID NO: 16010 - RNA, 22 nt, Homo sapiens
uuaucagaaucuccagggguac

SEQ ID NO: 16011 - RNA, 22 nt, Homo sapiens
uuauaauacaaccugauaagug

SEQ ID NO: 16012 - RNA, 22 nt, Homo sapiens
uggcaguguauuguuagcuggu

SEQ ID NO: 16013 - RNA, 22 nt, Homo sapiens
aggcaguguauuguuagcuggc

SEQ ID NO: 16014 - RNA, 23 nt, Homo sapiens
ugagugugugugugugagugugu

SEQ ID NO: 16015 - RNA, 22 nt, Homo sapiens
cacacacugcaauuacuuuugc

SEQ ID NO: 16016 - RNA, 20 nt, Homo sapiens
cggcucugggucugugggga

SEQ ID NO: 16017 - RNA, 23 nt, Homo sapiens
gcagcagagaauaggacuacguc

SEQ ID NO: 16018 - RNA, 22 nt, Homo sapiens
ugugcgcagggagaccucuccc

SEQ ID NO: 16019 - RNA, 22 nt, Homo sapiens
ucggccugaccacccaccccac

SEQ ID NO: 16020 - RNA, 17 nt, Homo sapiens
ucgccuccuccucuccc

SEQ ID NO: 16021 - RNA, 21 nt, Homo sapiens
ugcaggaccaagaugagcccu

SEQ ID NO: 16022 - RNA, 18 nt, Homo sapiens
ugaggcaguagauugaau

SEQ ID NO: 16023 - RNA, 22 nt, Homo sapiens
ucugcccccuccgcugcugcca

SEQ ID NO: 16024 - RNA, 20 nt, Homo sapiens
ccuccugcccuccuugcugu

SEQ ID NO: 16025 - RNA, 20 nt, Homo sapiens
acugccccaggugcugcugg

SEQ ID NO: 16026 - RNA, 23 nt, Homo sapiens
ucccccaggugugauucugauuu

SEQ ID NO: 16027 - RNA, 21 nt, Homo sapiens
cggggcagcucaguacaggau

SEQ ID NO: 16028 - RNA, 24 nt, Homo sapiens
acugggggcuuucgggcucugcgu

SEQ ID NO: 16029 - RNA, 21 nt, Homo sapiens
aggaggcagcgcucucaggac

SEQ ID NO: 16030 - RNA, 22 nt, Homo sapiens
aggcggggcgccgcgggaccgc

SEQ ID NO: 16031 - RNA, 21 nt, Homo sapiens
aaggcagggcccccgcucccc

SEQ ID NO: 16032 - RNA, 21 nt, Homo sapiens
uccuucugcuccgucccccag

SEQ ID NO: 16033 - RNA, 22 nt, Homo sapiens
cuggacugagccgugcuacugg

SEQ ID NO: 16034 - RNA, 21 nt, Homo sapiens
acuggacuuggagucagaagg

SEQ ID NO: 16035 - RNA, 22 nt, Homo sapiens
acuggacuuagggucagaaggc

SEQ ID NO: 16036 - RNA, 22 nt, Homo sapiens
aaagugcauccuuuuagagugu

SEQ ID NO: 16037 - RNA, 22 nt, Homo sapiens
aaagugcauccuuuuagagugu

SEQ ID NO: 16038 - RNA, 22 nt, Homo sapiens
aaagugcauccuuuuagagguu

SEQ ID NO: 16039 - RNA, 22 nt, Homo sapiens
aaagugcauccuuuuagagguu

SEQ ID NO: 16040 - RNA, 22 nt, Homo sapiens
aaagugcaucuuuuuagaggau

SEQ ID NO: 16041 - RNA, 22 nt, Homo sapiens
aaagugcaucuuuuuagaggau

SEQ ID NO: 16042 - RNA, 22 nt, Homo sapiens
ugugucacucgaugaccacugu

SEQ ID NO: 16043 - RNA, 20 nt, Homo sapiens
gugucugggcggacagcugc

SEQ ID NO: 16044 - RNA, 22 nt, Homo sapiens
uggagagaaaggcaguuccuga

SEQ ID NO: 16045 - RNA, 21 nt, Homo sapiens
cggcggggacggcgauugguc

SEQ ID NO: 16046 - RNA, 20 nt, Homo sapiens
ccccagggcgacgcggcggg

SEQ ID NO: 16047 - RNA, 22 nt, Homo sapiens
uagguaguuuccuguuguuggg

SEQ ID NO: 16048 - RNA, 21 nt, Homo sapiens
gccccugggccuauccuagaa

SEQ ID NO: 16049 - RNA, 23 nt, Homo sapiens
ugagcgccucgacgacagagccg

SEQ ID NO: 16050 - RNA, 22 nt, Homo sapiens
aauugcacuuuagcaaugguga

SEQ ID NO: 16051 - RNA, 23 nt, Homo sapiens
agcucggucugaggccccucagu

SEQ ID NO: 16052 - RNA, 22 nt, Homo sapiens
ggggguccccggugcucggauc

SEQ ID NO: 16053 - RNA, 19 nt, Homo sapiens
agcugucugaaaaugucuu

SEQ ID NO: 16054 - RNA, 22 nt, Homo sapiens
aggcggggcgccgcgggaccgc

SEQ ID NO: 16055 - RNA, 24 nt, Homo sapiens
ucccugagacccuuuaaccuguga

SEQ ID NO: 16056 - RNA, 22 nt, Homo sapiens
ucccugagacccuaacuuguga

SEQ ID NO: 16057 - RNA, 23 nt, Homo sapiens
ccucagggcuguagaacagggcu

SEQ ID NO: 16058 - RNA, 22 nt, Homo sapiens
acucggcguggcgucggucgug

SEQ ID NO: 16059 - RNA, 21 nt, Homo sapiens
ccacaccguaucugacacuuu

SEQ ID NO: 16060 - RNA, 23 nt, Homo sapiens
aucaacagacauuaauugggcgc

SEQ ID NO: 16061 - RNA, 22 nt, Homo sapiens
uacucaggagaguggcaaucac

SEQ ID NO: 16062 - RNA, 23 nt, Homo sapiens
gcgaggaccccucggggucugac

SEQ ID NO: 16063 - RNA, 23 nt, Homo sapiens
ucaaaugcucagacuccuguggu

SEQ ID NO: 16064 - RNA, 22 nt, Homo sapiens
uuugguccccuucaaccagcug

SEQ ID NO: 16065 - RNA, 22 nt, Homo sapiens
uuugguccccuucaaccagcua

SEQ ID NO: 16066 - RNA, 23 nt, Homo sapiens
cggcccgggcugcugcuguuccu

SEQ ID NO: 16067 - RNA, 21 nt, Homo sapiens
cggcggggacggcgauugguc

SEQ ID NO: 16068 - RNA, 20 nt, Homo sapiens
ccucugggcccuuccuccag

SEQ ID NO: 16069 - RNA, 22 nt, Homo sapiens
ucucugggccugugucuuaggc

SEQ ID NO: 16070 - RNA, 21 nt, Homo sapiens
acuggacuuggagucagaagg

SEQ ID NO: 16071 - RNA, 23 nt, Homo sapiens
agcucggucugaggccccucagu

SEQ ID NO: 16072 - RNA, 21 nt, Homo sapiens
gaagugugccguggugugucu

SEQ ID NO: 16073 - RNA, 19 nt, Homo sapiens
aagugugcagggcacuggu

SEQ ID NO: 16074 - RNA, 22 nt, Homo sapiens
aggcggggcgccgcgggaccgc

SEQ ID NO: 16075 - RNA, 22 nt, Homo sapiens
ugcggggcuagggcuaacagca

SEQ ID NO: 16076 - RNA, 23 nt, Homo sapiens
ucauagcccuguacaaugcugcu

SEQ ID NO: 16077 - RNA, 22 nt, Homo sapiens
uggguggucuggagauuugugc

SEQ ID NO: 16078 - RNA, 22 nt, Homo sapiens
ucucccaacccuuguaccagug

SEQ ID NO: 16079 - RNA, 20 nt, Homo sapiens
ccuccugcccuccuugcugu

SEQ ID NO: 16080 - RNA, 25 nt, Homo sapiens
aggggugguguugggacagcuccgu

SEQ ID NO: 16081 - RNA, 25 nt, Homo sapiens
aggggugguguugggacagcuccgu

SEQ ID NO: 16082 - RNA, 21 nt, Homo sapiens
uggaggagaaggaaggugaug

SEQ ID NO: 16083 - RNA, 23 nt, Homo sapiens
ugagcgccucgacgacagagccg

SEQ ID NO: 16084 - RNA, 21 nt, Homo sapiens
ccgucgccgccacccgagccg

SEQ ID NO: 16085 - RNA, 21 nt, Homo sapiens
uggcagggaggcugggagggg

SEQ ID NO: 16086 - RNA, 17 nt, Homo sapiens
ucgccuccuccucuccc

SEQ ID NO: 16087 - RNA, 18 nt, Homo sapiens
cagggaggugaaugugau

SEQ ID NO: 16088 - RNA, 21 nt, Homo sapiens
ucgaggagcucacagucuagu

SEQ ID NO: 16089 - RNA, 22 nt, Homo sapiens
gguccagaggggagauagguuc

SEQ ID NO: 16090 - RNA, 18 nt, Homo sapiens
ugcuuccuuucagagggu

SEQ ID NO: 16091 - RNA, 22 nt, Homo sapiens
aucuggagguaagaagcacuuu

SEQ ID NO: 16092 - RNA, 23 nt, Homo sapiens
caaagcgcuucucuuuagagugu

SEQ ID NO: 16093 - RNA, 21 nt, Homo sapiens
cuccagagggaaguacuuucu

SEQ ID NO: 16094 - RNA, 21 nt, Homo sapiens
cuccagagggaugcacuuucu

SEQ ID NO: 16095 - RNA, 19 nt, Homo sapiens
ugagcugcuguaccaaaau

SEQ ID NO: 16096 - RNA, 19 nt, Homo sapiens
aggcugcggaauucaggac

SEQ ID NO: 16097 - RNA, 19 nt, Homo sapiens
aagcagcugccucugaggc

SEQ ID NO: 16098 - RNA, 21 nt, Homo sapiens
cgcgggugcuuacugacccuu

SEQ ID NO: 16099 - RNA, 22 nt, Homo sapiens
auccgcgcucugacucucugcc

SEQ ID NO: 16100 - RNA, 18 nt, Homo sapiens
cgggcguggugguggggg

SEQ ID NO: 16101 - RNA, 22 nt, Homo sapiens
uuugguccccuucaaccagcug

SEQ ID NO: 16102 - RNA, 22 nt, Homo sapiens
uuugguccccuucaaccagcua

SEQ ID NO: 16103 - RNA, 22 nt, Homo sapiens
uagguaguuucauguuguuggg

SEQ ID NO: 16104 - RNA, 22 nt, Homo sapiens
aaggagcucacagucuauugag

SEQ ID NO: 16105 - RNA, 22 nt, Homo sapiens
uguaaacauccuacacucagcu

SEQ ID NO: 16106 - RNA, 22 nt, Homo sapiens
uacgucaucguugucaucguca

SEQ ID NO: 16107 - RNA, 21 nt, Homo sapiens
aauggcgccacuaggguugug

SEQ ID NO: 16108 - RNA, 23 nt, Homo sapiens
aaggagcuuacaaucuagcuggg

SEQ ID NO: 16109 - RNA, 21 nt, Homo sapiens
uggaggagaaggaaggugaug

SEQ ID NO: 16110 - RNA, 22 nt, Homo sapiens
uuuccggcucgcgugggugugu

SEQ ID NO: 16111 - RNA, 21 nt, Homo sapiens
acggugcuggauguggccuuu

SEQ ID NO: 16112 - RNA, 21 nt, Homo sapiens
agugaaugauggguucugacc

SEQ ID NO: 16113 - RNA, 23 nt, Homo sapiens
uauggcuuuuuauuccuauguga

SEQ ID NO: 16114 - RNA, 23 nt, Homo sapiens
uauggcuuuucauuccuauguga

SEQ ID NO: 16115 - RNA, 23 nt, Homo sapiens
ugaguaccgccaugucuguuggg

SEQ ID NO: 16116 - RNA, 22 nt, Homo sapiens
aacuguuugcagaggaaacuga

SEQ ID NO: 16117 - RNA, 22 nt, Homo sapiens
aguggggaacccuuccaugagg

SEQ ID NO: 16118 - RNA, 23 nt, Homo sapiens
uucucgaggaaagaagcacuuuc

SEQ ID NO: 16119 - RNA, 22 nt, Homo sapiens
cuugguucagggagggucccca

SEQ ID NO: 16120 - RNA, 22 nt, Homo sapiens
uauugcacucgucccggccucc

SEQ ID NO: 16121 - RNA, 22 nt, Homo sapiens
uggagugugacaaugguguuug

SEQ ID NO: 16122 - RNA, 22 nt, Homo sapiens
ucugcccccuccgcugcugcca

SEQ ID NO: 16123 - RNA, 23 nt, Homo sapiens
uaagugcuuccauguuuuaguag

SEQ ID NO: 16124 - RNA, 23 nt, Homo sapiens
uaagugcuuccauguuugagugu

SEQ ID NO: 16125 - RNA, 20 nt, Homo sapiens
acugccccaggugcugcugg

SEQ ID NO: 16126 - RNA, 23 nt, Homo sapiens
ugagcgccucgacgacagagccg

SEQ ID NO: 16127 - RNA, 21 nt, Homo sapiens
cggggcagcucaguacaggau

SEQ ID NO: 16128 - RNA, 22 nt, Homo sapiens
aggcagcgggguguaguggaua

SEQ ID NO: 16129 - RNA, 18 nt, Homo sapiens
acguuggcucugguggug

SEQ ID NO: 16130 - RNA, 21 nt, Homo sapiens
uccugcgcgucccagaugccc

SEQ ID NO: 16131 - RNA, 21 nt, Homo sapiens
cggcggggacggcgauugguc

SEQ ID NO: 16132 - RNA, 23 nt, Homo sapiens
ugagcgccucgacgacagagccg

SEQ ID NO: 16133 - RNA, 23 nt, Homo sapiens
aaugacacgaucacucccguuga

SEQ ID NO: 16134 - RNA, 23 nt, Homo sapiens
uagcagcgggaacaguucugcag

SEQ ID NO: 16135 - RNA, 23 nt, Homo sapiens
gaacgcgcuucccuauagagggu

SEQ ID NO: 16136 - RNA, 22 nt, Homo sapiens
caaaacuggcaauuacuuuugc

SEQ ID NO: 16137 - RNA, 22 nt, Homo sapiens
aaaaacugagacuacuuuugca

SEQ ID NO: 16138 - RNA, 19 nt, Homo sapiens
aaaaacuguaauuacuuuu

SEQ ID NO: 16139 - RNA, 19 nt, Homo sapiens
gggcgccugugaucccaac

SEQ ID NO: 16140 - RNA, 19 nt, Homo sapiens
gggcgccugugaucccaac

SEQ ID NO: 16141 - RNA, 22 nt, Homo sapiens
uaacugguugaacaacugaacc

SEQ ID NO: 16142 - RNA, 22 nt, Homo sapiens
uugugucaauaugcgaugaugu

SEQ ID NO: 16143 - RNA, 21 nt, Homo sapiens
aauggcgccacuaggguugug

SEQ ID NO: 16144 - RNA, 22 nt, Homo sapiens
aggcggggcgccgcgggaccgc

SEQ ID NO: 16145 - RNA, 20 nt, Homo sapiens
cggcucugggucugugggga

SEQ ID NO: 16146 - RNA, 21 nt, Homo sapiens
agagaagaagaucagccugca

SEQ ID NO: 16147 - RNA, 18 nt, Homo sapiens
cagggaggugaaugugau

SEQ ID NO: 16148 - RNA, 21 nt, Homo sapiens
cugaccuaugaauugacagcc

SEQ ID NO: 16149 - RNA, 21 nt, Homo sapiens
augaccuaugaauugacagac

SEQ ID NO: 16150 - RNA, 23 nt, Homo sapiens
ccugcagcgacuugauggcuucc

SEQ ID NO: 16151 - RNA, 20 nt, Homo sapiens
ucugcaggguuugcuuugag

SEQ ID NO: 16152 - RNA, 18 nt, Homo sapiens
acguuggcucugguggug

SEQ ID NO: 16153 - RNA, 21 nt, Homo sapiens
cggcggggacggcgauugguc

SEQ ID NO: 16154 - RNA, 22 nt, Homo sapiens
aagcugccaguugaagaacugu

SEQ ID NO: 16155 - RNA, 23 nt, Homo sapiens
gaacgcgcuucccuauagagggu

SEQ ID NO: 16156 - RNA, 19 nt, Homo sapiens
ugagcugcuguaccaaaau

SEQ ID NO: 16157 - RNA, 24 nt, Homo sapiens
ugccugggucucuggccugcgcgu

SEQ ID NO: 16158 - RNA, 22 nt, Homo sapiens
aggcggggcgccgcgggaccgc

SEQ ID NO: 16159 - RNA, 22 nt, Homo sapiens
uuuccggcucgcgugggugugu

SEQ ID NO: 16160 - RNA, 21 nt, Homo sapiens
ccgucgccgccacccgagccg

SEQ ID NO: 16161 - RNA, 21 nt, Homo sapiens
agagaagaagaucagccugca

SEQ ID NO: 16162 - RNA, 17 nt, Homo sapiens
ucgccuccuccucuccc

SEQ ID NO: 16163 - RNA, 21 nt, Homo sapiens
ugcaggaccaagaugagcccu

SEQ ID NO: 16164 - RNA, 21 nt, Homo sapiens
uccugcgcgucccagaugccc

SEQ ID NO: 16165 - RNA, 22 nt, Homo sapiens
ucugcccccuccgcugcugcca

SEQ ID NO: 16166 - RNA, 25 nt, Homo sapiens
cccccacaaccgcgcuugacuagcu

SEQ ID NO: 16167 - RNA, 20 nt, Homo sapiens
acugccccaggugcugcugg

SEQ ID NO: 16168 - RNA, 21 nt, Homo sapiens
cggggcagcucaguacaggau

SEQ ID NO: 16169 - RNA, 22 nt, Homo sapiens
ucugggcaacaaagugagaccu

SEQ ID NO: 16170 - RNA, 22 nt, Homo sapiens
cauugcacuugucucggucuga

SEQ ID NO: 16171 - RNA, 22 nt, Homo sapiens
ucaggcucaguccccucccgau

SEQ ID NO: 16172 - RNA, 25 nt, Homo sapiens
gcugggcagggcuucugagcuccuu

SEQ ID NO: 16173 - RNA, 21 nt, Homo sapiens
acagucugcugagguuggagc

SEQ ID NO: 16174 - RNA, 21 nt, Homo sapiens
guggcugcacucacuuccuuc

SEQ ID NO: 16175 - RNA, 24 nt, Homo sapiens
ugccugggucucuggccugcgcgu

SEQ ID NO: 16176 - RNA, 22 nt, Homo sapiens
uuuccggcucgcgugggugugu

SEQ ID NO: 16177 - RNA, 22 nt, Homo sapiens
uuuccggcucgcgugggugugu

SEQ ID NO: 16178 - RNA, 22 nt, Homo sapiens
cucuagagggaagcacuuucug

SEQ ID NO: 16179 - RNA, 22 nt, Homo sapiens
uagcuuaucagacugauguuga

SEQ ID NO: 16180 - RNA, 22 nt, Homo sapiens
uggcagugucuuagcugguugu

SEQ ID NO: 16181 - RNA, 22 nt, Homo sapiens
caaaacuggcaauuacuuuugc

SEQ ID NO: 16182 - RNA, 22 nt, Homo sapiens
aaaaacugagacuacuuuugca

SEQ ID NO: 16183 - RNA, 19 nt, Homo sapiens
aaaaacuguaauuacuuuu

SEQ ID NO: 16184 - RNA, 19 nt, Homo sapiens
gggcgccugugaucccaac

SEQ ID NO: 16185 - RNA, 19 nt, Homo sapiens
aggcugcggaauucaggac

SEQ ID NO: 16186 - RNA, 22 nt, Homo sapiens
uccgagccugggucucccucuu

SEQ ID NO: 16187 - RNA, 22 nt, Homo sapiens
agacuucccauuugaagguggc

SEQ ID NO: 16188 - RNA, 20 nt, Homo sapiens
uaaggcacgcggugaaugcc

SEQ ID NO: 16189 - RNA, 22 nt, Homo sapiens
acccgucccguucguccccgga

SEQ ID NO: 16190 - RNA, 22 nt, Homo sapiens
uggagagaaaggcaguuccuga

SEQ ID NO: 16191 - RNA, 21 nt, Homo sapiens
cggcggggacggcgauugguc

SEQ ID NO: 16192 - RNA, 22 nt, Homo sapiens
uguaacagcaacuccaugugga

SEQ ID NO: 16193 - RNA, 22 nt, Homo sapiens
uggcucaguucagcaggaacag

SEQ ID NO: 16194 - RNA, 23 nt, Homo sapiens
ucccccaggugugauucugauuu

SEQ ID NO: 16195 - RNA, 21 nt, Homo sapiens
uaaggcacccuucugaguaga

SEQ ID NO: 16196 - RNA, 19 nt, Homo sapiens
aggcacggugucagcaggc

SEQ ID NO: 16197 - RNA, 19 nt, Homo sapiens
gggcgccugugaucccaac

SEQ ID NO: 16198 - RNA, 22 nt, Homo sapiens
uccgagccugggucucccucuu

SEQ ID NO: 16199 - RNA, 24 nt, Homo sapiens
acugggggcuuucgggcucugcgu

SEQ ID NO: 16200 - RNA, 24 nt, Homo sapiens
ugccugggucucuggccugcgcgu

SEQ ID NO: 16201 - RNA, 22 nt, Homo sapiens
aggcggggcgccgcgggaccgc

SEQ ID NO: 16202 - RNA, 22 nt, Homo sapiens
ugcggggcuagggcuaacagca

SEQ ID NO: 16203 - RNA, 22 nt, Homo sapiens
uauugcacucgucccggccucc

SEQ ID NO: 16204 - RNA, 22 nt, Homo sapiens
uggaauguaaagaaguauguau

SEQ ID NO: 16205 - RNA, 22 nt, Homo sapiens
ugagccccugugccgcccccag

SEQ ID NO: 16206 - RNA, 22 nt, Homo sapiens
ugagccccugugccgcccccag

SEQ ID NO: 16207 - RNA, 20 nt, Homo sapiens
ucacaccugccucgcccccc

SEQ ID NO: 16208 - RNA, 20 nt, Homo sapiens
ccccagggcgacgcggcggg

SEQ ID NO: 16209 - RNA, 22 nt, Homo sapiens
uggaauguaaggaagugugugg

SEQ ID NO: 16210 - RNA, 22 nt, Homo sapiens
acagcaggcacagacaggcagu

SEQ ID NO: 16211 - RNA, 21 nt, Homo sapiens
agggcccccccucaauccugu

SEQ ID NO: 16212 - RNA, 20 nt, Homo sapiens
ccucugggcccuuccuccag

SEQ ID NO: 16213 - RNA, 22 nt, Homo sapiens
aacacaccugguuaaccucuuu

SEQ ID NO: 16214 - RNA, 22 nt, Homo sapiens
ucucugggccugugucuuaggc

SEQ ID NO: 16215 - RNA, 21 nt, Homo sapiens
gccccugggccuauccuagaa

SEQ ID NO: 16216 - RNA, 22 nt, Homo sapiens
aacacaccuauucaaggauuca

SEQ ID NO: 16217 - RNA, 22 nt, Homo sapiens
gccugcugggguggaaccuggu

SEQ ID NO: 16218 - RNA, 20 nt, Homo sapiens
aggaauguuccuucuuugcc

SEQ ID NO: 16219 - RNA, 20 nt, Homo sapiens
cggcucugggucugugggga

SEQ ID NO: 16220 - RNA, 22 nt, Homo sapiens
cagugcaaugaugaaagggcau

SEQ ID NO: 16221 - RNA, 22 nt, Homo sapiens
aaaaccgucuaguuacaguugu

SEQ ID NO: 16222 - RNA, 24 nt, Homo sapiens
uuuggcaaugguagaacucacacu

SEQ ID NO: 16223 - RNA, 23 nt, Homo sapiens
ugugcaaaucuaugcaaaacuga

SEQ ID NO: 16224 - RNA, 22 nt, Homo sapiens
aacaauauccuggugcugagug

SEQ ID NO: 16225 - RNA, 22 nt, Homo sapiens
agagguaguagguugcauaguu

SEQ ID NO: 16226 - RNA, 22 nt, Homo sapiens
auucugcauuuuuagcaaguuc

SEQ ID NO: 16227 - RNA, 21 nt, Homo sapiens
caaagaggaaggucccauuac

SEQ ID NO: 16228 - RNA, 21 nt, Homo sapiens
guggcugcacucacuuccuuc

SEQ ID NO: 16229 - RNA, 22 nt, Homo sapiens
uggagugugacaaugguguuug

SEQ ID NO: 16230 - RNA, 17 nt, Homo sapiens
gugggggagaggcuguc

SEQ ID NO: 16231 - RNA, 22 nt, Homo sapiens
uuauaaagcaaugagacugauu

SEQ ID NO: 16232 - RNA, 22 nt, Homo sapiens
aagacgggaggaaagaagggag

SEQ ID NO: 16233 - RNA, 22 nt, Homo sapiens
agaggcuggccgugaugaauuc

SEQ ID NO: 16234 - RNA, 22 nt, Homo sapiens
gaaagcgcuucccuuugcugga

SEQ ID NO: 16235 - RNA, 22 nt, Homo sapiens
caaagcgcuccccuuuagaggu

SEQ ID NO: 16236 - RNA, 23 nt, Homo sapiens
caaagcgcuucucuuuagagugu

SEQ ID NO: 16237 - RNA, 21 nt, Homo sapiens
caaagcgcuucccuuuggagc

SEQ ID NO: 16238 - RNA, 21 nt, Homo sapiens
aaagcgcuucccuucagagug

SEQ ID NO: 16239 - RNA, 21 nt, Homo sapiens
gaaagcgcuucucuuuagagg

SEQ ID NO: 16240 - RNA, 21 nt, Homo sapiens
uggaggagaaggaaggugaug

SEQ ID NO: 16241 - RNA, 21 nt, Homo sapiens
cgcgggugcuuacugacccuu

SEQ ID NO: 16242 - RNA, 20 nt, Homo sapiens
ggggagcuguggaagcagua

SEQ ID NO: 16243 - RNA, 21 nt, Homo sapiens
uugcucacuguucuucccuag

SEQ ID NO: 16244 - RNA, 19 nt, Homo sapiens
gugaggacucgggaggugg

SEQ ID NO: 16245 - RNA, 24 nt, Homo sapiens
uggcccugacugaagaccagcagu

SEQ ID NO: 16246 - RNA, 18 nt, Homo sapiens
cagggaggugaaugugau

SEQ ID NO: 16247 - RNA, 22 nt, Homo sapiens
ggagacgcggcccuguuggagu

SEQ ID NO: 16248 - RNA, 23 nt, Homo sapiens
ucuggcuccgugucuucacuccc

SEQ ID NO: 16249 - RNA, 21 nt, Homo sapiens
agggcccccccucaauccugu

SEQ ID NO: 16250 - RNA, 22 nt, Homo sapiens
uagcaccaucugaaaucgguua

SEQ ID NO: 16251 - RNA, 23 nt, Homo sapiens
ugaggggcagagagcgagacuuu

SEQ ID NO: 16252 - RNA, 19 nt, Homo sapiens
aggcugcggaauucaggac

SEQ ID NO: 16253 - RNA, 22 nt, Homo sapiens
uggaauguaaagaaguauguau

SEQ ID NO: 16254 - RNA, 23 nt, Homo sapiens
gagggucuugggagggaugugac

SEQ ID NO: 16255 - RNA, 22 nt, Homo sapiens
agaaggaaauugaauucauuua

SEQ ID NO: 16256 - RNA, 21 nt, Homo sapiens
gcccuccgcccgugcaccccg

SEQ ID NO: 16257 - RNA, 23 nt, Homo sapiens
ucuggcuccgugucuucacuccc

SEQ ID NO: 16258 - RNA, 22 nt, Homo sapiens
ugggucuuugcgggcgagauga

SEQ ID NO: 16259 - RNA, 22 nt, Homo sapiens
uggaauguaaggaagugugugg

SEQ ID NO: 16260 - RNA, 21 nt, Homo sapiens
gugcauuguaguugcauugca

SEQ ID NO: 16261 - RNA, 22 nt, Homo sapiens
aauugcacgguauccaucugua

SEQ ID NO: 16262 - RNA, 22 nt, Homo sapiens
agacccuggucugcacucuauc

SEQ ID NO: 16263 - RNA, 22 nt, Homo sapiens
aaacauucgcggugcacuucuu

SEQ ID NO: 16264 - RNA, 22 nt, Homo sapiens
auauuaccauuagcucaucuuu

SEQ ID NO: 16265 - RNA, 22 nt, Homo sapiens
cgaaaacagcaauuaccuuugc

SEQ ID NO: 16266 - RNA, 21 nt, Homo sapiens
uuggccacaauggguuagaac

SEQ ID NO: 16267 - RNA, 25 nt, Homo sapiens
aggggugguguugggacagcuccgu

SEQ ID NO: 16268 - RNA, 20 nt, Homo sapiens
aggaauguuccuucuuugcc

SEQ ID NO: 16269 - RNA, 22 nt, Homo sapiens
uccgagccugggucucccucuu

SEQ ID NO: 16270 - RNA, 19 nt, Homo sapiens
aguguggcuuucuuagagc

SEQ ID NO: 16271 - RNA, 23 nt, Homo sapiens
ucaaaugcucagacuccuguggu

SEQ ID NO: 16272 - RNA, 21 nt, Homo sapiens
uggcagggaggcugggagggg

SEQ ID NO: 16273 - RNA, 22 nt, Homo sapiens
ucggccugaccacccaccccac

SEQ ID NO: 16274 - RNA, 24 nt, Homo sapiens
uggcccugacugaagaccagcagu

SEQ ID NO: 16275 - RNA, 21 nt, Homo sapiens
cggcggggacggcgauugguc

SEQ ID NO: 16276 - RNA, 22 nt, Homo sapiens
cccugugcccggcccacuucug

SEQ ID NO: 16277 - RNA, 22 nt, Homo sapiens
gaggguuggguggaggcucucc

SEQ ID NO: 16278 - RNA, 21 nt, Homo sapiens
agggcccccccucaauccugu

SEQ ID NO: 16279 - RNA, 23 nt, Homo sapiens
ucccccaggugugauucugauuu

SEQ ID NO: 16280 - RNA, 23 nt, Homo sapiens
ucccccaggugugauucugauuu

SEQ ID NO: 16281 - RNA, 22 nt, Homo sapiens
uggugggcacagaaucuggacu

SEQ ID NO: 16282 - RNA, 21 nt, Homo sapiens
aacaggugacugguuagacaa

SEQ ID NO: 16283 - RNA, 24 nt, Homo sapiens
acugggggcuuucgggcucugcgu

SEQ ID NO: 16284 - RNA, 24 nt, Homo sapiens
acugggggcuuucgggcucugcgu

SEQ ID NO: 16285 - RNA, 22 nt, Homo sapiens
uggugggccgcagaacaugugc

SEQ ID NO: 16286 - RNA, 22 nt, Homo sapiens
aggcggggcgccgcgggaccgc

SEQ ID NO: 16287 - RNA, 22 nt, Homo sapiens
ugcggggcuagggcuaacagca

SEQ ID NO: 16288 - RNA, 22 nt, Homo sapiens
caaagugccucccuuuagagug

SEQ ID NO: 16289 - RNA, 22 nt, Homo sapiens
ugugcgcagggagaccucuccc

SEQ ID NO: 16290 - RNA, 22 nt, Homo sapiens
acucggcguggcgucggucgug

SEQ ID NO: 16291 - RNA, 21 nt, Homo sapiens
cggcggggacggcgauugguc

SEQ ID NO: 16292 - RNA, 22 nt, Homo sapiens
uggcagugucuuagcugguugu

SEQ ID NO: 16293 - RNA, 19 nt, Homo sapiens
ugggcguaucuguaugcua

SEQ ID NO: 16294 - RNA, 21 nt, Homo sapiens
uuggccacaauggguuagaac

SEQ ID NO: 16295 - RNA, 22 nt, Homo sapiens
aggcggggcgccgcgggaccgc

SEQ ID NO: 16296 - RNA, 22 nt, Homo sapiens
ugcggggcuagggcuaacagca

SEQ ID NO: 16297 - RNA, 22 nt, Homo sapiens
auccgcgcucugacucucugcc

SEQ ID NO: 16298 - RNA, 22 nt, Homo sapiens
uggagugugacaaugguguuug

SEQ ID NO: 16299 - RNA, 23 nt, Homo sapiens
cggcccgggcugcugcuguuccu

SEQ ID NO: 16300 - RNA, 21 nt, Homo sapiens
cggcggggacggcgauugguc

SEQ ID NO: 16301 - RNA, 25 nt, Homo sapiens
aggggugguguugggacagcuccgu

SEQ ID NO: 16302 - RNA, 22 nt, Homo sapiens
aggcggggcgccgcgggaccgc

SEQ ID NO: 16303 - RNA, 22 nt, Homo sapiens
ugcggggcuagggcuaacagca

SEQ ID NO: 16304 - RNA, 21 nt, Homo sapiens
acggugcuggauguggccuuu

SEQ ID NO: 16305 - RNA, 21 nt, Homo sapiens
uccugcgcgucccagaugccc

SEQ ID NO: 16306 - RNA, 22 nt, Homo sapiens
cauugcacuugucucggucuga

SEQ ID NO: 16307 - RNA, 21 nt, Homo sapiens
uaguagaccguauagcguacg

SEQ ID NO: 16308 - RNA, 23 nt, Homo sapiens
ucuuggaguaggucauugggugg

SEQ ID NO: 16309 - RNA, 21 nt, Homo sapiens
uacuuggaaaggcaucaguug

SEQ ID NO: 16310 - RNA, 22 nt, Homo sapiens
ugucuacuacuggagacacugg

SEQ ID NO: 16311 - RNA, 23 nt, Homo sapiens
gagggucuugggagggaugugac

SEQ ID NO: 16312 - RNA, 22 nt, Homo sapiens
uggagugugacaaugguguuug

SEQ ID NO: 16313 - RNA, 22 nt, Homo sapiens
uucauucggcuguccagaugua

SEQ ID NO: 16314 - RNA, 21 nt, Homo sapiens
cucccacaugcaggguuugca

SEQ ID NO: 16315 - RNA, 22 nt, Homo sapiens
ugggucuuugcgggcgagauga

SEQ ID NO: 16316 - RNA, 18 nt, Homo sapiens
uucacagggaggugucau

SEQ ID NO: 16317 - RNA, 23 nt, Homo sapiens
uggaagacuagugauuuuguugu

SEQ ID NO: 16318 - RNA, 21 nt, Homo sapiens
gcaggaacuugugagucuccu

SEQ ID NO: 16319 - RNA, 22 nt, Homo sapiens
uauugcacucgucccggccucc

SEQ ID NO: 16320 - RNA, 21 nt, Homo sapiens
cccggagccaggaugcagcuc

SEQ ID NO: 16321 - RNA, 21 nt, Homo sapiens
uggcagggaggcugggagggg

SEQ ID NO: 16322 - RNA, 23 nt, Homo sapiens
uggaguccaggaaucugcauuuu

SEQ ID NO: 16323 - RNA, 21 nt, Homo sapiens
gcccuccgcccgugcaccccg

SEQ ID NO: 16324 - RNA, 21 nt, Homo sapiens
cggcggggacggcgauugguc

SEQ ID NO: 16325 - RNA, 22 nt, Homo sapiens
cgcaggggccgggugcucaccg

SEQ ID NO: 16326 - RNA, 22 nt, Homo sapiens
ucugcccccuccgcugcugcca

SEQ ID NO: 16327 - RNA, 22 nt, Homo sapiens
cauugcacuugucucggucuga

SEQ ID NO: 16328 - RNA, 20 nt, Homo sapiens
acugccccaggugcugcugg

SEQ ID NO: 16329 - RNA, 21 nt, Homo sapiens
cggggcagcucaguacaggau

SEQ ID NO: 16330 - RNA, 20 nt, Homo sapiens
guccgcucggcgguggccca

SEQ ID NO: 16331 - RNA, 21 nt, Homo sapiens
agaccuggcccagaccucagc

SEQ ID NO: 16332 - RNA, 25 nt, Homo sapiens
ggcggagggaaguagguccguuggu

SEQ ID NO: 16333 - RNA, 22 nt, Homo sapiens
aggcggggcgccgcgggaccgc

SEQ ID NO: 16334 - RNA, 22 nt, Homo sapiens
ugcggggcuagggcuaacagca

SEQ ID NO: 16335 - RNA, 24 nt, Homo sapiens
uggggagcugaggcucugggggug

SEQ ID NO: 16336 - RNA, 22 nt, Homo sapiens
aacccguagauccgaacuugug

SEQ ID NO: 16337 - RNA, 22 nt, Homo sapiens
ucaccagcccuguguucccuag

SEQ ID NO: 16338 - RNA, 22 nt, Homo sapiens
cugaagcucagagggcucugau

SEQ ID NO: 16339 - RNA, 22 nt, Homo sapiens
cagugcaauguuaaaagggcau

SEQ ID NO: 16340 - RNA, 23 nt, Homo sapiens
agcugguguugugaaucaggccg

SEQ ID NO: 16341 - RNA, 22 nt, Homo sapiens
uagguaguuuccuguuguuggg

SEQ ID NO: 16342 - RNA, 22 nt, Homo sapiens
uagcuuaucagacugauguuga

SEQ ID NO: 16343 - RNA, 21 nt, Homo sapiens
aucacauugccagggauuucc

SEQ ID NO: 16344 - RNA, 21 nt, Homo sapiens
aucacauugccagggauuacc

SEQ ID NO: 16345 - RNA, 20 nt, Homo sapiens
ggggagcuguggaagcagua

SEQ ID NO: 16346 - RNA, 22 nt, Homo sapiens
ccucuuccccuugucucuccag

SEQ ID NO: 16347 - RNA, 19 nt, Homo sapiens
gagccaguuggacaggagc

SEQ ID NO: 16348 - RNA, 22 nt, Homo sapiens
aagauguggaaaaauuggaauc

SEQ ID NO: 16349 - RNA, 20 nt, Homo sapiens
guagaggagauggcgcaggg

SEQ ID NO: 16350 - RNA, 22 nt, Homo sapiens
cacuggcuccuuucuggguaga

SEQ ID NO: 16351 - RNA, 24 nt, Homo sapiens
uggggagcugaggcucugggggug

SEQ ID NO: 16352 - RNA, 23 nt, Homo sapiens
ccuaguagguguccaguaagugu

SEQ ID NO: 16353 - RNA, 22 nt, Homo sapiens
caaaguuuaagauccuugaagu

SEQ ID NO: 16354 - RNA, 22 nt, Homo sapiens
uuaugguuugccugggacugag

SEQ ID NO: 16355 - RNA, 21 nt, Homo sapiens
uggguuuacguugggagaacu

SEQ ID NO: 16356 - RNA, 17 nt, Homo sapiens
ucgccuccuccucuccc

SEQ ID NO: 16357 - RNA, 17 nt, Homo sapiens
ucgccuccuccucuccc

SEQ ID NO: 16358 - RNA, 20 nt, Homo sapiens
ucguuugccuuuuucugcuu

SEQ ID NO: 16359 - RNA, 23 nt, Homo sapiens
ucuggcuccgugucuucacuccc

SEQ ID NO: 16360 - RNA, 21 nt, Homo sapiens
cggcggggacggcgauugguc

SEQ ID NO: 16361 - RNA, 23 nt, Homo sapiens
caacggaaucccaaaagcagcug

SEQ ID NO: 16362 - RNA, 22 nt, Homo sapiens
cauugcacuugucucggucuga

SEQ ID NO: 16363 - RNA, 22 nt, Homo sapiens
cgucaacacuugcugguuuccu

SEQ ID NO: 16364 - RNA, 19 nt, Homo sapiens
gagccaguuggacaggagc

SEQ ID NO: 16365 - RNA, 21 nt, Homo sapiens
agggggaaaguucuauagucc

SEQ ID NO: 16366 - RNA, 25 nt, Homo sapiens
ggcggagggaaguagguccguuggu

SEQ ID NO: 16367 - RNA, 22 nt, Homo sapiens
aggcggggcgccgcgggaccgc

SEQ ID NO: 16368 - RNA, 21 nt, Homo sapiens
cgcgggugcuuacugacccuu

SEQ ID NO: 16369 - RNA, 22 nt, Homo sapiens
cacuggcuccuuucuggguaga

SEQ ID NO: 16370 - RNA, 22 nt, Homo sapiens
cgcaggggccgggugcucaccg

SEQ ID NO: 16371 - RNA, 22 nt, Homo sapiens
ugggucuuugcgggcgagauga

SEQ ID NO: 16372 - RNA, 22 nt, Homo sapiens
ggggguccccggugcucggauc

SEQ ID NO: 16373 - RNA, 22 nt, Homo sapiens
ugagccccugugccgcccccag

SEQ ID NO: 16374 - RNA, 21 nt, Homo sapiens
gcccuccgcccgugcaccccg

SEQ ID NO: 16375 - RNA, 23 nt, Homo sapiens
ucuggcuccgugucuucacuccc

SEQ ID NO: 16376 - RNA, 22 nt, Homo sapiens
ucugcccccuccgcugcugcca

SEQ ID NO: 16377 - RNA, 22 nt, Homo sapiens
acagcaggcacagacaggcagu

SEQ ID NO: 16378 - RNA, 22 nt, Homo sapiens
uguaaacauccuacacucagcu

SEQ ID NO: 16379 - RNA, 20 nt, Homo sapiens
acugccccaggugcugcugg

SEQ ID NO: 16380 - RNA, 22 nt, Homo sapiens
gccugcugggguggaaccuggu

SEQ ID NO: 16381 - RNA, 21 nt, Homo sapiens
cggggcagcucaguacaggau

SEQ ID NO: 16382 - RNA, 22 nt, Homo sapiens
uccgagccugggucucccucuu

SEQ ID NO: 16383 - RNA, 22 nt, Homo sapiens
uacccauugcauaucggaguug

SEQ ID NO: 16384 - RNA, 24 nt, Homo sapiens
ugccugggucucuggccugcgcgu

SEQ ID NO: 16385 - RNA, 23 nt, Homo sapiens
cgggucggaguuagcucaagcgg

SEQ ID NO: 16386 - RNA, 21 nt, Homo sapiens
agaggauacccuuuguauguu

SEQ ID NO: 16387 - RNA, 22 nt, Homo sapiens
uggagugugacaaugguguuug

SEQ ID NO: 16388 - RNA, 22 nt, Homo sapiens
cuggacugagccgugcuacugg

SEQ ID NO: 16389 - RNA, 22 nt, Homo sapiens
uagguuauccguguugccuucg

SEQ ID NO: 16390 - RNA, 23 nt, Homo sapiens
agcuacauugucugcuggguuuc

SEQ ID NO: 16391 - RNA, 21 nt, Homo sapiens
agcuacaucuggcuacugggu

SEQ ID NO: 16392 - RNA, 21 nt, Homo sapiens
gcaguccaugggcauauacac

SEQ ID NO: 16393 - RNA, 23 nt, Homo sapiens
uuacaguuguucaaccaguuacu

SEQ ID NO: 16394 - RNA, 23 nt, Homo sapiens
acuugggcacugaaacaaugucc

SEQ ID NO: 16395 - RNA, 22 nt, Homo sapiens
ucggccugaccacccaccccac

SEQ ID NO: 16396 - RNA, 17 nt, Homo sapiens
ucgccuccuccucuccc

SEQ ID NO: 16397 - RNA, 22 nt, Homo sapiens
ugcuggaucagugguucgaguc

SEQ ID NO: 16398 - RNA, 23 nt, Homo sapiens
agcuacauugucugcuggguuuc

SEQ ID NO: 16399 - RNA, 23 nt, Homo sapiens
ugagcgccucgacgacagagccg

SEQ ID NO: 16400 - RNA, 22 nt, Homo sapiens
gcugacuccuaguccagggcuc

SEQ ID NO: 16401 - RNA, 22 nt, Homo sapiens
agaggcuggccgugaugaauuc

SEQ ID NO: 16402 - RNA, 20 nt, Homo sapiens
accaggaggcugaggccccu

SEQ ID NO: 16403 - RNA, 22 nt, Homo sapiens
acuccagccccacagccucagc

SEQ ID NO: 16404 - RNA, 21 nt, Homo sapiens
ucguggccuggucuccauuau

SEQ ID NO: 16405 - RNA, 22 nt, Homo sapiens
ucggccugaccacccaccccac

SEQ ID NO: 16406 - RNA, 18 nt, Homo sapiens
cgggcguggugguggggg

SEQ ID NO: 16407 - RNA, 21 nt, Homo sapiens
cggcggggacggcgauugguc

SEQ ID NO: 16408 - RNA, 21 nt, Homo sapiens
cggcggggacggcgauugguc

SEQ ID NO: 16409 - RNA, 22 nt, Homo sapiens
cgcaggggccgggugcucaccg

SEQ ID NO: 16410 - RNA, 23 nt, Homo sapiens
ugaggggcagagagcgagacuuu

SEQ ID NO: 16411 - RNA, 22 nt, Homo sapiens
ggagaaauuauccuuggugugu

SEQ ID NO: 16412 - RNA, 22 nt, Homo sapiens
aggcggggcgccgcgggaccgc

SEQ ID NO: 16413 - RNA, 22 nt, Homo sapiens
aggcggggcgccgcgggaccgc

SEQ ID NO: 16414 - RNA, 23 nt, Homo sapiens
cgggucggaguuagcucaagcgg

SEQ ID NO: 16415 - RNA, 22 nt, Homo sapiens
ccucuuccccuugucucuccag

SEQ ID NO: 16416 - RNA, 22 nt, Homo sapiens
ugagaacugaauuccauggguu

SEQ ID NO: 16417 - RNA, 21 nt, Homo sapiens
ccaccaccgugucugacacuu

SEQ ID NO: 16418 - RNA, 22 nt, Homo sapiens
gcugacuccuaguccagggcuc

SEQ ID NO: 16419 - RNA, 22 nt, Homo sapiens
aggcaguguauuguuagcuggc

SEQ ID NO: 16420 - RNA, 22 nt, Homo sapiens
cgucaacacuugcugguuuccu

SEQ ID NO: 16421 - RNA, 25 nt, Homo sapiens
aggggugguguugggacagcuccgu

SEQ ID NO: 16422 - RNA, 19 nt, Homo sapiens
ucuaggcugguacugcuga

SEQ ID NO: 16423 - RNA, 21 nt, Homo sapiens
uggaggagaaggaaggugaug

SEQ ID NO: 16424 - RNA, 20 nt, Homo sapiens
guagaggagauggcgcaggg

SEQ ID NO: 16425 - RNA, 22 nt, Homo sapiens
caaagugccucccuuuagagug

SEQ ID NO: 16426 - RNA, 20 nt, Homo sapiens
ucguuugccuuuuucugcuu

SEQ ID NO: 16427 - RNA, 23 nt, Homo sapiens
guccaguuuucccaggaaucccu

SEQ ID NO: 16428 - RNA, 21 nt, Homo sapiens
cggcggggacggcgauugguc

SEQ ID NO: 16429 - RNA, 22 nt, Homo sapiens
cauugcacuugucucggucuga

SEQ ID NO: 16430 - RNA, 22 nt, Homo sapiens
aggcggggcgccgcgggaccgc

SEQ ID NO: 16431 - RNA, 22 nt, Homo sapiens
ugcggggcuagggcuaacagca

SEQ ID NO: 16432 - RNA, 22 nt, Homo sapiens
caaagugccucccuuuagagug

SEQ ID NO: 16433 - RNA, 22 nt, Homo sapiens
uggaauguaaagaaguauguau

SEQ ID NO: 16434 - RNA, 21 nt, Homo sapiens
acggugcuggauguggccuuu

SEQ ID NO: 16435 - RNA, 23 nt, Homo sapiens
guccaguuuucccaggaaucccu

SEQ ID NO: 16436 - RNA, 22 nt, Homo sapiens
uggaauguaaggaagugugugg

SEQ ID NO: 16437 - RNA, 21 nt, Homo sapiens
aucacauugccagggauuucc

SEQ ID NO: 16438 - RNA, 21 nt, Homo sapiens
aucacauugccagggauuacc

SEQ ID NO: 16439 - RNA, 21 nt, Homo sapiens
ugagaugaagcacuguagcuc

SEQ ID NO: 16440 - RNA, 21 nt, Homo sapiens
uaguagaccguauagcguacg

SEQ ID NO: 16441 - RNA, 22 nt, Homo sapiens
agaucagaaggugauuguggcu

SEQ ID NO: 16442 - RNA, 22 nt, Homo sapiens
gaauguugcucggugaaccccu

SEQ ID NO: 16443 - RNA, 22 nt, Homo sapiens
uucucaaggaggugucguuuau

SEQ ID NO: 16444 - RNA, 23 nt, Homo sapiens
cucuugagggaagcacuuucugu

SEQ ID NO: 16445 - RNA, 22 nt, Homo sapiens
aaacauucgcggugcacuucuu

SEQ ID NO: 16446 - RNA, 20 nt, Homo sapiens
aggaauguuccuucuuugcc

SEQ ID NO: 16447 - RNA, 21 nt, Homo sapiens
gcaggaacuugugagucuccu

SEQ ID NO: 16448 - RNA, 23 nt, Homo sapiens
gagggucuugggagggaugugac

SEQ ID NO: 16449 - RNA, 22 nt, Homo sapiens
uaacacugucugguaaagaugg

SEQ ID NO: 16450 - RNA, 24 nt, Homo sapiens
uuuggcaaugguagaacucacacu

SEQ ID NO: 16451 - RNA, 18 nt, Homo sapiens
ugaggcaguagauugaau

SEQ ID NO: 16452 - RNA, 21 nt, Homo sapiens
cucccacaugcaggguuugca

SEQ ID NO: 16453 - RNA, 22 nt, Homo sapiens
uaacacugucugguaacgaugu

SEQ ID NO: 16454 - RNA, 22 nt, Homo sapiens
uucccuuugucauccuaugccu

SEQ ID NO: 16455 - RNA, 23 nt, Homo sapiens
caaagugcucauagugcagguag

SEQ ID NO: 16456 - RNA, 22 nt, Homo sapiens
uucccuuugucauccuucgccu

SEQ ID NO: 16457 - RNA, 22 nt, Homo sapiens
aagcugccaguugaagaacugu

SEQ ID NO: 16458 - RNA, 20 nt, Homo sapiens
gugcauugcuguugcauugc

SEQ ID NO: 16459 - RNA, 22 nt, Homo sapiens
agaggcuggccgugaugaauuc

SEQ ID NO: 16460 - RNA, 22 nt, Homo sapiens
aguggggaacccuuccaugagg

SEQ ID NO: 16461 - RNA, 22 nt, Homo sapiens
aauccuuugucccugggugaga

SEQ ID NO: 16462 - RNA, 22 nt, Homo sapiens
agacccuggucugcacucuauc

SEQ ID NO: 16463 - RNA, 22 nt, Homo sapiens
gagugccuucuuuuggagcguu

SEQ ID NO: 16464 - RNA, 22 nt, Homo sapiens
aagugccuccuuuuagaguguu

SEQ ID NO: 16465 - RNA, 19 nt, Homo sapiens
ugagcugcuguaccaaaau

SEQ ID NO: 16466 - RNA, 19 nt, Homo sapiens
ugucucugcugggguuucu

SEQ ID NO: 16467 - RNA, 22 nt, Homo sapiens
uggucuaggauuguuggaggag

SEQ ID NO: 16468 - RNA, 25 nt, Homo sapiens
aggggugguguugggacagcuccgu

SEQ ID NO: 16469 - RNA, 20 nt, Homo sapiens
ggggagcuguggaagcagua

SEQ ID NO: 16470 - RNA, 22 nt, Homo sapiens
ccucuuccccuugucucuccag

SEQ ID NO: 16471 - RNA, 22 nt, Homo sapiens
agaaggaaauugaauucauuua

SEQ ID NO: 16472 - RNA, 22 nt, Homo sapiens
ucaaaacugaggggcauuuucu

SEQ ID NO: 16473 - RNA, 20 nt, Homo sapiens
guguguggaaaugcuucugc

SEQ ID NO: 16474 - RNA, 23 nt, Homo sapiens
ucuggcuccgugucuucacuccc

SEQ ID NO: 16475 - RNA, 23 nt, Homo sapiens
cccaguguucagacuaccuguuc

SEQ ID NO: 16476 - RNA, 23 nt, Homo sapiens
cccaguguuuagacuaucuguuc

SEQ ID NO: 16477 - RNA, 23 nt, Homo sapiens
ugugcaaaucuaugcaaaacuga

SEQ ID NO: 16478 - RNA, 22 nt, Homo sapiens
aacaauauccuggugcugagug

SEQ ID NO: 16479 - RNA, 22 nt, Homo sapiens
agagguaguagguugcauaguu

SEQ ID NO: 16480 - RNA, 23 nt, Homo sapiens
ucccccaggugugauucugauuu

SEQ ID NO: 16481 - RNA, 22 nt, Homo sapiens
ccaaaacugcaguuacuuuugc

SEQ ID NO: 16482 - RNA, 24 nt, Homo sapiens
acugggggcuuucgggcucugcgu

SEQ ID NO: 16483 - RNA, 22 nt, Homo sapiens
aaaccuguguuguucaagaguc

SEQ ID NO: 16484 - RNA, 22 nt, Homo sapiens
ucuucucuguuuuggccaugug

SEQ ID NO: 16485 - RNA, 21 nt, Homo sapiens
agagaagaagaucagccugca

SEQ ID NO: 16486 - RNA, 18 nt, Homo sapiens
cagggaggugaaugugau

SEQ ID NO: 16487 - RNA, 23 nt, Homo sapiens
uauggcuuuuuauuccuauguga

SEQ ID NO: 16488 - RNA, 25 nt, Homo sapiens
cccccacaaccgcgcuugacuagcu

SEQ ID NO: 16489 - RNA, 21 nt, Homo sapiens
agggcccccccucaauccugu

SEQ ID NO: 16490 - RNA, 21 nt, Homo sapiens
agggcccccccucaauccugu

SEQ ID NO: 16491 - RNA, 22 nt, Homo sapiens
aagacgggaggaaagaagggag

SEQ ID NO: 16492 - RNA, 18 nt, Homo sapiens
ugcuuccuuucagagggu

SEQ ID NO: 16493 - RNA, 22 nt, Homo sapiens
aucuggagguaagaagcacuuu

SEQ ID NO: 16494 - RNA, 21 nt, Homo sapiens
cacaagguauugguauuaccu

SEQ ID NO: 16495 - RNA, 23 nt, Homo sapiens
uggaagacuagugauuuuguugu

SEQ ID NO: 16496 - RNA, 20 nt, Homo sapiens
guagaggagauggcgcaggg

SEQ ID NO: 16497 - RNA, 22 nt, Homo sapiens
uuuucaacucuaaugggagaga

SEQ ID NO: 16498 - RNA, 22 nt, Homo sapiens
acucggcguggcgucggucgug

SEQ ID NO: 16499 - RNA, 18 nt, Homo sapiens
cagggaggugaaugugau

SEQ ID NO: 16500 - RNA, 23 nt, Homo sapiens
ucuggcuccgugucuucacuccc

SEQ ID NO: 16501 - RNA, 23 nt, Homo sapiens
ucuggcuccgugucuucacuccc

SEQ ID NO: 16502 - RNA, 21 nt, Homo sapiens
cucccacaugcaggguuugca

SEQ ID NO: 16503 - RNA, 22 nt, Homo sapiens
cugugcgugugacagcggcuga

SEQ ID NO: 16504 - RNA, 22 nt, Homo sapiens
agaguugagucuggacgucccg

SEQ ID NO: 16505 - RNA, 22 nt, Homo sapiens
cauugcacuugucucggucuga

SEQ ID NO: 16506 - RNA, 22 nt, Homo sapiens
aaggagcucacagucuauugag

SEQ ID NO: 16507 - RNA, 22 nt, Homo sapiens
uaugugggaugguaaaccgcuu

SEQ ID NO: 16508 - RNA, 22 nt, Homo sapiens
aagauguggaaaaauuggaauc

SEQ ID NO: 16509 - RNA, 21 nt, Homo sapiens
ucuuguguucucuagaucagu

SEQ ID NO: 16510 - RNA, 20 nt, Homo sapiens
accaggaggcugaggccccu

SEQ ID NO: 16511 - RNA, 23 nt, Homo sapiens
aaggagcuuacaaucuagcuggg

SEQ ID NO: 16512 - RNA, 20 nt, Homo sapiens
cggcucugggucugugggga

SEQ ID NO: 16513 - RNA, 22 nt, Homo sapiens
cauugcacuugucucggucuga

SEQ ID NO: 16514 - RNA, 23 nt, Homo sapiens
ucaagagcaauaacgaaaaaugu

SEQ ID NO: 16515 - RNA, 23 nt, Homo sapiens
ucccccaggugugauucugauuu

SEQ ID NO: 16516 - RNA, 21 nt, Homo sapiens
ucacuccucuccucccgucuu

SEQ ID NO: 16517 - RNA, 24 nt, Homo sapiens
uucuccaaaagaaagcacuuucug

SEQ ID NO: 16518 - RNA, 18 nt, Homo sapiens
ugcuuccuuucagagggu

SEQ ID NO: 16519 - RNA, 22 nt, Homo sapiens
aucuggagguaagaagcacuuu

SEQ ID NO: 16520 - RNA, 22 nt, Homo sapiens
aagugccuccuuuuagaguguu

SEQ ID NO: 16521 - RNA, 21 nt, Homo sapiens
agaccuggcccagaccucagc

SEQ ID NO: 16522 - RNA, 24 nt, Homo sapiens
acugggggcuuucgggcucugcgu

SEQ ID NO: 16523 - RNA, 23 nt, Homo sapiens
ugucacucggcucggcccacuac

SEQ ID NO: 16524 - RNA, 21 nt, Homo sapiens
uggaggagaaggaaggugaug

SEQ ID NO: 16525 - RNA, 19 nt, Homo sapiens
auggauaaggcuuuggcuu

SEQ ID NO: 16526 - RNA, 18 nt, Homo sapiens
gucccuguucaggcgcca

SEQ ID NO: 16527 - RNA, 17 nt, Homo sapiens
ucccuguucgggcgcca

SEQ ID NO: 16528 - RNA, 22 nt, Homo sapiens
ucaaaacugaggggcauuuucu

SEQ ID NO: 16529 - RNA, 22 nt, Homo sapiens
uguaacagcaacuccaugugga

SEQ ID NO: 16530 - RNA, 22 nt, Homo sapiens
uuauaaagcaaugagacugauu

SEQ ID NO: 16531 - RNA, 22 nt, Homo sapiens
ugugacagauugauaacugaaa

SEQ ID NO: 16532 - RNA, 22 nt, Homo sapiens
caaaacuggcaauuacuuuugc

SEQ ID NO: 16533 - RNA, 22 nt, Homo sapiens
aaaaacugagacuacuuuugca

SEQ ID NO: 16534 - RNA, 19 nt, Homo sapiens
aaaaacuguaauuacuuuu

SEQ ID NO: 16535 - RNA, 22 nt, Homo sapiens
aaaacuguaauuacuuuuguac

SEQ ID NO: 16536 - RNA, 22 nt, Homo sapiens
ccaaaacugcaguuacuuuugc

SEQ ID NO: 16537 - RNA, 21 nt, Homo sapiens
gaagugugccguggugugucu

SEQ ID NO: 16538 - RNA, 20 nt, Homo sapiens
aggguguuucucucaucucu

SEQ ID NO: 16539 - RNA, 22 nt, Homo sapiens
guggguacggcccagugggggg

SEQ ID NO: 16540 - RNA, 22 nt, Homo sapiens
augguacccuggcauacugagu

SEQ ID NO: 16541 - RNA, 18 nt, Homo sapiens
cgggcguggugguggggg

SEQ ID NO: 16542 - RNA, 17 nt, Homo sapiens
ucccuguucgggcgcca

SEQ ID NO: 16543 - RNA, 24 nt, Homo sapiens
uggcccugacugaagaccagcagu

SEQ ID NO: 16544 - RNA, 22 nt, Homo sapiens
ugcccuguggacucaguucugg

SEQ ID NO: 16545 - RNA, 21 nt, Homo sapiens
cggcggggacggcgauugguc

SEQ ID NO: 16546 - RNA, 22 nt, Homo sapiens
uagguaguuucauguuguuggg

SEQ ID NO: 16547 - RNA, 22 nt, Homo sapiens
uagcuuaucagacugauguuga

SEQ ID NO: 16548 - RNA, 23 nt, Homo sapiens
ucccccaggugugauucugauuu

SEQ ID NO: 16549 - RNA, 22 nt, Homo sapiens
aauugcacuuuagcaaugguga

SEQ ID NO: 16550 - RNA, 21 nt, Homo sapiens
aaaacggugagauuuuguuuu

SEQ ID NO: 16551 - RNA, 21 nt, Homo sapiens
uagauaaaauauugguaccug

SEQ ID NO: 16552 - RNA, 24 nt, Homo sapiens
acugggggcuuucgggcucugcgu

SEQ ID NO: 16553 - RNA, 22 nt, Homo sapiens
aggcggggcgccgcgggaccgc

SEQ ID NO: 16554 - RNA, 22 nt, Homo sapiens
ugcggggcuagggcuaacagca

SEQ ID NO: 16555 - RNA, 21 nt, Homo sapiens
aaggcagggcccccgcucccc

SEQ ID NO: 16556 - RNA, 21 nt, Homo sapiens
ccgucgccgccacccgagccg

SEQ ID NO: 16557 - RNA, 21 nt, Homo sapiens
ccccaccuccucucuccucag

SEQ ID NO: 16558 - RNA, 22 nt, Homo sapiens
ugagccccugugccgcccccag

SEQ ID NO: 16559 - RNA, 22 nt, Homo sapiens
ucggccugaccacccaccccac

SEQ ID NO: 16560 - RNA, 22 nt, Homo sapiens
acgcccuucccccccuucuuca

SEQ ID NO: 16561 - RNA, 22 nt, Homo sapiens
uggcagugucuuagcugguugu

SEQ ID NO: 16562 - RNA, 23 nt, Homo sapiens
aggcaguguaguuagcugauugc

SEQ ID NO: 16563 - RNA, 22 nt, Homo sapiens
uggcaguguauuguuagcuggu

SEQ ID NO: 16564 - RNA, 22 nt, Homo sapiens
aggcaguguauuguuagcuggc

SEQ ID NO: 16565 - RNA, 19 nt, Homo sapiens
ugggcguaucuguaugcua

SEQ ID NO: 16566 - RNA, 25 nt, Homo sapiens
aggggugguguugggacagcuccgu

SEQ ID NO: 16567 - RNA, 20 nt, Homo sapiens
cggcucugggucugugggga

SEQ ID NO: 16568 - RNA, 23 nt, Homo sapiens
ucugcucauaccccaugguuucu

SEQ ID NO: 16569 - RNA, 20 nt, Homo sapiens
ggggagcuguggaagcagua

SEQ ID NO: 16570 - RNA, 20 nt, Homo sapiens
ggggagcuguggaagcagua

SEQ ID NO: 16571 - RNA, 22 nt, Homo sapiens
acaggugagguucuugggagcc

SEQ ID NO: 16572 - RNA, 22 nt, Homo sapiens
uaaugccccuaaaaauccuuau

SEQ ID NO: 16573 - RNA, 22 nt, Homo sapiens
auauaauacaaccugcuaagug

SEQ ID NO: 16574 - RNA, 21 nt, Homo sapiens
uugaaaggcuauuucuugguc

SEQ ID NO: 16575 - RNA, 22 nt, Homo sapiens
caaccuggaggacuccaugcug

SEQ ID NO: 16576 - RNA, 22 nt, Homo sapiens
cgaaaacagcaauuaccuuugc

SEQ ID NO: 16577 - RNA, 22 nt, Homo sapiens
agacuucccauuugaagguggc

SEQ ID NO: 16578 - RNA, 24 nt, Homo sapiens
gaccuggacauguuugugcccagu

SEQ ID NO: 16579 - RNA, 23 nt, Homo sapiens
aucccuugcaggggcuguugggu

SEQ ID NO: 16580 - RNA, 21 nt, Homo sapiens
cacaagguauugguauuaccu

SEQ ID NO: 16581 - RNA, 20 nt, Homo sapiens
ggggagcuguggaagcagua

SEQ ID NO: 16582 - RNA, 20 nt, Homo sapiens
ucugcaggguuugcuuugag

SEQ ID NO: 16583 - RNA, 22 nt, Homo sapiens
uaacacugucugguaaagaugg

SEQ ID NO: 16584 - RNA, 22 nt, Homo sapiens
ugcccuguggacucaguucugg

SEQ ID NO: 16585 - RNA, 22 nt, Homo sapiens
cgcaggggccgggugcucaccg

SEQ ID NO: 16586 - RNA, 22 nt, Homo sapiens
aacuggccuacaaagucccagu

SEQ ID NO: 16587 - RNA, 22 nt, Homo sapiens
aacuggcccucaaagucccgcu

SEQ ID NO: 16588 - RNA, 22 nt, Homo sapiens
uagguaguuucauguuguuggg

SEQ ID NO: 16589 - RNA, 22 nt, Homo sapiens
uaacacugucugguaacgaugu

SEQ ID NO: 16590 - RNA, 22 nt, Homo sapiens
acacagggcuguugugaagacu

SEQ ID NO: 16591 - RNA, 22 nt, Homo sapiens
uguaaacauccucgacuggaag

SEQ ID NO: 16592 - RNA, 22 nt, Homo sapiens
uguaaacauccccgacuggaag

SEQ ID NO: 16593 - RNA, 22 nt, Homo sapiens
uguaaacauccuugacuggaag

SEQ ID NO: 16594 - RNA, 18 nt, Homo sapiens
uucacagggaggugucau

SEQ ID NO: 16595 - RNA, 21 nt, Homo sapiens
aagccugcccggcuccucggg

SEQ ID NO: 16596 - RNA, 23 nt, Homo sapiens
acuugggcacugaaacaaugucc

SEQ ID NO: 16597 - RNA, 22 nt, Homo sapiens
ugcggggcuagggcuaacagca

SEQ ID NO: 16598 - RNA, 20 nt, Homo sapiens
cggcucugggucugugggga

SEQ ID NO: 16599 - RNA, 22 nt, Homo sapiens
cugcccuggcccgagggaccga

SEQ ID NO: 16600 - RNA, 21 nt, Homo sapiens
ccccaccuccucucuccucag

SEQ ID NO: 16601 - RNA, 18 nt, Homo sapiens
aucccaccucugccacca

SEQ ID NO: 16602 - RNA, 21 nt, Homo sapiens
gcccuccgcccgugcaccccg

SEQ ID NO: 16603 - RNA, 22 nt, Homo sapiens
ucagugcacuacagaacuuugu

SEQ ID NO: 16604 - RNA, 22 nt, Homo sapiens
ucagugcaucacagaacuuugu

SEQ ID NO: 16605 - RNA, 23 nt, Homo sapiens
ucuggcuccgugucuucacuccc

SEQ ID NO: 16606 - RNA, 21 nt, Homo sapiens
ucagugcaugacagaacuugg

SEQ ID NO: 16607 - RNA, 22 nt, Homo sapiens
uggagagaaaggcaguuccuga

SEQ ID NO: 16608 - RNA, 22 nt, Homo sapiens
gugaaauguuuaggaccacuag

SEQ ID NO: 16609 - RNA, 22 nt, Homo sapiens
uccuucauuccaccggagucug

SEQ ID NO: 16610 - RNA, 22 nt, Homo sapiens
uguaaacauccucgacuggaag

SEQ ID NO: 16611 - RNA, 22 nt, Homo sapiens
uguaaacauccccgacuggaag

SEQ ID NO: 16612 - RNA, 22 nt, Homo sapiens
uguaaacauccuugacuggaag

SEQ ID NO: 16613 - RNA, 22 nt, Homo sapiens
uaaugccccuaaaaauccuuau

SEQ ID NO: 16614 - RNA, 23 nt, Homo sapiens
ucuuggaguaggucauugggugg

SEQ ID NO: 16615 - RNA, 20 nt, Homo sapiens
cugcaaagggaagcccuuuc

SEQ ID NO: 16616 - RNA, 20 nt, Homo sapiens
cugcaaagggaagcccuuuc

SEQ ID NO: 16617 - RNA, 22 nt, Homo sapiens
ccucccacacccaaggcuugca

SEQ ID NO: 16618 - RNA, 20 nt, Homo sapiens
cggcucugggucugugggga

SEQ ID NO: 16619 - RNA, 21 nt, Homo sapiens
ccgucgccgccacccgagccg

SEQ ID NO: 16620 - RNA, 23 nt, Homo sapiens
ccugcagcgacuugauggcuucc

SEQ ID NO: 16621 - RNA, 20 nt, Homo sapiens
ucugcaggguuugcuuugag

SEQ ID NO: 16622 - RNA, 18 nt, Homo sapiens
ucagcuggcccucauuuc

SEQ ID NO: 16623 - RNA, 21 nt, Homo sapiens
cggcggggacggcgauugguc

SEQ ID NO: 16624 - RNA, 23 nt, Homo sapiens
aaugacacgaucacucccguuga

SEQ ID NO: 16625 - RNA, 23 nt, Homo sapiens
ugugcuugcucgucccgcccgca

SEQ ID NO: 16626 - RNA, 24 nt, Homo sapiens
ugccugggucucuggccugcgcgu

SEQ ID NO: 16627 - RNA, 22 nt, Homo sapiens
aggcggggcgccgcgggaccgc

SEQ ID NO: 16628 - RNA, 22 nt, Homo sapiens
ugcggggcuagggcuaacagca

SEQ ID NO: 16629 - RNA, 22 nt, Homo sapiens
aggcagcgggguguaguggaua

SEQ ID NO: 16630 - RNA, 20 nt, Homo sapiens
uaaggcacgcggugaaugcc

SEQ ID NO: 16631 - RNA, 22 nt, Homo sapiens
agaaggaaauugaauucauuua

SEQ ID NO: 16632 - RNA, 22 nt, Homo sapiens
uucauucggcuguccagaugua

SEQ ID NO: 16633 - RNA, 20 nt, Homo sapiens
ccuccugcccuccuugcugu

SEQ ID NO: 16634 - RNA, 22 nt, Homo sapiens
uccuucauuccaccggagucug

SEQ ID NO: 16635 - RNA, 20 nt, Homo sapiens
uguuuugauaacaguaaugu

SEQ ID NO: 16636 - RNA, 22 nt, Homo sapiens
acagcaggcacagacaggcagu

SEQ ID NO: 16637 - RNA, 21 nt, Homo sapiens
uucacaguggcuaaguuccgc

SEQ ID NO: 16638 - RNA, 21 nt, Homo sapiens
uucacaguggcuaaguucugc

SEQ ID NO: 16639 - RNA, 22 nt, Homo sapiens
uuauaaagcaaugagacugauu

SEQ ID NO: 16640 - RNA, 22 nt, Homo sapiens
gccugcugggguggaaccuggu

SEQ ID NO: 16641 - RNA, 23 nt, Homo sapiens
gaagugcuucgauuuuggggugu

SEQ ID NO: 16642 - RNA, 22 nt, Homo sapiens
uaugugccuuuggacuacaucg

SEQ ID NO: 16643 - RNA, 21 nt, Homo sapiens
uaaggcacccuucugaguaga

SEQ ID NO: 16644 - RNA, 22 nt, Homo sapiens
agucauuggaggguuugagcag

SEQ ID NO: 16645 - RNA, 21 nt, Homo sapiens
uggaggagaaggaaggugaug

SEQ ID NO: 16646 - RNA, 21 nt, Homo sapiens
uacucaaaaagcugucaguca

SEQ ID NO: 16647 - RNA, 22 nt, Homo sapiens
ugugcgcagggagaccucuccc

SEQ ID NO: 16648 - RNA, 21 nt, Homo sapiens
ccccaccuccucucuccucag

SEQ ID NO: 16649 - RNA, 22 nt, Homo sapiens
acaggugagguucuugggagcc

SEQ ID NO: 16650 - RNA, 23 nt, Homo sapiens
ucuggcuccgugucuucacuccc

SEQ ID NO: 16651 - RNA, 21 nt, Homo sapiens
aacaggugacugguuagacaa

SEQ ID NO: 16652 - RNA, 20 nt, Homo sapiens
uaaagagcccuguggagaca

SEQ ID NO: 16653 - RNA, 22 nt, Homo sapiens
uauggcacugguagaauucacu

SEQ ID NO: 16654 - RNA, 23 nt, Homo sapiens
aggaccugcgggacaagauucuu

SEQ ID NO: 16655 - RNA, 22 nt, Homo sapiens
ugauugguacgucuguggguag

SEQ ID NO: 16656 - RNA, 19 nt, Homo sapiens
aggcacggugucagcaggc

SEQ ID NO: 16657 - RNA, 20 nt, Homo sapiens
cggcucugggucugugggga

SEQ ID NO: 16658 - RNA, 21 nt, Homo sapiens
uggaggagaaggaaggugaug

SEQ ID NO: 16659 - RNA, 17 nt, Homo sapiens
ucgccuccuccucuccc

SEQ ID NO: 16660 - RNA, 21 nt, Homo sapiens
ugcaggaccaagaugagcccu

SEQ ID NO: 16661 - RNA, 22 nt, Homo sapiens
acucggcguggcgucggucgug

SEQ ID NO: 16662 - RNA, 22 nt, Homo sapiens
cucggcgcggggcgcgggcucc

SEQ ID NO: 16663 - RNA, 21 nt, Homo sapiens
gcccuccgcccgugcaccccg

SEQ ID NO: 16664 - RNA, 23 nt, Homo sapiens
ucuggcuccgugucuucacuccc

SEQ ID NO: 16665 - RNA, 21 nt, Homo sapiens
cggcggggacggcgauugguc

SEQ ID NO: 16666 - RNA, 22 nt, Homo sapiens
cccugugcccggcccacuucug

SEQ ID NO: 16667 - RNA, 22 nt, Homo sapiens
cauugcacuugucucggucuga

SEQ ID NO: 16668 - RNA, 22 nt, Homo sapiens
ggggguccccggugcucggauc

SEQ ID NO: 16669 - RNA, 25 nt, Homo sapiens
ggcggagggaaguagguccguuggu

SEQ ID NO: 16670 - RNA, 22 nt, Homo sapiens
aggcggggcgccgcgggaccgc

SEQ ID NO: 16671 - RNA, 22 nt, Homo sapiens
ugcggggcuagggcuaacagca

SEQ ID NO: 16672 - RNA, 21 nt, Homo sapiens
cgcgggugcuuacugacccuu

SEQ ID NO: 16673 - RNA, 23 nt, Homo sapiens
guccaguuuucccaggaaucccu

SEQ ID NO: 16674 - RNA, 23 nt, Homo sapiens
ucuggcuccgugucuucacuccc

SEQ ID NO: 16675 - RNA, 22 nt, Homo sapiens
uguaaacauccuacacucagcu

SEQ ID NO: 16676 - RNA, 23 nt, Homo sapiens
ugaggggcagagagcgagacuuu

SEQ ID NO: 16677 - RNA, 22 nt, Homo sapiens
ccucccacacccaaggcuugca

SEQ ID NO: 16678 - RNA, 21 nt, Homo sapiens
ucccacguuguggcccagcag

SEQ ID NO: 16679 - RNA, 23 nt, Homo sapiens
cgggucggaguuagcucaagcgg

SEQ ID NO: 16680 - RNA, 22 nt, Homo sapiens
caaagugccucccuuuagagug

SEQ ID NO: 16681 - RNA, 27 nt, Homo sapiens
accuucuuguauaagcacugugcuaaa

SEQ ID NO: 16682 - RNA, 23 nt, Homo sapiens
uggaguccaggaaucugcauuuu

SEQ ID NO: 16683 - RNA, 22 nt, Homo sapiens
uucuggaauucugugugaggga

SEQ ID NO: 16684 - RNA, 22 nt, Homo sapiens
aagcccuuaccccaaaaagcau

SEQ ID NO: 16685 - RNA, 23 nt, Homo sapiens
ucuggcuccgugucuucacuccc

SEQ ID NO: 16686 - RNA, 22 nt, Homo sapiens
uuuugcaauauguuccugaaua

SEQ ID NO: 16687 - RNA, 21 nt, Homo sapiens
cuucuugugcucuaggauugu

SEQ ID NO: 16688 - RNA, 22 nt, Homo sapiens
gucccucuccaaaugugucuug

SEQ ID NO: 16689 - RNA, 22 nt, Homo sapiens
ugcggggcuagggcuaacagca

SEQ ID NO: 16690 - RNA, 18 nt, Homo sapiens
ucagcuggcccucauuuc

SEQ ID NO: 16691 - RNA, 23 nt, Homo sapiens
uaaggugcaucuagugcagauag

SEQ ID NO: 16692 - RNA, 21 nt, Homo sapiens
cggcggggacggcgauugguc

SEQ ID NO: 16693 - RNA, 22 nt, Homo sapiens
aagcugccaguugaagaacugu

SEQ ID NO: 16694 - RNA, 21 nt, Homo sapiens
aggggugcuaucugugauuga

SEQ ID NO: 16695 - RNA, 22 nt, Homo sapiens
ugagaaccacgucugcucugag

SEQ ID NO: 16696 - RNA, 22 nt, Homo sapiens
aggcggggcgccgcgggaccgc

SEQ ID NO: 16697 - RNA, 23 nt, Homo sapiens
uggugcggagagggcccacagug

SEQ ID NO: 16698 - RNA, 22 nt, Homo sapiens
cugaagcucagagggcucugau

SEQ ID NO: 16699 - RNA, 23 nt, Homo sapiens
uuauugcuuaagaauacgcguag

SEQ ID NO: 16700 - RNA, 22 nt, Homo sapiens
ucagugcacuacagaacuuugu

SEQ ID NO: 16701 - RNA, 22 nt, Homo sapiens
uauacaagggcagacucucucu

SEQ ID NO: 16702 - RNA, 21 nt, Homo sapiens
aucauagaggaaaauccacgu

SEQ ID NO: 16703 - RNA, 22 nt, Homo sapiens
uauacaagggcaagcucucugu

SEQ ID NO: 16704 - RNA, 20 nt, Homo sapiens
auuccuagaaauuguucaua

SEQ ID NO: 16705 - RNA, 23 nt, Homo sapiens
caaagcgcuucucuuuagagugu

SEQ ID NO: 16706 - RNA, 21 nt, Homo sapiens
cuccagagggaaguacuuucu

SEQ ID NO: 16707 - RNA, 21 nt, Homo sapiens
cuccagagggaugcacuuucu

SEQ ID NO: 16708 - RNA, 22 nt, Homo sapiens
acuuguaugcuagcucagguag

SEQ ID NO: 16709 - RNA, 22 nt, Homo sapiens
aaauuauuguacaucggaugag

SEQ ID NO: 16710 - RNA, 22 nt, Homo sapiens
uggagugugacaaugguguuug

SEQ ID NO: 16711 - RNA, 17 nt, Homo sapiens
ucgccuccuccucuccc

SEQ ID NO: 16712 - RNA, 20 nt, Homo sapiens
ucguuugccuuuuucugcuu

SEQ ID NO: 16713 - RNA, 21 nt, Homo sapiens
cggcggggacggcgauugguc

SEQ ID NO: 16714 - RNA, 22 nt, Homo sapiens
cauugcacuugucucggucuga

SEQ ID NO: 16715 - RNA, 22 nt, Homo sapiens
uccgagccugggucucccucuu

SEQ ID NO: 16716 - RNA, 22 nt, Homo sapiens
ggggguccccggugcucggauc

SEQ ID NO: 16717 - RNA, 25 nt, Homo sapiens
ggcggagggaaguagguccguuggu

SEQ ID NO: 16718 - RNA, 22 nt, Homo sapiens
aggcggggcgccgcgggaccgc

SEQ ID NO: 16719 - RNA, 20 nt, Homo sapiens
accaggaggcugaggccccu

SEQ ID NO: 16720 - RNA, 22 nt, Homo sapiens
ugcggggcuagggcuaacagca

SEQ ID NO: 16721 - RNA, 23 nt, Homo sapiens
cgggucggaguuagcucaagcgg

SEQ ID NO: 16722 - RNA, 17 nt, Homo sapiens
ucccaccgcugccaccc

SEQ ID NO: 16723 - RNA, 21 nt, Homo sapiens
aggggugcuaucugugauuga

SEQ ID NO: 16724 - RNA, 23 nt, Homo sapiens
uagcagcgggaacaguucugcag

SEQ ID NO: 16725 - RNA, 23 nt, Homo sapiens
aucgcugcgguugcgagcgcugu

SEQ ID NO: 16726 - RNA, 23 nt, Homo sapiens
uggugcggagagggcccacagug

SEQ ID NO: 16727 - RNA, 17 nt, Homo sapiens
ucucgcuggggccucca

SEQ ID NO: 16728 - RNA, 22 nt, Homo sapiens
ugcggggcuagggcuaacagca

SEQ ID NO: 16729 - RNA, 21 nt, Homo sapiens
uggaggagaaggaaggugaug

SEQ ID NO: 16730 - RNA, 20 nt, Homo sapiens
ggggagcuguggaagcagua

SEQ ID NO: 16731 - RNA, 21 nt, Homo sapiens
uacaguacugugauaacugaa

SEQ ID NO: 16732 - RNA, 23 nt, Homo sapiens
ccugcagcgacuugauggcuucc

SEQ ID NO: 16733 - RNA, 21 nt, Homo sapiens
gugccagcugcagugggggag

SEQ ID NO: 16734 - RNA, 20 nt, Homo sapiens
ucugcaggguuugcuuugag

SEQ ID NO: 16735 - RNA, 18 nt, Homo sapiens
ucagcuggcccucauuuc

SEQ ID NO: 16736 - RNA, 18 nt, Homo sapiens
ucagcuggcccucauuuc

SEQ ID NO: 16737 - RNA, 20 nt, Homo sapiens
ugagcccuguccucccgcag

SEQ ID NO: 16738 - RNA, 22 nt, Homo sapiens
uggagagaaaggcaguuccuga

SEQ ID NO: 16739 - RNA, 23 nt, Homo sapiens
caacggaaucccaaaagcagcug

SEQ ID NO: 16740 - RNA, 23 nt, Homo sapiens
uaauacugccggguaaugaugga

SEQ ID NO: 16741 - RNA, 24 nt, Homo sapiens
aauccuuggaaccuaggugugagu

SEQ ID NO: 16742 - RNA, 21 nt, Homo sapiens
auccuugcuaucugggugcua

SEQ ID NO: 16743 - RNA, 23 nt, Homo sapiens
agugccugagggaguaagagccc

SEQ ID NO: 16744 - RNA, 17 nt, Homo sapiens
ucucgcuggggccucca

SEQ ID NO: 16745 - RNA, 22 nt, Homo sapiens
acuccagccccacagccucagc

SEQ ID NO: 16746 - RNA, 20 nt, Homo sapiens
uaaagagcccuguggagaca

SEQ ID NO: 16747 - RNA, 22 nt, Homo sapiens
uuugaggcuacagugagaugug

SEQ ID NO: 16748 - RNA, 22 nt, Homo sapiens
cagugcaaugaugaaagggcau

SEQ ID NO: 16749 - RNA, 21 nt, Homo sapiens
gcccuccgcccgugcaccccg

SEQ ID NO: 16750 - RNA, 21 nt, Homo sapiens
cucccacaugcaggguuugca

SEQ ID NO: 16751 - RNA, 20 nt, Homo sapiens
ccccagggcgacgcggcggg

SEQ ID NO: 16752 - RNA, 22 nt, Homo sapiens
gaggguuggguggaggcucucc

SEQ ID NO: 16753 - RNA, 21 nt, Homo sapiens
agggcccccccucaauccugu

SEQ ID NO: 16754 - RNA, 22 nt, Homo sapiens
uaugugggaugguaaaccgcuu

SEQ ID NO: 16755 - RNA, 22 nt, Homo sapiens
uaaugccccuaaaaauccuuau

SEQ ID NO: 16756 - RNA, 18 nt, Homo sapiens
ugcuuccuuucagagggu

SEQ ID NO: 16757 - RNA, 22 nt, Homo sapiens
aucuggagguaagaagcacuuu

SEQ ID NO: 16758 - RNA, 19 nt, Homo sapiens
ugagcugcuguaccaaaau

SEQ ID NO: 16759 - RNA, 25 nt, Homo sapiens
aggggugguguugggacagcuccgu

SEQ ID NO: 16760 - RNA, 23 nt, Homo sapiens
aggaagcccuggaggggcuggag

SEQ ID NO: 16761 - RNA, 22 nt, Homo sapiens
caaagugccucccuuuagagug

SEQ ID NO: 16762 - RNA, 20 nt, Homo sapiens
ggggagcuguggaagcagua

SEQ ID NO: 16763 - RNA, 21 nt, Homo sapiens
gugccagcugcagugggggag

SEQ ID NO: 16764 - RNA, 20 nt, Homo sapiens
ucugcaggguuugcuuugag

SEQ ID NO: 16765 - RNA, 20 nt, Homo sapiens
ucugcaggguuugcuuugag

SEQ ID NO: 16766 - RNA, 21 nt, Homo sapiens
ccccaccuccucucuccucag

SEQ ID NO: 16767 - RNA, 20 nt, Homo sapiens
ugagcccuguccucccgcag

SEQ ID NO: 16768 - RNA, 21 nt, Homo sapiens
uccuucugcuccgucccccag

SEQ ID NO: 16769 - RNA, 21 nt, Homo sapiens
cauaaaguagaaagcacuacu

SEQ ID NO: 16770 - RNA, 23 nt, Homo sapiens
ucuggcuccgugucuucacuccc

SEQ ID NO: 16771 - RNA, 23 nt, Homo sapiens
uaaggugcaucuagugcagauag

SEQ ID NO: 16772 - RNA, 22 nt, Homo sapiens
aguggggaacccuuccaugagg

SEQ ID NO: 16773 - RNA, 21 nt, Homo sapiens
aagccugcccggcuccucggg

SEQ ID NO: 16774 - RNA, 21 nt, Homo sapiens
guggcugcacucacuuccuuc

SEQ ID NO: 16775 - RNA, 20 nt, Homo sapiens
ggggagcuguggaagcagua

SEQ ID NO: 16776 - RNA, 21 nt, Homo sapiens
cccggagccaggaugcagcuc

SEQ ID NO: 16777 - RNA, 18 nt, Homo sapiens
aucccaccucugccacca

SEQ ID NO: 16778 - RNA, 22 nt, Homo sapiens
acucggcguggcgucggucgug

SEQ ID NO: 16779 - RNA, 22 nt, Homo sapiens
cucggcgcggggcgcgggcucc

SEQ ID NO: 16780 - RNA, 23 nt, Homo sapiens
cggcccgggcugcugcuguuccu

SEQ ID NO: 16781 - RNA, 21 nt, Homo sapiens
uccugcgcgucccagaugccc

SEQ ID NO: 16782 - RNA, 22 nt, Homo sapiens
cgcaggggccgggugcucaccg

SEQ ID NO: 16783 - RNA, 22 nt, Homo sapiens
cauugcacuugucucggucuga

SEQ ID NO: 16784 - RNA, 19 nt, Homo sapiens
ugagcugcuguaccaaaau

SEQ ID NO: 16785 - RNA, 25 nt, Homo sapiens
aggggugguguugggacagcuccgu

SEQ ID NO: 16786 - RNA, 23 nt, Homo sapiens
cucucaccacugcccucccacag

SEQ ID NO: 16787 - RNA, 22 nt, Homo sapiens
ccucuuccccuugucucuccag

SEQ ID NO: 16788 - RNA, 22 nt, Homo sapiens
uucuggaauucugugugaggga

SEQ ID NO: 16789 - RNA, 22 nt, Homo sapiens
aagcccuuaccccaaaaagcau

SEQ ID NO: 16790 - RNA, 18 nt, Homo sapiens
uugagaaggaggcugcug

SEQ ID NO: 16791 - RNA, 22 nt, Homo sapiens
uauguaauaugguccacaucuu

SEQ ID NO: 16792 - RNA, 23 nt, Homo sapiens
uaauccuugcuaccugggugaga

SEQ ID NO: 16793 - RNA, 21 nt, Homo sapiens
auccuugcuaucugggugcua

SEQ ID NO: 16794 - RNA, 22 nt, Homo sapiens
uggugggcacagaaucuggacu

SEQ ID NO: 16795 - RNA, 19 nt, Homo sapiens
agguugacauacguuuccc

SEQ ID NO: 16796 - RNA, 22 nt, Homo sapiens
cugcccuggcccgagggaccga

SEQ ID NO: 16797 - RNA, 22 nt, Homo sapiens
uggugguuuacaaaguaauuca

SEQ ID NO: 16798 - RNA, 17 nt, Homo sapiens
ucgccuccuccucuccc

SEQ ID NO: 16799 - RNA, 21 nt, Homo sapiens
cggcggggacggcgauugguc

SEQ ID NO: 16800 - RNA, 21 nt, Homo sapiens
gccccugggccuauccuagaa

SEQ ID NO: 16801 - RNA, 22 nt, Homo sapiens
uggugggcacagaaucuggacu

SEQ ID NO: 16802 - RNA, 19 nt, Homo sapiens
aggcugcggaauucaggac

SEQ ID NO: 16803 - RNA, 25 nt, Homo sapiens
aggggugguguugggacagcuccgu

SEQ ID NO: 16804 - RNA, 22 nt, Homo sapiens
uggugggccgcagaacaugugc

SEQ ID NO: 16805 - RNA, 22 nt, Homo sapiens
aggcggggcgccgcgggaccgc

SEQ ID NO: 16806 - RNA, 23 nt, Homo sapiens
uggugcggagagggcccacagug

SEQ ID NO: 16807 - RNA, 22 nt, Homo sapiens
ugcggggcuagggcuaacagca

SEQ ID NO: 16808 - RNA, 21 nt, Homo sapiens
uggaggagaaggaaggugaug

SEQ ID NO: 16809 - RNA, 21 nt, Homo sapiens
cgcgggugcuuacugacccuu

SEQ ID NO: 16810 - RNA, 19 nt, Homo sapiens
gggcgccugugaucccaac

SEQ ID NO: 16811 - RNA, 23 nt, Homo sapiens
aucgcugcgguugcgagcgcugu

SEQ ID NO: 16812 - RNA, 22 nt, Homo sapiens
ugcggggcuagggcuaacagca

SEQ ID NO: 16813 - RNA, 20 nt, Homo sapiens
cggcucugggucugugggga

SEQ ID NO: 16814 - RNA, 21 nt, Homo sapiens
uaaagugcugacagugcagau

SEQ ID NO: 16815 - RNA, 21 nt, Homo sapiens
uugcucacuguucuucccuag

SEQ ID NO: 16816 - RNA, 18 nt, Homo sapiens
cgggcguggugguggggg

SEQ ID NO: 16817 - RNA, 22 nt, Homo sapiens
gcccgcguguggagccaggugu

SEQ ID NO: 16818 - RNA, 18 nt, Homo sapiens
uccagugcccuccucucc

SEQ ID NO: 16819 - RNA, 21 nt, Homo sapiens
cggcggggacggcgauugguc

SEQ ID NO: 16820 - RNA, 22 nt, Homo sapiens
cgcaggggccgggugcucaccg

SEQ ID NO: 16821 - RNA, 19 nt, Homo sapiens
gagccaguuggacaggagc

SEQ ID NO: 16822 - RNA, 21 nt, Homo sapiens
guggcugcacucacuuccuuc

SEQ ID NO: 16823 - RNA, 22 nt, Homo sapiens
aggcggggcgccgcgggaccgc

SEQ ID NO: 16824 - RNA, 22 nt, Homo sapiens
ugcggggcuagggcuaacagca

SEQ ID NO: 16825 - RNA, 22 nt, Homo sapiens
ugcggggcuagggcuaacagca

SEQ ID NO: 16826 - RNA, 23 nt, Homo sapiens
ucugcucauaccccaugguuucu

SEQ ID NO: 16827 - RNA, 22 nt, Homo sapiens
cacuggcuccuuucuggguaga

SEQ ID NO: 16828 - RNA, 22 nt, Homo sapiens
cagugcaauguuaaaagggcau

SEQ ID NO: 16829 - RNA, 22 nt, Homo sapiens
ucagugcacuacagaacuuugu

SEQ ID NO: 16830 - RNA, 22 nt, Homo sapiens
ucagugcaucacagaacuuugu

SEQ ID NO: 16831 - RNA, 21 nt, Homo sapiens
ucagugcaugacagaacuugg

SEQ ID NO: 16832 - RNA, 23 nt, Homo sapiens
aacauucaacgcugucggugagu

SEQ ID NO: 16833 - RNA, 23 nt, Homo sapiens
aacauucauugcugucggugggu

SEQ ID NO: 16834 - RNA, 22 nt, Homo sapiens
aacauucaaccugucggugagu

SEQ ID NO: 16835 - RNA, 23 nt, Homo sapiens
aacauucauuguugucggugggu

SEQ ID NO: 16836 - RNA, 21 nt, Homo sapiens
aucacauugccagggauuucc

SEQ ID NO: 16837 - RNA, 21 nt, Homo sapiens
aucacauugccagggauuacc

SEQ ID NO: 16838 - RNA, 22 nt, Homo sapiens
cuggcccucucugcccuuccgu

SEQ ID NO: 16839 - RNA, 21 nt, Homo sapiens
gugcauuguaguugcauugca

SEQ ID NO: 16840 - RNA, 20 nt, Homo sapiens
gugcauugcuguugcauugc

SEQ ID NO: 16841 - RNA, 21 nt, Homo sapiens
guucaaauccagaucuauaac

SEQ ID NO: 16842 - RNA, 21 nt, Homo sapiens
uggaggagaaggaaggugaug

SEQ ID NO: 16843 - RNA, 20 nt, Homo sapiens
ggggagcuguggaagcagua

SEQ ID NO: 16844 - RNA, 22 nt, Homo sapiens
acucggcguggcgucggucgug

SEQ ID NO: 16845 - RNA, 19 nt, Homo sapiens
gaugaugcugcugaugcug

SEQ ID NO: 16846 - RNA, 22 nt, Homo sapiens
cauugcacuugucucggucuga

SEQ ID NO: 16847 - RNA, 22 nt, Homo sapiens
uggcagugucuuagcugguugu

SEQ ID NO: 16848 - RNA, 22 nt, Homo sapiens
uacccauugcauaucggaguug

SEQ ID NO: 16849 - RNA, 22 nt, Homo sapiens
gguggcccggccgugccugagg

SEQ ID NO: 16850 - RNA, 20 nt, Homo sapiens
accaggaggcugaggccccu

SEQ ID NO: 16851 - RNA, 20 nt, Homo sapiens
guccgcucggcgguggccca

SEQ ID NO: 16852 - RNA, 26 nt, Homo sapiens
aaguaguugguuuguaugagaugguu

SEQ ID NO: 16853 - RNA, 22 nt, Homo sapiens
cagugguuuuacccuaugguag

SEQ ID NO: 16854 - RNA, 21 nt, Homo sapiens
gugcauuguaguugcauugca

SEQ ID NO: 16855 - RNA, 20 nt, Homo sapiens
gugcauugcuguugcauugc

SEQ ID NO: 16856 - RNA, 22 nt, Homo sapiens
ugaaacauacacgggaaaccuc

SEQ ID NO: 16857 - RNA, 22 nt, Homo sapiens
gagugccuucuuuuggagcguu

SEQ ID NO: 16858 - RNA, 22 nt, Homo sapiens
aagugccuccuuuuagaguguu

SEQ ID NO: 16859 - RNA, 22 nt, Homo sapiens
ugagaaccacgucugcucugag

SEQ ID NO: 16860 - RNA, 21 nt, Homo sapiens
aaacuacugaaaaucaaagau

SEQ ID NO: 16861 - RNA, 23 nt, Homo sapiens
ucuuugguuaucuagcuguauga

SEQ ID NO: 16862 - RNA, 21 nt, Homo sapiens
ucguggccuggucuccauuau

SEQ ID NO: 16863 - RNA, 22 nt, Homo sapiens
cagugcaaugaugaaagggcau

SEQ ID NO: 16864 - RNA, 22 nt, Homo sapiens
uggagagaaaggcaguuccuga

SEQ ID NO: 16865 - RNA, 21 nt, Homo sapiens
cggcggggacggcgauugguc

SEQ ID NO: 16866 - RNA, 21 nt, Homo sapiens
gguuugguccuagccuuucua

SEQ ID NO: 16867 - RNA, 22 nt, Homo sapiens
uccagcaucagugauuuuguug

SEQ ID NO: 16868 - RNA, 23 nt, Homo sapiens
agguuacccgagcaacuuugcau

SEQ ID NO: 16869 - RNA, 23 nt, Homo sapiens
aucgcugcgguugcgagcgcugu

SEQ ID NO: 16870 - RNA, 22 nt, Homo sapiens
aggcggggcgccgcgggaccgc

SEQ ID NO: 16871 - RNA, 23 nt, Homo sapiens
cgggucggaguuagcucaagcgg

SEQ ID NO: 16872 - RNA, 22 nt, Homo sapiens
ugagccccugugccgcccccag

SEQ ID NO: 16873 - RNA, 18 nt, Homo sapiens
gucccuguucaggcgcca

SEQ ID NO: 16874 - RNA, 25 nt, Homo sapiens
cccccacaaccgcgcuugacuagcu

SEQ ID NO: 16875 - RNA, 22 nt, Homo sapiens
aaaucucugcaggcaaauguga

SEQ ID NO: 16876 - RNA, 22 nt, Homo sapiens
ugucaguuugucaaauacccca

SEQ ID NO: 16877 - RNA, 22 nt, Homo sapiens
uggcucaguucagcaggaacag

SEQ ID NO: 16878 - RNA, 21 nt, Homo sapiens
uucacaguggcuaaguuccgc

SEQ ID NO: 16879 - RNA, 23 nt, Homo sapiens
ucccuguccuccaggagcucacg

SEQ ID NO: 16880 - RNA, 22 nt, Homo sapiens
ucagcaaacauuuauugugugc

SEQ ID NO: 16881 - RNA, 21 nt, Homo sapiens
uacucaaaaagcugucaguca

SEQ ID NO: 16882 - RNA, 18 nt, Homo sapiens
cagggaggugaaugugau

SEQ ID NO: 16883 - RNA, 23 nt, Homo sapiens
ucuggcuccgugucuucacuccc

SEQ ID NO: 16884 - RNA, 22 nt, Homo sapiens
uauguaauaugguccacaucuu

SEQ ID NO: 16885 - RNA, 22 nt, Homo sapiens
agaggcuggccgugaugaauuc

SEQ ID NO: 16886 - RNA, 19 nt, Homo sapiens
agguugacauacguuuccc

SEQ ID NO: 16887 - RNA, 19 nt, Homo sapiens
aggcugcggaauucaggac

SEQ ID NO: 16888 - RNA, 23 nt, Homo sapiens
gcgaggaccccucggggucugac

SEQ ID NO: 16889 - RNA, 22 nt, Homo sapiens
ggggguccccggugcucggauc

SEQ ID NO: 16890 - RNA, 21 nt, Homo sapiens
guggcugcacucacuuccuuc

SEQ ID NO: 16891 - RNA, 21 nt, Homo sapiens
ccccaccuccucucuccucag

SEQ ID NO: 16892 - RNA, 22 nt, Homo sapiens
uggagugugacaaugguguuug

SEQ ID NO: 16893 - RNA, 22 nt, Homo sapiens
uauggcacugguagaauucacu

SEQ ID NO: 16894 - RNA, 22 nt, Homo sapiens
uguaacagcaacuccaugugga

SEQ ID NO: 16895 - RNA, 22 nt, Homo sapiens
aucacacaaaggcaacuuuugu

SEQ ID NO: 16896 - RNA, 23 nt, Homo sapiens
ucuuggaguaggucauugggugg

SEQ ID NO: 16897 - RNA, 22 nt, Homo sapiens
uaugugccuuuggacuacaucg

SEQ ID NO: 16898 - RNA, 22 nt, Homo sapiens
aguggggaacccuuccaugagg

SEQ ID NO: 16899 - RNA, 23 nt, Homo sapiens
gacacgggcgacagcugcggccc

SEQ ID NO: 16900 - RNA, 20 nt, Homo sapiens
ggggagcuguggaagcagua

SEQ ID NO: 16901 - RNA, 22 nt, Homo sapiens
ucaccagcccuguguucccuag

SEQ ID NO: 16902 - RNA, 22 nt, Homo sapiens
acgcccuucccccccuucuuca

SEQ ID NO: 16903 - RNA, 18 nt, Homo sapiens
cgggcguggugguggggg

SEQ ID NO: 16904 - RNA, 23 nt, Homo sapiens
agcugguguugugaaucaggccg

SEQ ID NO: 16905 - RNA, 21 nt, Homo sapiens
cggcggggacggcgauugguc

SEQ ID NO: 16906 - RNA, 25 nt, Homo sapiens
cccccacaaccgcgcuugacuagcu

SEQ ID NO: 16907 - RNA, 22 nt, Homo sapiens
agaggcuggccgugaugaauuc

SEQ ID NO: 16908 - RNA, 23 nt, Homo sapiens
agugccugagggaguaagagccc

SEQ ID NO: 16909 - RNA, 24 nt, Homo sapiens
ugccugggucucuggccugcgcgu

SEQ ID NO: 16910 - RNA, 22 nt, Homo sapiens
aggcggggcgccgcgggaccgc

SEQ ID NO: 16911 - RNA, 22 nt, Homo sapiens
ugcggggcuagggcuaacagca

SEQ ID NO: 16912 - RNA, 22 nt, Homo sapiens
acuccagccccacagccucagc

SEQ ID NO: 16913 - RNA, 21 nt, Homo sapiens
ccccaccuccucucuccucag

SEQ ID NO: 16914 - RNA, 19 nt, Homo sapiens
auggauaaggcuuuggcuu

SEQ ID NO: 16915 - RNA, 20 nt, Homo sapiens
guguguggaaaugcuucugc

SEQ ID NO: 16916 - RNA, 22 nt, Homo sapiens
cucuagagggaagcacuuucug

SEQ ID NO: 16917 - RNA, 21 nt, Homo sapiens
cucccacaugcaggguuugca

SEQ ID NO: 16918 - RNA, 22 nt, Homo sapiens
aaggagcucacagucuauugag

SEQ ID NO: 16919 - RNA, 22 nt, Homo sapiens
uguaaacauccuacacucagcu

SEQ ID NO: 16920 - RNA, 22 nt, Homo sapiens
uccagcaucagugauuuuguug

SEQ ID NO: 16921 - RNA, 22 nt, Homo sapiens
uugggaucauuuugcauccaua

SEQ ID NO: 16922 - RNA, 22 nt, Homo sapiens
cuuaugcaagauucccuucuac

SEQ ID NO: 16923 - RNA, 22 nt, Homo sapiens
ugaaggucuacugugugccagg

SEQ ID NO: 16924 - RNA, 22 nt, Homo sapiens
ccucccacacccaaggcuugca

SEQ ID NO: 16925 - RNA, 21 nt, Homo sapiens
aacaggugacugguuagacaa

SEQ ID NO: 16926 - RNA, 22 nt, Homo sapiens
gguggcccggccgugccugagg

SEQ ID NO: 16927 - RNA, 23 nt, Homo sapiens
aaggagcuuacaaucuagcuggg

SEQ ID NO: 16928 - RNA, 21 nt, Homo sapiens
uggaggagaaggaaggugaug

SEQ ID NO: 16929 - RNA, 23 nt, Homo sapiens
cugggaucuccggggucuugguu

SEQ ID NO: 16930 - RNA, 20 nt, Homo sapiens
ggggagcuguggaagcagua

SEQ ID NO: 16931 - RNA, 22 nt, Homo sapiens
augggugaauuuguagaaggau

SEQ ID NO: 16932 - RNA, 23 nt, Homo sapiens
uauggcuuuuuauuccuauguga

SEQ ID NO: 16933 - RNA, 22 nt, Homo sapiens
ugagaacugaauuccauggguu

SEQ ID NO: 16934 - RNA, 22 nt, Homo sapiens
ugagaaccacgucugcucugag

SEQ ID NO: 16935 - RNA, 23 nt, Homo sapiens
ugaguaccgccaugucuguuggg

SEQ ID NO: 16936 - RNA, 22 nt, Homo sapiens
uagcuuaucagacugauguuga

SEQ ID NO: 16937 - RNA, 22 nt, Homo sapiens
ucaggcucaguccccucccgau

SEQ ID NO: 16938 - RNA, 24 nt, Homo sapiens
uucuccaaaagaaagcacuuucug

SEQ ID NO: 16939 - RNA, 22 nt, Homo sapiens
aagugccuccuuuuagaguguu

SEQ ID NO: 16940 - RNA, 21 nt, Homo sapiens
uaauuuuauguauaagcuagu

SEQ ID NO: 16941 - RNA, 22 nt, Homo sapiens
gagcuuauucauaaaagugcag

SEQ ID NO: 16942 - RNA, 22 nt, Homo sapiens
aaauuauuguacaucggaugag

SEQ ID NO: 16943 - RNA, 17 nt, Homo sapiens
ucgccuccuccucuccc

SEQ ID NO: 16944 - RNA, 18 nt, Homo sapiens
cagggaggugaaugugau

SEQ ID NO: 16945 - RNA, 23 nt, Homo sapiens
ucuggcuccgugucuucacuccc

SEQ ID NO: 16946 - RNA, 22 nt, Homo sapiens
cccugugcccggcccacuucug

SEQ ID NO: 16947 - RNA, 22 nt, Homo sapiens
uggcaguguauuguuagcuggu

SEQ ID NO: 16948 - RNA, 22 nt, Homo sapiens
cuggcccucucugcccuuccgu

SEQ ID NO: 16949 - RNA, 21 nt, Homo sapiens
uggguuuacguugggagaacu

SEQ ID NO: 16950 - RNA, 17 nt, Homo sapiens
ucucgcuggggccucca

SEQ ID NO: 16951 - RNA, 21 nt, Homo sapiens
ucguggccuggucuccauuau

SEQ ID NO: 16952 - RNA, 19 nt, Homo sapiens
gaugaugcugcugaugcug

SEQ ID NO: 16953 - RNA, 22 nt, Homo sapiens
uugcauagucacaaaagugauc

SEQ ID NO: 16954 - RNA, 22 nt, Homo sapiens
uaaugccccuaaaaauccuuau

SEQ ID NO: 16955 - RNA, 22 nt, Homo sapiens
aucuggagguaagaagcacuuu

SEQ ID NO: 16956 - RNA, 23 nt, Homo sapiens
aguauguucuuccaggacagaac

SEQ ID NO: 16957 - RNA, 23 nt, Homo sapiens
caagucuuauuugagcaccuguu

SEQ ID NO: 16958 - RNA, 21 nt, Homo sapiens
cuuuuugcggucugggcuugc

SEQ ID NO: 16959 - RNA, 22 nt, Homo sapiens
uugcauagucacaaaagugauc

SEQ ID NO: 16960 - RNA, 22 nt, Homo sapiens
cuuaugcaagauucccuucuac

SEQ ID NO: 16961 - RNA, 22 nt, Homo sapiens
aaaaguacuugcggauuuugcu

SEQ ID NO: 16962 - RNA, 22 nt, Homo sapiens
uagcaaaaacugcaguuacuuu

SEQ ID NO: 16963 - RNA, 23 nt, Homo sapiens
aguauguucuuccaggacagaac

SEQ ID NO: 16964 - RNA, 20 nt, Homo sapiens
ucugcaggguuugcuuugag

SEQ ID NO: 16965 - RNA, 20 nt, Homo sapiens
cgugccacccuuuuccccag

SEQ ID NO: 16966 - RNA, 22 nt, Homo sapiens
uagcagcacauaaugguuugug

SEQ ID NO: 16967 - RNA, 20 nt, Homo sapiens
ccccagggcgacgcggcggg

SEQ ID NO: 16968 - RNA, 22 nt, Homo sapiens
aacuggccuacaaagucccagu

SEQ ID NO: 16969 - RNA, 22 nt, Homo sapiens
aacuggcccucaaagucccgcu

SEQ ID NO: 16970 - RNA, 23 nt, Homo sapiens
acuucaccugguccacuagccgu

SEQ ID NO: 16971 - RNA, 22 nt, Homo sapiens
aggcaguguauuguuagcuggc

SEQ ID NO: 16972 - RNA, 22 nt, Homo sapiens
ugaaggucuacugugugccagg

SEQ ID NO: 16973 - RNA, 22 nt, Homo sapiens
ugugacagauugauaacugaaa

SEQ ID NO: 16974 - RNA, 25 nt, Homo sapiens
aggggugguguugggacagcuccgu

SEQ ID NO: 16975 - RNA, 23 nt, Homo sapiens
ugucacucggcucggcccacuac

SEQ ID NO: 16976 - RNA, 18 nt, Homo sapiens
ucagcuggcccucauuuc

SEQ ID NO: 16977 - RNA, 23 nt, Homo sapiens
uggaguccaggaaucugcauuuu

SEQ ID NO: 16978 - RNA, 23 nt, Homo sapiens
guccaguuuucccaggaaucccu

SEQ ID NO: 16979 - RNA, 21 nt, Homo sapiens
ccuggaaacacugagguugug

SEQ ID NO: 16980 - RNA, 23 nt, Homo sapiens
cggcccgggcugcugcuguuccu

SEQ ID NO: 16981 - RNA, 23 nt, Homo sapiens
ugaggggcagagagcgagacuuu

SEQ ID NO: 16982 - RNA, 19 nt, Homo sapiens
gggcgccugugaucccaac

SEQ ID NO: 16983 - RNA, 22 nt, Homo sapiens
ugcggggcuagggcuaacagca

SEQ ID NO: 16984 - RNA, 22 nt, Homo sapiens
guggguacggcccagugggggg

SEQ ID NO: 16985 - RNA, 19 nt, Homo sapiens
gaugaugcugcugaugcug

SEQ ID NO: 16986 - RNA, 22 nt, Homo sapiens
uggagagaaaggcaguuccuga

SEQ ID NO: 16987 - RNA, 22 nt, Homo sapiens
uagguaguuucauguuguuggg

SEQ ID NO: 16988 - RNA, 22 nt, Homo sapiens
uagguaguuuccuguuguuggg

SEQ ID NO: 16989 - RNA, 23 nt, Homo sapiens
uaagugcuuccauguuuugguga

SEQ ID NO: 16990 - RNA, 23 nt, Homo sapiens
uaagugcuuccauguuuuaguag

SEQ ID NO: 16991 - RNA, 23 nt, Homo sapiens
uaagugcuuccauguuucagugg

SEQ ID NO: 16992 - RNA, 23 nt, Homo sapiens
uaagugcuuccauguuugagugu

SEQ ID NO: 16993 - RNA, 17 nt, Homo sapiens
uaagugcuuccaugcuu

SEQ ID NO: 16994 - RNA, 22 nt, Homo sapiens
gcugacuccuaguccagggcuc

SEQ ID NO: 16995 - RNA, 23 nt, Homo sapiens
aaagugcugcgacauuugagcgu

SEQ ID NO: 16996 - RNA, 23 nt, Homo sapiens
gaagugcuucgauuuuggggugu

SEQ ID NO: 16997 - RNA, 21 nt, Homo sapiens
acuggacuuggagucagaagg

SEQ ID NO: 16998 - RNA, 22 nt, Homo sapiens
ucaggcucaguccccucccgau

SEQ ID NO: 16999 - RNA, 22 nt, Homo sapiens
aaagugcuucccuuuggacugu

SEQ ID NO: 17000 - RNA, 21 nt, Homo sapiens
aaagugcuuccuuuuagaggg

SEQ ID NO: 17001 - RNA, 22 nt, Homo sapiens
aaagugcuuccuuuuagagggu

SEQ ID NO: 17002 - RNA, 22 nt, Homo sapiens
aaagugcuucucuuuggugggu

SEQ ID NO: 17003 - RNA, 21 nt, Homo sapiens
aaagugcuuccuuuuugaggg

SEQ ID NO: 17004 - RNA, 22 nt, Homo sapiens
aagugcuuccuuuuagaggguu

SEQ ID NO: 17005 - RNA, 22 nt, Homo sapiens
uacgucaucguugucaucguca

SEQ ID NO: 17006 - RNA, 23 nt, Homo sapiens
acuuacagacaagagccuugcuc

SEQ ID NO: 17007 - RNA, 20 nt, Homo sapiens
cggcucugggucugugggga

SEQ ID NO: 17008 - RNA, 22 nt, Homo sapiens
aggcagcgggguguaguggaua

SEQ ID NO: 17009 - RNA, 22 nt, Homo sapiens
uuuccggcucgcgugggugugu

SEQ ID NO: 17010 - RNA, 24 nt, Homo sapiens
ucccugagacccuuuaaccuguga

SEQ ID NO: 17011 - RNA, 22 nt, Homo sapiens
ucccugagacccuaacuuguga

SEQ ID NO: 17012 - RNA, 23 nt, Homo sapiens
ccucagggcuguagaacagggcu

SEQ ID NO: 17013 - RNA, 17 nt, Homo sapiens
ucgccuccuccucuccc

SEQ ID NO: 17014 - RNA, 22 nt, Homo sapiens
cagugguuuuacccuaugguag

SEQ ID NO: 17015 - RNA, 21 nt, Homo sapiens
uccugcgcgucccagaugccc

SEQ ID NO: 17016 - RNA, 22 nt, Homo sapiens
uggcucaguucagcaggaacag

SEQ ID NO: 17017 - RNA, 20 nt, Homo sapiens
ccucugggcccuuccuccag

SEQ ID NO: 17018 - RNA, 22 nt, Homo sapiens
ucucugggccugugucuuaggc

SEQ ID NO: 17019 - RNA, 25 nt, Homo sapiens
ggcggagggaaguagguccguuggu

SEQ ID NO: 17020 - RNA, 22 nt, Homo sapiens
acuccagccccacagccucagc

SEQ ID NO: 17021 - RNA, 22 nt, Homo sapiens
aggcagcgggguguaguggaua

SEQ ID NO: 17022 - RNA, 24 nt, Homo sapiens
uggggagcugaggcucugggggug

SEQ ID NO: 17023 - RNA, 22 nt, Homo sapiens
uggagagaaaggcaguuccuga

SEQ ID NO: 17024 - RNA, 21 nt, Homo sapiens
cggcggggacggcgauugguc

SEQ ID NO: 17025 - RNA, 22 nt, Homo sapiens
aacuggcccucaaagucccgcu

SEQ ID NO: 17026 - RNA, 25 nt, Homo sapiens
cccccacaaccgcgcuugacuagcu

SEQ ID NO: 17027 - RNA, 22 nt, Homo sapiens
uuggggaaacggccgcugagug

SEQ ID NO: 17028 - RNA, 21 nt, Homo sapiens
caagucacuagugguuccguu

SEQ ID NO: 17029 - RNA, 23 nt, Homo sapiens
ugagcgccucgacgacagagccg

SEQ ID NO: 17030 - RNA, 22 nt, Homo sapiens
aaaaugguucccuuuagagugu

SEQ ID NO: 17031 - RNA, 22 nt, Homo sapiens
aggcggggcgccgcgggaccgc

SEQ ID NO: 17032 - RNA, 22 nt, Homo sapiens
ucggccugaccacccaccccac

SEQ ID NO: 17033 - RNA, 24 nt, Homo sapiens
uggcccugacugaagaccagcagu

SEQ ID NO: 17034 - RNA, 22 nt, Homo sapiens
uggagagaaaggcaguuccuga

SEQ ID NO: 17035 - RNA, 21 nt, Homo sapiens
cggcggggacggcgauugguc

SEQ ID NO: 17036 - RNA, 21 nt, Homo sapiens
cugaccuaugaauugacagcc

SEQ ID NO: 17037 - RNA, 21 nt, Homo sapiens
agggcccccccucaauccugu

SEQ ID NO: 17038 - RNA, 23 nt, Homo sapiens
ugaggggcagagagcgagacuuu

SEQ ID NO: 17039 - RNA, 22 nt, Homo sapiens
aggcggggcgccgcgggaccgc

SEQ ID NO: 17040 - RNA, 22 nt, Homo sapiens
ugcggggcuagggcuaacagca

SEQ ID NO: 17041 - RNA, 21 nt, Homo sapiens
uggaggagaaggaaggugaug

SEQ ID NO: 17042 - RNA, 20 nt, Homo sapiens
ggggagcuguggaagcagua

SEQ ID NO: 17043 - RNA, 22 nt, Homo sapiens
augggugaauuuguagaaggau

SEQ ID NO: 17044 - RNA, 22 nt, Homo sapiens
uacguagauauauauguauuuu

SEQ ID NO: 17045 - RNA, 17 nt, Homo sapiens
ucccaccgcugccaccc

SEQ ID NO: 17046 - RNA, 22 nt, Homo sapiens
ucugggcaacaaagugagaccu

SEQ ID NO: 17047 - RNA, 22 nt, Homo sapiens
ucugcccccuccgcugcugcca

SEQ ID NO: 17048 - RNA, 23 nt, Homo sapiens
caacggaaucccaaaagcagcug

SEQ ID NO: 17049 - RNA, 22 nt, Homo sapiens
uucccuuugucauccuaugccu

SEQ ID NO: 17050 - RNA, 22 nt, Homo sapiens
uucccuuugucauccuucgccu

SEQ ID NO: 17051 - RNA, 22 nt, Homo sapiens
uagcuuaucagacugauguuga

SEQ ID NO: 17052 - RNA, 20 nt, Homo sapiens
acugccccaggugcugcugg

SEQ ID NO: 17053 - RNA, 20 nt, Homo sapiens
ccucugggcccuuccuccag

SEQ ID NO: 17054 - RNA, 22 nt, Homo sapiens
ucucugggccugugucuuaggc

SEQ ID NO: 17055 - RNA, 23 nt, Homo sapiens
acuucaccugguccacuagccgu

SEQ ID NO: 17056 - RNA, 21 nt, Homo sapiens
cggggcagcucaguacaggau

SEQ ID NO: 17057 - RNA, 22 nt, Homo sapiens
gugacaucacauauacggcagc

SEQ ID NO: 17058 - RNA, 22 nt, Homo sapiens
aacaucacagcaagucugugcu

SEQ ID NO: 17059 - RNA, 21 nt, Homo sapiens
auccuugcuaucugggugcua

SEQ ID NO: 17060 - RNA, 19 nt, Homo sapiens
aggcugcggaauucaggac

SEQ ID NO: 17061 - RNA, 25 nt, Homo sapiens
gcugggcagggcuucugagcuccuu

SEQ ID NO: 17062 - RNA, 22 nt, Homo sapiens
augcugacauauuuacuagagg

SEQ ID NO: 17063 - RNA, 23 nt, Homo sapiens
caagucuuauuugagcaccuguu

SEQ ID NO: 17064 - RNA, 22 nt, Homo sapiens
uugcauagucacaaaagugauc

SEQ ID NO: 17065 - RNA, 22 nt, Homo sapiens
uaaugccccuaaaaauccuuau

SEQ ID NO: 17066 - RNA, 22 nt, Homo sapiens
aaaaguaauugcgaguuuuacc

SEQ ID NO: 17067 - RNA, 22 nt, Homo sapiens
aaaaguaauugugguuuuggcc

SEQ ID NO: 17068 - RNA, 22 nt, Homo sapiens
aaaaguaauugcgguuuuugcc

SEQ ID NO: 17069 - RNA, 22 nt, Homo sapiens
aaaaguaauugugguuuuugcc

SEQ ID NO: 17070 - RNA, 22 nt, Homo sapiens
aaaaguaaucgcgguuuuuguc

SEQ ID NO: 17071 - RNA, 22 nt, Homo sapiens
aaaaguaauugcggauuuugcc

SEQ ID NO: 17072 - RNA, 22 nt, Homo sapiens
aaaaguaauugcggucuuuggu

SEQ ID NO: 17073 - RNA, 21 nt, Homo sapiens
uaaaguaaauaugcaccaaaa

SEQ ID NO: 17074 - RNA, 23 nt, Homo sapiens
aguauguucuuccaggacagaac

SEQ ID NO: 17075 - RNA, 22 nt, Homo sapiens
uaugucugcugaccaucaccuu

SEQ ID NO: 17076 - RNA, 23 nt, Homo sapiens
gagggucuugggagggaugugac

SEQ ID NO: 17077 - RNA, 21 nt, Homo sapiens
cggcggggacggcgauugguc

SEQ ID NO: 17078 - RNA, 24 nt, Homo sapiens
agcagaagcagggagguucuccca

SEQ ID NO: 17079 - RNA, 18 nt, Homo sapiens
ugcuuccuuucagagggu

SEQ ID NO: 17080 - RNA, 22 nt, Homo sapiens
aucuggagguaagaagcacuuu

SEQ ID NO: 17081 - RNA, 19 nt, Homo sapiens
aggcugcggaauucaggac

SEQ ID NO: 17082 - RNA, 22 nt, Homo sapiens
aggcggggcgccgcgggaccgc

SEQ ID NO: 17083 - RNA, 20 nt, Homo sapiens
cgugccacccuuuuccccag

SEQ ID NO: 17084 - RNA, 24 nt, Homo sapiens
agccuggaagcuggagccugcagu

SEQ ID NO: 17085 - RNA, 17 nt, Homo sapiens
gugggggagaggcuguc

SEQ ID NO: 17086 - RNA, 18 nt, Homo sapiens
cagggaggugaaugugau

SEQ ID NO: 17087 - RNA, 21 nt, Homo sapiens
ugagaugaagcacuguagcuc

SEQ ID NO: 17088 - RNA, 22 nt, Homo sapiens
ugagaacugaauuccauggguu

SEQ ID NO: 17089 - RNA, 23 nt, Homo sapiens
ucuggcuccgugucuucacuccc

SEQ ID NO: 17090 - RNA, 22 nt, Homo sapiens
uggagagaaaggcaguuccuga

SEQ ID NO: 17091 - RNA, 25 nt, Homo sapiens
cccccacaaccgcgcuugacuagcu

SEQ ID NO: 17092 - RNA, 22 nt, Homo sapiens
uccuucauuccaccggagucug

SEQ ID NO: 17093 - RNA, 22 nt, Homo sapiens
uagcuuaucagacugauguuga

SEQ ID NO: 17094 - RNA, 24 nt, Homo sapiens
agcagaagcagggagguucuccca

SEQ ID NO: 17095 - RNA, 22 nt, Homo sapiens
auauaauacaaccugcuaagug

SEQ ID NO: 17096 - RNA, 21 nt, Homo sapiens
ucacuccucuccucccgucuu

SEQ ID NO: 17097 - RNA, 23 nt, Homo sapiens
uacuccagagggcgucacucaug

SEQ ID NO: 17098 - RNA, 21 nt, Homo sapiens
guggcugcacucacuuccuuc

SEQ ID NO: 17099 - RNA, 21 nt, Homo sapiens
uccugcgcgucccagaugccc

SEQ ID NO: 17100 - RNA, 21 nt, Homo sapiens
cggcggggacggcgauugguc

SEQ ID NO: 17101 - RNA, 22 nt, Homo sapiens
ucugcccccuccgcugcugcca

SEQ ID NO: 17102 - RNA, 20 nt, Homo sapiens
acugccccaggugcugcugg

SEQ ID NO: 17103 - RNA, 21 nt, Homo sapiens
cggggcagcucaguacaggau

SEQ ID NO: 17104 - RNA, 22 nt, Homo sapiens
aggcggggcgccgcgggaccgc

SEQ ID NO: 17105 - RNA, 22 nt, Homo sapiens
auccgcgcucugacucucugcc

SEQ ID NO: 17106 - RNA, 18 nt, Homo sapiens
aucccaccucugccacca

SEQ ID NO: 17107 - RNA, 17 nt, Homo sapiens
gugggggagaggcuguc

SEQ ID NO: 17108 - RNA, 17 nt, Homo sapiens
ucgccuccuccucuccc

SEQ ID NO: 17109 - RNA, 21 nt, Homo sapiens
ucgaggagcucacagucuagu

SEQ ID NO: 17110 - RNA, 21 nt, Homo sapiens
cggcggggacggcgauugguc

SEQ ID NO: 17111 - RNA, 20 nt, Homo sapiens
ccuccugcccuccuugcugu

SEQ ID NO: 17112 - RNA, 22 nt, Homo sapiens
cauugcacuugucucggucuga

SEQ ID NO: 17113 - RNA, 22 nt, Homo sapiens
uguaaacauccuacacucagcu

SEQ ID NO: 17114 - RNA, 22 nt, Homo sapiens
ccucccacacccaaggcuugca

SEQ ID NO: 17115 - RNA, 25 nt, Homo sapiens
ggcggagggaaguagguccguuggu

SEQ ID NO: 17116 - RNA, 21 nt, Homo sapiens
uggaggagaaggaaggugaug

SEQ ID NO: 17117 - RNA, 24 nt, Homo sapiens
uggggagcugaggcucugggggug

SEQ ID NO: 17118 - RNA, 21 nt, Homo sapiens
uaggacacauggucuacuucu

SEQ ID NO: 17119 - RNA, 19 nt, Homo sapiens
gugaggacucgggaggugg

SEQ ID NO: 17120 - RNA, 20 nt, Homo sapiens
cgugccacccuuuuccccag

SEQ ID NO: 17121 - RNA, 22 nt, Homo sapiens
cagugguuuuacccuaugguag

SEQ ID NO: 17122 - RNA, 22 nt, Homo sapiens
ugauauguuugauauauuaggu

SEQ ID NO: 17123 - RNA, 22 nt, Homo sapiens
uccuucauuccaccggagucug

SEQ ID NO: 17124 - RNA, 22 nt, Homo sapiens
aaaucucugcaggcaaauguga

SEQ ID NO: 17125 - RNA, 21 nt, Homo sapiens
auguaugugugcaugugcaug

SEQ ID NO: 17126 - RNA, 22 nt, Homo sapiens
gucauacacggcucuccucucu

SEQ ID NO: 17127 - RNA, 23 nt, Homo sapiens
uaaauuucaccuuucugagaagg

SEQ ID NO: 17128 - RNA, 18 nt, Homo sapiens
gucccuguucaggcgcca

SEQ ID NO: 17129 - RNA, 18 nt, Homo sapiens
cagggaggugaaugugau

SEQ ID NO: 17130 - RNA, 23 nt, Homo sapiens
cggcccgggcugcugcuguuccu

SEQ ID NO: 17131 - RNA, 22 nt, Homo sapiens
uggagagaaaggcaguuccuga

SEQ ID NO: 17132 - RNA, 23 nt, Homo sapiens
ucccccaggugugauucugauuu

SEQ ID NO: 17133 - RNA, 23 nt, Homo sapiens
agcucggucugaggccccucagu

SEQ ID NO: 17134 - RNA, 22 nt, Homo sapiens
aguggggaacccuuccaugagg

SEQ ID NO: 17135 - RNA, 22 nt, Homo sapiens
ggagaaauuauccuuggugugu

SEQ ID NO: 17136 - RNA, 22 nt, Homo sapiens
uccgagccugggucucccucuu

SEQ ID NO: 17137 - RNA, 24 nt, Homo sapiens
acugggggcuuucgggcucugcgu

SEQ ID NO: 17138 - RNA, 24 nt, Homo sapiens
ugccugggucucuggccugcgcgu

SEQ ID NO: 17139 - RNA, 21 nt, Homo sapiens
ucccacguuguggcccagcag

SEQ ID NO: 17140 - RNA, 22 nt, Homo sapiens
uggagugugacaaugguguuug

SEQ ID NO: 17141 - RNA, 22 nt, Homo sapiens
acccgucccguucguccccgga

SEQ ID NO: 17142 - RNA, 18 nt, Homo sapiens
cgggcguggugguggggg

SEQ ID NO: 17143 - RNA, 21 nt, Homo sapiens
gcccuccgcccgugcaccccg

SEQ ID NO: 17144 - RNA, 23 nt, Homo sapiens
ucuggcuccgugucuucacuccc

SEQ ID NO: 17145 - RNA, 21 nt, Homo sapiens
cggcggggacggcgauugguc

SEQ ID NO: 17146 - RNA, 23 nt, Homo sapiens
agcuacauugucugcuggguuuc

SEQ ID NO: 17147 - RNA, 22 nt, Homo sapiens
cauugcacuugucucggucuga

SEQ ID NO: 17148 - RNA, 22 nt, Homo sapiens
agaggcuggccgugaugaauuc

SEQ ID NO: 17149 - RNA, 22 nt, Homo sapiens
ggagaaauuauccuuggugugu

SEQ ID NO: 17150 - RNA, 22 nt, Homo sapiens
uggugggcacagaaucuggacu

SEQ ID NO: 17151 - RNA, 21 nt, Homo sapiens
caaagaggaaggucccauuac

SEQ ID NO: 17152 - RNA, 25 nt, Homo sapiens
aggggugguguugggacagcuccgu

SEQ ID NO: 17153 - RNA, 22 nt, Homo sapiens
uggugggccgcagaacaugugc

SEQ ID NO: 17154 - RNA, 25 nt, Homo sapiens
ggcggagggaaguagguccguuggu

SEQ ID NO: 17155 - RNA, 22 nt, Homo sapiens
aggcggggcgccgcgggaccgc

SEQ ID NO: 17156 - RNA, 20 nt, Homo sapiens
accaggaggcugaggccccu

SEQ ID NO: 17157 - RNA, 21 nt, Homo sapiens
uggaggagaaggaaggugaug

SEQ ID NO: 17158 - RNA, 21 nt, Homo sapiens
ccgucgccgccacccgagccg

SEQ ID NO: 17159 - RNA, 22 nt, Homo sapiens
uuagggcccuggcuccaucucc

SEQ ID NO: 17160 - RNA, 19 nt, Homo sapiens
gaugaugcugcugaugcug

SEQ ID NO: 17161 - RNA, 21 nt, Homo sapiens
cggcggggacggcgauugguc

SEQ ID NO: 17162 - RNA, 23 nt, Homo sapiens
ucaagagcaauaacgaaaaaugu

SEQ ID NO: 17163 - RNA, 23 nt, Homo sapiens
ucccccaggugugauucugauuu

SEQ ID NO: 17164 - RNA, 22 nt, Homo sapiens
aagacgggaggaaagaagggag

SEQ ID NO: 17165 - RNA, 25 nt, Homo sapiens
aggggugguguugggacagcuccgu

SEQ ID NO: 17166 - RNA, 24 nt, Homo sapiens
acugggggcuuucgggcucugcgu

SEQ ID NO: 17167 - RNA, 24 nt, Homo sapiens
ugccugggucucuggccugcgcgu

SEQ ID NO: 17168 - RNA, 22 nt, Homo sapiens
aggcggggcgccgcgggaccgc

SEQ ID NO: 17169 - RNA, 23 nt, Homo sapiens
uggaagacuagugauuuuguugu

SEQ ID NO: 17170 - RNA, 20 nt, Homo sapiens
ggggagcuguggaagcagua

SEQ ID NO: 17171 - RNA, 21 nt, Homo sapiens
ucguggccuggucuccauuau

SEQ ID NO: 17172 - RNA, 24 nt, Homo sapiens
uggcccugacugaagaccagcagu

SEQ ID NO: 17173 - RNA, 19 nt, Homo sapiens
gaugaugcugcugaugcug

SEQ ID NO: 17174 - RNA, 23 nt, Homo sapiens
cggcccgggcugcugcuguuccu

SEQ ID NO: 17175 - RNA, 21 nt, Homo sapiens
agggcccccccucaauccugu

SEQ ID NO: 17176 - RNA, 23 nt, Homo sapiens
ucccccaggugugauucugauuu

SEQ ID NO: 17177 - RNA, 25 nt, Homo sapiens
agggaucgcgggcggguggcggccu

SEQ ID NO: 17178 - RNA, 22 nt, Homo sapiens
uauugcacucgucccggccucc

SEQ ID NO: 17179 - RNA, 22 nt, Homo sapiens
ugcuggaucagugguucgaguc

SEQ ID NO: 17180 - RNA, 22 nt, Homo sapiens
cugugcgugugacagcggcuga

SEQ ID NO: 17181 - RNA, 21 nt, Homo sapiens
agcuacaucuggcuacugggu

SEQ ID NO: 17182 - RNA, 22 nt, Homo sapiens
uagcaccaucugaaaucgguua

SEQ ID NO: 17183 - RNA, 22 nt, Homo sapiens
ucaggcucaguccccucccgau

SEQ ID NO: 17184 - RNA, 18 nt, Homo sapiens
uucacagggaggugucau

SEQ ID NO: 17185 - RNA, 22 nt, Homo sapiens
ggagaaauuauccuuggugugu

SEQ ID NO: 17186 - RNA, 21 nt, Homo sapiens
uggaggagaaggaaggugaug

SEQ ID NO: 17187 - RNA, 22 nt, Homo sapiens
uggauuucuuugugaaucacca

SEQ ID NO: 17188 - RNA, 21 nt, Homo sapiens
uggcagggaggcugggagggg

SEQ ID NO: 17189 - RNA, 21 nt, Homo sapiens
ccuguugaaguguaaucccca

SEQ ID NO: 17190 - RNA, 22 nt, Homo sapiens
uucuggaauucugugugaggga

SEQ ID NO: 17191 - RNA, 22 nt, Homo sapiens
aagcccuuaccccaaaaagcau

SEQ ID NO: 17192 - RNA, 23 nt, Homo sapiens
uaagugcuuccauguuuugguga

SEQ ID NO: 17193 - RNA, 23 nt, Homo sapiens
uaagugcuuccauguuuuaguag

SEQ ID NO: 17194 - RNA, 23 nt, Homo sapiens
uaagugcuuccauguuucagugg

SEQ ID NO: 17195 - RNA, 23 nt, Homo sapiens
uaagugcuuccauguuugagugu

SEQ ID NO: 17196 - RNA, 17 nt, Homo sapiens
uaagugcuuccaugcuu

SEQ ID NO: 17197 - RNA, 23 nt, Homo sapiens
aaagugcugcgacauuugagcgu

SEQ ID NO: 17198 - RNA, 23 nt, Homo sapiens
gaagugcuucgauuuuggggugu

SEQ ID NO: 17199 - RNA, 23 nt, Homo sapiens
aucaacagacauuaauugggcgc

SEQ ID NO: 17200 - RNA, 22 nt, Homo sapiens
cgucaacacuugcugguuuccu

SEQ ID NO: 17201 - RNA, 23 nt, Homo sapiens
caaagcgcuucucuuuagagugu

SEQ ID NO: 17202 - RNA, 22 nt, Homo sapiens
aaagugcuucccuuuggacugu

SEQ ID NO: 17203 - RNA, 21 nt, Homo sapiens
cuccagagggaaguacuuucu

SEQ ID NO: 17204 - RNA, 21 nt, Homo sapiens
aaagugcuuccuuuuagaggg

SEQ ID NO: 17205 - RNA, 22 nt, Homo sapiens
aaagugcuuccuuuuagagggu

SEQ ID NO: 17206 - RNA, 22 nt, Homo sapiens
aaagugcuucucuuuggugggu

SEQ ID NO: 17207 - RNA, 21 nt, Homo sapiens
aaagugcuuccuuuuugaggg

SEQ ID NO: 17208 - RNA, 22 nt, Homo sapiens
aagugcuuccuuuuagaggguu

SEQ ID NO: 17209 - RNA, 21 nt, Homo sapiens
cuccagagggaugcacuuucu

SEQ ID NO: 17210 - RNA, 22 nt, Homo sapiens
cugcccuggcccgagggaccga

SEQ ID NO: 17211 - RNA, 21 nt, Homo sapiens
aaggcagggcccccgcucccc

SEQ ID NO: 17212 - RNA, 22 nt, Homo sapiens
ucggccugaccacccaccccac

SEQ ID NO: 17213 - RNA, 17 nt, Homo sapiens
ucgccuccuccucuccc

SEQ ID NO: 17214 - RNA, 22 nt, Homo sapiens
acucggcguggcgucggucgug

SEQ ID NO: 17215 - RNA, 22 nt, Homo sapiens
cucggcgcggggcgcgggcucc

SEQ ID NO: 17216 - RNA, 21 nt, Homo sapiens
ucgaggagcucacagucuagu

SEQ ID NO: 17217 - RNA, 22 nt, Homo sapiens
aagacgggaggaaagaagggag

SEQ ID NO: 17218 - RNA, 22 nt, Homo sapiens
uggugggcacagaaucuggacu

SEQ ID NO: 17219 - RNA, 22 nt, Homo sapiens
agacuucccauuugaagguggc

SEQ ID NO: 17220 - RNA, 22 nt, Homo sapiens
uggugggccgcagaacaugugc

SEQ ID NO: 17221 - RNA, 23 nt, Homo sapiens
aaggagcuuacaaucuagcuggg

SEQ ID NO: 17222 - RNA, 21 nt, Homo sapiens
uggaggagaaggaaggugaug

SEQ ID NO: 17223 - RNA, 18 nt, Homo sapiens
ucagcuggcccucauuuc

SEQ ID NO: 17224 - RNA, 21 nt, Homo sapiens
uggcagggaggcugggagggg

SEQ ID NO: 17225 - RNA, 22 nt, Homo sapiens
ucggauccgucugagcuuggcu

SEQ ID NO: 17226 - RNA, 23 nt, Homo sapiens
uaaggugcaucuagugcagauag

SEQ ID NO: 17227 - RNA, 21 nt, Homo sapiens
cggcggggacggcgauugguc

SEQ ID NO: 17228 - RNA, 21 nt, Homo sapiens
aggggugcuaucugugauuga

SEQ ID NO: 17229 - RNA, 22 nt, Homo sapiens
agacccuggucugcacucuauc

SEQ ID NO: 17230 - RNA, 25 nt, Homo sapiens
aggggugguguugggacagcuccgu

SEQ ID NO: 17231 - RNA, 22 nt, Homo sapiens
aggcggggcgccgcgggaccgc

SEQ ID NO: 17232 - RNA, 22 nt, Homo sapiens
ugcggggcuagggcuaacagca

SEQ ID NO: 17233 - RNA, 22 nt, Homo sapiens
ugcggggcuagggcuaacagca

SEQ ID NO: 17234 - RNA, 20 nt, Homo sapiens
ggggagcuguggaagcagua

SEQ ID NO: 17235 - RNA, 23 nt, Homo sapiens
guccaguuuucccaggaaucccu

SEQ ID NO: 17236 - RNA, 22 nt, Homo sapiens
ugcccuguggacucaguucugg

SEQ ID NO: 17237 - RNA, 21 nt, Homo sapiens
cucccacaugcaggguuugca

SEQ ID NO: 17238 - RNA, 21 nt, Homo sapiens
ccaguccugugccugccgccu

SEQ ID NO: 17239 - RNA, 21 nt, Homo sapiens
ccaguccugugccugccgccu

SEQ ID NO: 17240 - RNA, 23 nt, Homo sapiens
ucuuggaguaggucauugggugg

SEQ ID NO: 17241 - RNA, 22 nt, Homo sapiens
uugggaucauuuugcauccaua

SEQ ID NO: 17242 - RNA, 23 nt, Homo sapiens
cugggaucuccggggucuugguu

SEQ ID NO: 17243 - RNA, 20 nt, Homo sapiens
ggggagcuguggaagcagua

SEQ ID NO: 17244 - RNA, 20 nt, Homo sapiens
ucugcaggguuugcuuugag

SEQ ID NO: 17245 - RNA, 17 nt, Homo sapiens
ucgccuccuccucuccc

SEQ ID NO: 17246 - RNA, 22 nt, Homo sapiens
ucugggcaacaaagugagaccu

SEQ ID NO: 17247 - RNA, 22 nt, Homo sapiens
uguaaacauccuacacucagcu

SEQ ID NO: 17248 - RNA, 22 nt, Homo sapiens
caaccuggaggacuccaugcug

SEQ ID NO: 17249 - RNA, 22 nt, Homo sapiens
cgucaacacuugcugguuuccu

SEQ ID NO: 17250 - RNA, 25 nt, Homo sapiens
aggggugguguugggacagcuccgu

SEQ ID NO: 17251 - RNA, 25 nt, Homo sapiens
gcugggcagggcuucugagcuccuu

SEQ ID NO: 17252 - RNA, 21 nt, Homo sapiens
gugccagcugcagugggggag

SEQ ID NO: 17253 - RNA, 20 nt, Homo sapiens
ugagcccuguccucccgcag

SEQ ID NO: 17254 - RNA, 23 nt, Homo sapiens
ugaguaccgccaugucuguuggg

SEQ ID NO: 17255 - RNA, 20 nt, Homo sapiens
gugcauugcuguugcauugc

SEQ ID NO: 17256 - RNA, 22 nt, Homo sapiens
uuaucagaaucuccagggguac

SEQ ID NO: 17257 - RNA, 20 nt, Homo sapiens
auuccuagaaauuguucaua

SEQ ID NO: 17258 - RNA, 22 nt, Homo sapiens
ugaaggucuacugugugccagg

SEQ ID NO: 17259 - RNA, 22 nt, Homo sapiens
gagugccuucuuuuggagcguu

SEQ ID NO: 17260 - RNA, 22 nt, Homo sapiens
aucuggagguaagaagcacuuu

SEQ ID NO: 17261 - RNA, 23 nt, Homo sapiens
caaagcgcuucucuuuagagugu

SEQ ID NO: 17262 - RNA, 22 nt, Homo sapiens
aagugccuccuuuuagaguguu

SEQ ID NO: 17263 - RNA, 21 nt, Homo sapiens
cuccagagggaaguacuuucu

SEQ ID NO: 17264 - RNA, 21 nt, Homo sapiens
cuccagagggaugcacuuucu

SEQ ID NO: 17265 - RNA, 19 nt, Homo sapiens
gggcgccugugaucccaac

SEQ ID NO: 17266 - RNA, 19 nt, Homo sapiens
agcugucugaaaaugucuu

SEQ ID NO: 17267 - RNA, 19 nt, Homo sapiens
gugucugcuuccuguggga

SEQ ID NO: 17268 - RNA, 21 nt, Homo sapiens
guguugaaacaaucucuacug

SEQ ID NO: 17269 - RNA, 20 nt, Homo sapiens
cggcucugggucugugggga

SEQ ID NO: 17270 - RNA, 22 nt, Homo sapiens
ucuucucuguuuuggccaugug

SEQ ID NO: 17271 - RNA, 22 nt, Homo sapiens
uucuggaauucugugugaggga

SEQ ID NO: 17272 - RNA, 22 nt, Homo sapiens
ucagugcaucacagaacuuugu

SEQ ID NO: 17273 - RNA, 22 nt, Homo sapiens
acagcaggcacagacaggcagu

SEQ ID NO: 17274 - RNA, 23 nt, Homo sapiens
ucccuguccuccaggagcucacg

SEQ ID NO: 17275 - RNA, 22 nt, Homo sapiens
gccugcugggguggaaccuggu

SEQ ID NO: 17276 - RNA, 22 nt, Homo sapiens
agucauuggaggguuugagcag

SEQ ID NO: 17277 - RNA, 20 nt, Homo sapiens
accaggaggcugaggccccu

SEQ ID NO: 17278 - RNA, 21 nt, Homo sapiens
ccuggaaacacugagguugug

SEQ ID NO: 17279 - RNA, 24 nt, Homo sapiens
agccuggaagcuggagccugcagu

SEQ ID NO: 17280 - RNA, 23 nt, Homo sapiens
cuggagauauggaagagcugugu

SEQ ID NO: 17281 - RNA, 22 nt, Homo sapiens
agaguugagucuggacgucccg

SEQ ID NO: 17282 - RNA, 21 nt, Homo sapiens
aucacauugccagggauuucc

SEQ ID NO: 17283 - RNA, 21 nt, Homo sapiens
aucacauugccagggauuacc

SEQ ID NO: 17284 - RNA, 23 nt, Homo sapiens
ucaagagcaauaacgaaaaaugu

SEQ ID NO: 17285 - RNA, 22 nt, Homo sapiens
ucaggcucaguccccucccgau

SEQ ID NO: 17286 - RNA, 22 nt, Homo sapiens
auucugcauuuuuagcaaguuc

SEQ ID NO: 17287 - RNA, 23 nt, Homo sapiens
ugagugugugugugugagugugu

SEQ ID NO: 17288 - RNA, 22 nt, Homo sapiens
cacacacugcaauuacuuuugc

SEQ ID NO: 17289 - RNA, 20 nt, Homo sapiens
auggagauagauauagaaau

SEQ ID NO: 17290 - RNA, 24 nt, Homo sapiens
ugccugggucucuggccugcgcgu

SEQ ID NO: 17291 - RNA, 17 nt, Homo sapiens
ucgccuccuccucuccc

SEQ ID NO: 17292 - RNA, 21 nt, Homo sapiens
gcccuccgcccgugcaccccg

SEQ ID NO: 17293 - RNA, 23 nt, Homo sapiens
gaacgcgcuucccuauagagggu

SEQ ID NO: 17294 - RNA, 23 nt, Homo sapiens
ucggggaucaucaugucacgaga

SEQ ID NO: 17295 - RNA, 21 nt, Homo sapiens
ugaguuggccaucugagugag

SEQ ID NO: 17296 - RNA, 25 nt, Homo sapiens
ggcggagggaaguagguccguuggu

SEQ ID NO: 17297 - RNA, 20 nt, Homo sapiens
cggcucugggucugugggga

SEQ ID NO: 17298 - RNA, 21 nt, Homo sapiens
uggaggagaaggaaggugaug

SEQ ID NO: 17299 - RNA, 22 nt, Homo sapiens
auccgcgcucugacucucugcc

SEQ ID NO: 17300 - RNA, 24 nt, Homo sapiens
uggggagcugaggcucugggggug

SEQ ID NO: 17301 - RNA, 21 nt, Homo sapiens
agaggauacccuuuguauguu

SEQ ID NO: 17302 - RNA, 22 nt, Homo sapiens
augggugaauuuguagaaggau

SEQ ID NO: 17303 - RNA, 22 nt, Homo sapiens
ugugagguuggcauuguugucu

SEQ ID NO: 17304 - RNA, 23 nt, Homo sapiens
uauggcuuuuuauuccuauguga

SEQ ID NO: 17305 - RNA, 23 nt, Homo sapiens
uauggcuuuucauuccuauguga

SEQ ID NO: 17306 - RNA, 23 nt, Homo sapiens
ucuggcuccgugucuucacuccc

SEQ ID NO: 17307 - RNA, 22 nt, Homo sapiens
caaagaauucuccuuuugggcu

SEQ ID NO: 17308 - RNA, 22 nt, Homo sapiens
cgcaggggccgggugcucaccg

SEQ ID NO: 17309 - RNA, 22 nt, Homo sapiens
cacacacugcaauuacuuuugc

SEQ ID NO: 17310 - RNA, 20 nt, Homo sapiens
accaggaggcugaggccccu

SEQ ID NO: 17311 - RNA, 22 nt, Homo sapiens
uuuccggcucgcgugggugugu

SEQ ID NO: 17312 - RNA, 22 nt, Homo sapiens
uuuccggcucgcgugggugugu

SEQ ID NO: 17313 - RNA, 21 nt, Homo sapiens
uggcagggaggcugggagggg

SEQ ID NO: 17314 - RNA, 21 nt, Homo sapiens
uggcagggaggcugggagggg

SEQ ID NO: 17315 - RNA, 22 nt, Homo sapiens
acccgucccguucguccccgga

SEQ ID NO: 17316 - RNA, 18 nt, Homo sapiens
cgggcguggugguggggg

SEQ ID NO: 17317 - RNA, 21 nt, Homo sapiens
cggcggggacggcgauugguc

SEQ ID NO: 17318 - RNA, 22 nt, Homo sapiens
cgcaggggccgggugcucaccg

SEQ ID NO: 17319 - RNA, 22 nt, Homo sapiens
aacgcacuucccuuuagagugu

SEQ ID NO: 17320 - RNA, 22 nt, Homo sapiens
aggcggggcgccgcgggaccgc

SEQ ID NO: 17321 - RNA, 22 nt, Homo sapiens
uauugcacucgucccggccucc

SEQ ID NO: 17322 - RNA, 21 nt, Homo sapiens
aaggcagggcccccgcucccc

SEQ ID NO: 17323 - RNA, 23 nt, Homo sapiens
ucuggcuccgugucuucacuccc

SEQ ID NO: 17324 - RNA, 22 nt, Homo sapiens
uagguaguuuccuguuguuggg

SEQ ID NO: 17325 - RNA, 21 nt, Homo sapiens
agggcccccccucaauccugu

SEQ ID NO: 17326 - RNA, 23 nt, Homo sapiens
ugaggggcagagagcgagacuuu

SEQ ID NO: 17327 - RNA, 22 nt, Homo sapiens
aguggggaacccuuccaugagg

SEQ ID NO: 17328 - RNA, 20 nt, Homo sapiens
accaggaggcugaggccccu

SEQ ID NO: 17329 - RNA, 20 nt, Homo sapiens
ggggagcuguggaagcagua

SEQ ID NO: 17330 - RNA, 20 nt, Homo sapiens
ggggagcuguggaagcagua

SEQ ID NO: 17331 - RNA, 22 nt, Homo sapiens
ugagguaguagguuguaugguu

SEQ ID NO: 17332 - RNA, 21 nt, Homo sapiens
caucccuugcaugguggaggg

SEQ ID NO: 17333 - RNA, 21 nt, Homo sapiens
ccaguccugugccugccgccu

SEQ ID NO: 17334 - RNA, 22 nt, Homo sapiens
uucccuuugucauccuaugccu

SEQ ID NO: 17335 - RNA, 22 nt, Homo sapiens
uucccuuugucauccuucgccu

SEQ ID NO: 17336 - RNA, 23 nt, Homo sapiens
gcaaagcacacggccugcagaga

SEQ ID NO: 17337 - RNA, 21 nt, Homo sapiens
acuggacuuggagucagaagg

SEQ ID NO: 17338 - RNA, 22 nt, Homo sapiens
ucagcaaacauuuauugugugc

SEQ ID NO: 17339 - RNA, 22 nt, Homo sapiens
aaaaguaauugcgaguuuuacc

SEQ ID NO: 17340 - RNA, 22 nt, Homo sapiens
aaaaguaauugugguuuuggcc

SEQ ID NO: 17341 - RNA, 22 nt, Homo sapiens
aaaaguaauugcgguuuuugcc

SEQ ID NO: 17342 - RNA, 22 nt, Homo sapiens
aaaaguaauugugguuuuugcc

SEQ ID NO: 17343 - RNA, 22 nt, Homo sapiens
aaaaguaaucgcgguuuuuguc

SEQ ID NO: 17344 - RNA, 22 nt, Homo sapiens
aaaaguaauugcggauuuugcc

SEQ ID NO: 17345 - RNA, 22 nt, Homo sapiens
aaaaguaauugcggucuuuggu

SEQ ID NO: 17346 - RNA, 22 nt, Homo sapiens
caaaaguaauuguggauuuugu

SEQ ID NO: 17347 - RNA, 21 nt, Homo sapiens
uaaaguaaauaugcaccaaaa

SEQ ID NO: 17348 - RNA, 21 nt, Homo sapiens
uggaggagaaggaaggugaug

SEQ ID NO: 17349 - RNA, 21 nt, Homo sapiens
cacuguguccuuucugcguag

SEQ ID NO: 17350 - RNA, 26 nt, Homo sapiens
gaugaugauggcagcaaauucugaaa

SEQ ID NO: 17351 - RNA, 22 nt, Homo sapiens
uaacagucuacagccauggucg

SEQ ID NO: 17352 - RNA, 21 nt, Homo sapiens
uaacagucuccagucacggcc

SEQ ID NO: 17353 - RNA, 22 nt, Homo sapiens
ugaaacauacacgggaaaccuc

SEQ ID NO: 17354 - RNA, 22 nt, Homo sapiens
aaaaguauuugcggguuuuguc

SEQ ID NO: 17355 - RNA, 21 nt, Homo sapiens
aggguaagcugaaccucugau

SEQ ID NO: 17356 - RNA, 21 nt, Homo sapiens
cuucuugugcucuaggauugu

SEQ ID NO: 17357 - RNA, 21 nt, Homo sapiens
cugacuguugccguccuccag

SEQ ID NO: 17358 - RNA, 22 nt, Homo sapiens
ugagaacugaauuccauggguu

SEQ ID NO: 17359 - RNA, 23 nt, Homo sapiens
ugaguaccgccaugucuguuggg

SEQ ID NO: 17360 - RNA, 22 nt, Homo sapiens
gaaguuguucgugguggauucg

SEQ ID NO: 17361 - RNA, 22 nt, Homo sapiens
ugaguauuacauggccaaucuc

SEQ ID NO: 17362 - RNA, 22 nt, Homo sapiens
aaaaguauuugcggguuuuguc

SEQ ID NO: 17363 - RNA, 21 nt, Homo sapiens
uggcagggaggcugggagggg

SEQ ID NO: 17364 - RNA, 22 nt, Homo sapiens
acaggugagguucuugggagcc

SEQ ID NO: 17365 - RNA, 17 nt, Homo sapiens
ucccaccgcugccaccc

SEQ ID NO: 17366 - RNA, 18 nt, Homo sapiens
cagggaggugaaugugau

SEQ ID NO: 17367 - RNA, 22 nt, Homo sapiens
ucucccaacccuuguaccagug

SEQ ID NO: 17368 - RNA, 22 nt, Homo sapiens
cgcaggggccgggugcucaccg

SEQ ID NO: 17369 - RNA, 22 nt, Homo sapiens
uggagugugacaaugguguuug

SEQ ID NO: 17370 - RNA, 24 nt, Homo sapiens
uggcccugacugaagaccagcagu

SEQ ID NO: 17371 - RNA, 22 nt, Homo sapiens
cagugcaaugaugaaagggcau

SEQ ID NO: 17372 - RNA, 21 nt, Homo sapiens
cggcggggacggcgauugguc

SEQ ID NO: 17373 - RNA, 20 nt, Homo sapiens
ccccagggcgacgcggcggg

SEQ ID NO: 17374 - RNA, 23 nt, Homo sapiens
guguuaauuaaaccucuauuuac

SEQ ID NO: 17375 - RNA, 21 nt, Homo sapiens
agggcccccccucaauccugu

SEQ ID NO: 17376 - RNA, 22 nt, Homo sapiens
aaaaguacuugcggauuuugcu

SEQ ID NO: 17377 - RNA, 21 nt, Homo sapiens
caaagaggaaggucccauuac

SEQ ID NO: 17378 - RNA, 22 nt, Homo sapiens
aggcggggcgccgcgggaccgc

SEQ ID NO: 17379 - RNA, 22 nt, Homo sapiens
ugcggggcuagggcuaacagca

SEQ ID NO: 17380 - RNA, 20 nt, Homo sapiens
ggggagcuguggaagcagua

SEQ ID NO: 17381 - RNA, 22 nt, Homo sapiens
ugagccccugugccgcccccag

SEQ ID NO: 17382 - RNA, 22 nt, Homo sapiens
acucggcguggcgucggucgug

SEQ ID NO: 17383 - RNA, 22 nt, Homo sapiens
uggagagaaaggcaguuccuga

SEQ ID NO: 17384 - RNA, 23 nt, Homo sapiens
gaacgcgcuucccuauagagggu

SEQ ID NO: 17385 - RNA, 19 nt, Homo sapiens
aggcugcggaauucaggac

SEQ ID NO: 17386 - RNA, 22 nt, Homo sapiens
uccgagccugggucucccucuu

SEQ ID NO: 17387 - RNA, 23 nt, Homo sapiens
aucgcugcgguugcgagcgcugu

SEQ ID NO: 17388 - RNA, 22 nt, Homo sapiens
ugagccccugugccgcccccag

SEQ ID NO: 17389 - RNA, 17 nt, Homo sapiens
gugggggagaggcuguc

SEQ ID NO: 17390 - RNA, 17 nt, Homo sapiens
ucccaccgcugccaccc

SEQ ID NO: 17391 - RNA, 18 nt, Homo sapiens
cagggaggugaaugugau

SEQ ID NO: 17392 - RNA, 23 nt, Homo sapiens
ucuggcuccgugucuucacuccc

SEQ ID NO: 17393 - RNA, 22 nt, Homo sapiens
aauugcacgguauccaucugua

SEQ ID NO: 17394 - RNA, 21 nt, Homo sapiens
agggggaaaguucuauagucc

SEQ ID NO: 17395 - RNA, 22 nt, Homo sapiens
gucccucuccaaaugugucuug

SEQ ID NO: 17396 - RNA, 21 nt, Homo sapiens
cuuuuugcggucugggcuugc

SEQ ID NO: 17397 - RNA, 22 nt, Homo sapiens
uggagagaaaggcaguuccuga

SEQ ID NO: 17398 - RNA, 23 nt, Homo sapiens
ugaggggcagagagcgagacuuu

SEQ ID NO: 17399 - RNA, 18 nt, Homo sapiens
uucacagggaggugucau

SEQ ID NO: 17400 - RNA, 22 nt, Homo sapiens
caaaaaucucaauuacuuuugc

SEQ ID NO: 17401 - RNA, 22 nt, Homo sapiens
uagcaaaaacugcaguuacuuu

SEQ ID NO: 17402 - RNA, 22 nt, Homo sapiens
acuccagccccacagccucagc

SEQ ID NO: 17403 - RNA, 23 nt, Homo sapiens
ucaaaugcucagacuccuguggu

SEQ ID NO: 17404 - RNA, 21 nt, Homo sapiens
cuuuuugcggucugggcuugc

SEQ ID NO: 17405 - RNA, 23 nt, Homo sapiens
uauggcuuuuuauuccuauguga

SEQ ID NO: 17406 - RNA, 23 nt, Homo sapiens
uuaaugcuaaucgugauaggggu

SEQ ID NO: 17407 - RNA, 22 nt, Homo sapiens
uccuucauuccaccggagucug

SEQ ID NO: 17408 - RNA, 18 nt, Homo sapiens
ugcuuccuuucagagggu

SEQ ID NO: 17409 - RNA, 22 nt, Homo sapiens
aucuggagguaagaagcacuuu

SEQ ID NO: 17410 - RNA, 22 nt, Homo sapiens
caugccuugaguguaggaccgu

SEQ ID NO: 17411 - RNA, 22 nt, Homo sapiens
uagcaaaaacugcaguuacuuu

SEQ ID NO: 17412 - RNA, 23 nt, Homo sapiens
aguauguucuuccaggacagaac

SEQ ID NO: 17413 - RNA, 22 nt, Homo sapiens
ucguaccgugaguaauaaugcg

SEQ ID NO: 17414 - RNA, 18 nt, Homo sapiens
cagggaggugaaugugau

SEQ ID NO: 17415 - RNA, 21 nt, Homo sapiens
ucgaggagcucacagucuagu

SEQ ID NO: 17416 - RNA, 21 nt, Homo sapiens
uccugcgcgucccagaugccc

SEQ ID NO: 17417 - RNA, 21 nt, Homo sapiens
cggcggggacggcgauugguc

SEQ ID NO: 17418 - RNA, 22 nt, Homo sapiens
cgcaggggccgggugcucaccg

SEQ ID NO: 17419 - RNA, 22 nt, Homo sapiens
aacuggcccucaaagucccgcu

SEQ ID NO: 17420 - RNA, 22 nt, Homo sapiens
cauugcacuugucucggucuga

SEQ ID NO: 17421 - RNA, 21 nt, Homo sapiens
aggcaagaugcuggcauagcu

SEQ ID NO: 17422 - RNA, 22 nt, Homo sapiens
gaaagcgcuucccuuugcugga

SEQ ID NO: 17423 - RNA, 22 nt, Homo sapiens
caaagcgcuccccuuuagaggu

SEQ ID NO: 17424 - RNA, 23 nt, Homo sapiens
caaagcgcuucucuuuagagugu

SEQ ID NO: 17425 - RNA, 21 nt, Homo sapiens
caaagcgcuucccuuuggagc

SEQ ID NO: 17426 - RNA, 21 nt, Homo sapiens
gaaagcgcuucucuuuagagg

SEQ ID NO: 17427 - RNA, 25 nt, Homo sapiens
ggcggagggaaguagguccguuggu

SEQ ID NO: 17428 - RNA, 22 nt, Homo sapiens
aggcggggcgccgcgggaccgc

SEQ ID NO: 17429 - RNA, 20 nt, Homo sapiens
accaggaggcugaggccccu

SEQ ID NO: 17430 - RNA, 20 nt, Homo sapiens
cggcucugggucugugggga

SEQ ID NO: 17431 - RNA, 22 nt, Homo sapiens
aucacacaaaggcaacuuuugu

SEQ ID NO: 17432 - RNA, 22 nt, Homo sapiens
ccucuuccccuugucucuccag

SEQ ID NO: 17433 - RNA, 22 nt, Homo sapiens
uucuggaauucugugugaggga

SEQ ID NO: 17434 - RNA, 22 nt, Homo sapiens
aagcccuuaccccaaaaagcau

SEQ ID NO: 17435 - RNA, 22 nt, Homo sapiens
ucagugcaucacagaacuuugu

SEQ ID NO: 17436 - RNA, 22 nt, Homo sapiens
cccugugcccggcccacuucug

SEQ ID NO: 17437 - RNA, 22 nt, Homo sapiens
uuggggaaacggccgcugagug

SEQ ID NO: 17438 - RNA, 23 nt, Homo sapiens
ucccuguccuccaggagcucacg

SEQ ID NO: 17439 - RNA, 22 nt, Homo sapiens
cgucaacacuugcugguuuccu

SEQ ID NO: 17440 - RNA, 19 nt, Homo sapiens
ugucucugcugggguuucu

SEQ ID NO: 17441 - RNA, 21 nt, Homo sapiens
agggggaaaguucuauagucc

SEQ ID NO: 17442 - RNA, 20 nt, Homo sapiens
guagaggagauggcgcaggg

SEQ ID NO: 17443 - RNA, 17 nt, Homo sapiens
ucccaccgcugccaccc

SEQ ID NO: 17444 - RNA, 18 nt, Homo sapiens
ugcuuccuuucagagggu

SEQ ID NO: 17445 - RNA, 22 nt, Homo sapiens
aucuggagguaagaagcacuuu

SEQ ID NO: 17446 - RNA, 20 nt, Homo sapiens
ggggagcuguggaagcagua

SEQ ID NO: 17447 - RNA, 21 nt, Homo sapiens
ccgucgccgccacccgagccg

SEQ ID NO: 17448 - RNA, 22 nt, Homo sapiens
ggagacgcggcccuguuggagu

SEQ ID NO: 17449 - RNA, 21 nt, Homo sapiens
cggcggggacggcgauugguc

SEQ ID NO: 17450 - RNA, 22 nt, Homo sapiens
uagguaguuuccuguuguuggg

SEQ ID NO: 17451 - RNA, 22 nt, Homo sapiens
aggcggggcgccgcgggaccgc

SEQ ID NO: 17452 - RNA, 22 nt, Homo sapiens
uucuggaauucugugugaggga

SEQ ID NO: 17453 - RNA, 22 nt, Homo sapiens
aagcccuuaccccaaaaagcau

SEQ ID NO: 17454 - RNA, 23 nt, Homo sapiens
uauggcuuuuuauuccuauguga

SEQ ID NO: 17455 - RNA, 22 nt, Homo sapiens
ugagaacugaauuccauggguu

SEQ ID NO: 17456 - RNA, 22 nt, Homo sapiens
ugagaacugaauuccauaggcu

SEQ ID NO: 17457 - RNA, 23 nt, Homo sapiens
ucuggcuccgugucuucacuccc

SEQ ID NO: 17458 - RNA, 22 nt, Homo sapiens
uggagagaaaggcaguuccuga

SEQ ID NO: 17459 - RNA, 22 nt, Homo sapiens
uggagagaaaggcaguuccuga

SEQ ID NO: 17460 - RNA, 20 nt, Homo sapiens
uguuuugauaacaguaaugu

SEQ ID NO: 17461 - RNA, 22 nt, Homo sapiens
cauugcacuugucucggucuga

SEQ ID NO: 17462 - RNA, 23 nt, Homo sapiens
cacucagccuugagggcacuuuc

SEQ ID NO: 17463 - RNA, 17 nt, Homo sapiens
ucucgcuggggccucca

SEQ ID NO: 17464 - RNA, 23 nt, Homo sapiens
uccaguaccacgugucagggcca

SEQ ID NO: 17465 - RNA, 22 nt, Homo sapiens
ucggccugaccacccaccccac

SEQ ID NO: 17466 - RNA, 22 nt, Homo sapiens
augguacccuggcauacugagu

SEQ ID NO: 17467 - RNA, 22 nt, Homo sapiens
uggguggucuggagauuugugc

SEQ ID NO: 17468 - RNA, 21 nt, Homo sapiens
cggcggggacggcgauugguc

SEQ ID NO: 17469 - RNA, 22 nt, Homo sapiens
uagcuuaucagacugauguuga

SEQ ID NO: 17470 - RNA, 22 nt, Homo sapiens
cauugcacuugucucggucuga

SEQ ID NO: 17471 - RNA, 23 nt, Homo sapiens
ucccccaggugugauucugauuu

SEQ ID NO: 17472 - RNA, 19 nt, Homo sapiens
gggcgccugugaucccaac

SEQ ID NO: 17473 - RNA, 25 nt, Homo sapiens
aggggugguguugggacagcuccgu

SEQ ID NO: 17474 - RNA, 24 nt, Homo sapiens
acugggggcuuucgggcucugcgu

SEQ ID NO: 17475 - RNA, 22 nt, Homo sapiens
aggcggggcgccgcgggaccgc

SEQ ID NO: 17476 - RNA, 25 nt, Homo sapiens
gggcgacaaagcaagacucuuucuu

SEQ ID NO: 17477 - RNA, 23 nt, Homo sapiens
gaagugcuucgauuuuggggugu

SEQ ID NO: 17478 - RNA, 22 nt, Homo sapiens
aucacacaaaggcaacuuuugu

SEQ ID NO: 17479 - RNA, 22 nt, Homo sapiens
agucauuggaggguuugagcag

SEQ ID NO: 17480 - RNA, 24 nt, Homo sapiens
ugccugggucucuggccugcgcgu

SEQ ID NO: 17481 - RNA, 21 nt, Homo sapiens
uggcagggaggcugggagggg

SEQ ID NO: 17482 - RNA, 22 nt, Homo sapiens
uggagugugacaaugguguuug

SEQ ID NO: 17483 - RNA, 17 nt, Homo sapiens
ucgccuccuccucuccc

SEQ ID NO: 17484 - RNA, 21 nt, Homo sapiens
uccugcgcgucccagaugccc

SEQ ID NO: 17485 - RNA, 21 nt, Homo sapiens
cggcggggacggcgauugguc

SEQ ID NO: 17486 - RNA, 22 nt, Homo sapiens
cgcaggggccgggugcucaccg

SEQ ID NO: 17487 - RNA, 23 nt, Homo sapiens
ugagcgccucgacgacagagccg

SEQ ID NO: 17488 - RNA, 19 nt, Homo sapiens
ugucucugcugggguuucu

SEQ ID NO: 17489 - RNA, 21 nt, Homo sapiens
ucccacguuguggcccagcag

SEQ ID NO: 17490 - RNA, 22 nt, Homo sapiens
aggcggggcgccgcgggaccgc

SEQ ID NO: 17491 - RNA, 23 nt, Homo sapiens
aggaagcccuggaggggcuggag

SEQ ID NO: 17492 - RNA, 22 nt, Homo sapiens
ugcggggcuagggcuaacagca

SEQ ID NO: 17493 - RNA, 22 nt, Homo sapiens
acccgucccguucguccccgga

SEQ ID NO: 17494 - RNA, 22 nt, Homo sapiens
uauggcacugguagaauucacu

SEQ ID NO: 17495 - RNA, 19 nt, Homo sapiens
accgugcaaagguagcaua

SEQ ID NO: 17496 - RNA, 22 nt, Homo sapiens
cauugcacuugucucggucuga

SEQ ID NO: 17497 - RNA, 23 nt, Homo sapiens
ugaggggcagagagcgagacuuu

SEQ ID NO: 17498 - RNA, 22 nt, Homo sapiens
ucgugcaucccuuuagaguguu

SEQ ID NO: 17499 - RNA, 22 nt, Homo sapiens
aggcggggcgccgcgggaccgc

SEQ ID NO: 17500 - RNA, 22 nt, Homo sapiens
ugcggggcuagggcuaacagca

SEQ ID NO: 17501 - RNA, 21 nt, Homo sapiens
uggaggagaaggaaggugaug

SEQ ID NO: 17502 - RNA, 21 nt, Homo sapiens
ccuggaaacacugagguugug

SEQ ID NO: 17503 - RNA, 21 nt, Homo sapiens
uggcagggaggcugggagggg

SEQ ID NO: 17504 - RNA, 22 nt, Homo sapiens
uggagugugacaaugguguuug

SEQ ID NO: 17505 - RNA, 22 nt, Homo sapiens
acccgucccguucguccccgga

SEQ ID NO: 17506 - RNA, 21 nt, Homo sapiens
acucuagcugccaaaggcgcu

SEQ ID NO: 17507 - RNA, 24 nt, Homo sapiens
uggcccugacugaagaccagcagu

SEQ ID NO: 17508 - RNA, 23 nt, Homo sapiens
ucuggcuccgugucuucacuccc

SEQ ID NO: 17509 - RNA, 18 nt, Homo sapiens
ugaggcaguagauugaau

SEQ ID NO: 17510 - RNA, 20 nt, Homo sapiens
ccccagggcgacgcggcggg

SEQ ID NO: 17511 - RNA, 22 nt, Homo sapiens
aagcugccaguugaagaacugu

SEQ ID NO: 17512 - RNA, 22 nt, Homo sapiens
cuggcccucucugcccuuccgu

SEQ ID NO: 17513 - RNA, 22 nt, Homo sapiens
aauugcacgguauccaucugua

SEQ ID NO: 17514 - RNA, 23 nt, Homo sapiens
ugaggggcagagagcgagacuuu

SEQ ID NO: 17515 - RNA, 21 nt, Homo sapiens
ugaguuggccaucugagugag

SEQ ID NO: 17516 - RNA, 21 nt, Homo sapiens
aggaggcagcgcucucaggac

SEQ ID NO: 17517 - RNA, 22 nt, Homo sapiens
uauugcacucgucccggccucc

SEQ ID NO: 17518 - RNA, 22 nt, Homo sapiens
ugugcgcagggagaccucuccc

SEQ ID NO: 17519 - RNA, 21 nt, Homo sapiens
aaggcagggcccccgcucccc

SEQ ID NO: 17520 - RNA, 22 nt, Homo sapiens
ucuucucuguuuuggccaugug

SEQ ID NO: 17521 - RNA, 22 nt, Homo sapiens
uuuccggcucgcgugggugugu

SEQ ID NO: 17522 - RNA, 22 nt, Homo sapiens
ccucuuccccuugucucuccag

SEQ ID NO: 17523 - RNA, 22 nt, Homo sapiens
gcccgcguguggagccaggugu

SEQ ID NO: 17524 - RNA, 21 nt, Homo sapiens
uggguuuacguugggagaacu

SEQ ID NO: 17525 - RNA, 22 nt, Homo sapiens
gucccucuccaaaugugucuug

SEQ ID NO: 17526 - RNA, 20 nt, Homo sapiens
cggcucugggucugugggga

SEQ ID NO: 17527 - RNA, 20 nt, Homo sapiens
guagaggagauggcgcaggg

SEQ ID NO: 17528 - RNA, 25 nt, Homo sapiens
cuagugagggacagaaccaggauuc

SEQ ID NO: 17529 - RNA, 23 nt, Homo sapiens
cacccggcugugugcacaugugc

SEQ ID NO: 17530 - RNA, 22 nt, Homo sapiens
cuccugagccauucugagccuc

SEQ ID NO: 17531 - RNA, 21 nt, Homo sapiens
ugacaacuauggaugagcucu

SEQ ID NO: 17532 - RNA, 22 nt, Homo sapiens
aaaaguaauugcggauuuugcc

SEQ ID NO: 17533 - RNA, 23 nt, Homo sapiens
ucaagagcaauaacgaaaaaugu

SEQ ID NO: 17534 - RNA, 22 nt, Homo sapiens
aacuguuugcagaggaaacuga

SEQ ID NO: 17535 - RNA, 22 nt, Homo sapiens
ugaaacauacacgggaaaccuc

SEQ ID NO: 17536 - RNA, 20 nt, Homo sapiens
guugugucaguuuaucaaac

SEQ ID NO: 17537 - RNA, 21 nt, Homo sapiens
gcaggaacuugugagucuccu

SEQ ID NO: 17538 - RNA, 21 nt, Homo sapiens
agcuacaucuggcuacugggu

SEQ ID NO: 17539 - RNA, 22 nt, Homo sapiens
ucggccugaccacccaccccac

SEQ ID NO: 17540 - RNA, 23 nt, Homo sapiens
cggcccgggcugcugcuguuccu

SEQ ID NO: 17541 - RNA, 22 nt, Homo sapiens
cucuagagggaagcacuuucug

SEQ ID NO: 17542 - RNA, 22 nt, Homo sapiens
uggcucaguucagcaggaacag

SEQ ID NO: 17543 - RNA, 23 nt, Homo sapiens
ggcagguucucacccucucuagg

SEQ ID NO: 17544 - RNA, 24 nt, Homo sapiens
ugccugggucucuggccugcgcgu

SEQ ID NO: 17545 - RNA, 20 nt, Homo sapiens
ggggagcuguggaagcagua

SEQ ID NO: 17546 - RNA, 24 nt, Homo sapiens
uggggagcugaggcucugggggug

SEQ ID NO: 17547 - RNA, 23 nt, Homo sapiens
uuucaagccagggggcguuuuuc

SEQ ID NO: 17548 - RNA, 17 nt, Homo sapiens
ucgccuccuccucuccc

SEQ ID NO: 17549 - RNA, 18 nt, Homo sapiens
cagggaggugaaugugau

SEQ ID NO: 17550 - RNA, 21 nt, Homo sapiens
gcccuccgcccgugcaccccg

SEQ ID NO: 17551 - RNA, 21 nt, Homo sapiens
cggcggggacggcgauugguc

SEQ ID NO: 17552 - RNA, 22 nt, Homo sapiens
uaugugccuuuggacuacaucg

SEQ ID NO: 17553 - RNA, 22 nt, Homo sapiens
aggcggggcgccgcgggaccgc

SEQ ID NO: 17554 - RNA, 22 nt, Homo sapiens
ugcggggcuagggcuaacagca

SEQ ID NO: 17555 - RNA, 21 nt, Homo sapiens
agugaaugauggguucugacc

SEQ ID NO: 17556 - RNA, 22 nt, Homo sapiens
ucaaaacugaggggcauuuucu

SEQ ID NO: 17557 - RNA, 22 nt, Homo sapiens
ucagugcaucacagaacuuugu

SEQ ID NO: 17558 - RNA, 22 nt, Homo sapiens
ucagugcaucacagaacuuugu

SEQ ID NO: 17559 - RNA, 23 nt, Homo sapiens
ugugcaaaucuaugcaaaacuga

SEQ ID NO: 17560 - RNA, 22 nt, Homo sapiens
aacaauauccuggugcugagug

SEQ ID NO: 17561 - RNA, 22 nt, Homo sapiens
agagguaguagguugcauaguu

SEQ ID NO: 17562 - RNA, 22 nt, Homo sapiens
ugucaguuugucaaauacccca

SEQ ID NO: 17563 - RNA, 22 nt, Homo sapiens
uggcaguguauuguuagcuggu

SEQ ID NO: 17564 - RNA, 22 nt, Homo sapiens
auauaauacaaccugcuaagug

SEQ ID NO: 17565 - RNA, 22 nt, Homo sapiens
ccaaaacugcaguuacuuuugc

SEQ ID NO: 17566 - RNA, 22 nt, Homo sapiens
uagcaaaaacugcaguuacuuu

SEQ ID NO: 17567 - RNA, 22 nt, Homo sapiens
caaaguuuaagauccuugaagu

SEQ ID NO: 17568 - RNA, 21 nt, Homo sapiens
uggcagggaggcugggagggg

SEQ ID NO: 17569 - RNA, 24 nt, Homo sapiens
agccuggaagcuggagccugcagu

SEQ ID NO: 17570 - RNA, 22 nt, Homo sapiens
gcccgcguguggagccaggugu

SEQ ID NO: 17571 - RNA, 21 nt, Homo sapiens
ugacaacuauggaugagcucu

SEQ ID NO: 17572 - RNA, 22 nt, Homo sapiens
uaaugccccuaaaaauccuuau

SEQ ID NO: 17573 - RNA, 22 nt, Homo sapiens
caaccuggaggacuccaugcug

SEQ ID NO: 17574 - RNA, 22 nt, Homo sapiens
ugaaggucuacugugugccagg

SEQ ID NO: 17575 - RNA, 22 nt, Homo sapiens
aaaaguacuugcggauuuugcu

SEQ ID NO: 17576 - RNA, 22 nt, Homo sapiens
caaaaguaauuguggauuuugu

SEQ ID NO: 17577 - RNA, 21 nt, Homo sapiens
aagccugcccggcuccucggg

SEQ ID NO: 17578 - RNA, 22 nt, Homo sapiens
agacuucccauuugaagguggc

SEQ ID NO: 17579 - RNA, 21 nt, Homo sapiens
aaggcagggcccccgcucccc

SEQ ID NO: 17580 - RNA, 21 nt, Homo sapiens
ccccaccuccucucuccucag

SEQ ID NO: 17581 - RNA, 24 nt, Homo sapiens
agccuggaagcuggagccugcagu

SEQ ID NO: 17582 - RNA, 23 nt, Homo sapiens
ucuggcuccgugucuucacuccc

SEQ ID NO: 17583 - RNA, 23 nt, Homo sapiens
ucuggcuccgugucuucacuccc

SEQ ID NO: 17584 - RNA, 23 nt, Homo sapiens
uaaggugcaucuagugcagauag

SEQ ID NO: 17585 - RNA, 22 nt, Homo sapiens
cccugugcccggcccacuucug

SEQ ID NO: 17586 - RNA, 20 nt, Homo sapiens
ccuccugcccuccuugcugu

SEQ ID NO: 17587 - RNA, 22 nt, Homo sapiens
acacagggcuguugugaagacu

SEQ ID NO: 17588 - RNA, 22 nt, Homo sapiens
ucaggcucaguccccucccgau

SEQ ID NO: 17589 - RNA, 22 nt, Homo sapiens
agaggcuggccgugaugaauuc

SEQ ID NO: 17590 - RNA, 21 nt, Homo sapiens
aagccugcccggcuccucggg

SEQ ID NO: 17591 - RNA, 23 nt, Homo sapiens
uauucauuuauccccagccuaca

SEQ ID NO: 17592 - RNA, 20 nt, Homo sapiens
ggggagcuguggaagcagua

SEQ ID NO: 17593 - RNA, 20 nt, Homo sapiens
uaaagagcccuguggagaca

SEQ ID NO: 17594 - RNA, 21 nt, Homo sapiens
cuuuuugcggucugggcuugc

SEQ ID NO: 17595 - RNA, 22 nt, Homo sapiens
uuuagagacggggucuugcucu

SEQ ID NO: 17596 - RNA, 22 nt, Homo sapiens
cagugcaaugaugaaagggcau

SEQ ID NO: 17597 - RNA, 22 nt, Homo sapiens
uguaaacauccucgacuggaag

SEQ ID NO: 17598 - RNA, 22 nt, Homo sapiens
uguaaacauccccgacuggaag

SEQ ID NO: 17599 - RNA, 22 nt, Homo sapiens
uguaaacauccuugacuggaag

SEQ ID NO: 17600 - RNA, 21 nt, Homo sapiens
acuggacuuggagucagaagg

SEQ ID NO: 17601 - RNA, 22 nt, Homo sapiens
uacucaggagaguggcaaucac

SEQ ID NO: 17602 - RNA, 22 nt, Homo sapiens
ugugacagauugauaacugaaa

SEQ ID NO: 17603 - RNA, 19 nt, Homo sapiens
ugucucugcugggguuucu

SEQ ID NO: 17604 - RNA, 22 nt, Homo sapiens
gugagucucuaagaaaagagga

SEQ ID NO: 17605 - RNA, 21 nt, Homo sapiens
uacuuggaaaggcaucaguug

SEQ ID NO: 17606 - RNA, 19 nt, Homo sapiens
gugaggacucgggaggugg

SEQ ID NO: 17607 - RNA, 22 nt, Homo sapiens
uggagagaaaggcaguuccuga

SEQ ID NO: 17608 - RNA, 21 nt, Homo sapiens
ccaguccugugccugccgccu

SEQ ID NO: 17609 - RNA, 22 nt, Homo sapiens
uagcuuaucagacugauguuga

SEQ ID NO: 17610 - RNA, 21 nt, Homo sapiens
uaaagugcugacagugcagau

SEQ ID NO: 17611 - RNA, 23 nt, Homo sapiens
cagugcaaugauauugucaaagc

SEQ ID NO: 17612 - RNA, 22 nt, Homo sapiens
uuauaauacaaccugauaagug

SEQ ID NO: 17613 - RNA, 22 nt, Homo sapiens
auauaauacaaccugcuaagug

SEQ ID NO: 17614 - RNA, 22 nt, Homo sapiens
caaaaaucucaauuacuuuugc

SEQ ID NO: 17615 - RNA, 21 nt, Homo sapiens
uaauuuuauguauaagcuagu

SEQ ID NO: 17616 - RNA, 22 nt, Homo sapiens
gagcuuauucauaaaagugcag

SEQ ID NO: 17617 - RNA, 22 nt, Homo sapiens
aaaccuguguuguucaagaguc

SEQ ID NO: 17618 - RNA, 21 nt, Homo sapiens
aauauuauacagucaaccucu

SEQ ID NO: 17619 - RNA, 21 nt, Homo sapiens
ccccaccuccucucuccucag

SEQ ID NO: 17620 - RNA, 22 nt, Homo sapiens
cuggacugagccgugcuacugg

SEQ ID NO: 17621 - RNA, 21 nt, Homo sapiens
uggacugcccugaucuggaga

SEQ ID NO: 17622 - RNA, 22 nt, Homo sapiens
cagugcaaugaugaaagggcau

SEQ ID NO: 17623 - RNA, 22 nt, Homo sapiens
uagcagcacauaaugguuugug

SEQ ID NO: 17624 - RNA, 22 nt, Homo sapiens
uagcagcacaucaugguuuaca

SEQ ID NO: 17625 - RNA, 22 nt, Homo sapiens
uagcagcacguaaauauuggcg

SEQ ID NO: 17626 - RNA, 23 nt, Homo sapiens
caaagugcuuacagugcagguag

SEQ ID NO: 17627 - RNA, 22 nt, Homo sapiens
uggagagaaaggcaguuccuga

SEQ ID NO: 17628 - RNA, 23 nt, Homo sapiens
ugaguaccgccaugucuguuggg

SEQ ID NO: 17629 - RNA, 21 nt, Homo sapiens
uagcagcacagaaauauuggc

SEQ ID NO: 17630 - RNA, 23 nt, Homo sapiens
agcuacauugucugcuggguuuc

SEQ ID NO: 17631 - RNA, 21 nt, Homo sapiens
acuggacuuggagucagaagg

SEQ ID NO: 17632 - RNA, 22 nt, Homo sapiens
acuggacuuagggucagaaggc

SEQ ID NO: 17633 - RNA, 22 nt, Homo sapiens
cagcagcaauucauguuuugaa

SEQ ID NO: 17634 - RNA, 21 nt, Homo sapiens
gcaguccaugggcauauacac

SEQ ID NO: 17635 - RNA, 21 nt, Homo sapiens
cagcagcacacugugguuugu

SEQ ID NO: 17636 - RNA, 21 nt, Homo sapiens
auccuugcuaucugggugcua

SEQ ID NO: 17637 - RNA, 24 nt, Homo sapiens
gaccuggacauguuugugcccagu

SEQ ID NO: 17638 - RNA, 21 nt, Homo sapiens
agaccuggcccagaccucagc

SEQ ID NO: 17639 - RNA, 22 nt, Homo sapiens
ugagaccucuggguucugagcu

SEQ ID NO: 17640 - RNA, 20 nt, Homo sapiens
guagaggagauggcgcaggg

SEQ ID NO: 17641 - RNA, 20 nt, Homo sapiens
ggggagcuguggaagcagua

SEQ ID NO: 17642 - RNA, 21 nt, Homo sapiens
aaggcagggcccccgcucccc

SEQ ID NO: 17643 - RNA, 18 nt, Homo sapiens
cagggaggugaaugugau

SEQ ID NO: 17644 - RNA, 21 nt, Homo sapiens
gcccuccgcccgugcaccccg

SEQ ID NO: 17645 - RNA, 23 nt, Homo sapiens
ucuggcuccgugucuucacuccc

SEQ ID NO: 17646 - RNA, 21 nt, Homo sapiens
cggcggggacggcgauugguc

SEQ ID NO: 17647 - RNA, 22 nt, Homo sapiens
uucccuuugucauccuaugccu

SEQ ID NO: 17648 - RNA, 22 nt, Homo sapiens
uucccuuugucauccuucgccu

SEQ ID NO: 17649 - RNA, 22 nt, Homo sapiens
cauugcacuugucucggucuga

SEQ ID NO: 17650 - RNA, 21 nt, Homo sapiens
uucacaguggcuaaguucugc

SEQ ID NO: 17651 - RNA, 21 nt, Homo sapiens
aaagcgcuucccuucagagug

SEQ ID NO: 17652 - RNA, 25 nt, Homo sapiens
ggcggagggaaguagguccguuggu

SEQ ID NO: 17653 - RNA, 22 nt, Homo sapiens
aggcggggcgccgcgggaccgc

SEQ ID NO: 17654 - RNA, 24 nt, Homo sapiens
uggggagcugaggcucugggggug

SEQ ID NO: 17655 - RNA, 21 nt, Homo sapiens
ccgucgccgccacccgagccg

SEQ ID NO: 17656 - RNA, 22 nt, Homo sapiens
ccucuuccccuugucucuccag

SEQ ID NO: 17657 - RNA, 22 nt, Homo sapiens
gugugcggaaaugcuucugcua

SEQ ID NO: 17658 - RNA, 22 nt, Homo sapiens
cccugugcccggcccacuucug

SEQ ID NO: 17659 - RNA, 23 nt, Homo sapiens
ucaagagcaauaacgaaaaaugu

SEQ ID NO: 17660 - RNA, 25 nt, Homo sapiens
agggaucgcgggcggguggcggccu

SEQ ID NO: 17661 - RNA, 25 nt, Homo sapiens
ggcggagggaaguagguccguuggu

SEQ ID NO: 17662 - RNA, 18 nt, Homo sapiens
ucagcuggcccucauuuc

SEQ ID NO: 17663 - RNA, 21 nt, Homo sapiens
ccccaccuccucucuccucag

SEQ ID NO: 17664 - RNA, 19 nt, Homo sapiens
gugaggacucgggaggugg

SEQ ID NO: 17665 - RNA, 18 nt, Homo sapiens
aucccaccucugccacca

SEQ ID NO: 17666 - RNA, 21 nt, Homo sapiens
cggcggggacggcgauugguc

SEQ ID NO: 17667 - RNA, 20 nt, Homo sapiens
ccccagggcgacgcggcggg

SEQ ID NO: 17668 - RNA, 22 nt, Homo sapiens
uguaacagcaacuccaugugga

SEQ ID NO: 17669 - RNA, 22 nt, Homo sapiens
uagcuuaucagacugauguuga

SEQ ID NO: 17670 - RNA, 21 nt, Homo sapiens
agggcccccccucaauccugu

SEQ ID NO: 17671 - RNA, 22 nt, Homo sapiens
uggcagugucuuagcugguugu

SEQ ID NO: 17672 - RNA, 22 nt, Homo sapiens
caaucacuaacuccacugccau

SEQ ID NO: 17673 - RNA, 23 nt, Homo sapiens
aggcaguguaguuagcugauugc

SEQ ID NO: 17674 - RNA, 22 nt, Homo sapiens
uggcaguguauuguuagcuggu

SEQ ID NO: 17675 - RNA, 22 nt, Homo sapiens
aggcaguguauuguuagcuggc

SEQ ID NO: 17676 - RNA, 22 nt, Homo sapiens
aggcggggcgccgcgggaccgc

SEQ ID NO: 17677 - RNA, 22 nt, Homo sapiens
ugcggggcuagggcuaacagca

SEQ ID NO: 17678 - RNA, 20 nt, Homo sapiens
ggggagcuguggaagcagua

SEQ ID NO: 17679 - RNA, 21 nt, Homo sapiens
gugccagcugcagugggggag

SEQ ID NO: 17680 - RNA, 20 nt, Homo sapiens
ucacuguucagacaggcgga

SEQ ID NO: 17681 - RNA, 24 nt, Homo sapiens
agccuggaagcuggagccugcagu

SEQ ID NO: 17682 - RNA, 24 nt, Homo sapiens
uggcccugacugaagaccagcagu

SEQ ID NO: 17683 - RNA, 22 nt, Homo sapiens
cagugcaauguuaaaagggcau

SEQ ID NO: 17684 - RNA, 22 nt, Homo sapiens
cagugcaaugaugaaagggcau

SEQ ID NO: 17685 - RNA, 22 nt, Homo sapiens
ugcccuguggacucaguucugg

SEQ ID NO: 17686 - RNA, 22 nt, Homo sapiens
cccugugcccggcccacuucug

SEQ ID NO: 17687 - RNA, 22 nt, Homo sapiens
acacagggcuguugugaagacu

SEQ ID NO: 17688 - RNA, 23 nt, Homo sapiens
cagugcaauaguauugucaaagc

SEQ ID NO: 17689 - RNA, 23 nt, Homo sapiens
cagugcaaugauauugucaaagc

SEQ ID NO: 17690 - RNA, 22 nt, Homo sapiens
cuggcccucucugcccuuccgu

SEQ ID NO: 17691 - RNA, 22 nt, Homo sapiens
uccagcaucagugauuuuguug

SEQ ID NO: 17692 - RNA, 20 nt, Homo sapiens
auuccuagaaauuguucaua

SEQ ID NO: 17693 - RNA, 22 nt, Homo sapiens
aacuguuugcagaggaaacuga

SEQ ID NO: 17694 - RNA, 23 nt, Homo sapiens
uagugcaauauugcuuauagggu

SEQ ID NO: 17695 - RNA, 22 nt, Homo sapiens
agaggcuggccgugaugaauuc

SEQ ID NO: 17696 - RNA, 20 nt, Homo sapiens
agaccauggguucucauugu

SEQ ID NO: 17697 - RNA, 21 nt, Homo sapiens
aagccugcccggcuccucggg

SEQ ID NO: 17698 - RNA, 23 nt, Homo sapiens
ucaaaugcucagacuccuguggu

SEQ ID NO: 17699 - RNA, 20 nt, Homo sapiens
ucugcaggguuugcuuugag

SEQ ID NO: 17700 - RNA, 21 nt, Homo sapiens
ccccaccuccucucuccucag

SEQ ID NO: 17701 - RNA, 20 nt, Homo sapiens
gugucugggcggacagcugc

SEQ ID NO: 17702 - RNA, 24 nt, Homo sapiens
agccuggaagcuggagccugcagu

SEQ ID NO: 17703 - RNA, 23 nt, Homo sapiens
aggaugagcaaagaaaguagauu

SEQ ID NO: 17704 - RNA, 22 nt, Homo sapiens
cggaugagcaaagaaagugguu

SEQ ID NO: 17705 - RNA, 22 nt, Homo sapiens
cuggacugagccgugcuacugg

SEQ ID NO: 17706 - RNA, 21 nt, Homo sapiens
uggacugcccugaucuggaga

SEQ ID NO: 17707 - RNA, 22 nt, Homo sapiens
uagcagcacauaaugguuugug

SEQ ID NO: 17708 - RNA, 22 nt, Homo sapiens
uagcagcacaucaugguuuaca

SEQ ID NO: 17709 - RNA, 22 nt, Homo sapiens
uagcagcacguaaauauuggcg

SEQ ID NO: 17710 - RNA, 23 nt, Homo sapiens
caaagugcuuacagugcagguag

SEQ ID NO: 17711 - RNA, 18 nt, Homo sapiens
ugaggcaguagauugaau

SEQ ID NO: 17712 - RNA, 21 nt, Homo sapiens
uagcagcacagaaauauuggc

SEQ ID NO: 17713 - RNA, 21 nt, Homo sapiens
acuggacuuggagucagaagg

SEQ ID NO: 17714 - RNA, 22 nt, Homo sapiens
acuggacuuagggucagaaggc

SEQ ID NO: 17715 - RNA, 22 nt, Homo sapiens
cagcagcaauucauguuuugaa

SEQ ID NO: 17716 - RNA, 21 nt, Homo sapiens
gcaguccaugggcauauacac

SEQ ID NO: 17717 - RNA, 22 nt, Homo sapiens
agaggcuggccgugaugaauuc

SEQ ID NO: 17718 - RNA, 21 nt, Homo sapiens
cagcagcacacugugguuugu

SEQ ID NO: 17719 - RNA, 21 nt, Homo sapiens
auccuugcuaucugggugcua

SEQ ID NO: 17720 - RNA, 22 nt, Homo sapiens
uacugcagacguggcaaucaug

SEQ ID NO: 17721 - RNA, 21 nt, Homo sapiens
uacugcagacaguggcaauca

SEQ ID NO: 17722 - RNA, 22 nt, Homo sapiens
aaagugcauccuuuuagagugu

SEQ ID NO: 17723 - RNA, 22 nt, Homo sapiens
aaagugcauccuuuuagagguu

SEQ ID NO: 17724 - RNA, 22 nt, Homo sapiens
aaagugcaucuuuuuagaggau

SEQ ID NO: 17725 - RNA, 22 nt, Homo sapiens
gucccucuccaaaugugucuug

SEQ ID NO: 17726 - RNA, 22 nt, Homo sapiens
uaugucugcugaccaucaccuu

SEQ ID NO: 17727 - RNA, 20 nt, Homo sapiens
guagaggagauggcgcaggg

SEQ ID NO: 17728 - RNA, 21 nt, Homo sapiens
aaggcagggcccccgcucccc

SEQ ID NO: 17729 - RNA, 21 nt, Homo sapiens
ccccaccuccucucuccucag

SEQ ID NO: 17730 - RNA, 21 nt, Homo sapiens
cggcggggacggcgauugguc

SEQ ID NO: 17731 - RNA, 23 nt, Homo sapiens
ugaguaccgccaugucuguuggg

SEQ ID NO: 17732 - RNA, 22 nt, Homo sapiens
ucugcccccuccgcugcugcca

SEQ ID NO: 17733 - RNA, 20 nt, Homo sapiens
acugccccaggugcugcugg

SEQ ID NO: 17734 - RNA, 21 nt, Homo sapiens
cggggcagcucaguacaggau

SEQ ID NO: 17735 - RNA, 22 nt, Homo sapiens
uggugggcacagaaucuggacu

SEQ ID NO: 17736 - RNA, 19 nt, Homo sapiens
gggcgccugugaucccaac

SEQ ID NO: 17737 - RNA, 22 nt, Homo sapiens
uggugggccgcagaacaugugc

SEQ ID NO: 17738 - RNA, 22 nt, Homo sapiens
aggcggggcgccgcgggaccgc

SEQ ID NO: 17739 - RNA, 21 nt, Homo sapiens
uggaggagaaggaaggugaug

SEQ ID NO: 17740 - RNA, 21 nt, Homo sapiens
cgcgggugcuuacugacccuu

SEQ ID NO: 17741 - RNA, 20 nt, Homo sapiens
ggggagcuguggaagcagua

SEQ ID NO: 17742 - RNA, 17 nt, Homo sapiens
uucaaguaauucaggug

SEQ ID NO: 17743 - RNA, 22 nt, Homo sapiens
uuuagagacggggucuugcucu

SEQ ID NO: 17744 - RNA, 24 nt, Homo sapiens
ccagacagaauucuaugcacuuuc

SEQ ID NO: 17745 - RNA, 22 nt, Homo sapiens
uagcagcacaucaugguuuaca

SEQ ID NO: 17746 - RNA, 22 nt, Homo sapiens
uucaaguaauccaggauaggcu

SEQ ID NO: 17747 - RNA, 21 nt, Homo sapiens
uucaaguaauucaggauaggu

SEQ ID NO: 17748 - RNA, 21 nt, Homo sapiens
auguaugugugcaugugcaug

SEQ ID NO: 17749 - RNA, 22 nt, Homo sapiens
auauaauacaaccugcuaagug

SEQ ID NO: 17750 - RNA, 22 nt, Homo sapiens
aaaacuguaauuacuuuuguac

SEQ ID NO: 17751 - RNA, 23 nt, Homo sapiens
aguauguucuuccaggacagaac

SEQ ID NO: 17752 - RNA, 22 nt, Homo sapiens
uaugucugcugaccaucaccuu

SEQ ID NO: 17753 - RNA, 23 nt, Homo sapiens
uuuggcacuagcacauuuuugcu

SEQ ID NO: 17754 - RNA, 22 nt, Homo sapiens
uggagagaaaggcaguuccuga

SEQ ID NO: 17755 - RNA, 22 nt, Homo sapiens
uguaaacauccuacacucagcu

SEQ ID NO: 17756 - RNA, 22 nt, Homo sapiens
ugcaacgaaccugagccacuga

SEQ ID NO: 17757 - RNA, 22 nt, Homo sapiens
uauugcacucgucccggccucc

SEQ ID NO: 17758 - RNA, 21 nt, Homo sapiens
ccccaccuccucucuccucag

SEQ ID NO: 17759 - RNA, 18 nt, Homo sapiens
aucccaccucugccacca

SEQ ID NO: 17760 - RNA, 22 nt, Homo sapiens
uggagagaaaggcaguuccuga

SEQ ID NO: 17761 - RNA, 22 nt, Homo sapiens
cgcaggggccgggugcucaccg

SEQ ID NO: 17762 - RNA, 22 nt, Homo sapiens
ugggucuuugcgggcgagauga

SEQ ID NO: 17763 - RNA, 21 nt, Homo sapiens
ccaccaccgugucugacacuu

SEQ ID NO: 17764 - RNA, 21 nt, Homo sapiens
uaaagugcugacagugcagau

SEQ ID NO: 17765 - RNA, 23 nt, Homo sapiens
cagugcaaugauauugucaaagc

SEQ ID NO: 17766 - RNA, 21 nt, Homo sapiens
aggggugcuaucugugauuga

SEQ ID NO: 17767 - RNA, 22 nt, Homo sapiens
aauugcacgguauccaucugua

SEQ ID NO: 17768 - RNA, 22 nt, Homo sapiens
aucgugcaucccuuuagagugu

SEQ ID NO: 17769 - RNA, 22 nt, Homo sapiens
aucgugcauccuuuuagagugu

SEQ ID NO: 17770 - RNA, 22 nt, Homo sapiens
ugugacagauugauaacugaaa

SEQ ID NO: 17771 - RNA, 25 nt, Homo sapiens
aggggugguguugggacagcuccgu

SEQ ID NO: 17772 - RNA, 18 nt, Homo sapiens
ucagcuggcccucauuuc

SEQ ID NO: 17773 - RNA, 22 nt, Homo sapiens
ucguaccgugaguaauaaugcg

SEQ ID NO: 17774 - RNA, 18 nt, Homo sapiens
gucccuguucaggcgcca

SEQ ID NO: 17775 - RNA, 24 nt, Homo sapiens
uggcccugacugaagaccagcagu

SEQ ID NO: 17776 - RNA, 24 nt, Homo sapiens
uuuggcaaugguagaacucacacu

SEQ ID NO: 17777 - RNA, 21 nt, Homo sapiens
cugaccuaugaauugacagcc

SEQ ID NO: 17778 - RNA, 21 nt, Homo sapiens
uaaagugcugacagugcagau

SEQ ID NO: 17779 - RNA, 23 nt, Homo sapiens
cagugcaaugauauugucaaagc

SEQ ID NO: 17780 - RNA, 22 nt, Homo sapiens
uaaugccccuaaaaauccuuau

SEQ ID NO: 17781 - RNA, 22 nt, Homo sapiens
ugagaaccacgucugcucugag

SEQ ID NO: 17782 - RNA, 23 nt, Homo sapiens
acuuacagacaagagccuugcuc

SEQ ID NO: 17783 - RNA, 23 nt, Homo sapiens
gacacgggcgacagcugcggccc

SEQ ID NO: 17784 - RNA, 22 nt, Homo sapiens
aaauuauuguacaucggaugag

SEQ ID NO: 17785 - RNA, 21 nt, Homo sapiens
uggcagggaggcugggagggg

SEQ ID NO: 17786 - RNA, 23 nt, Homo sapiens
uaaggugcaucuagugcagauag

SEQ ID NO: 17787 - RNA, 22 nt, Homo sapiens
cgcaggggccgggugcucaccg

SEQ ID NO: 17788 - RNA, 22 nt, Homo sapiens
ugggucuuugcgggcgagauga

SEQ ID NO: 17789 - RNA, 23 nt, Homo sapiens
uaauacugccggguaaugaugga

SEQ ID NO: 17790 - RNA, 22 nt, Homo sapiens
uggcucaguucagcaggaacag

SEQ ID NO: 17791 - RNA, 21 nt, Homo sapiens
uaaagugcugacagugcagau

SEQ ID NO: 17792 - RNA, 23 nt, Homo sapiens
cagugcaaugauauugucaaagc

SEQ ID NO: 17793 - RNA, 18 nt, Homo sapiens
ugcuuccuuucagagggu

SEQ ID NO: 17794 - RNA, 22 nt, Homo sapiens
aucuggagguaagaagcacuuu

SEQ ID NO: 17795 - RNA, 23 nt, Homo sapiens
agugccugagggaguaagagccc

SEQ ID NO: 17796 - RNA, 22 nt, Homo sapiens
cugcccuggcccgagggaccga

SEQ ID NO: 17797 - RNA, 23 nt, Homo sapiens
ucuggcuccgugucuucacuccc

SEQ ID NO: 17798 - RNA, 23 nt, Homo sapiens
cggcccgggcugcugcuguuccu

SEQ ID NO: 17799 - RNA, 21 nt, Homo sapiens
cggcggggacggcgauugguc

SEQ ID NO: 17800 - RNA, 22 nt, Homo sapiens
cgcaggggccgggugcucaccg

SEQ ID NO: 17801 - RNA, 23 nt, Homo sapiens
ugaguaccgccaugucuguuggg

SEQ ID NO: 17802 - RNA, 22 nt, Homo sapiens
cgucaacacuugcugguuuccu

SEQ ID NO: 17803 - RNA, 22 nt, Homo sapiens
aagugcuuccuuuuagaggguu

SEQ ID NO: 17804 - RNA, 22 nt, Homo sapiens
aggcggggcgccgcgggaccgc

SEQ ID NO: 17805 - RNA, 17 nt, Homo sapiens
ucgccuccuccucuccc

SEQ ID NO: 17806 - RNA, 24 nt, Homo sapiens
uggcccugacugaagaccagcagu

SEQ ID NO: 17807 - RNA, 23 nt, Homo sapiens
ugagcgccucgacgacagagccg

SEQ ID NO: 17808 - RNA, 22 nt, Homo sapiens
ugcggggcuagggcuaacagca

SEQ ID NO: 17809 - RNA, 21 nt, Homo sapiens
cggcggggacggcgauugguc

SEQ ID NO: 17810 - RNA, 22 nt, Homo sapiens
aggcggggcgccgcgggaccgc

SEQ ID NO: 17811 - RNA, 18 nt, Homo sapiens
ucagcuggcccucauuuc

SEQ ID NO: 17812 - RNA, 21 nt, Homo sapiens
uggcagggaggcugggagggg

SEQ ID NO: 17813 - RNA, 24 nt, Homo sapiens
uggcccugacugaagaccagcagu

SEQ ID NO: 17814 - RNA, 18 nt, Homo sapiens
cagggaggugaaugugau

SEQ ID NO: 17815 - RNA, 23 nt, Homo sapiens
ucuggcuccgugucuucacuccc

SEQ ID NO: 17816 - RNA, 21 nt, Homo sapiens
ccaguccugugccugccgccu

SEQ ID NO: 17817 - RNA, 22 nt, Homo sapiens
gaggguuggguggaggcucucc

SEQ ID NO: 17818 - RNA, 23 nt, Homo sapiens
ucuuggaguaggucauugggugg

SEQ ID NO: 17819 - RNA, 19 nt, Homo sapiens
ugggcguaucuguaugcua

SEQ ID NO: 17820 - RNA, 22 nt, Homo sapiens
ggggguccccggugcucggauc

SEQ ID NO: 17821 - RNA, 22 nt, Homo sapiens
gucccucuccaaaugugucuug

SEQ ID NO: 17822 - RNA, 22 nt, Homo sapiens
uggagugugacaaugguguuug

SEQ ID NO: 17823 - RNA, 21 nt, Homo sapiens
uggaggagaaggaaggugaug

SEQ ID NO: 17824 - RNA, 22 nt, Homo sapiens
aggcagcgggguguaguggaua

SEQ ID NO: 17825 - RNA, 22 nt, Homo sapiens
acccgucccguucguccccgga

SEQ ID NO: 17826 - RNA, 21 nt, Homo sapiens
uggacugcccugaucuggaga

SEQ ID NO: 17827 - RNA, 23 nt, Homo sapiens
cggcccgggcugcugcuguuccu

SEQ ID NO: 17828 - RNA, 22 nt, Homo sapiens
cgcaggggccgggugcucaccg

SEQ ID NO: 17829 - RNA, 23 nt, Homo sapiens
ugaggggcagagagcgagacuuu

SEQ ID NO: 17830 - RNA, 21 nt, Homo sapiens
cggggcagcucaguacaggau

SEQ ID NO: 17831 - RNA, 24 nt, Homo sapiens
ugccugggucucuggccugcgcgu

SEQ ID NO: 17832 - RNA, 20 nt, Homo sapiens
cggcucugggucugugggga

SEQ ID NO: 17833 - RNA, 21 nt, Homo sapiens
ucguggccuggucuccauuau

SEQ ID NO: 17834 - RNA, 22 nt, Homo sapiens
uggagugugacaaugguguuug

SEQ ID NO: 17835 - RNA, 22 nt, Homo sapiens
acgcccuucccccccuucuuca

SEQ ID NO: 17836 - RNA, 21 nt, Homo sapiens
cggcggggacggcgauugguc

SEQ ID NO: 17837 - RNA, 22 nt, Homo sapiens
uuggggaaacggccgcugagug

SEQ ID NO: 17838 - RNA, 23 nt, Homo sapiens
ucccuguccuccaggagcucacg

SEQ ID NO: 17839 - RNA, 19 nt, Homo sapiens
ugucucugcugggguuucu

SEQ ID NO: 17840 - RNA, 25 nt, Homo sapiens
aggggugguguugggacagcuccgu

SEQ ID NO: 17841 - RNA, 21 nt, Homo sapiens
ggcuagcaacagcgcuuaccu

SEQ ID NO: 17842 - RNA, 22 nt, Homo sapiens
aggcggggcgccgcgggaccgc

SEQ ID NO: 17843 - RNA, 22 nt, Homo sapiens
ugcggggcuagggcuaacagca

SEQ ID NO: 17844 - RNA, 20 nt, Homo sapiens
ggggagcuguggaagcagua

SEQ ID NO: 17845 - RNA, 22 nt, Homo sapiens
ugagccccugugccgcccccag

SEQ ID NO: 17846 - RNA, 20 nt, Homo sapiens
gugucugggcggacagcugc

SEQ ID NO: 17847 - RNA, 21 nt, Homo sapiens
ugcaggaccaagaugagcccu

SEQ ID NO: 17848 - RNA, 21 nt, Homo sapiens
uugggacauacuuaugcuaaa

SEQ ID NO: 17849 - RNA, 21 nt, Homo sapiens
uaccacaggguagaaccacgg

SEQ ID NO: 17850 - RNA, 21 nt, Homo sapiens
cggcggggacggcgauugguc

SEQ ID NO: 17851 - RNA, 21 nt, Homo sapiens
gccccugggccuauccuagaa

SEQ ID NO: 17852 - RNA, 21 nt, Homo sapiens
ugucuugcaggccgucaugca

SEQ ID NO: 17853 - RNA, 23 nt, Homo sapiens
aggaccugcgggacaagauucuu

SEQ ID NO: 17854 - RNA, 21 nt, Homo sapiens
gugucuuuugcucugcaguca

SEQ ID NO: 17855 - RNA, 22 nt, Homo sapiens
uccgagccugggucucccucuu

SEQ ID NO: 17856 - RNA, 19 nt, Homo sapiens
agcugucugaaaaugucuu

SEQ ID NO: 17857 - RNA, 21 nt, Homo sapiens
aauggcgccacuaggguugug

SEQ ID NO: 17858 - RNA, 22 nt, Homo sapiens
uaugucugcugaccaucaccuu

SEQ ID NO: 17859 - RNA, 22 nt, Homo sapiens
aggcggggcgccgcgggaccgc

SEQ ID NO: 17860 - RNA, 22 nt, Homo sapiens
gguggcccggccgugccugagg

SEQ ID NO: 17861 - RNA, 21 nt, Homo sapiens
ccuggaaacacugagguugug

SEQ ID NO: 17862 - RNA, 22 nt, Homo sapiens
cuccugagccauucugagccuc

SEQ ID NO: 17863 - RNA, 25 nt, Homo sapiens
gggcgacaaagcaagacucuuucuu

SEQ ID NO: 17864 - RNA, 23 nt, Homo sapiens
uauggcuuuuuauuccuauguga

SEQ ID NO: 17865 - RNA, 23 nt, Homo sapiens
uauggcuuuucauuccuauguga

SEQ ID NO: 17866 - RNA, 20 nt, Homo sapiens
ccuccugcccuccuugcugu

SEQ ID NO: 17867 - RNA, 21 nt, Homo sapiens
uaaagugcugacagugcagau

SEQ ID NO: 17868 - RNA, 23 nt, Homo sapiens
cagugcaaugauauugucaaagc

SEQ ID NO: 17869 - RNA, 22 nt, Homo sapiens
uuauaaagcaaugagacugauu

SEQ ID NO: 17870 - RNA, 22 nt, Homo sapiens
agaggcuggccgugaugaauuc

SEQ ID NO: 17871 - RNA, 22 nt, Homo sapiens
caaccuggaggacuccaugcug

SEQ ID NO: 17872 - RNA, 23 nt, Homo sapiens
uuucaagccagggggcguuuuuc

SEQ ID NO: 17873 - RNA, 22 nt, Homo sapiens
uacucaggagaguggcaaucac

SEQ ID NO: 17874 - RNA, 24 nt, Homo sapiens
ugccugggucucuggccugcgcgu

SEQ ID NO: 17875 - RNA, 22 nt, Homo sapiens
acuccagccccacagccucagc

SEQ ID NO: 17876 - RNA, 22 nt, Homo sapiens
uggagugugacaaugguguuug

SEQ ID NO: 17877 - RNA, 22 nt, Homo sapiens
caggauguggucaaguguuguu

SEQ ID NO: 17878 - RNA, 24 nt, Homo sapiens
uuuggcaaugguagaacucacacu

SEQ ID NO: 17879 - RNA, 22 nt, Homo sapiens
ucgugucuuguguugcagccgg

SEQ ID NO: 17880 - RNA, 23 nt, Homo sapiens
ugugcaaaucuaugcaaaacuga

SEQ ID NO: 17881 - RNA, 22 nt, Homo sapiens
aacaauauccuggugcugagug

SEQ ID NO: 17882 - RNA, 22 nt, Homo sapiens
agagguaguagguugcauaguu

SEQ ID NO: 17883 - RNA, 21 nt, Homo sapiens
gccccugggccuauccuagaa

SEQ ID NO: 17884 - RNA, 22 nt, Homo sapiens
ugaaacauacacgggaaaccuc

SEQ ID NO: 17885 - RNA, 22 nt, Homo sapiens
ucagcaaacauuuauugugugc

SEQ ID NO: 17886 - RNA, 23 nt, Homo sapiens
uucauuugguauaaaccgcgauu

SEQ ID NO: 17887 - RNA, 21 nt, Homo sapiens
guggcugcacucacuuccuuc

SEQ ID NO: 17888 - RNA, 20 nt, Homo sapiens
ggggagcuguggaagcagua

SEQ ID NO: 17889 - RNA, 21 nt, Homo sapiens
uuaggccgcagaucuggguga

SEQ ID NO: 17890 - RNA, 21 nt, Homo sapiens
cggcggggacggcgauugguc

SEQ ID NO: 17891 - RNA, 23 nt, Homo sapiens
ugaggggcagagagcgagacuuu

SEQ ID NO: 17892 - RNA, 23 nt, Homo sapiens
gaacgccuguucuugccaggugg

SEQ ID NO: 17893 - RNA, 22 nt, Homo sapiens
aggcggggcgccgcgggaccgc

SEQ ID NO: 17894 - RNA, 22 nt, Homo sapiens
gguggcccggccgugccugagg

SEQ ID NO: 17895 - RNA, 22 nt, Homo sapiens
ugcggggcuagggcuaacagca

SEQ ID NO: 17896 - RNA, 21 nt, Homo sapiens
ucguggccuggucuccauuau

SEQ ID NO: 17897 - RNA, 17 nt, Homo sapiens
ucgccuccuccucuccc

SEQ ID NO: 17898 - RNA, 19 nt, Homo sapiens
gaugaugcugcugaugcug

SEQ ID NO: 17899 - RNA, 21 nt, Homo sapiens
cggcggggacggcgauugguc

SEQ ID NO: 17900 - RNA, 21 nt, Homo sapiens
cggcggggacggcgauugguc

SEQ ID NO: 17901 - RNA, 23 nt, Homo sapiens
ugaggggcagagagcgagacuuu

SEQ ID NO: 17902 - RNA, 23 nt, Homo sapiens
ucuuggaguaggucauugggugg

SEQ ID NO: 17903 - RNA, 19 nt, Homo sapiens
aggcugcggaauucaggac

SEQ ID NO: 17904 - RNA, 22 nt, Homo sapiens
ggggguccccggugcucggauc

SEQ ID NO: 17905 - RNA, 25 nt, Homo sapiens
agggaucgcgggcggguggcggccu

SEQ ID NO: 17906 - RNA, 22 nt, Homo sapiens
aggcggggcgccgcgggaccgc

SEQ ID NO: 17907 - RNA, 22 nt, Homo sapiens
aggcggggcgccgcgggaccgc

SEQ ID NO: 17908 - RNA, 22 nt, Homo sapiens
ugcggggcuagggcuaacagca

SEQ ID NO: 17909 - RNA, 22 nt, Homo sapiens
ucguaccgugaguaauaaugcg

SEQ ID NO: 17910 - RNA, 20 nt, Homo sapiens
ggggagcuguggaagcagua

SEQ ID NO: 17911 - RNA, 23 nt, Homo sapiens
guccaguuuucccaggaaucccu

SEQ ID NO: 17912 - RNA, 21 nt, Homo sapiens
gguuugguccuagccuuucua

SEQ ID NO: 17913 - RNA, 23 nt, Homo sapiens
ugugcaaaucuaugcaaaacuga

SEQ ID NO: 17914 - RNA, 23 nt, Homo sapiens
ugugcaaaucuaugcaaaacuga

SEQ ID NO: 17915 - RNA, 23 nt, Homo sapiens
ugugcaaauccaugcaaaacuga

SEQ ID NO: 17916 - RNA, 22 nt, Homo sapiens
aacaauauccuggugcugagug

SEQ ID NO: 17917 - RNA, 22 nt, Homo sapiens
agagguaguagguugcauaguu

SEQ ID NO: 17918 - RNA, 21 nt, Homo sapiens
uuuugcaccuuuuggagugaa

SEQ ID NO: 17919 - RNA, 23 nt, Homo sapiens
guuugcacgggugggccuugucu

SEQ ID NO: 17920 - RNA, 20 nt, Homo sapiens
aaaguagcuguaccauuugc

SEQ ID NO: 17921 - RNA, 21 nt, Homo sapiens
ccuggaaacacugagguugug

SEQ ID NO: 17922 - RNA, 20 nt, Homo sapiens
uaaagagcccuguggagaca

SEQ ID NO: 17923 - RNA, 22 nt, Homo sapiens
ucuacaaaggaaagcgcuuucu

SEQ ID NO: 17924 - RNA, 22 nt, Homo sapiens
ucagugcacuacagaacuuugu

SEQ ID NO: 17925 - RNA, 21 nt, Homo sapiens
uaggacacauggucuacuucu

SEQ ID NO: 17926 - RNA, 18 nt, Homo sapiens
ucagcuggcccucauuuc

SEQ ID NO: 17927 - RNA, 18 nt, Homo sapiens
uugagaaggaggcugcug

SEQ ID NO: 17928 - RNA, 24 nt, Homo sapiens
ccagacagaauucuaugcacuuuc

SEQ ID NO: 17929 - RNA, 21 nt, Homo sapiens
auguaugugugcaugugcaug

SEQ ID NO: 17930 - RNA, 21 nt, Homo sapiens
aaagcgcuucccuucagagug

SEQ ID NO: 17931 - RNA, 22 nt, Homo sapiens
uugugucaauaugcgaugaugu

SEQ ID NO: 17932 - RNA, 22 nt, Homo sapiens
ugugucacucgaugaccacugu

SEQ ID NO: 17933 - RNA, 21 nt, Homo sapiens
acagucugcugagguuggagc

SEQ ID NO: 17934 - RNA, 22 nt, Homo sapiens
uuugugaccugguccacuaacc

SEQ ID NO: 17935 - RNA, 22 nt, Homo sapiens
acuccagccccacagccucagc

SEQ ID NO: 17936 - RNA, 22 nt, Homo sapiens
cuccugagccauucugagccuc

SEQ ID NO: 17937 - RNA, 23 nt, Homo sapiens
ucuggcuccgugucuucacuccc

SEQ ID NO: 17938 - RNA, 23 nt, Homo sapiens
cccaguguucagacuaccuguuc

SEQ ID NO: 17939 - RNA, 23 nt, Homo sapiens
cccaguguuuagacuaucuguuc

SEQ ID NO: 17940 - RNA, 19 nt, Homo sapiens
gagccaguuggacaggagc

SEQ ID NO: 17941 - RNA, 20 nt, Homo sapiens
accaggaggcugaggccccu

SEQ ID NO: 17942 - RNA, 22 nt, Homo sapiens
ugcaacgaaccugagccacuga

SEQ ID NO: 17943 - RNA, 22 nt, Homo sapiens
cacuggcuccuuucuggguaga

SEQ ID NO: 17944 - RNA, 22 nt, Homo sapiens
uagguaguuuccuguuguuggg

SEQ ID NO: 17945 - RNA, 21 nt, Homo sapiens
agggcccccccucaauccugu

SEQ ID NO: 17946 - RNA, 19 nt, Homo sapiens
aggcugcggaauucaggac

SEQ ID NO: 17947 - RNA, 25 nt, Homo sapiens
ggcggagggaaguagguccguuggu

SEQ ID NO: 17948 - RNA, 22 nt, Homo sapiens
aggcggggcgccgcgggaccgc

SEQ ID NO: 17949 - RNA, 23 nt, Homo sapiens
cgggucggaguuagcucaagcgg

SEQ ID NO: 17950 - RNA, 22 nt, Homo sapiens
auccgcgcucugacucucugcc

SEQ ID NO: 17951 - RNA, 22 nt, Homo sapiens
ucaccagcccuguguucccuag

SEQ ID NO: 17952 - RNA, 23 nt, Homo sapiens
agcugguguugugaaucaggccg

SEQ ID NO: 17953 - RNA, 23 nt, Homo sapiens
cggcccgggcugcugcuguuccu

SEQ ID NO: 17954 - RNA, 21 nt, Homo sapiens
uccugcgcgucccagaugccc

SEQ ID NO: 17955 - RNA, 22 nt, Homo sapiens
augcugacauauuuacuagagg

SEQ ID NO: 17956 - RNA, 22 nt, Homo sapiens
ugugcgcagggagaccucuccc

SEQ ID NO: 17957 - RNA, 22 nt, Homo sapiens
ugugcgcagggagaccucuccc

SEQ ID NO: 17958 - RNA, 21 nt, Homo sapiens
ccgucgccgccacccgagccg

SEQ ID NO: 17959 - RNA, 20 nt, Homo sapiens
ucacaccugccucgcccccc

SEQ ID NO: 17960 - RNA, 22 nt, Homo sapiens
ccucuuccccuugucucuccag

SEQ ID NO: 17961 - RNA, 22 nt, Homo sapiens
ccucuuccccuugucucuccag

SEQ ID NO: 17962 - RNA, 21 nt, Homo sapiens
cggcggggacggcgauugguc

SEQ ID NO: 17963 - RNA, 22 nt, Homo sapiens
uacgucaucguugucaucguca

SEQ ID NO: 17964 - RNA, 19 nt, Homo sapiens
aguguggcuuucuuagagc

SEQ ID NO: 17965 - RNA, 22 nt, Homo sapiens
aggcggggcgccgcgggaccgc

SEQ ID NO: 17966 - RNA, 20 nt, Homo sapiens
ggggagcuguggaagcagua

SEQ ID NO: 17967 - RNA, 24 nt, Homo sapiens
uggggagcugaggcucugggggug

SEQ ID NO: 17968 - RNA, 18 nt, Homo sapiens
ucagcuggcccucauuuc

SEQ ID NO: 17969 - RNA, 22 nt, Homo sapiens
uggguggucuggagauuugugc

SEQ ID NO: 17970 - RNA, 22 nt, Homo sapiens
ucugcccccuccgcugcugcca

SEQ ID NO: 17971 - RNA, 22 nt, Homo sapiens
aggugguccguggcgcguucgc

SEQ ID NO: 17972 - RNA, 20 nt, Homo sapiens
acugccccaggugcugcugg

SEQ ID NO: 17973 - RNA, 22 nt, Homo sapiens
uggcagugucuuagcugguugu

SEQ ID NO: 17974 - RNA, 23 nt, Homo sapiens
aggcaguguaguuagcugauugc

SEQ ID NO: 17975 - RNA, 23 nt, Homo sapiens
ucccccaggugugauucugauuu

SEQ ID NO: 17976 - RNA, 22 nt, Homo sapiens
uggcaguguauuguuagcuggu

SEQ ID NO: 17977 - RNA, 22 nt, Homo sapiens
aggcaguguauuguuagcuggc

SEQ ID NO: 17978 - RNA, 21 nt, Homo sapiens
cggggcagcucaguacaggau

SEQ ID NO: 17979 - RNA, 22 nt, Homo sapiens
aagugcugucauagcugagguc

SEQ ID NO: 17980 - RNA, 22 nt, Homo sapiens
cacacacugcaauuacuuuugc

SEQ ID NO: 17981 - RNA, 24 nt, Homo sapiens
acugggggcuuucgggcucugcgu

SEQ ID NO: 17982 - RNA, 23 nt, Homo sapiens
gagggucuugggagggaugugac

SEQ ID NO: 17983 - RNA, 21 nt, Homo sapiens
gugccagcugcagugggggag

SEQ ID NO: 17984 - RNA, 21 nt, Homo sapiens
uggcagggaggcugggagggg

SEQ ID NO: 17985 - RNA, 21 nt, Homo sapiens
uggcagggaggcugggagggg

SEQ ID NO: 17986 - RNA, 21 nt, Homo sapiens
gcccuccgcccgugcaccccg

SEQ ID NO: 17987 - RNA, 23 nt, Homo sapiens
uaaggugcaucuagugcagauag

SEQ ID NO: 17988 - RNA, 22 nt, Homo sapiens
cgcaggggccgggugcucaccg

SEQ ID NO: 17989 - RNA, 22 nt, Homo sapiens
cauugcacuugucucggucuga

SEQ ID NO: 17990 - RNA, 23 nt, Homo sapiens
ugagcgccucgacgacagagccg

SEQ ID NO: 17991 - RNA, 22 nt, Homo sapiens
aguggggaacccuuccaugagg

SEQ ID NO: 17992 - RNA, 25 nt, Homo sapiens
ggcggagggaaguagguccguuggu

SEQ ID NO: 17993 - RNA, 23 nt, Homo sapiens
ccugcagcgacuugauggcuucc

SEQ ID NO: 17994 - RNA, 21 nt, Homo sapiens
ccccaccuccucucuccucag

SEQ ID NO: 17995 - RNA, 24 nt, Homo sapiens
uugcagcugccugggagugacuuc

SEQ ID NO: 17996 - RNA, 22 nt, Homo sapiens
caugccuugaguguaggaccgu

SEQ ID NO: 17997 - RNA, 19 nt, Homo sapiens
ugagcugcuguaccaaaau

SEQ ID NO: 17998 - RNA, 21 nt, Homo sapiens
ugaguuggccaucugagugag

SEQ ID NO: 17999 - RNA, 23 nt, Homo sapiens
acuugggcacugaaacaaugucc

SEQ ID NO: 18000 - RNA, 20 nt, Homo sapiens
ggggagcuguggaagcagua

SEQ ID NO: 18001 - RNA, 24 nt, Homo sapiens
agcagaagcagggagguucuccca

SEQ ID NO: 18002 - RNA, 17 nt, Homo sapiens
ucccaccgcugccaccc

SEQ ID NO: 18003 - RNA, 18 nt, Homo sapiens
cagggaggugaaugugau

SEQ ID NO: 18004 - RNA, 21 nt, Homo sapiens
ugacaacuauggaugagcucu

SEQ ID NO: 18005 - RNA, 21 nt, Homo sapiens
acuggacuuggagucagaagg

SEQ ID NO: 18006 - RNA, 22 nt, Homo sapiens
agaggcuggccgugaugaauuc

SEQ ID NO: 18007 - RNA, 21 nt, Homo sapiens
aaaacggugagauuuuguuuu

SEQ ID NO: 18008 - RNA, 17 nt, Homo sapiens
ucucgcuggggccucca

SEQ ID NO: 18009 - RNA, 21 nt, Homo sapiens
uggaggagaaggaaggugaug

SEQ ID NO: 18010 - RNA, 22 nt, Homo sapiens
uuugaggcuacagugagaugug

SEQ ID NO: 18011 - RNA, 22 nt, Homo sapiens
acagcaggcacagacaggcagu

SEQ ID NO: 18012 - RNA, 22 nt, Homo sapiens
gcugacuccuaguccagggcuc

SEQ ID NO: 18013 - RNA, 22 nt, Homo sapiens
gccugcugggguggaaccuggu

SEQ ID NO: 18014 - RNA, 23 nt, Homo sapiens
gaagugcuucgauuuuggggugu

SEQ ID NO: 18015 - RNA, 21 nt, Homo sapiens
ugucuugcaggccgucaugca

SEQ ID NO: 18016 - RNA, 23 nt, Homo sapiens
uacuccagagggcgucacucaug

SEQ ID NO: 18017 - RNA, 22 nt, Homo sapiens
uacucaggagaguggcaaucac

SEQ ID NO: 18018 - RNA, 22 nt, Homo sapiens
aucuggagguaagaagcacuuu

SEQ ID NO: 18019 - RNA, 23 nt, Homo sapiens
caaagcgcuucucuuuagagugu

SEQ ID NO: 18020 - RNA, 21 nt, Homo sapiens
cuccagagggaaguacuuucu

SEQ ID NO: 18021 - RNA, 21 nt, Homo sapiens
cuccagagggaugcacuuucu

SEQ ID NO: 18022 - RNA, 22 nt, Homo sapiens
uccgagccugggucucccucuu

SEQ ID NO: 18023 - RNA, 22 nt, Homo sapiens
agucauuggaggguuugagcag

SEQ ID NO: 18024 - RNA, 23 nt, Homo sapiens
ucugcucauaccccaugguuucu

SEQ ID NO: 18025 - RNA, 23 nt, Homo sapiens
aaaagugcuuacagugcagguag

SEQ ID NO: 18026 - RNA, 21 nt, Homo sapiens
uaaagugcugacagugcagau

SEQ ID NO: 18027 - RNA, 23 nt, Homo sapiens
caaagugcuuacagugcagguag

SEQ ID NO: 18028 - RNA, 22 nt, Homo sapiens
cccugugcccggcccacuucug

SEQ ID NO: 18029 - RNA, 23 nt, Homo sapiens
uaaagugcuuauagugcagguag

SEQ ID NO: 18030 - RNA, 23 nt, Homo sapiens
caaagugcucauagugcagguag

SEQ ID NO: 18031 - RNA, 23 nt, Homo sapiens
caaagugcucauagugcagguag

SEQ ID NO: 18032 - RNA, 21 nt, Homo sapiens
auuugugcuuggcucugucac

SEQ ID NO: 18033 - RNA, 22 nt, Homo sapiens
acacagggcuguugugaagacu

SEQ ID NO: 18034 - RNA, 21 nt, Homo sapiens
aucacauugccagggauuucc

SEQ ID NO: 18035 - RNA, 21 nt, Homo sapiens
aucacauugccagggauuacc

SEQ ID NO: 18036 - RNA, 22 nt, Homo sapiens
aaacaaacauggugcacuucuu

SEQ ID NO: 18037 - RNA, 22 nt, Homo sapiens
aaagugcauccuuuuagagugu

SEQ ID NO: 18038 - RNA, 22 nt, Homo sapiens
aaagugcauccuuuuagagguu

SEQ ID NO: 18039 - RNA, 22 nt, Homo sapiens
aaagugcaucuuuuuagaggau

SEQ ID NO: 18040 - RNA, 22 nt, Homo sapiens
caaagugccucccuuuagagug

SEQ ID NO: 18041 - RNA, 24 nt, Homo sapiens
acaaagugcuucccuuuagagugu

SEQ ID NO: 18042 - RNA, 22 nt, Homo sapiens
acaaagugcuucccuuuagagu

SEQ ID NO: 18043 - RNA, 23 nt, Homo sapiens
cucuugagggaagcacuuucugu

SEQ ID NO: 18044 - RNA, 22 nt, Homo sapiens
caagaaccucaguugcuuuugu

SEQ ID NO: 18045 - RNA, 22 nt, Homo sapiens
aaaccuguguuguucaagaguc

SEQ ID NO: 18046 - RNA, 22 nt, Homo sapiens
cugcccuggcccgagggaccga

SEQ ID NO: 18047 - RNA, 25 nt, Homo sapiens
cuagugagggacagaaccaggauuc

SEQ ID NO: 18048 - RNA, 23 nt, Homo sapiens
caaagugcuguucgugcagguag

SEQ ID NO: 18049 - RNA, 25 nt, Homo sapiens
ugggaacggguuccggcagacgcug

SEQ ID NO: 18050 - RNA, 22 nt, Homo sapiens
uggcagugucuuagcugguugu

SEQ ID NO: 18051 - RNA, 22 nt, Homo sapiens
agaucagaaggugauuguggcu

SEQ ID NO: 18052 - RNA, 18 nt, Homo sapiens
uucacagggaggugucau

SEQ ID NO: 18053 - RNA, 22 nt, Homo sapiens
ucagcaaacauuuauugugugc

SEQ ID NO: 18054 - RNA, 23 nt, Homo sapiens
uuuggcacuagcacauuuuugcu

SEQ ID NO: 18055 - RNA, 21 nt, Homo sapiens
uguucauguagauguuuaagc

SEQ ID NO: 18056 - RNA, 17 nt, Homo sapiens
ucgccuccuccucuccc

SEQ ID NO: 18057 - RNA, 20 nt, Homo sapiens
ccuccugcccuccuugcugu

SEQ ID NO: 18058 - RNA, 22 nt, Homo sapiens
uguaaacauccuacacucagcu

SEQ ID NO: 18059 - RNA, 22 nt, Homo sapiens
ggggguccccggugcucggauc

SEQ ID NO: 18060 - RNA, 25 nt, Homo sapiens
ggcggagggaaguagguccguuggu

SEQ ID NO: 18061 - RNA, 23 nt, Homo sapiens
uggugcggagagggcccacagug

SEQ ID NO: 18062 - RNA, 22 nt, Homo sapiens
ugcggggcuagggcuaacagca

SEQ ID NO: 18063 - RNA, 23 nt, Homo sapiens
gagggucuugggagggaugugac

SEQ ID NO: 18064 - RNA, 22 nt, Homo sapiens
ucugggcaacaaagugagaccu

SEQ ID NO: 18065 - RNA, 25 nt, Homo sapiens
gcugggcagggcuucugagcuccuu

SEQ ID NO: 18066 - RNA, 21 nt, Homo sapiens
ucguggccuggucuccauuau

SEQ ID NO: 18067 - RNA, 22 nt, Homo sapiens
ugagccccugugccgcccccag

SEQ ID NO: 18068 - RNA, 20 nt, Homo sapiens
ucacaccugccucgcccccc

SEQ ID NO: 18069 - RNA, 22 nt, Homo sapiens
acccgucccguucguccccgga

SEQ ID NO: 18070 - RNA, 23 nt, Homo sapiens
aggaccugcgggacaagauucuu

SEQ ID NO: 18071 - RNA, 21 nt, Homo sapiens
agaccuggcccagaccucagc

SEQ ID NO: 18072 - RNA, 22 nt, Homo sapiens
gucccucuccaaaugugucuug

SEQ ID NO: 18073 - RNA, 21 nt, Homo sapiens
ucguggccuggucuccauuau

SEQ ID NO: 18074 - RNA, 21 nt, Homo sapiens
uggcagggaggcugggagggg

SEQ ID NO: 18075 - RNA, 19 nt, Homo sapiens
gaugaugcugcugaugcug

SEQ ID NO: 18076 - RNA, 21 nt, Homo sapiens
uccugcgcgucccagaugccc

SEQ ID NO: 18077 - RNA, 23 nt, Homo sapiens
ugaguaccgccaugucuguuggg

SEQ ID NO: 18078 - RNA, 22 nt, Homo sapiens
ucugcccccuccgcugcugcca

SEQ ID NO: 18079 - RNA, 22 nt, Homo sapiens
ucaggccaggcacaguggcuca

SEQ ID NO: 18080 - RNA, 20 nt, Homo sapiens
acugccccaggugcugcugg

SEQ ID NO: 18081 - RNA, 20 nt, Homo sapiens
ccucugggcccuuccuccag

SEQ ID NO: 18082 - RNA, 22 nt, Homo sapiens
ucucugggccugugucuuaggc

SEQ ID NO: 18083 - RNA, 21 nt, Homo sapiens
acuggacuuggagucagaagg

SEQ ID NO: 18084 - RNA, 21 nt, Homo sapiens
cggggcagcucaguacaggau

SEQ ID NO: 18085 - RNA, 21 nt, Homo sapiens
gaaggcgcuucccuuuggagu

SEQ ID NO: 18086 - RNA, 22 nt, Homo sapiens
gaaggcgcuucccuuuagagcg

SEQ ID NO: 18087 - RNA, 21 nt, Homo sapiens
aaaacggugagauuuuguuuu

SEQ ID NO: 18088 - RNA, 19 nt, Homo sapiens
ugagcugcuguaccaaaau

SEQ ID NO: 18089 - RNA, 19 nt, Homo sapiens
gagccaguuggacaggagc

SEQ ID NO: 18090 - RNA, 19 nt, Homo sapiens
aggcugcggaauucaggac

SEQ ID NO: 18091 - RNA, 19 nt, Homo sapiens
aagcagcugccucugaggc

SEQ ID NO: 18092 - RNA, 21 nt, Homo sapiens
guggcugcacucacuuccuuc

SEQ ID NO: 18093 - RNA, 22 nt, Homo sapiens
cacuggcuccuuucuggguaga

SEQ ID NO: 18094 - RNA, 23 nt, Homo sapiens
cccaguguucagacuaccuguuc

SEQ ID NO: 18095 - RNA, 23 nt, Homo sapiens
cccaguguuuagacuaucuguuc

SEQ ID NO: 18096 - RNA, 22 nt, Homo sapiens
cugugcgugugacagcggcuga

SEQ ID NO: 18097 - RNA, 23 nt, Homo sapiens
gacacgggcgacagcugcggccc

SEQ ID NO: 18098 - RNA, 19 nt, Homo sapiens
aagugugcagggcacuggu

SEQ ID NO: 18099 - RNA, 20 nt, Homo sapiens
ggggagcuguggaagcagua

SEQ ID NO: 18100 - RNA, 22 nt, Homo sapiens
auccgcgcucugacucucugcc

SEQ ID NO: 18101 - RNA, 21 nt, Homo sapiens
ccccaccuccucucuccucag

SEQ ID NO: 18102 - RNA, 21 nt, Homo sapiens
cggcggggacggcgauugguc

SEQ ID NO: 18103 - RNA, 22 nt, Homo sapiens
uuuaggauaagcuugacuuuug

SEQ ID NO: 18104 - RNA, 22 nt, Homo sapiens
aggcggggcgccgcgggaccgc

SEQ ID NO: 18105 - RNA, 20 nt, Homo sapiens
ggggagcuguggaagcagua

SEQ ID NO: 18106 - RNA, 21 nt, Homo sapiens
cuccguuugccuguuucgcug

SEQ ID NO: 18107 - RNA, 23 nt, Homo sapiens
caacggaaucccaaaagcagcug

SEQ ID NO: 18108 - RNA, 22 nt, Homo sapiens
uuauaauacaaccugauaagug

SEQ ID NO: 18109 - RNA, 22 nt, Homo sapiens
auauaauacaaccugcuaagug

SEQ ID NO: 18110 - RNA, 22 nt, Homo sapiens
aggcaguguauuguuagcuggc

SEQ ID NO: 18111 - RNA, 22 nt, Homo sapiens
aaacaaacauggugcacuucuu

SEQ ID NO: 18112 - RNA, 23 nt, Homo sapiens
uucauuugguauaaaccgcgauu

SEQ ID NO: 18113 - RNA, 22 nt, Homo sapiens
uuaugguuugccugggacugag

SEQ ID NO: 18114 - RNA, 21 nt, Homo sapiens
aauauuauacagucaaccucu

SEQ ID NO: 18115 - RNA, 25 nt, Homo sapiens
cuagugagggacagaaccaggauuc

SEQ ID NO: 18116 - RNA, 18 nt, Homo sapiens
aucccaccucugccacca

SEQ ID NO: 18117 - RNA, 22 nt, Homo sapiens
ucugggcaacaaagugagaccu

SEQ ID NO: 18118 - RNA, 22 nt, Homo sapiens
uaacacugucugguaaagaugg

SEQ ID NO: 18119 - RNA, 18 nt, Homo sapiens
uccagugcccuccucucc

SEQ ID NO: 18120 - RNA, 22 nt, Homo sapiens
cccugugcccggcccacuucug

SEQ ID NO: 18121 - RNA, 22 nt, Homo sapiens
uaacacugucugguaacgaugu

SEQ ID NO: 18122 - RNA, 23 nt, Homo sapiens
uacuccagagggcgucacucaug

SEQ ID NO: 18123 - RNA, 21 nt, Homo sapiens
gcuaguccugacucagccagu

SEQ ID NO: 18124 - RNA, 19 nt, Homo sapiens
gagccaguuggacaggagc

SEQ ID NO: 18125 - RNA, 25 nt, Homo sapiens
aggggugguguugggacagcuccgu

SEQ ID NO: 18126 - RNA, 25 nt, Homo sapiens
gcugggcagggcuucugagcuccuu

SEQ ID NO: 18127 - RNA, 19 nt, Homo sapiens
ucuaggcugguacugcuga

SEQ ID NO: 18128 - RNA, 22 nt, Homo sapiens
acuccagccccacagccucagc

SEQ ID NO: 18129 - RNA, 23 nt, Homo sapiens
caguaacaaagauucauccuugu

SEQ ID NO: 18130 - RNA, 22 nt, Homo sapiens
cacuggcuccuuucuggguaga

SEQ ID NO: 18131 - RNA, 22 nt, Homo sapiens
caaagugccucccuuuagagug

SEQ ID NO: 18132 - RNA, 22 nt, Homo sapiens
aacccguagauccgaacuugug

SEQ ID NO: 18133 - RNA, 22 nt, Homo sapiens
aacccguagauccgaacuugug

SEQ ID NO: 18134 - RNA, 19 nt, Homo sapiens
gaugaugcugcugaugcug

SEQ ID NO: 18135 - RNA, 22 nt, Homo sapiens
ucagugcaucacagaacuuugu

SEQ ID NO: 18136 - RNA, 24 nt, Homo sapiens
aauccuuggaaccuaggugugagu

SEQ ID NO: 18137 - RNA, 21 nt, Homo sapiens
aucauagaggaaaauccacgu

SEQ ID NO: 18138 - RNA, 22 nt, Homo sapiens
aucauagaggaaaauccauguu

SEQ ID NO: 18139 - RNA, 23 nt, Homo sapiens
uaauccuugcuaccugggugaga

SEQ ID NO: 18140 - RNA, 23 nt, Homo sapiens
uacuccagagggcgucacucaug

SEQ ID NO: 18141 - RNA, 22 nt, Homo sapiens
aucuggagguaagaagcacuuu

SEQ ID NO: 18142 - RNA, 23 nt, Homo sapiens
caaagcgcuucucuuuagagugu

SEQ ID NO: 18143 - RNA, 21 nt, Homo sapiens
cuccagagggaaguacuuucu

SEQ ID NO: 18144 - RNA, 21 nt, Homo sapiens
cuccagagggaugcacuuucu

SEQ ID NO: 18145 - RNA, 22 nt, Homo sapiens
uggugggcacagaaucuggacu

SEQ ID NO: 18146 - RNA, 22 nt, Homo sapiens
caagaaccucaguugcuuuugu

SEQ ID NO: 18147 - RNA, 21 nt, Homo sapiens
cuucuugugcucuaggauugu

SEQ ID NO: 18148 - RNA, 20 nt, Homo sapiens
guugugucaguuuaucaaac

SEQ ID NO: 18149 - RNA, 21 nt, Homo sapiens
cacaagguauugguauuaccu

SEQ ID NO: 18150 - RNA, 22 nt, Homo sapiens
augggugaauuuguagaaggau

SEQ ID NO: 18151 - RNA, 25 nt, Homo sapiens
ugggaacggguuccggcagacgcug

SEQ ID NO: 18152 - RNA, 22 nt, Homo sapiens
aaggagcucacagucuauugag

SEQ ID NO: 18153 - RNA, 22 nt, Homo sapiens
aaaccguuaccauuacugaguu

SEQ ID NO: 18154 - RNA, 20 nt, Homo sapiens
guccgcucggcgguggccca

SEQ ID NO: 18155 - RNA, 25 nt, Homo sapiens
aggggugguguugggacagcuccgu

SEQ ID NO: 18156 - RNA, 22 nt, Homo sapiens
uacccauugcauaucggaguug

SEQ ID NO: 18157 - RNA, 23 nt, Homo sapiens
aaggagcuuacaaucuagcuggg

SEQ ID NO: 18158 - RNA, 22 nt, Homo sapiens
uccauuacacuacccugccucu

SEQ ID NO: 18159 - RNA, 24 nt, Homo sapiens
uggggagcugaggcucugggggug

SEQ ID NO: 18160 - RNA, 22 nt, Homo sapiens
ugagguaguaguuugugcuguu

SEQ ID NO: 18161 - RNA, 22 nt, Homo sapiens
uggagugugacaaugguguuug

SEQ ID NO: 18162 - RNA, 22 nt, Homo sapiens
acccgucccguucguccccgga

SEQ ID NO: 18163 - RNA, 23 nt, Homo sapiens
aacauucaacgcugucggugagu

SEQ ID NO: 18164 - RNA, 21 nt, Homo sapiens
cggcggggacggcgauugguc

SEQ ID NO: 18165 - RNA, 23 nt, Homo sapiens
ugaguaccgccaugucuguuggg

SEQ ID NO: 18166 - RNA, 19 nt, Homo sapiens
aggcugcggaauucaggac

SEQ ID NO: 18167 - RNA, 21 nt, Homo sapiens
uggguuuacguugggagaacu

SEQ ID NO: 18168 - RNA, 22 nt, Homo sapiens
aggcggggcgccgcgggaccgc

SEQ ID NO: 18169 - RNA, 22 nt, Homo sapiens
ugugcgcagggagaccucuccc

SEQ ID NO: 18170 - RNA, 25 nt, Homo sapiens
ugggaacggguuccggcagacgcug

SEQ ID NO: 18171 - RNA, 22 nt, Homo sapiens
uagcagcacauaaugguuugug

SEQ ID NO: 18172 - RNA, 23 nt, Homo sapiens
uacugcaucaggaacugauugga

SEQ ID NO: 18173 - RNA, 23 nt, Homo sapiens
acuuacagacaagagccuugcuc

SEQ ID NO: 18174 - RNA, 23 nt, Homo sapiens
uauucauuuauccccagccuaca

SEQ ID NO: 18175 - RNA, 21 nt, Homo sapiens
cccggagccaggaugcagcuc

SEQ ID NO: 18176 - RNA, 22 nt, Homo sapiens
ugagccccugugccgcccccag

SEQ ID NO: 18177 - RNA, 24 nt, Homo sapiens
uggcccugacugaagaccagcagu

SEQ ID NO: 18178 - RNA, 19 nt, Homo sapiens
aggcugcggaauucaggac

SEQ ID NO: 18179 - RNA, 22 nt, Homo sapiens
aggcggggcgccgcgggaccgc

SEQ ID NO: 18180 - RNA, 22 nt, Homo sapiens
ugcggggcuagggcuaacagca

SEQ ID NO: 18181 - RNA, 22 nt, Homo sapiens
aggcagcgggguguaguggaua

SEQ ID NO: 18182 - RNA, 22 nt, Homo sapiens
aucuggagguaagaagcacuuu

SEQ ID NO: 18183 - RNA, 17 nt, Homo sapiens
ucccuguucgggcgcca

SEQ ID NO: 18184 - RNA, 23 nt, Homo sapiens
ugaguaccgccaugucuguuggg

SEQ ID NO: 18185 - RNA, 22 nt, Homo sapiens
uauguaauaugguccacaucuu

SEQ ID NO: 18186 - RNA, 22 nt, Homo sapiens
gaaguuguucgugguggauucg

SEQ ID NO: 18187 - RNA, 21 nt, Homo sapiens
gugucuuuugcucugcaguca

SEQ ID NO: 18188 - RNA, 19 nt, Homo sapiens
agguugacauacguuuccc

SEQ ID NO: 18189 - RNA, 23 nt, Homo sapiens
aaaagugcuuacagugcagguag

SEQ ID NO: 18190 - RNA, 23 nt, Homo sapiens
aaaagugcuuacagugcagguag

SEQ ID NO: 18191 - RNA, 21 nt, Homo sapiens
uaaagugcugacagugcagau

SEQ ID NO: 18192 - RNA, 21 nt, Homo sapiens
uaaagugcugacagugcagau

SEQ ID NO: 18193 - RNA, 19 nt, Homo sapiens
uggauuuuuggaucaggga

SEQ ID NO: 18194 - RNA, 22 nt, Homo sapiens
uaacagucuacagccauggucg

SEQ ID NO: 18195 - RNA, 23 nt, Homo sapiens
caaagugcuuacagugcagguag

SEQ ID NO: 18196 - RNA, 23 nt, Homo sapiens
caaagugcuuacagugcagguag

SEQ ID NO: 18197 - RNA, 25 nt, Homo sapiens
cccccacaaccgcgcuugacuagcu

SEQ ID NO: 18198 - RNA, 23 nt, Homo sapiens
uaaagugcuuauagugcagguag

SEQ ID NO: 18199 - RNA, 23 nt, Homo sapiens
uaaagugcuuauagugcagguag

SEQ ID NO: 18200 - RNA, 23 nt, Homo sapiens
caaagugcucauagugcagguag

SEQ ID NO: 18201 - RNA, 23 nt, Homo sapiens
caaagugcucauagugcagguag

SEQ ID NO: 18202 - RNA, 21 nt, Homo sapiens
uaacagucuccagucacggcc

SEQ ID NO: 18203 - RNA, 21 nt, Homo sapiens
ugacaacuauggaugagcucu

SEQ ID NO: 18204 - RNA, 22 nt, Homo sapiens
agaguugagucuggacgucccg

SEQ ID NO: 18205 - RNA, 22 nt, Homo sapiens
aaggagcucacagucuauugag

SEQ ID NO: 18206 - RNA, 23 nt, Homo sapiens
uaagugcuuccauguuuugguga

SEQ ID NO: 18207 - RNA, 23 nt, Homo sapiens
uaagugcuuccauguuuuaguag

SEQ ID NO: 18208 - RNA, 23 nt, Homo sapiens
uaagugcuuccauguuucagugg

SEQ ID NO: 18209 - RNA, 23 nt, Homo sapiens
uaagugcuuccauguuugagugu

SEQ ID NO: 18210 - RNA, 17 nt, Homo sapiens
uaagugcuuccaugcuu

SEQ ID NO: 18211 - RNA, 23 nt, Homo sapiens
aaagugcugcgacauuugagcgu

SEQ ID NO: 18212 - RNA, 23 nt, Homo sapiens
gaagugcuucgauuuuggggugu

SEQ ID NO: 18213 - RNA, 22 nt, Homo sapiens
aguggggaacccuuccaugagg

SEQ ID NO: 18214 - RNA, 23 nt, Homo sapiens
uuucaagccagggggcguuuuuc

SEQ ID NO: 18215 - RNA, 22 nt, Homo sapiens
aaagugcauccuuuuagagugu

SEQ ID NO: 18216 - RNA, 22 nt, Homo sapiens
aaagugcauccuuuuagagguu

SEQ ID NO: 18217 - RNA, 22 nt, Homo sapiens
aaagugcaucuuuuuagaggau

SEQ ID NO: 18218 - RNA, 22 nt, Homo sapiens
caaagugccucccuuuagagug

SEQ ID NO: 18219 - RNA, 22 nt, Homo sapiens
caaagugccucccuuuagagug

SEQ ID NO: 18220 - RNA, 22 nt, Homo sapiens
aaagugcuucccuuuggacugu

SEQ ID NO: 18221 - RNA, 21 nt, Homo sapiens
aaagugcuuccuuuuagaggg

SEQ ID NO: 18222 - RNA, 22 nt, Homo sapiens
aaagugcuuccuuuuagagggu

SEQ ID NO: 18223 - RNA, 22 nt, Homo sapiens
aaagugcuucucuuuggugggu

SEQ ID NO: 18224 - RNA, 21 nt, Homo sapiens
aaagugcuuccuuuuugaggg

SEQ ID NO: 18225 - RNA, 23 nt, Homo sapiens
cucuugagggaagcacuuucugu

SEQ ID NO: 18226 - RNA, 23 nt, Homo sapiens
cucuugagggaagcacuuucugu

SEQ ID NO: 18227 - RNA, 23 nt, Homo sapiens
uaaaucccauggugccuucuccu

SEQ ID NO: 18228 - RNA, 22 nt, Homo sapiens
aaccagcaccccaacuuuggac

SEQ ID NO: 18229 - RNA, 23 nt, Homo sapiens
aaggagcuuacaaucuagcuggg

SEQ ID NO: 18230 - RNA, 23 nt, Homo sapiens
caaagugcuguucgugcagguag

SEQ ID NO: 18231 - RNA, 23 nt, Homo sapiens
caaagugcuguucgugcagguag

SEQ ID NO: 18232 - RNA, 21 nt, Homo sapiens
cugacuguugccguccuccag

SEQ ID NO: 18233 - RNA, 22 nt, Homo sapiens
caggauguggucaaguguuguu

SEQ ID NO: 18234 - RNA, 22 nt, Homo sapiens
uuugguccccuucaaccagcug

SEQ ID NO: 18235 - RNA, 22 nt, Homo sapiens
uuugguccccuucaaccagcua

SEQ ID NO: 18236 - RNA, 20 nt, Homo sapiens
ggggagcuguggaagcagua

SEQ ID NO: 18237 - RNA, 22 nt, Homo sapiens
uaugugggaugguaaaccgcuu

SEQ ID NO: 18238 - RNA, 20 nt, Homo sapiens
aaaguagcuguaccauuugc

SEQ ID NO: 18239 - RNA, 23 nt, Homo sapiens
uauucauuuauccccagccuaca

SEQ ID NO: 18240 - RNA, 20 nt, Homo sapiens
ggggagcuguggaagcagua

SEQ ID NO: 18241 - RNA, 22 nt, Homo sapiens
ugugcgcagggagaccucuccc

SEQ ID NO: 18242 - RNA, 22 nt, Homo sapiens
ucuucucuguuuuggccaugug

SEQ ID NO: 18243 - RNA, 21 nt, Homo sapiens
cccggagccaggaugcagcuc

SEQ ID NO: 18244 - RNA, 18 nt, Homo sapiens
aucccaccucugccacca

SEQ ID NO: 18245 - RNA, 23 nt, Homo sapiens
uaaggugcaucuagugcagauag

SEQ ID NO: 18246 - RNA, 21 nt, Homo sapiens
cggcggggacggcgauugguc

SEQ ID NO: 18247 - RNA, 21 nt, Homo sapiens
cggcggggacggcgauugguc

SEQ ID NO: 18248 - RNA, 22 nt, Homo sapiens
ucugcccccuccgcugcugcca

SEQ ID NO: 18249 - RNA, 22 nt, Homo sapiens
acagcaggcacagacaggcagu

SEQ ID NO: 18250 - RNA, 21 nt, Homo sapiens
agggcccccccucaauccugu

SEQ ID NO: 18251 - RNA, 21 nt, Homo sapiens
agggcccccccucaauccugu

SEQ ID NO: 18252 - RNA, 20 nt, Homo sapiens
acugccccaggugcugcugg

SEQ ID NO: 18253 - RNA, 22 nt, Homo sapiens
gccugcugggguggaaccuggu

SEQ ID NO: 18254 - RNA, 23 nt, Homo sapiens
agcucggucugaggccccucagu

SEQ ID NO: 18255 - RNA, 21 nt, Homo sapiens
cggggcagcucaguacaggau

SEQ ID NO: 18256 - RNA, 18 nt, Homo sapiens
ugcuuccuuucagagggu

SEQ ID NO: 18257 - RNA, 22 nt, Homo sapiens
aucuggagguaagaagcacuuu

SEQ ID NO: 18258 - RNA, 24 nt, Homo sapiens
ugccugggucucuggccugcgcgu

SEQ ID NO: 18259 - RNA, 22 nt, Homo sapiens
aggcggggcgccgcgggaccgc

SEQ ID NO: 18260 - RNA, 22 nt, Homo sapiens
aggcggggcgccgcgggaccgc

SEQ ID NO: 18261 - RNA, 22 nt, Homo sapiens
ugcggggcuagggcuaacagca

SEQ ID NO: 18262 - RNA, 22 nt, Homo sapiens
cugcccuggcccgagggaccga

SEQ ID NO: 18263 - RNA, 24 nt, Homo sapiens
uggggagcugaggcucugggggug

SEQ ID NO: 18264 - RNA, 22 nt, Homo sapiens
ugugacugguugaccagagggg

SEQ ID NO: 18265 - RNA, 23 nt, Homo sapiens
ccuaguagguguccaguaagugu

SEQ ID NO: 18266 - RNA, 22 nt, Homo sapiens
aaucguacagggucauccacuu

SEQ ID NO: 18267 - RNA, 23 nt, Homo sapiens
cucuugagggaagcacuuucugu

SEQ ID NO: 18268 - RNA, 22 nt, Homo sapiens
ugagaccucuggguucugagcu

SEQ ID NO: 18269 - RNA, 23 nt, Homo sapiens
uccaguaccacgugucagggcca

SEQ ID NO: 18270 - RNA, 21 nt, Homo sapiens
cugacuguugccguccuccag

SEQ ID NO: 18271 - RNA, 22 nt, Homo sapiens
acccgucccguucguccccgga

SEQ ID NO: 18272 - RNA, 23 nt, Homo sapiens
guccaguuuucccaggaaucccu

SEQ ID NO: 18273 - RNA, 22 nt, Homo sapiens
ugagaacugaauuccauggguu

SEQ ID NO: 18274 - RNA, 22 nt, Homo sapiens
ugagaacugaauuccauaggcu

SEQ ID NO: 18275 - RNA, 21 nt, Homo sapiens
cggcggggacggcgauugguc

SEQ ID NO: 18276 - RNA, 22 nt, Homo sapiens
cgcaggggccgggugcucaccg

SEQ ID NO: 18277 - RNA, 23 nt, Homo sapiens
ugaggggcagagagcgagacuuu

SEQ ID NO: 18278 - RNA, 22 nt, Homo sapiens
aggcggggcgccgcgggaccgc

SEQ ID NO: 18279 - RNA, 22 nt, Homo sapiens
ugcggggcuagggcuaacagca

SEQ ID NO: 18280 - RNA, 22 nt, Homo sapiens
uggaauguaaggaagugugugg

SEQ ID NO: 18281 - RNA, 23 nt, Homo sapiens
agguuacccgagcaacuuugcau

SEQ ID NO: 18282 - RNA, 23 nt, Homo sapiens
uucucgaggaaagaagcacuuuc

SEQ ID NO: 18283 - RNA, 23 nt, Homo sapiens
uuacaguuguucaaccaguuacu

SEQ ID NO: 18284 - RNA, 22 nt, Homo sapiens
ugagaaccacgucugcucugag

SEQ ID NO: 18285 - RNA, 21 nt, Homo sapiens
uggcagggaggcugggagggg

SEQ ID NO: 18286 - RNA, 22 nt, Homo sapiens
ucugggcaacaaagugagaccu

SEQ ID NO: 18287 - RNA, 21 nt, Homo sapiens
cggcggggacggcgauugguc

SEQ ID NO: 18288 - RNA, 25 nt, Homo sapiens
gcugggcagggcuucugagcuccuu

SEQ ID NO: 18289 - RNA, 22 nt, Homo sapiens
aggcggggcgccgcgggaccgc

SEQ ID NO: 18290 - RNA, 21 nt, Homo sapiens
uccgguucucagggcuccacc

SEQ ID NO: 18291 - RNA, 22 nt, Homo sapiens
ugcggggcuagggcuaacagca

SEQ ID NO: 18292 - RNA, 24 nt, Homo sapiens
uggggagcugaggcucugggggug

SEQ ID NO: 18293 - RNA, 22 nt, Homo sapiens
aggcauugacuucucacuagcu

SEQ ID NO: 18294 - RNA, 23 nt, Homo sapiens
uuauugcuuaagaauacgcguag

SEQ ID NO: 18295 - RNA, 21 nt, Homo sapiens
aagugaucuaaaggccuacau

SEQ ID NO: 18296 - RNA, 21 nt, Homo sapiens
cucccacaugcaggguuugca

SEQ ID NO: 18297 - RNA, 21 nt, Homo sapiens
ugagaugaagcacuguagcuc

SEQ ID NO: 18298 - RNA, 21 nt, Homo sapiens
uaguagaccguauagcguacg

SEQ ID NO: 18299 - RNA, 22 nt, Homo sapiens
uugggaucauuuugcauccaua

SEQ ID NO: 18300 - RNA, 22 nt, Homo sapiens
aacaucacagcaagucugugcu

SEQ ID NO: 18301 - RNA, 22 nt, Homo sapiens
ggagaaauuauccuuggugugu

SEQ ID NO: 18302 - RNA, 22 nt, Homo sapiens
augcugacauauuuacuagagg

SEQ ID NO: 18303 - RNA, 23 nt, Homo sapiens
cugggaucuccggggucuugguu

SEQ ID NO: 18304 - RNA, 21 nt, Homo sapiens
cggcggggacggcgauugguc

SEQ ID NO: 18305 - RNA, 21 nt, Homo sapiens
gugcauuguaguugcauugca

SEQ ID NO: 18306 - RNA, 22 nt, Homo sapiens
gaaagcgcuucccuuugcugga

SEQ ID NO: 18307 - RNA, 20 nt, Homo sapiens
cugcaaagggaagcccuuuc

SEQ ID NO: 18308 - RNA, 22 nt, Homo sapiens
caaagcgcuccccuuuagaggu

SEQ ID NO: 18309 - RNA, 23 nt, Homo sapiens
caaagcgcuucucuuuagagugu

SEQ ID NO: 18310 - RNA, 21 nt, Homo sapiens
caaagcgcuucccuuuggagc

SEQ ID NO: 18311 - RNA, 21 nt, Homo sapiens
gaaagcgcuucucuuuagagg

SEQ ID NO: 18312 - RNA, 21 nt, Homo sapiens
gaaggcgcuucccuuuggagu

SEQ ID NO: 18313 - RNA, 22 nt, Homo sapiens
gaaggcgcuucccuuuagagcg

SEQ ID NO: 18314 - RNA, 20 nt, Homo sapiens
cugcaaagggaagcccuuuc

SEQ ID NO: 18315 - RNA, 22 nt, Homo sapiens
aggcggggcgccgcgggaccgc

SEQ ID NO: 18316 - RNA, 23 nt, Homo sapiens
ucuggcuccgugucuucacuccc

SEQ ID NO: 18317 - RNA, 21 nt, Homo sapiens
uccugcgcgucccagaugccc

SEQ ID NO: 18318 - RNA, 21 nt, Homo sapiens
cggcggggacggcgauugguc

SEQ ID NO: 18319 - RNA, 22 nt, Homo sapiens
cgcaggggccgggugcucaccg

SEQ ID NO: 18320 - RNA, 22 nt, Homo sapiens
aggcggggcgccgcgggaccgc

SEQ ID NO: 18321 - RNA, 21 nt, Homo sapiens
uagcagcacagaaauauuggc

SEQ ID NO: 18322 - RNA, 22 nt, Homo sapiens
uggcagugucuuagcugguugu

SEQ ID NO: 18323 - RNA, 22 nt, Homo sapiens
caaucacuaacuccacugccau

SEQ ID NO: 18324 - RNA, 23 nt, Homo sapiens
aggcaguguaguuagcugauugc

SEQ ID NO: 18325 - RNA, 22 nt, Homo sapiens
uggcaguguauuguuagcuggu

SEQ ID NO: 18326 - RNA, 22 nt, Homo sapiens
aggcaguguauuguuagcuggc

SEQ ID NO: 18327 - RNA, 22 nt, Homo sapiens
caaccuggaggacuccaugcug

SEQ ID NO: 18328 - RNA, 19 nt, Homo sapiens
aagugugcagggcacuggu

SEQ ID NO: 18329 - RNA, 22 nt, Homo sapiens
acaguagagggaggaaucgcag

SEQ ID NO: 18330 - RNA, 18 nt, Homo sapiens
cgggcguggugguggggg

SEQ ID NO: 18331 - RNA, 18 nt, Homo sapiens
gucccuguucaggcgcca

SEQ ID NO: 18332 - RNA, 22 nt, Homo sapiens
ucugggcaacaaagugagaccu

SEQ ID NO: 18333 - RNA, 23 nt, Homo sapiens
caacggaaucccaaaagcagcug

SEQ ID NO: 18334 - RNA, 21 nt, Homo sapiens
agggcccccccucaauccugu

SEQ ID NO: 18335 - RNA, 23 nt, Homo sapiens
ucccuguccuccaggagcucacg

SEQ ID NO: 18336 - RNA, 23 nt, Homo sapiens
uagcagcgggaacaguucugcag

SEQ ID NO: 18337 - RNA, 25 nt, Homo sapiens
gcugggcagggcuucugagcuccuu

SEQ ID NO: 18338 - RNA, 23 nt, Homo sapiens
cgggucggaguuagcucaagcgg

SEQ ID NO: 18339 - RNA, 21 nt, Homo sapiens
ccccaccuccucucuccucag

SEQ ID NO: 18340 - RNA, 21 nt, Homo sapiens
aguuaggauuaggucguggaa

SEQ ID NO: 18341 - RNA, 18 nt, Homo sapiens
aucccaccucugccacca

SEQ ID NO: 18342 - RNA, 21 nt, Homo sapiens
gcccuccgcccgugcaccccg

SEQ ID NO: 18343 - RNA, 18 nt, Homo sapiens
ugaggcaguagauugaau

SEQ ID NO: 18344 - RNA, 20 nt, Homo sapiens
ccucugggcccuuccuccag

SEQ ID NO: 18345 - RNA, 22 nt, Homo sapiens
ucucugggccugugucuuaggc

SEQ ID NO: 18346 - RNA, 22 nt, Homo sapiens
aguggggaacccuuccaugagg

SEQ ID NO: 18347 - RNA, 18 nt, Homo sapiens
ugcuuccuuucagagggu

SEQ ID NO: 18348 - RNA, 22 nt, Homo sapiens
aucuggagguaagaagcacuuu

SEQ ID NO: 18349 - RNA, 21 nt, Homo sapiens
guggcugcacucacuuccuuc

SEQ ID NO: 18350 - RNA, 25 nt, Homo sapiens
ggcggagggaaguagguccguuggu

SEQ ID NO: 18351 - RNA, 23 nt, Homo sapiens
agcagcauuguacagggcuauga

SEQ ID NO: 18352 - RNA, 23 nt, Homo sapiens
agcagcauuguacagggcuauca

SEQ ID NO: 18353 - RNA, 23 nt, Homo sapiens
ccugcagcgacuugauggcuucc

SEQ ID NO: 18354 - RNA, 22 nt, Homo sapiens
ugugacugguugaccagagggg

SEQ ID NO: 18355 - RNA, 22 nt, Homo sapiens
ucagugcacuacagaacuuugu

SEQ ID NO: 18356 - RNA, 22 nt, Homo sapiens
ucagugcaucacagaacuuugu

SEQ ID NO: 18357 - RNA, 21 nt, Homo sapiens
ucagugcaugacagaacuugg

SEQ ID NO: 18358 - RNA, 23 nt, Homo sapiens
aacauucaacgcugucggugagu

SEQ ID NO: 18359 - RNA, 23 nt, Homo sapiens
aacauucauugcugucggugggu

SEQ ID NO: 18360 - RNA, 22 nt, Homo sapiens
aacauucaaccugucggugagu

SEQ ID NO: 18361 - RNA, 23 nt, Homo sapiens
aacauucauuguugucggugggu

SEQ ID NO: 18362 - RNA, 23 nt, Homo sapiens
agcuacauugucugcuggguuuc

SEQ ID NO: 18363 - RNA, 21 nt, Homo sapiens
agcuacaucuggcuacugggu

SEQ ID NO: 18364 - RNA, 21 nt, Homo sapiens
gugcauuguaguugcauugca

SEQ ID NO: 18365 - RNA, 22 nt, Homo sapiens
ugaaacauacacgggaaaccuc

SEQ ID NO: 18366 - RNA, 22 nt, Homo sapiens
aaacauucgcggugcacuucuu

SEQ ID NO: 18367 - RNA, 19 nt, Homo sapiens
gugucugcuuccuguggga

SEQ ID NO: 18368 - RNA, 23 nt, Homo sapiens
ugucacucggcucggcccacuac

SEQ ID NO: 18369 - RNA, 22 nt, Homo sapiens
ugagguaguagguuguauaguu

SEQ ID NO: 18370 - RNA, 22 nt, Homo sapiens
ugagguaguagguugugugguu

SEQ ID NO: 18371 - RNA, 19 nt, Homo sapiens
ugucucugcugggguuucu

SEQ ID NO: 18372 - RNA, 24 nt, Homo sapiens
uggcccugacugaagaccagcagu

SEQ ID NO: 18373 - RNA, 23 nt, Homo sapiens
ugguuguaguccgugcgagaaua

SEQ ID NO: 18374 - RNA, 19 nt, Homo sapiens
ugagcugcuguaccaaaau

SEQ ID NO: 18375 - RNA, 21 nt, Homo sapiens
ugagaugaagcacuguagcuc

SEQ ID NO: 18376 - RNA, 18 nt, Homo sapiens
ugaggcaguagauugaau

SEQ ID NO: 18377 - RNA, 22 nt, Homo sapiens
ucgugucuuguguugcagccgg

SEQ ID NO: 18378 - RNA, 22 nt, Homo sapiens
caaucacuaacuccacugccau

SEQ ID NO: 18379 - RNA, 22 nt, Homo sapiens
ugugacagauugauaacugaaa

SEQ ID NO: 18380 - RNA, 22 nt, Homo sapiens
ucagcaaacauuuauugugugc

SEQ ID NO: 18381 - RNA, 19 nt, Homo sapiens
aagcagcugccucugaggc

SEQ ID NO: 18382 - RNA, 19 nt, Homo sapiens
aagugugcagggcacuggu

SEQ ID NO: 18383 - RNA, 21 nt, Homo sapiens
aggaggcagcgcucucaggac

SEQ ID NO: 18384 - RNA, 21 nt, Homo sapiens
gcaggaacuugugagucuccu

SEQ ID NO: 18385 - RNA, 21 nt, Homo sapiens
aaggcagggcccccgcucccc

SEQ ID NO: 18386 - RNA, 23 nt, Homo sapiens
ccugcagcgacuugauggcuucc

SEQ ID NO: 18387 - RNA, 20 nt, Homo sapiens
ucugcaggguuugcuuugag

SEQ ID NO: 18388 - RNA, 20 nt, Homo sapiens
ucugcaggguuugcuuugag

SEQ ID NO: 18389 - RNA, 21 nt, Homo sapiens
ccccaccuccucucuccucag

SEQ ID NO: 18390 - RNA, 22 nt, Homo sapiens
uggagugugacaaugguguuug

SEQ ID NO: 18391 - RNA, 23 nt, Homo sapiens
caaagugcuuacagugcagguag

SEQ ID NO: 18392 - RNA, 22 nt, Homo sapiens
uggagagaaaggcaguuccuga

SEQ ID NO: 18393 - RNA, 21 nt, Homo sapiens
cggcggggacggcgauugguc

SEQ ID NO: 18394 - RNA, 21 nt, Homo sapiens
acuggacuuggagucagaagg

SEQ ID NO: 18395 - RNA, 22 nt, Homo sapiens
acuggacuuagggucagaaggc

SEQ ID NO: 18396 - RNA, 22 nt, Homo sapiens
uacugcagacguggcaaucaug

SEQ ID NO: 18397 - RNA, 21 nt, Homo sapiens
uacugcagacaguggcaauca

SEQ ID NO: 18398 - RNA, 21 nt, Homo sapiens
aacaggugacugguuagacaa

SEQ ID NO: 18399 - RNA, 23 nt, Homo sapiens
cuaauaguaucuaccacaauaaa

SEQ ID NO: 18400 - RNA, 22 nt, Homo sapiens
aggcggggcgccgcgggaccgc

SEQ ID NO: 18401 - RNA, 21 nt, Homo sapiens
ucguggccuggucuccauuau

SEQ ID NO: 18402 - RNA, 22 nt, Homo sapiens
uggagugugacaaugguguuug

SEQ ID NO: 18403 - RNA, 22 nt, Homo sapiens
ccucuuccccuugucucuccag

SEQ ID NO: 18404 - RNA, 17 nt, Homo sapiens
ucgccuccuccucuccc

SEQ ID NO: 18405 - RNA, 20 nt, Homo sapiens
ccccagggcgacgcggcggg

SEQ ID NO: 18406 - RNA, 22 nt, Homo sapiens
aagacgggaggaaagaagggag

SEQ ID NO: 18407 - RNA, 25 nt, Homo sapiens
ggcggagggaaguagguccguuggu

SEQ ID NO: 18408 - RNA, 22 nt, Homo sapiens
gguggcccggccgugccugagg

SEQ ID NO: 18409 - RNA, 23 nt, Homo sapiens
uggugcggagagggcccacagug

SEQ ID NO: 18410 - RNA, 22 nt, Homo sapiens
aggcagcgggguguaguggaua

SEQ ID NO: 18411 - RNA, 20 nt, Homo sapiens
ucugcaggguuugcuuugag

SEQ ID NO: 18412 - RNA, 24 nt, Homo sapiens
ucccugagacccuuuaaccuguga

SEQ ID NO: 18413 - RNA, 22 nt, Homo sapiens
ucccugagacccuaacuuguga

SEQ ID NO: 18414 - RNA, 23 nt, Homo sapiens
ccucagggcuguagaacagggcu

SEQ ID NO: 18415 - RNA, 24 nt, Homo sapiens
uggcccugacugaagaccagcagu

SEQ ID NO: 18416 - RNA, 23 nt, Homo sapiens
ucuggcuccgugucuucacuccc

SEQ ID NO: 18417 - RNA, 23 nt, Homo sapiens
uaaggugcaucuagugcagauag

SEQ ID NO: 18418 - RNA, 22 nt, Homo sapiens
cccugugcccggcccacuucug

SEQ ID NO: 18419 - RNA, 20 nt, Homo sapiens
ccccagggcgacgcggcggg

SEQ ID NO: 18420 - RNA, 22 nt, Homo sapiens
ucaggccaggcacaguggcuca

SEQ ID NO: 18421 - RNA, 22 nt, Homo sapiens
aagcugccaguugaagaacugu

SEQ ID NO: 18422 - RNA, 23 nt, Homo sapiens
agcuacauugucugcuggguuuc

SEQ ID NO: 18423 - RNA, 21 nt, Homo sapiens
aggggugcuaucugugauuga

SEQ ID NO: 18424 - RNA, 20 nt, Homo sapiens
accaggaggcugaggccccu

SEQ ID NO: 18425 - RNA, 22 nt, Homo sapiens
cugcccuggcccgagggaccga

SEQ ID NO: 18426 - RNA, 23 nt, Homo sapiens
cacccggcugugugcacaugugc

SEQ ID NO: 18427 - RNA, 22 nt, Homo sapiens
ucucccaacccuuguaccagug

SEQ ID NO: 18428 - RNA, 22 nt, Homo sapiens
ggagacgcggcccuguuggagu

SEQ ID NO: 18429 - RNA, 22 nt, Homo sapiens
uagguaguuuccuguuguuggg

SEQ ID NO: 18430 - RNA, 23 nt, Homo sapiens
uaauacugccggguaaugaugga

SEQ ID NO: 18431 - RNA, 22 nt, Homo sapiens
auaagacgagcaaaaagcuugu

SEQ ID NO: 18432 - RNA, 22 nt, Homo sapiens
auaagacgaacaaaagguuugu

SEQ ID NO: 18433 - RNA, 22 nt, Homo sapiens
uagcuuaucagacugauguuga

SEQ ID NO: 18434 - RNA, 21 nt, Homo sapiens
agggcccccccucaauccugu

SEQ ID NO: 18435 - RNA, 23 nt, Homo sapiens
agugccugagggaguaagagccc

SEQ ID NO: 18436 - RNA, 19 nt, Homo sapiens
ugucucugcugggguuucu

SEQ ID NO: 18437 - RNA, 23 nt, Homo sapiens
cgggucggaguuagcucaagcgg

SEQ ID NO: 18438 - RNA, 23 nt, Homo sapiens
cacccggcugugugcacaugugc

SEQ ID NO: 18439 - RNA, 22 nt, Homo sapiens
ugagguaguagguuguauaguu

SEQ ID NO: 18440 - RNA, 22 nt, Homo sapiens
ugagguaguagguugugugguu

SEQ ID NO: 18441 - RNA, 19 nt, Homo sapiens
ugucucugcugggguuucu

SEQ ID NO: 18442 - RNA, 24 nt, Homo sapiens
ucccugagacccuuuaaccuguga

SEQ ID NO: 18443 - RNA, 22 nt, Homo sapiens
ucccugagacccuaacuuguga

SEQ ID NO: 18444 - RNA, 23 nt, Homo sapiens
ccucagggcuguagaacagggcu

SEQ ID NO: 18445 - RNA, 22 nt, Homo sapiens
uagguaguuucauguuguuggg

SEQ ID NO: 18446 - RNA, 21 nt, Homo sapiens
caaagguauuugugguuuuug

SEQ ID NO: 18447 - RNA, 23 nt, Homo sapiens
uaaaucccauggugccuucuccu

SEQ ID NO: 18448 - RNA, 19 nt, Homo sapiens
ucuaggcugguacugcuga

SEQ ID NO: 18449 - RNA, 22 nt, Homo sapiens
ugcggggcuagggcuaacagca

SEQ ID NO: 18450 - RNA, 23 nt, Homo sapiens
ucugcucauaccccaugguuucu

SEQ ID NO: 18451 - RNA, 17 nt, Homo sapiens
gugggggagaggcuguc

SEQ ID NO: 18452 - RNA, 18 nt, Homo sapiens
ugaggcaguagauugaau

SEQ ID NO: 18453 - RNA, 22 nt, Homo sapiens
uggacggagaacugauaagggu

SEQ ID NO: 18454 - RNA, 22 nt, Homo sapiens
aacuggccuacaaagucccagu

SEQ ID NO: 18455 - RNA, 22 nt, Homo sapiens
aacuggcccucaaagucccgcu

SEQ ID NO: 18456 - RNA, 25 nt, Homo sapiens
cccccacaaccgcgcuugacuagcu

SEQ ID NO: 18457 - RNA, 23 nt, Homo sapiens
cccaguguucagacuaccuguuc

SEQ ID NO: 18458 - RNA, 23 nt, Homo sapiens
cccaguguuuagacuaucuguuc

SEQ ID NO: 18459 - RNA, 23 nt, Homo sapiens
gcaaagcacacggccugcagaga

SEQ ID NO: 18460 - RNA, 22 nt, Homo sapiens
cgucaacacuugcugguuuccu

SEQ ID NO: 18461 - RNA, 23 nt, Homo sapiens
ugagugugugugugugagugugu

SEQ ID NO: 18462 - RNA, 19 nt, Homo sapiens
ugucucugcugggguuucu

SEQ ID NO: 18463 - RNA, 23 nt, Homo sapiens
gcagcagagaauaggacuacguc

SEQ ID NO: 18464 - RNA, 24 nt, Homo sapiens
uggggagcugaggcucugggggug

SEQ ID NO: 18465 - RNA, 22 nt, Homo sapiens
uggagugugacaaugguguuug

SEQ ID NO: 18466 - RNA, 18 nt, Homo sapiens
cgggcguggugguggggg

SEQ ID NO: 18467 - RNA, 22 nt, Homo sapiens
cucggcgcggggcgcgggcucc

SEQ ID NO: 18468 - RNA, 21 nt, Homo sapiens
uccugcgcgucccagaugccc

SEQ ID NO: 18469 - RNA, 22 nt, Homo sapiens
cucuagagggaagcacuuucug

SEQ ID NO: 18470 - RNA, 22 nt, Homo sapiens
uucaccaccuucuccacccagc

SEQ ID NO: 18471 - RNA, 22 nt, Homo sapiens
cauugcacuugucucggucuga

SEQ ID NO: 18472 - RNA, 23 nt, Homo sapiens
ucaagagcaauaacgaaaaaugu

SEQ ID NO: 18473 - RNA, 23 nt, Homo sapiens
agcucggucugaggccccucagu

SEQ ID NO: 18474 - RNA, 19 nt, Homo sapiens
ugagcugcuguaccaaaau

SEQ ID NO: 18475 - RNA, 22 nt, Homo sapiens
uccgagccugggucucccucuu

SEQ ID NO: 18476 - RNA, 19 nt, Homo sapiens
aagcagcugccucugaggc

SEQ ID NO: 18477 - RNA, 25 nt, Homo sapiens
ggcggagggaaguagguccguuggu

SEQ ID NO: 18478 - RNA, 23 nt, Homo sapiens
cgggucggaguuagcucaagcgg

SEQ ID NO: 18479 - RNA, 21 nt, Homo sapiens
uaaagugcugacagugcagau

SEQ ID NO: 18480 - RNA, 22 nt, Homo sapiens
gugugcggaaaugcuucugcua

SEQ ID NO: 18481 - RNA, 23 nt, Homo sapiens
ucuggcuccgugucuucacuccc

SEQ ID NO: 18482 - RNA, 18 nt, Homo sapiens
uccagugcccuccucucc

SEQ ID NO: 18483 - RNA, 22 nt, Homo sapiens
uggagagaaaggcaguuccuga

SEQ ID NO: 18484 - RNA, 21 nt, Homo sapiens
cggcggggacggcgauugguc

SEQ ID NO: 18485 - RNA, 17 nt, Homo sapiens
uaauugcuuccauguuu

SEQ ID NO: 18486 - RNA, 23 nt, Homo sapiens
ucccccaggugugauucugauuu

SEQ ID NO: 18487 - RNA, 23 nt, Homo sapiens
ugaggggcagagagcgagacuuu

SEQ ID NO: 18488 - RNA, 22 nt, Homo sapiens
augcugacauauuuacuagagg

SEQ ID NO: 18489 - RNA, 24 nt, Homo sapiens
acugggggcuuucgggcucugcgu

SEQ ID NO: 18490 - RNA, 22 nt, Homo sapiens
aggcggggcgccgcgggaccgc

SEQ ID NO: 18491 - RNA, 22 nt, Homo sapiens
ugugcgcagggagaccucuccc

SEQ ID NO: 18492 - RNA, 23 nt, Homo sapiens
ccugcagcgacuugauggcuucc

SEQ ID NO: 18493 - RNA, 23 nt, Homo sapiens
ccugcagcgacuugauggcuucc

SEQ ID NO: 18494 - RNA, 21 nt, Homo sapiens
uggcagggaggcugggagggg

SEQ ID NO: 18495 - RNA, 21 nt, Homo sapiens
cggcggggacggcgauugguc

SEQ ID NO: 18496 - RNA, 22 nt, Homo sapiens
cgcaggggccgggugcucaccg

SEQ ID NO: 18497 - RNA, 22 nt, Homo sapiens
uguaaacauccuacacucagcu

SEQ ID NO: 18498 - RNA, 22 nt, Homo sapiens
aggcggggcgccgcgggaccgc

SEQ ID NO: 18499 - RNA, 21 nt, Homo sapiens
cgcgggugcuuacugacccuu

SEQ ID NO: 18500 - RNA, 21 nt, Homo sapiens
gugccagcugcagugggggag

SEQ ID NO: 18501 - RNA, 21 nt, Homo sapiens
uggcagggaggcugggagggg

SEQ ID NO: 18502 - RNA, 24 nt, Homo sapiens
agccuggaagcuggagccugcagu

SEQ ID NO: 18503 - RNA, 18 nt, Homo sapiens
cgggcguggugguggggg

SEQ ID NO: 18504 - RNA, 23 nt, Homo sapiens
cuggagauauggaagagcugugu

SEQ ID NO: 18505 - RNA, 23 nt, Homo sapiens
ucuggcuccgugucuucacuccc

SEQ ID NO: 18506 - RNA, 22 nt, Homo sapiens
cgcaggggccgggugcucaccg

SEQ ID NO: 18507 - RNA, 22 nt, Homo sapiens
uagcaccaucugaaaucgguua

SEQ ID NO: 18508 - RNA, 23 nt, Homo sapiens
uagcaccauuugaaaucaguguu

SEQ ID NO: 18509 - RNA, 22 nt, Homo sapiens
uggcaguguauuguuagcuggu

SEQ ID NO: 18510 - RNA, 22 nt, Homo sapiens
uagcaccauuugaaaucgguua

SEQ ID NO: 18511 - RNA, 23 nt, Homo sapiens
ucuuggaguaggucauugggugg

SEQ ID NO: 18512 - RNA, 22 nt, Homo sapiens
agaggcuggccgugaugaauuc

SEQ ID NO: 18513 - RNA, 22 nt, Homo sapiens
cgucaacacuugcugguuuccu

SEQ ID NO: 18514 - RNA, 24 nt, Homo sapiens
uucuccaaaagaaagcacuuucug

SEQ ID NO: 18515 - RNA, 22 nt, Homo sapiens
aagugccuccuuuuagaguguu

SEQ ID NO: 18516 - RNA, 20 nt, Homo sapiens
auggagauagauauagaaau

SEQ ID NO: 18517 - RNA, 22 nt, Homo sapiens
acuccagccccacagccucagc

SEQ ID NO: 18518 - RNA, 21 nt, Homo sapiens
aaggcagggcccccgcucccc

SEQ ID NO: 18519 - RNA, 21 nt, Homo sapiens
uccuucugcuccgucccccag

SEQ ID NO: 18520 - RNA, 21 nt, Homo sapiens
uggcagggaggcugggagggg

SEQ ID NO: 18521 - RNA, 24 nt, Homo sapiens
agccuggaagcuggagccugcagu

SEQ ID NO: 18522 - RNA, 21 nt, Homo sapiens
uugggacauacuuaugcuaaa

SEQ ID NO: 18523 - RNA, 21 nt, Homo sapiens
aagugaucuaaaggccuacau

SEQ ID NO: 18524 - RNA, 22 nt, Homo sapiens
cgcaggggccgggugcucaccg

SEQ ID NO: 18525 - RNA, 22 nt, Homo sapiens
ucugcccccuccgcugcugcca

SEQ ID NO: 18526 - RNA, 22 nt, Homo sapiens
uggcucaguucagcaggaacag

SEQ ID NO: 18527 - RNA, 20 nt, Homo sapiens
acugccccaggugcugcugg

SEQ ID NO: 18528 - RNA, 22 nt, Homo sapiens
uaaugccccuaaaaauccuuau

SEQ ID NO: 18529 - RNA, 22 nt, Homo sapiens
ucaggcucaguccccucccgau

SEQ ID NO: 18530 - RNA, 21 nt, Homo sapiens
cggggcagcucaguacaggau

SEQ ID NO: 18531 - RNA, 22 nt, Homo sapiens
uggugggcacagaaucuggacu

SEQ ID NO: 18532 - RNA, 25 nt, Homo sapiens
aggggugguguugggacagcuccgu

SEQ ID NO: 18533 - RNA, 22 nt, Homo sapiens
uggugggccgcagaacaugugc

SEQ ID NO: 18534 - RNA, 22 nt, Homo sapiens
ugcggggcuagggcuaacagca

SEQ ID NO: 18535 - RNA, 21 nt, Homo sapiens
cuuuuugcggucugggcuugc

SEQ ID NO: 18536 - RNA, 21 nt, Homo sapiens
aauauaacacagauggccugu

SEQ ID NO: 18537 - RNA, 27 nt, Homo sapiens
cacuguaggugauggugagagugggca

SEQ ID NO: 18538 - RNA, 22 nt, Homo sapiens
ucaccagcccuguguucccuag

SEQ ID NO: 18539 - RNA, 23 nt, Homo sapiens
agcugguguugugaaucaggccg

SEQ ID NO: 18540 - RNA, 22 nt, Homo sapiens
ucuacagugcacgugucuccag

SEQ ID NO: 18541 - RNA, 22 nt, Homo sapiens
uagcagcacauaaugguuugug

SEQ ID NO: 18542 - RNA, 22 nt, Homo sapiens
uagcagcacaucaugguuuaca

SEQ ID NO: 18543 - RNA, 22 nt, Homo sapiens
uagcagcacguaaauauuggcg

SEQ ID NO: 18544 - RNA, 21 nt, Homo sapiens
uagcagcacagaaauauuggc

SEQ ID NO: 18545 - RNA, 21 nt, Homo sapiens
acuggacuuggagucagaagg

SEQ ID NO: 18546 - RNA, 22 nt, Homo sapiens
cagcagcaauucauguuuugaa

SEQ ID NO: 18547 - RNA, 22 nt, Homo sapiens
ugaguauuacauggccaaucuc

SEQ ID NO: 18548 - RNA, 21 nt, Homo sapiens
cagcagcacacugugguuugu

SEQ ID NO: 18549 - RNA, 23 nt, Homo sapiens
uuucaagccagggggcguuuuuc

SEQ ID NO: 18550 - RNA, 22 nt, Homo sapiens
ucagcaaacauuuauugugugc

SEQ ID NO: 18551 - RNA, 23 nt, Homo sapiens
uuacaguuguucaaccaguuacu

SEQ ID NO: 18552 - RNA, 21 nt, Homo sapiens
uaauuuuauguauaagcuagu

SEQ ID NO: 18553 - RNA, 25 nt, Homo sapiens
aggggugguguugggacagcuccgu

SEQ ID NO: 18554 - RNA, 22 nt, Homo sapiens
aaccagcaccccaacuuuggac

SEQ ID NO: 18555 - RNA, 23 nt, Homo sapiens
gcagcagagaauaggacuacguc

SEQ ID NO: 18556 - RNA, 23 nt, Homo sapiens
ccaguuaccgcuuccgcuaccgc

SEQ ID NO: 18557 - RNA, 24 nt, Homo sapiens
uggcccugacugaagaccagcagu

SEQ ID NO: 18558 - RNA, 22 nt, Homo sapiens
ugcccuguggacucaguucugg

SEQ ID NO: 18559 - RNA, 21 nt, Homo sapiens
uccugcgcgucccagaugccc

SEQ ID NO: 18560 - RNA, 18 nt, Homo sapiens
ugaggcaguagauugaau

SEQ ID NO: 18561 - RNA, 22 nt, Homo sapiens
cgcaggggccgggugcucaccg

SEQ ID NO: 18562 - RNA, 23 nt, Homo sapiens
ugaguaccgccaugucuguuggg

SEQ ID NO: 18563 - RNA, 22 nt, Homo sapiens
cccugugcccggcccacuucug

SEQ ID NO: 18564 - RNA, 21 nt, Homo sapiens
ccaccaccgugucugacacuu

SEQ ID NO: 18565 - RNA, 23 nt, Homo sapiens
cgcauccccuagggcauuggugu

SEQ ID NO: 18566 - RNA, 21 nt, Homo sapiens
aggaggcagcgcucucaggac

SEQ ID NO: 18567 - RNA, 22 nt, Homo sapiens
aggcagcgggguguaguggaua

SEQ ID NO: 18568 - RNA, 23 nt, Homo sapiens
cggcccgggcugcugcuguuccu

SEQ ID NO: 18569 - RNA, 22 nt, Homo sapiens
aacuguuugcagaggaaacuga

SEQ ID NO: 18570 - RNA, 21 nt, Homo sapiens
uagcagcacagaaauauuggc

SEQ ID NO: 18571 - RNA, 23 nt, Homo sapiens
ugugcaaaucuaugcaaaacuga

SEQ ID NO: 18572 - RNA, 23 nt, Homo sapiens
ugugcaaauccaugcaaaacuga

SEQ ID NO: 18573 - RNA, 21 nt, Homo sapiens
uuuugcaccuuuuggagugaa

SEQ ID NO: 18574 - RNA, 23 nt, Homo sapiens
guuugcacgggugggccuugucu

SEQ ID NO: 18575 - RNA, 23 nt, Homo sapiens
uucauuugguauaaaccgcgauu

SEQ ID NO: 18576 - RNA, 22 nt, Homo sapiens
ugagaaccacgucugcucugag

SEQ ID NO: 18577 - RNA, 21 nt, Homo sapiens
acagucugcugagguuggagc

SEQ ID NO: 18578 - RNA, 20 nt, Homo sapiens
agaccauggguucucauugu

SEQ ID NO: 18579 - RNA, 22 nt, Homo sapiens
uggagugugacaaugguguuug

SEQ ID NO: 18580 - RNA, 22 nt, Homo sapiens
aaaucucugcaggcaaauguga

SEQ ID NO: 18581 - RNA, 22 nt, Homo sapiens
uggcagugucuuagcugguugu

SEQ ID NO: 18582 - RNA, 22 nt, Homo sapiens
caaucacuaacuccacugccau

SEQ ID NO: 18583 - RNA, 23 nt, Homo sapiens
aggcaguguaguuagcugauugc

SEQ ID NO: 18584 - RNA, 22 nt, Homo sapiens
uuauaauacaaccugauaagug

SEQ ID NO: 18585 - RNA, 22 nt, Homo sapiens
auauaauacaaccugcuaagug

SEQ ID NO: 18586 - RNA, 20 nt, Homo sapiens
auuccuagaaauuguucaua

SEQ ID NO: 18587 - RNA, 22 nt, Homo sapiens
uggcaguguauuguuagcuggu

SEQ ID NO: 18588 - RNA, 22 nt, Homo sapiens
aggcaguguauuguuagcuggc

SEQ ID NO: 18589 - RNA, 21 nt, Homo sapiens
uagauaaaauauugguaccug

SEQ ID NO: 18590 - RNA, 20 nt, Homo sapiens
agaccauggguucucauugu

SEQ ID NO: 18591 - RNA, 22 nt, Homo sapiens
uggagugugacaaugguguuug

SEQ ID NO: 18592 - RNA, 23 nt, Homo sapiens
uacccuguagaaccgaauuugug

SEQ ID NO: 18593 - RNA, 21 nt, Homo sapiens
ccgucgccgccacccgagccg

SEQ ID NO: 18594 - RNA, 21 nt, Homo sapiens
agagaagaagaucagccugca

SEQ ID NO: 18595 - RNA, 22 nt, Homo sapiens
acucggcguggcgucggucgug

SEQ ID NO: 18596 - RNA, 22 nt, Homo sapiens
cucggcgcggggcgcgggcucc

SEQ ID NO: 18597 - RNA, 18 nt, Homo sapiens
uccagugcccuccucucc

SEQ ID NO: 18598 - RNA, 23 nt, Homo sapiens
ucaagagcaauaacgaaaaaugu

SEQ ID NO: 18599 - RNA, 22 nt, Homo sapiens
gaaagcgcuucccuuugcugga

SEQ ID NO: 18600 - RNA, 22 nt, Homo sapiens
gaaagcgcuucccuuugcugga

SEQ ID NO: 18601 - RNA, 22 nt, Homo sapiens
caaagcgcuccccuuuagaggu

SEQ ID NO: 18602 - RNA, 22 nt, Homo sapiens
caaagcgcuccccuuuagaggu

SEQ ID NO: 18603 - RNA, 23 nt, Homo sapiens
caaagcgcuucucuuuagagugu

SEQ ID NO: 18604 - RNA, 23 nt, Homo sapiens
caaagcgcuucucuuuagagugu

SEQ ID NO: 18605 - RNA, 21 nt, Homo sapiens
caaagcgcuucccuuuggagc

SEQ ID NO: 18606 - RNA, 21 nt, Homo sapiens
caaagcgcuucccuuuggagc

SEQ ID NO: 18607 - RNA, 21 nt, Homo sapiens
aaagcgcuucccuucagagug

SEQ ID NO: 18608 - RNA, 21 nt, Homo sapiens
gaaagcgcuucucuuuagagg

SEQ ID NO: 18609 - RNA, 21 nt, Homo sapiens
gaaagcgcuucucuuuagagg

SEQ ID NO: 18610 - RNA, 23 nt, Homo sapiens
cucuugagggaagcacuuucugu

SEQ ID NO: 18611 - RNA, 21 nt, Homo sapiens
uggguuuacguugggagaacu

SEQ ID NO: 18612 - RNA, 22 nt, Homo sapiens
ucagugcacuacagaacuuugu

SEQ ID NO: 18613 - RNA, 22 nt, Homo sapiens
ugauauguuugauauauuaggu

SEQ ID NO: 18614 - RNA, 22 nt, Homo sapiens
cuggcccucucugcccuuccgu

SEQ ID NO: 18615 - RNA, 20 nt, Homo sapiens
auguauaaauguauacacac

SEQ ID NO: 18616 - RNA, 25 nt, Homo sapiens
aggggugguguugggacagcuccgu

SEQ ID NO: 18617 - RNA, 22 nt, Homo sapiens
caaagugccucccuuuagagug

SEQ ID NO: 18618 - RNA, 20 nt, Homo sapiens
ggggagcuguggaagcagua

SEQ ID NO: 18619 - RNA, 22 nt, Homo sapiens
uggagugugacaaugguguuug

SEQ ID NO: 18620 - RNA, 18 nt, Homo sapiens
gucccuguucaggcgcca

SEQ ID NO: 18621 - RNA, 18 nt, Homo sapiens
cagggaggugaaugugau

SEQ ID NO: 18622 - RNA, 23 nt, Homo sapiens
ucuggcuccgugucuucacuccc

SEQ ID NO: 18623 - RNA, 23 nt, Homo sapiens
ucccuguccuccaggagcucacg

SEQ ID NO: 18624 - RNA, 23 nt, Homo sapiens
uagcagcgggaacaguucugcag

SEQ ID NO: 18625 - RNA, 21 nt, Homo sapiens
agggggaaaguucuauagucc

SEQ ID NO: 18626 - RNA, 23 nt, Homo sapiens
gcagcagagaauaggacuacguc

SEQ ID NO: 18627 - RNA, 22 nt, Homo sapiens
caaagugccucccuuuagagug

SEQ ID NO: 18628 - RNA, 22 nt, Homo sapiens
ucuucucuguuuuggccaugug

SEQ ID NO: 18629 - RNA, 22 nt, Homo sapiens
ucggccugaccacccaccccac

SEQ ID NO: 18630 - RNA, 22 nt, Homo sapiens
cgcaggggccgggugcucaccg

SEQ ID NO: 18631 - RNA, 22 nt, Homo sapiens
uagcaccaucugaaaucgguua

SEQ ID NO: 18632 - RNA, 23 nt, Homo sapiens
uagcaccauuugaaaucaguguu

SEQ ID NO: 18633 - RNA, 22 nt, Homo sapiens
uagcaccauuugaaaucgguua

SEQ ID NO: 18634 - RNA, 21 nt, Homo sapiens
gcuaguccugacucagccagu

SEQ ID NO: 18635 - RNA, 19 nt, Homo sapiens
gggcgccugugaucccaac

SEQ ID NO: 18636 - RNA, 22 nt, Homo sapiens
cuugguucagggagggucccca

SEQ ID NO: 18637 - RNA, 21 nt, Homo sapiens
ucccacguuguggcccagcag

SEQ ID NO: 18638 - RNA, 22 nt, Homo sapiens
cugcccuggcccgagggaccga

SEQ ID NO: 18639 - RNA, 24 nt, Homo sapiens
uuuggcaaugguagaacucacacu

SEQ ID NO: 18640 - RNA, 22 nt, Homo sapiens
uauugcacauuacuaaguugca

SEQ ID NO: 18641 - RNA, 22 nt, Homo sapiens
aacuguuugcagaggaaacuga

SEQ ID NO: 18642 - RNA, 24 nt, Homo sapiens
ugccugggucucuggccugcgcgu

SEQ ID NO: 18643 - RNA, 22 nt, Homo sapiens
uggaauguaaagaaguauguau

SEQ ID NO: 18644 - RNA, 18 nt, Homo sapiens
ucagcuggcccucauuuc

SEQ ID NO: 18645 - RNA, 21 nt, Homo sapiens
uggcagggaggcugggagggg

SEQ ID NO: 18646 - RNA, 24 nt, Homo sapiens
uggcccugacugaagaccagcagu

SEQ ID NO: 18647 - RNA, 20 nt, Homo sapiens
guguguggaaaugcuucugc

SEQ ID NO: 18648 - RNA, 22 nt, Homo sapiens
uccuucauuccaccggagucug

SEQ ID NO: 18649 - RNA, 22 nt, Homo sapiens
uggaauguaaggaagugugugg

SEQ ID NO: 18650 - RNA, 21 nt, Homo sapiens
ccaccaccgugucugacacuu

SEQ ID NO: 18651 - RNA, 23 nt, Homo sapiens
cacucagccuugagggcacuuuc

SEQ ID NO: 18652 - RNA, 22 nt, Homo sapiens
ugagaaccacgucugcucugag

SEQ ID NO: 18653 - RNA, 22 nt, Homo sapiens
cacacacugcaauuacuuuugc

SEQ ID NO: 18654 - RNA, 20 nt, Homo sapiens
aggaauguuccuucuuugcc

SEQ ID NO: 18655 - RNA, 18 nt, Homo sapiens
ugaggcaguagauugaau

SEQ ID NO: 18656 - RNA, 20 nt, Homo sapiens
ccuccugcccuccuugcugu

SEQ ID NO: 18657 - RNA, 22 nt, Homo sapiens
uaaucucagcuggcaacuguga

SEQ ID NO: 18658 - RNA, 23 nt, Homo sapiens
gcaaagcacacggccugcagaga

SEQ ID NO: 18659 - RNA, 21 nt, Homo sapiens
ucacuccucuccucccgucuu

SEQ ID NO: 18660 - RNA, 23 nt, Homo sapiens
aggaccugcgggacaagauucuu

SEQ ID NO: 18661 - RNA, 20 nt, Homo sapiens
accaggaggcugaggccccu

SEQ ID NO: 18662 - RNA, 21 nt, Homo sapiens
uggaggagaaggaaggugaug

SEQ ID NO: 18663 - RNA, 23 nt, Homo sapiens
gcagcagagaauaggacuacguc

SEQ ID NO: 18664 - RNA, 21 nt, Homo sapiens
uugcucacuguucuucccuag

SEQ ID NO: 18665 - RNA, 22 nt, Homo sapiens
cuccugagccauucugagccuc

SEQ ID NO: 18666 - RNA, 23 nt, Homo sapiens
ucuggcuccgugucuucacuccc

SEQ ID NO: 18667 - RNA, 23 nt, Homo sapiens
cccaguguucagacuaccuguuc

SEQ ID NO: 18668 - RNA, 23 nt, Homo sapiens
cccaguguuuagacuaucuguuc

SEQ ID NO: 18669 - RNA, 23 nt, Homo sapiens
agcuacauugucugcuggguuuc

SEQ ID NO: 18670 - RNA, 22 nt, Homo sapiens
cgucaacacuugcugguuuccu

SEQ ID NO: 18671 - RNA, 22 nt, Homo sapiens
uggugggcacagaaucuggacu

SEQ ID NO: 18672 - RNA, 19 nt, Homo sapiens
gagccaguuggacaggagc

SEQ ID NO: 18673 - RNA, 22 nt, Homo sapiens
uggugggccgcagaacaugugc

SEQ ID NO: 18674 - RNA, 23 nt, Homo sapiens
ucugcucauaccccaugguuucu

SEQ ID NO: 18675 - RNA, 22 nt, Homo sapiens
ugcaacgaaccugagccacuga

SEQ ID NO: 18676 - RNA, 22 nt, Homo sapiens
cacuggcuccuuucuggguaga

SEQ ID NO: 18677 - RNA, 21 nt, Homo sapiens
cggcggggacggcgauugguc

SEQ ID NO: 18678 - RNA, 22 nt, Homo sapiens
cauugcacuugucucggucuga

SEQ ID NO: 18679 - RNA, 23 nt, Homo sapiens
ucccccaggugugauucugauuu

SEQ ID NO: 18680 - RNA, 22 nt, Homo sapiens
uaaugccccuaaaaauccuuau

SEQ ID NO: 18681 - RNA, 22 nt, Homo sapiens
ggggguccccggugcucggauc

SEQ ID NO: 18682 - RNA, 24 nt, Homo sapiens
acugggggcuuucgggcucugcgu

SEQ ID NO: 18683 - RNA, 22 nt, Homo sapiens
aggcggggcgccgcgggaccgc

SEQ ID NO: 18684 - RNA, 22 nt, Homo sapiens
auccgcgcucugacucucugcc

SEQ ID NO: 18685 - RNA, 21 nt, Homo sapiens
cuuuuugcggucugggcuugc

SEQ ID NO: 18686 - RNA, 22 nt, Homo sapiens
uauggcacugguagaauucacu

SEQ ID NO: 18687 - RNA, 23 nt, Homo sapiens
ucaagagcaauaacgaaaaaugu

SEQ ID NO: 18688 - RNA, 22 nt, Homo sapiens
uccagcaucagugauuuuguug

SEQ ID NO: 18689 - RNA, 22 nt, Homo sapiens
caaucacuaacuccacugccau

SEQ ID NO: 18690 - RNA, 22 nt, Homo sapiens
uaaugccccuaaaaauccuuau

SEQ ID NO: 18691 - RNA, 22 nt, Homo sapiens
uuuugcaauauguuccugaaua

SEQ ID NO: 18692 - RNA, 21 nt, Homo sapiens
gugucuuuugcucugcaguca

SEQ ID NO: 18693 - RNA, 22 nt, Homo sapiens
ucagcaaacauuuauugugugc

SEQ ID NO: 18694 - RNA, 22 nt, Homo sapiens
uagcaaaaacugcaguuacuuu

SEQ ID NO: 18695 - RNA, 20 nt, Homo sapiens
agaccauggguucucauugu

SEQ ID NO: 18696 - RNA, 22 nt, Homo sapiens
aaccagcaccccaacuuuggac

SEQ ID NO: 18697 - RNA, 23 nt, Homo sapiens
ucuggcuccgugucuucacuccc

SEQ ID NO: 18698 - RNA, 22 nt, Homo sapiens
ucucccaacccuuguaccagug

SEQ ID NO: 18699 - RNA, 23 nt, Homo sapiens
cggcccgggcugcugcuguuccu

SEQ ID NO: 18700 - RNA, 21 nt, Homo sapiens
cggcggggacggcgauugguc

SEQ ID NO: 18701 - RNA, 22 nt, Homo sapiens
uguaacagcaacuccaugugga

SEQ ID NO: 18702 - RNA, 22 nt, Homo sapiens
cauugcacuugucucggucuga

SEQ ID NO: 18703 - RNA, 22 nt, Homo sapiens
uguaaacauccuacacucagcu

SEQ ID NO: 18704 - RNA, 23 nt, Homo sapiens
ugaggggcagagagcgagacuuu

SEQ ID NO: 18705 - RNA, 22 nt, Homo sapiens
ugcggggcuagggcuaacagca

SEQ ID NO: 18706 - RNA, 21 nt, Homo sapiens
ccccaccuccucucuccucag

SEQ ID NO: 18707 - RNA, 22 nt, Homo sapiens
ugagccccugugccgcccccag

SEQ ID NO: 18708 - RNA, 23 nt, Homo sapiens
cucucaccacugcccucccacag

SEQ ID NO: 18709 - RNA, 22 nt, Homo sapiens
uggaauguaaggaagugugugg

SEQ ID NO: 18710 - RNA, 22 nt, Homo sapiens
uuagggcccuggcuccaucucc

SEQ ID NO: 18711 - RNA, 23 nt, Homo sapiens
cggcccgggcugcugcuguuccu

SEQ ID NO: 18712 - RNA, 22 nt, Homo sapiens
uggagagaaaggcaguuccuga

SEQ ID NO: 18713 - RNA, 22 nt, Homo sapiens
uggagagaaaggcaguuccuga

SEQ ID NO: 18714 - RNA, 21 nt, Homo sapiens
agggcccccccucaauccugu

SEQ ID NO: 18715 - RNA, 23 nt, Homo sapiens
agguuacccgagcaacuuugcau

SEQ ID NO: 18716 - RNA, 22 nt, Homo sapiens
uccgagccugggucucccucuu

SEQ ID NO: 18717 - RNA, 23 nt, Homo sapiens
uauucauuuauccccagccuaca

SEQ ID NO: 18718 - RNA, 21 nt, Homo sapiens
cgcgggugcuuacugacccuu

SEQ ID NO: 18719 - RNA, 20 nt, Homo sapiens
ggggagcuguggaagcagua

SEQ ID NO: 18720 - RNA, 23 nt, Homo sapiens
cacccggcugugugcacaugugc

SEQ ID NO: 18721 - RNA, 22 nt, Homo sapiens
uuuccggcucgcgugggugugu

SEQ ID NO: 18722 - RNA, 24 nt, Homo sapiens
agccugauuaaacacaugcucuga

SEQ ID NO: 18723 - RNA, 22 nt, Homo sapiens
ucggccugaccacccaccccac

SEQ ID NO: 18724 - RNA, 18 nt, Homo sapiens
cagggaggugaaugugau

SEQ ID NO: 18725 - RNA, 21 nt, Homo sapiens
cggcggggacggcgauugguc

SEQ ID NO: 18726 - RNA, 22 nt, Homo sapiens
uacgucaucguugucaucguca

SEQ ID NO: 18727 - RNA, 22 nt, Homo sapiens
aggcggggcgccgcgggaccgc

SEQ ID NO: 18728 - RNA, 22 nt, Homo sapiens
ugcggggcuagggcuaacagca

SEQ ID NO: 18729 - RNA, 22 nt, Homo sapiens
acuccagccccacagccucagc

SEQ ID NO: 18730 - RNA, 17 nt, Homo sapiens
ucccaccgcugccaccc

SEQ ID NO: 18731 - RNA, 22 nt, Homo sapiens
uaacacugucugguaaagaugg

SEQ ID NO: 18732 - RNA, 21 nt, Homo sapiens
ucgaggagcucacagucuagu

SEQ ID NO: 18733 - RNA, 23 nt, Homo sapiens
cggcccgggcugcugcuguuccu

SEQ ID NO: 18734 - RNA, 22 nt, Homo sapiens
uaacacugucugguaacgaugu

SEQ ID NO: 18735 - RNA, 21 nt, Homo sapiens
ccaccaccgugucugacacuu

SEQ ID NO: 18736 - RNA, 22 nt, Homo sapiens
uggcucaguucagcaggaacag

SEQ ID NO: 18737 - RNA, 21 nt, Homo sapiens
aggggugcuaucugugauuga

SEQ ID NO: 18738 - RNA, 23 nt, Homo sapiens
uggugcggagagggcccacagug

SEQ ID NO: 18739 - RNA, 20 nt, Homo sapiens
ggggagcuguggaagcagua

SEQ ID NO: 18740 - RNA, 22 nt, Homo sapiens
ugagguaguaguuugugcuguu

SEQ ID NO: 18741 - RNA, 18 nt, Homo sapiens
cagggaggugaaugugau

SEQ ID NO: 18742 - RNA, 22 nt, Homo sapiens
aaaagcuggguugagagggcga

SEQ ID NO: 18743 - RNA, 22 nt, Homo sapiens
aaaagcuggguugagagggcaa

SEQ ID NO: 18744 - RNA, 20 nt, Homo sapiens
aaaagcuggguugagagggu

SEQ ID NO: 18745 - RNA, 19 nt, Homo sapiens
aaaagcuggguugagagga

SEQ ID NO: 18746 - RNA, 19 nt, Homo sapiens
aggcugcggaauucaggac

SEQ ID NO: 18747 - RNA, 22 nt, Homo sapiens
ggggguccccggugcucggauc

SEQ ID NO: 18748 - RNA, 19 nt, Homo sapiens
aguguggcuuucuuagagc

SEQ ID NO: 18749 - RNA, 21 nt, Homo sapiens
guggcugcacucacuuccuuc

SEQ ID NO: 18750 - RNA, 21 nt, Homo sapiens
aggaggcagcgcucucaggac

SEQ ID NO: 18751 - RNA, 22 nt, Homo sapiens
ugcggggcuagggcuaacagca

SEQ ID NO: 18752 - RNA, 23 nt, Homo sapiens
cacccggcugugugcacaugugc

SEQ ID NO: 18753 - RNA, 22 nt, Homo sapiens
uucuggaauucugugugaggga

SEQ ID NO: 18754 - RNA, 22 nt, Homo sapiens
aagcccuuaccccaaaaagcau

SEQ ID NO: 18755 - RNA, 23 nt, Homo sapiens
cggcccgggcugcugcuguuccu

SEQ ID NO: 18756 - RNA, 21 nt, Homo sapiens
cggcggggacggcgauugguc

SEQ ID NO: 18757 - RNA, 23 nt, Homo sapiens
acuugggcacugaaacaaugucc

SEQ ID NO: 18758 - RNA, 22 nt, Homo sapiens
aggcggggcgccgcgggaccgc

SEQ ID NO: 18759 - RNA, 23 nt, Homo sapiens
aggaagcccuggaggggcuggag

SEQ ID NO: 18760 - RNA, 22 nt, Homo sapiens
ugcggggcuagggcuaacagca

SEQ ID NO: 18761 - RNA, 22 nt, Homo sapiens
acuccagccccacagccucagc

SEQ ID NO: 18762 - RNA, 20 nt, Homo sapiens
guagaggagauggcgcaggg

SEQ ID NO: 18763 - RNA, 20 nt, Homo sapiens
agagucuugugaugucuugc

SEQ ID NO: 18764 - RNA, 22 nt, Homo sapiens
auccgcgcucugacucucugcc

SEQ ID NO: 18765 - RNA, 22 nt, Homo sapiens
ugagaacugaauuccauggguu

SEQ ID NO: 18766 - RNA, 23 nt, Homo sapiens
ucuggcuccgugucuucacuccc

SEQ ID NO: 18767 - RNA, 23 nt, Homo sapiens
uaaggugcaucuagugcagauag

SEQ ID NO: 18768 - RNA, 22 nt, Homo sapiens
cgcaggggccgggugcucaccg

SEQ ID NO: 18769 - RNA, 20 nt, Homo sapiens
agagguauagggcaugggaa

SEQ ID NO: 18770 - RNA, 22 nt, Homo sapiens
uauaccucaguuuuaucaggug

SEQ ID NO: 18771 - RNA, 20 nt, Homo sapiens
ggggagcuguggaagcagua

SEQ ID NO: 18772 - RNA, 18 nt, Homo sapiens
ucagcuggcccucauuuc

SEQ ID NO: 18773 - RNA, 21 nt, Homo sapiens
uccuucugcuccgucccccag

SEQ ID NO: 18774 - RNA, 23 nt, Homo sapiens
ucuggcuccgugucuucacuccc

SEQ ID NO: 18775 - RNA, 23 nt, Homo sapiens
ucuggcuccgugucuucacuccc

SEQ ID NO: 18776 - RNA, 22 nt, Homo sapiens
cauugcacuugucucggucuga

SEQ ID NO: 18777 - RNA, 22 nt, Homo sapiens
cgucaacacuugcugguuuccu

SEQ ID NO: 18778 - RNA, 22 nt, Homo sapiens
uacucaggagaguggcaaucac

SEQ ID NO: 18779 - RNA, 21 nt, Homo sapiens
ugaguuggccaucugagugag

SEQ ID NO: 18780 - RNA, 21 nt, Homo sapiens
uggaggagaaggaaggugaug

SEQ ID NO: 18781 - RNA, 22 nt, Homo sapiens
acuccagccccacagccucagc

SEQ ID NO: 18782 - RNA, 23 nt, Homo sapiens
ucaaaugcucagacuccuguggu

SEQ ID NO: 18783 - RNA, 22 nt, Homo sapiens
ccucuuccccuugucucuccag

SEQ ID NO: 18784 - RNA, 22 nt, Homo sapiens
uucccuuugucauccuaugccu

SEQ ID NO: 18785 - RNA, 22 nt, Homo sapiens
uucccuuugucauccuucgccu

SEQ ID NO: 18786 - RNA, 22 nt, Homo sapiens
uaugcauuguauuuuuaggucc

SEQ ID NO: 18787 - RNA, 22 nt, Homo sapiens
gucccucuccaaaugugucuug

SEQ ID NO: 18788 - RNA, 21 nt, Homo sapiens
guggcugcacucacuuccuuc

SEQ ID NO: 18789 - RNA, 22 nt, Homo sapiens
uuagggcccuggcuccaucucc

SEQ ID NO: 18790 - RNA, 18 nt, Homo sapiens
ugaggcaguagauugaau

SEQ ID NO: 18791 - RNA, 23 nt, Homo sapiens
uaaggugcaucuagugcaguuag

SEQ ID NO: 18792 - RNA, 21 nt, Homo sapiens
ccaguccugugccugccgccu

SEQ ID NO: 18793 - RNA, 22 nt, Homo sapiens
ucugcccccuccgcugcugcca

SEQ ID NO: 18794 - RNA, 20 nt, Homo sapiens
ccccagggcgacgcggcggg

SEQ ID NO: 18795 - RNA, 22 nt, Homo sapiens
gauuagggugcuuagcuguuaa

SEQ ID NO: 18796 - RNA, 22 nt, Homo sapiens
gauuagggugcuuagcuguuaa

SEQ ID NO: 18797 - RNA, 20 nt, Homo sapiens
acugccccaggugcugcugg

SEQ ID NO: 18798 - RNA, 22 nt, Homo sapiens
cuggcccucucugcccuuccgu

SEQ ID NO: 18799 - RNA, 21 nt, Homo sapiens
cggggcagcucaguacaggau

SEQ ID NO: 18800 - RNA, 19 nt, Homo sapiens
ucuaggcugguacugcuga

SEQ ID NO: 18801 - RNA, 20 nt, Homo sapiens
cggcucugggucugugggga

SEQ ID NO: 18802 - RNA, 21 nt, Homo sapiens
aaggcagggcccccgcucccc

SEQ ID NO: 18803 - RNA, 21 nt, Homo sapiens
uggcagggaggcugggagggg

SEQ ID NO: 18804 - RNA, 27 nt, Homo sapiens
accuucuuguauaagcacugugcuaaa

SEQ ID NO: 18805 - RNA, 17 nt, Homo sapiens
ucgccuccuccucuccc

SEQ ID NO: 18806 - RNA, 18 nt, Homo sapiens
uugagaaggaggcugcug

SEQ ID NO: 18807 - RNA, 18 nt, Homo sapiens
cagggaggugaaugugau

SEQ ID NO: 18808 - RNA, 23 nt, Homo sapiens
ucuggcuccgugucuucacuccc

SEQ ID NO: 18809 - RNA, 22 nt, Homo sapiens
ucugcccccuccgcugcugcca

SEQ ID NO: 18810 - RNA, 20 nt, Homo sapiens
acugccccaggugcugcugg

SEQ ID NO: 18811 - RNA, 22 nt, Homo sapiens
uaaugccccuaaaaauccuuau

SEQ ID NO: 18812 - RNA, 23 nt, Homo sapiens
ugaggggcagagagcgagacuuu

SEQ ID NO: 18813 - RNA, 21 nt, Homo sapiens
cggggcagcucaguacaggau

SEQ ID NO: 18814 - RNA, 20 nt, Homo sapiens
accaggaggcugaggccccu

SEQ ID NO: 18815 - RNA, 21 nt, Homo sapiens
uggcagggaggcugggagggg

SEQ ID NO: 18816 - RNA, 22 nt, Homo sapiens
acucggcguggcgucggucgug

SEQ ID NO: 18817 - RNA, 22 nt, Homo sapiens
cucggcgcggggcgcgggcucc

SEQ ID NO: 18818 - RNA, 21 nt, Homo sapiens
cggcggggacggcgauugguc

SEQ ID NO: 18819 - RNA, 21 nt, Homo sapiens
cggcggggacggcgauugguc

SEQ ID NO: 18820 - RNA, 22 nt, Homo sapiens
aggcggggcgccgcgggaccgc

SEQ ID NO: 18821 - RNA, 22 nt, Homo sapiens
aggcggggcgccgcgggaccgc

SEQ ID NO: 18822 - RNA, 22 nt, Homo sapiens
ugcggggcuagggcuaacagca

SEQ ID NO: 18823 - RNA, 22 nt, Homo sapiens
ugcggggcuagggcuaacagca

SEQ ID NO: 18824 - RNA, 21 nt, Homo sapiens
uggaggagaaggaaggugaug

SEQ ID NO: 18825 - RNA, 21 nt, Homo sapiens
gugccagcugcagugggggag

SEQ ID NO: 18826 - RNA, 18 nt, Homo sapiens
cagggaggugaaugugau

SEQ ID NO: 18827 - RNA, 23 nt, Homo sapiens
ucuggcuccgugucuucacuccc

SEQ ID NO: 18828 - RNA, 21 nt, Homo sapiens
cggcggggacggcgauugguc

SEQ ID NO: 18829 - RNA, 23 nt, Homo sapiens
caacggaaucccaaaagcagcug

SEQ ID NO: 18830 - RNA, 22 nt, Homo sapiens
uguaacagcaacuccaugugga

SEQ ID NO: 18831 - RNA, 22 nt, Homo sapiens
cucccacugcuucacuugacua

SEQ ID NO: 18832 - RNA, 23 nt, Homo sapiens
uacugcaucaggaacugauugga

SEQ ID NO: 18833 - RNA, 22 nt, Homo sapiens
aagcugccaguugaagaacugu

SEQ ID NO: 18834 - RNA, 22 nt, Homo sapiens
uguaaacauccuacacucagcu

SEQ ID NO: 18835 - RNA, 22 nt, Homo sapiens
uccagcaucagugauuuuguug

SEQ ID NO: 18836 - RNA, 22 nt, Homo sapiens
uggcagugucuuagcugguugu

SEQ ID NO: 18837 - RNA, 23 nt, Homo sapiens
aggcaguguaguuagcugauugc

SEQ ID NO: 18838 - RNA, 22 nt, Homo sapiens
uggcaguguauuguuagcuggu

SEQ ID NO: 18839 - RNA, 22 nt, Homo sapiens
aggcaguguauuguuagcuggc

SEQ ID NO: 18840 - RNA, 22 nt, Homo sapiens
ccucccacacccaaggcuugca

SEQ ID NO: 18841 - RNA, 19 nt, Homo sapiens
ugagcugcuguaccaaaau

SEQ ID NO: 18842 - RNA, 25 nt, Homo sapiens
aggggugguguugggacagcuccgu

SEQ ID NO: 18843 - RNA, 21 nt, Homo sapiens
acagucugcugagguuggagc

SEQ ID NO: 18844 - RNA, 22 nt, Homo sapiens
aggcggggcgccgcgggaccgc

SEQ ID NO: 18845 - RNA, 22 nt, Homo sapiens
aggcagcgggguguaguggaua

SEQ ID NO: 18846 - RNA, 20 nt, Homo sapiens
ggggagcuguggaagcagua

SEQ ID NO: 18847 - RNA, 22 nt, Homo sapiens
ugagccccugugccgcccccag

SEQ ID NO: 18848 - RNA, 22 nt, Homo sapiens
acccgucccguucguccccgga

SEQ ID NO: 18849 - RNA, 25 nt, Homo sapiens
ugggaacggguuccggcagacgcug

SEQ ID NO: 18850 - RNA, 22 nt, Homo sapiens
cucuagagggaagcacuuucug

SEQ ID NO: 18851 - RNA, 25 nt, Homo sapiens
cccccacaaccgcgcuugacuagcu

SEQ ID NO: 18852 - RNA, 22 nt, Homo sapiens
uaugugggaugguaaaccgcuu

SEQ ID NO: 18853 - RNA, 22 nt, Homo sapiens
aucuggagguaagaagcacuuu

SEQ ID NO: 18854 - RNA, 23 nt, Homo sapiens
cucuugagggaagcacuuucugu

SEQ ID NO: 18855 - RNA, 21 nt, Homo sapiens
agggggaaaguucuauagucc

SEQ ID NO: 18856 - RNA, 21 nt, Homo sapiens
gaaggcgcuucccuuuggagu

SEQ ID NO: 18857 - RNA, 21 nt, Homo sapiens
cugaccuaugaauugacagcc

SEQ ID NO: 18858 - RNA, 22 nt, Homo sapiens
uguaacagcaacuccaugugga

SEQ ID NO: 18859 - RNA, 21 nt, Homo sapiens
aauauaacacagauggccugu

SEQ ID NO: 18860 - RNA, 22 nt, Homo sapiens
gugacaucacauauacggcagc

SEQ ID NO: 18861 - RNA, 20 nt, Homo sapiens
auguauaaauguauacacac

SEQ ID NO: 18862 - RNA, 23 nt, Homo sapiens
uucauuugguauaaaccgcgauu

SEQ ID NO: 18863 - RNA, 21 nt, Homo sapiens
uaauuuuauguauaagcuagu

SEQ ID NO: 18864 - RNA, 23 nt, Homo sapiens
caguaacaaagauucauccuugu

SEQ ID NO: 18865 - RNA, 21 nt, Homo sapiens
ugcaggaccaagaugagcccu

SEQ ID NO: 18866 - RNA, 22 nt, Homo sapiens
uggacggagaacugauaagggu

SEQ ID NO: 18867 - RNA, 22 nt, Homo sapiens
uggagagaaaggcaguuccuga

SEQ ID NO: 18868 - RNA, 22 nt, Homo sapiens
ugggucuuugcgggcgagauga

SEQ ID NO: 18869 - RNA, 22 nt, Homo sapiens
aaaagcuggguugagagggcga

SEQ ID NO: 18870 - RNA, 22 nt, Homo sapiens
aaaagcuggguugagagggcaa

SEQ ID NO: 18871 - RNA, 20 nt, Homo sapiens
aaaagcuggguugagagggu

SEQ ID NO: 18872 - RNA, 19 nt, Homo sapiens
aaaagcuggguugagagga

SEQ ID NO: 18873 - RNA, 23 nt, Homo sapiens
ucccccaggugugauucugauuu

SEQ ID NO: 18874 - RNA, 22 nt, Homo sapiens
aaaaguacuugcggauuuugcu

SEQ ID NO: 18875 - RNA, 24 nt, Homo sapiens
acugggggcuuucgggcucugcgu

SEQ ID NO: 18876 - RNA, 22 nt, Homo sapiens
gucccucuccaaaugugucuug

SEQ ID NO: 18877 - RNA, 20 nt, Homo sapiens
accaggaggcugaggccccu

SEQ ID NO: 18878 - RNA, 23 nt, Homo sapiens
ugaguaccgccaugucuguuggg

SEQ ID NO: 18879 - RNA, 21 nt, Homo sapiens
ccacaccguaucugacacuuu

SEQ ID NO: 18880 - RNA, 23 nt, Homo sapiens
aucaacagacauuaauugggcgc

SEQ ID NO: 18881 - RNA, 22 nt, Homo sapiens
aacuguuugcagaggaaacuga

SEQ ID NO: 18882 - RNA, 23 nt, Homo sapiens
uaaauuucaccuuucugagaagg

SEQ ID NO: 18883 - RNA, 19 nt, Homo sapiens
ugucucugcugggguuucu

SEQ ID NO: 18884 - RNA, 21 nt, Homo sapiens
uggcagggaggcugggagggg

SEQ ID NO: 18885 - RNA, 18 nt, Homo sapiens
cagggaggugaaugugau

SEQ ID NO: 18886 - RNA, 21 nt, Homo sapiens
ucgaggagcucacagucuagu

SEQ ID NO: 18887 - RNA, 22 nt, Homo sapiens
uagcagcacauaaugguuugug

SEQ ID NO: 18888 - RNA, 22 nt, Homo sapiens
uagcagcacaucaugguuuaca

SEQ ID NO: 18889 - RNA, 22 nt, Homo sapiens
uagcagcacguaaauauuggcg

SEQ ID NO: 18890 - RNA, 21 nt, Homo sapiens
uagcagcacagaaauauuggc

SEQ ID NO: 18891 - RNA, 22 nt, Homo sapiens
uagcuuaucagacugauguuga

SEQ ID NO: 18892 - RNA, 22 nt, Homo sapiens
cuggcccucucugcccuuccgu

SEQ ID NO: 18893 - RNA, 22 nt, Homo sapiens
cagcagcaauucauguuuugaa

SEQ ID NO: 18894 - RNA, 21 nt, Homo sapiens
cagcagcacacugugguuugu

SEQ ID NO: 18895 - RNA, 18 nt, Homo sapiens
ugcuuccuuucagagggu

SEQ ID NO: 18896 - RNA, 22 nt, Homo sapiens
aucuggagguaagaagcacuuu

SEQ ID NO: 18897 - RNA, 21 nt, Homo sapiens
uggguuuacguugggagaacu

SEQ ID NO: 18898 - RNA, 21 nt, Homo sapiens
uggaggagaaggaaggugaug

SEQ ID NO: 18899 - RNA, 23 nt, Homo sapiens
uccaguaccacgugucagggcca

SEQ ID NO: 18900 - RNA, 21 nt, Homo sapiens
aaggcagggcccccgcucccc

SEQ ID NO: 18901 - RNA, 22 nt, Homo sapiens
aacuggaucaauuauaggagug

SEQ ID NO: 18902 - RNA, 18 nt, Homo sapiens
gucccuguucaggcgcca

SEQ ID NO: 18903 - RNA, 18 nt, Homo sapiens
cagggaggugaaugugau

SEQ ID NO: 18904 - RNA, 22 nt, Homo sapiens
gguccagaggggagauagguuc

SEQ ID NO: 18905 - RNA, 22 nt, Homo sapiens
uggcagugucuuagcugguugu

SEQ ID NO: 18906 - RNA, 22 nt, Homo sapiens
gaugagcucauuguaauaugag

SEQ ID NO: 18907 - RNA, 22 nt, Homo sapiens
cacacacugcaauuacuuuugc

SEQ ID NO: 18908 - RNA, 21 nt, Homo sapiens
aggaggcagcgcucucaggac

SEQ ID NO: 18909 - RNA, 23 nt, Homo sapiens
uccaguaccacgugucagggcca

SEQ ID NO: 18910 - RNA, 20 nt, Homo sapiens
guagaggagauggcgcaggg

SEQ ID NO: 18911 - RNA, 19 nt, Homo sapiens
gugaggacucgggaggugg

SEQ ID NO: 18912 - RNA, 25 nt, Homo sapiens
ugggaacggguuccggcagacgcug

SEQ ID NO: 18913 - RNA, 23 nt, Homo sapiens
ucuggcuccgugucuucacuccc

SEQ ID NO: 18914 - RNA, 22 nt, Homo sapiens
caaagaauucuccuuuugggcu

SEQ ID NO: 18915 - RNA, 25 nt, Homo sapiens
cccccacaaccgcgcuugacuagcu

SEQ ID NO: 18916 - RNA, 22 nt, Homo sapiens
uuggggaaacggccgcugagug

SEQ ID NO: 18917 - RNA, 23 nt, Homo sapiens
ugagcgccucgacgacagagccg

SEQ ID NO: 18918 - RNA, 25 nt, Homo sapiens
aggggugguguugggacagcuccgu

SEQ ID NO: 18919 - RNA, 20 nt, Homo sapiens
ggggagcuguggaagcagua

SEQ ID NO: 18920 - RNA, 23 nt, Homo sapiens
uacccuguagauccgaauuugug

SEQ ID NO: 18921 - RNA, 23 nt, Homo sapiens
uacccuguagaaccgaauuugug

SEQ ID NO: 18922 - RNA, 22 nt, Homo sapiens
ggagacgcggcccuguuggagu

SEQ ID NO: 18923 - RNA, 22 nt, Homo sapiens
acacagggcuguugugaagacu

SEQ ID NO: 18924 - RNA, 23 nt, Homo sapiens
ucccccaggugugauucugauuu

SEQ ID NO: 18925 - RNA, 21 nt, Homo sapiens
agggggaaaguucuauagucc

SEQ ID NO: 18926 - RNA, 24 nt, Homo sapiens
acugggggcuuucgggcucugcgu

SEQ ID NO: 18927 - RNA, 20 nt, Homo sapiens
accaggaggcugaggccccu

SEQ ID NO: 18928 - RNA, 21 nt, Homo sapiens
ccuggaaacacugagguugug

SEQ ID NO: 18929 - RNA, 20 nt, Homo sapiens
ggggagcuguggaagcagua

SEQ ID NO: 18930 - RNA, 22 nt, Homo sapiens
ccucuuccccuugucucuccag

SEQ ID NO: 18931 - RNA, 22 nt, Homo sapiens
cauugcacuugucucggucuga

SEQ ID NO: 18932 - RNA, 18 nt, Homo sapiens
ugcuuccuuucagagggu

SEQ ID NO: 18933 - RNA, 22 nt, Homo sapiens
aucuggagguaagaagcacuuu

SEQ ID NO: 18934 - RNA, 23 nt, Homo sapiens
gcgaggaccccucggggucugac

SEQ ID NO: 18935 - RNA, 22 nt, Homo sapiens
agacuucccauuugaagguggc

SEQ ID NO: 18936 - RNA, 20 nt, Homo sapiens
guagaggagauggcgcaggg

SEQ ID NO: 18937 - RNA, 20 nt, Homo sapiens
agagucuugugaugucuugc

SEQ ID NO: 18938 - RNA, 17 nt, Homo sapiens
ucgccuccuccucuccc

SEQ ID NO: 18939 - RNA, 18 nt, Homo sapiens
cagggaggugaaugugau

SEQ ID NO: 18940 - RNA, 23 nt, Homo sapiens
cggcccgggcugcugcuguuccu

SEQ ID NO: 18941 - RNA, 23 nt, Homo sapiens
cggcccgggcugcugcuguuccu

SEQ ID NO: 18942 - RNA, 21 nt, Homo sapiens
cggcggggacggcgauugguc

SEQ ID NO: 18943 - RNA, 21 nt, Homo sapiens
agggcccccccucaauccugu

SEQ ID NO: 18944 - RNA, 23 nt, Homo sapiens
ucccccaggugugauucugauuu

SEQ ID NO: 18945 - RNA, 23 nt, Homo sapiens
ugaggggcagagagcgagacuuu

SEQ ID NO: 18946 - RNA, 22 nt, Homo sapiens
cgucaacacuugcugguuuccu

SEQ ID NO: 18947 - RNA, 22 nt, Homo sapiens
ugagaaccacgucugcucugag

SEQ ID NO: 18948 - RNA, 24 nt, Homo sapiens
acugggggcuuucgggcucugcgu

SEQ ID NO: 18949 - RNA, 23 nt, Homo sapiens
ggcagguucucacccucucuagg

SEQ ID NO: 18950 - RNA, 22 nt, Homo sapiens
ugcggggcuagggcuaacagca

SEQ ID NO: 18951 - RNA, 23 nt, Homo sapiens
aaaagugcuuacagugcagguag

SEQ ID NO: 18952 - RNA, 26 nt, Homo sapiens
aaguaguugguuuguaugagaugguu

SEQ ID NO: 18953 - RNA, 25 nt, Homo sapiens
gggcgacaaagcaagacucuuucuu

SEQ ID NO: 18954 - RNA, 22 nt, Homo sapiens
uagguuauccguguugccuucg

SEQ ID NO: 18955 - RNA, 22 nt, Homo sapiens
cucccacugcuucacuugacua

SEQ ID NO: 18956 - RNA, 22 nt, Homo sapiens
acaguagucugcacauugguua

SEQ ID NO: 18957 - RNA, 22 nt, Homo sapiens
acaguagucugcacauugguua

SEQ ID NO: 18958 - RNA, 21 nt, Homo sapiens
agcuacaucuggcuacugggu

SEQ ID NO: 18959 - RNA, 22 nt, Homo sapiens
agaucagaaggugauuguggcu

SEQ ID NO: 18960 - RNA, 22 nt, Homo sapiens
gucauacacggcucuccucucu

SEQ ID NO: 18961 - RNA, 22 nt, Homo sapiens
aaucauacagggacauccaguu

SEQ ID NO: 18962 - RNA, 21 nt, Homo sapiens
aaacuacugaaaaucaaagau

SEQ ID NO: 18963 - RNA, 27 nt, Homo sapiens
accuucuuguauaagcacugugcuaaa

SEQ ID NO: 18964 - RNA, 23 nt, Homo sapiens
ucuggcuccgugucuucacuccc

SEQ ID NO: 18965 - RNA, 22 nt, Homo sapiens
uggagagaaaggcaguuccuga

SEQ ID NO: 18966 - RNA, 23 nt, Homo sapiens
cccaguguucagacuaccuguuc

SEQ ID NO: 18967 - RNA, 23 nt, Homo sapiens
cccaguguuuagacuaucuguuc

SEQ ID NO: 18968 - RNA, 21 nt, Homo sapiens
uaaagugcugacagugcagau

SEQ ID NO: 18969 - RNA, 23 nt, Homo sapiens
cagugcaaugauauugucaaagc

SEQ ID NO: 18970 - RNA, 23 nt, Homo sapiens
ucucacacagaaaucgcacccgu

SEQ ID NO: 18971 - RNA, 22 nt, Homo sapiens
ggagaaauuauccuuggugugu

SEQ ID NO: 18972 - RNA, 22 nt, Homo sapiens
gucccucuccaaaugugucuug

SEQ ID NO: 18973 - RNA, 20 nt, Homo sapiens
guagaggagauggcgcaggg

SEQ ID NO: 18974 - RNA, 22 nt, Homo sapiens
ucuucucuguuuuggccaugug

SEQ ID NO: 18975 - RNA, 21 nt, Homo sapiens
acucuagcugccaaaggcgcu

SEQ ID NO: 18976 - RNA, 23 nt, Homo sapiens
aggaugagcaaagaaaguagauu

SEQ ID NO: 18977 - RNA, 22 nt, Homo sapiens
cggaugagcaaagaaagugguu

SEQ ID NO: 18978 - RNA, 22 nt, Homo sapiens
ucaaaacugaggggcauuuucu

SEQ ID NO: 18979 - RNA, 23 nt, Homo sapiens
caacggaaucccaaaagcagcug

SEQ ID NO: 18980 - RNA, 22 nt, Homo sapiens
aagcugccaguugaagaacugu

SEQ ID NO: 18981 - RNA, 21 nt, Homo sapiens
gugcauuguaguugcauugca

SEQ ID NO: 18982 - RNA, 22 nt, Homo sapiens
ugaaacauacacgggaaaccuc

SEQ ID NO: 18983 - RNA, 22 nt, Homo sapiens
ccaaaacugcaguuacuuuugc

SEQ ID NO: 18984 - RNA, 21 nt, Homo sapiens
cuucuugugcucuaggauugu

SEQ ID NO: 18985 - RNA, 24 nt, Homo sapiens
ugccugggucucuggccugcgcgu

SEQ ID NO: 18986 - RNA, 23 nt, Homo sapiens
aggaagcccuggaggggcuggag

SEQ ID NO: 18987 - RNA, 22 nt, Homo sapiens
uucaacggguauuuauugagca

SEQ ID NO: 18988 - RNA, 23 nt, Homo sapiens
agcagcauuguacagggcuauga

SEQ ID NO: 18989 - RNA, 23 nt, Homo sapiens
agcagcauuguacagggcuauca

SEQ ID NO: 18990 - RNA, 21 nt, Homo sapiens
ccccaccuccucucuccucag

SEQ ID NO: 18991 - RNA, 17 nt, Homo sapiens
ucgccuccuccucuccc

SEQ ID NO: 18992 - RNA, 22 nt, Homo sapiens
cauugcacuugucucggucuga

SEQ ID NO: 18993 - RNA, 23 nt, Homo sapiens
uaagugcuuccauguuuuaguag

SEQ ID NO: 18994 - RNA, 23 nt, Homo sapiens
uaagugcuuccauguuugagugu

SEQ ID NO: 18995 - RNA, 22 nt, Homo sapiens
uguaaacauccuacacucagcu

SEQ ID NO: 18996 - RNA, 22 nt, Homo sapiens
gaaagcgcuucccuuugcugga

SEQ ID NO: 18997 - RNA, 22 nt, Homo sapiens
caaagcgcuccccuuuagaggu

SEQ ID NO: 18998 - RNA, 23 nt, Homo sapiens
caaagcgcuucucuuuagagugu

SEQ ID NO: 18999 - RNA, 21 nt, Homo sapiens
caaagcgcuucccuuuggagc

SEQ ID NO: 19000 - RNA, 21 nt, Homo sapiens
aaagcgcuucccuucagagug

SEQ ID NO: 19001 - RNA, 21 nt, Homo sapiens
gaaagcgcuucucuuuagagg

SEQ ID NO: 19002 - RNA, 22 nt, Homo sapiens
gugagucucuaagaaaagagga

SEQ ID NO: 19003 - RNA, 22 nt, Homo sapiens
ucuucucuguuuuggccaugug

SEQ ID NO: 19004 - RNA, 24 nt, Homo sapiens
uggcccugacugaagaccagcagu

SEQ ID NO: 19005 - RNA, 22 nt, Homo sapiens
acucggcguggcgucggucgug

SEQ ID NO: 19006 - RNA, 17 nt, Homo sapiens
ucccuguucgggcgcca

SEQ ID NO: 19007 - RNA, 22 nt, Homo sapiens
aagcugccaguugaagaacugu

SEQ ID NO: 19008 - RNA, 21 nt, Homo sapiens
gugcauuguaguugcauugca

SEQ ID NO: 19009 - RNA, 22 nt, Homo sapiens
agacccuggucugcacucuauc

SEQ ID NO: 19010 - RNA, 22 nt, Homo sapiens
uugugucaauaugcgaugaugu

SEQ ID NO: 19011 - RNA, 22 nt, Homo sapiens
ugugucacucgaugaccacugu

SEQ ID NO: 19012 - RNA, 17 nt, Homo sapiens
ucgccuccuccucuccc

SEQ ID NO: 19013 - RNA, 21 nt, Homo sapiens
gcccuccgcccgugcaccccg

SEQ ID NO: 19014 - RNA, 23 nt, Homo sapiens
cggcccgggcugcugcuguuccu

SEQ ID NO: 19015 - RNA, 21 nt, Homo sapiens
cggcggggacggcgauugguc

SEQ ID NO: 19016 - RNA, 22 nt, Homo sapiens
cauugcacuugucucggucuga

SEQ ID NO: 19017 - RNA, 23 nt, Homo sapiens
ugagcgccucgacgacagagccg

SEQ ID NO: 19018 - RNA, 25 nt, Homo sapiens
ggcggagggaaguagguccguuggu

SEQ ID NO: 19019 - RNA, 22 nt, Homo sapiens
aggcggggcgccgcgggaccgc

SEQ ID NO: 19020 - RNA, 18 nt, Homo sapiens
cagggaggugaaugugau

SEQ ID NO: 19021 - RNA, 22 nt, Homo sapiens
ugagaacugaauuccauggguu

SEQ ID NO: 19022 - RNA, 23 nt, Homo sapiens
ucuggcuccgugucuucacuccc

SEQ ID NO: 19023 - RNA, 22 nt, Homo sapiens
uucccuuugucauccuaugccu

SEQ ID NO: 19024 - RNA, 22 nt, Homo sapiens
uucccuuugucauccuucgccu

SEQ ID NO: 19025 - RNA, 22 nt, Homo sapiens
aaaucucugcaggcaaauguga

SEQ ID NO: 19026 - RNA, 23 nt, Homo sapiens
agcuacauugucugcuggguuuc

SEQ ID NO: 19027 - RNA, 21 nt, Homo sapiens
uucacaguggcuaaguucugc

SEQ ID NO: 19028 - RNA, 23 nt, Homo sapiens
uacuccagagggcgucacucaug

SEQ ID NO: 19029 - RNA, 21 nt, Homo sapiens
uggguuuacguugggagaacu

SEQ ID NO: 19030 - RNA, 21 nt, Homo sapiens
uggguuuacguugggagaacu

SEQ ID NO: 19031 - RNA, 21 nt, Homo sapiens
uggaggagaaggaaggugaug

SEQ ID NO: 19032 - RNA, 22 nt, Homo sapiens
aacccguagauccgaacuugug

SEQ ID NO: 19033 - RNA, 21 nt, Homo sapiens
uggcagggaggcugggagggg

SEQ ID NO: 19034 - RNA, 21 nt, Homo sapiens
cuccguuugccuguuucgcug

SEQ ID NO: 19035 - RNA, 22 nt, Homo sapiens
cucggcgcggggcgcgggcucc

SEQ ID NO: 19036 - RNA, 21 nt, Homo sapiens
uccugcgcgucccagaugccc

SEQ ID NO: 19037 - RNA, 18 nt, Homo sapiens
ugaggcaguagauugaau

SEQ ID NO: 19038 - RNA, 23 nt, Homo sapiens
agcuacauugucugcuggguuuc

SEQ ID NO: 19039 - RNA, 22 nt, Homo sapiens
ugaaggucuacugugugccagg

SEQ ID NO: 19040 - RNA, 19 nt, Homo sapiens
gggcgccugugaucccaac

SEQ ID NO: 19041 - RNA, 21 nt, Homo sapiens
aggaggcagcgcucucaggac

SEQ ID NO: 19042 - RNA, 22 nt, Homo sapiens
ugcaacgaaccugagccacuga

SEQ ID NO: 19043 - RNA, 20 nt, Homo sapiens
ggggagcuguggaagcagua

SEQ ID NO: 19044 - RNA, 21 nt, Homo sapiens
aaggcagggcccccgcucccc

SEQ ID NO: 19045 - RNA, 22 nt, Homo sapiens
aacccguagauccgaucuugug

SEQ ID NO: 19046 - RNA, 22 nt, Homo sapiens
cacccguagaaccgaccuugcg

SEQ ID NO: 19047 - RNA, 18 nt, Homo sapiens
cagggaggugaaugugau

SEQ ID NO: 19048 - RNA, 18 nt, Homo sapiens
cagggaggugaaugugau

SEQ ID NO: 19049 - RNA, 23 nt, Homo sapiens
ucuggcuccgugucuucacuccc

SEQ ID NO: 19050 - RNA, 22 nt, Homo sapiens
uggagagaaaggcaguuccuga

SEQ ID NO: 19051 - RNA, 22 nt, Homo sapiens
acagcaggcacagacaggcagu

SEQ ID NO: 19052 - RNA, 22 nt, Homo sapiens
uguaaacauccuacacucagcu

SEQ ID NO: 19053 - RNA, 22 nt, Homo sapiens
gccugcugggguggaaccuggu

SEQ ID NO: 19054 - RNA, 22 nt, Homo sapiens
ugagccccugugccgcccccag

SEQ ID NO: 19055 - RNA, 20 nt, Homo sapiens
cgugccacccuuuuccccag

SEQ ID NO: 19056 - RNA, 22 nt, Homo sapiens
aaggagcucacagucuauugag

SEQ ID NO: 19057 - RNA, 22 nt, Homo sapiens
aguggggaacccuuccaugagg

SEQ ID NO: 19058 - RNA, 23 nt, Homo sapiens
aaggagcuuacaaucuagcuggg

SEQ ID NO: 19059 - RNA, 21 nt, Homo sapiens
uggaggagaaggaaggugaug

SEQ ID NO: 19060 - RNA, 22 nt, Homo sapiens
uggagugugacaaugguguuug

SEQ ID NO: 19061 - RNA, 17 nt, Homo sapiens
gugggggagaggcuguc

SEQ ID NO: 19062 - RNA, 22 nt, Homo sapiens
ugugagguuggcauuguugucu

SEQ ID NO: 19063 - RNA, 22 nt, Homo sapiens
uucuggaauucugugugaggga

SEQ ID NO: 19064 - RNA, 21 nt, Homo sapiens
agggcccccccucaauccugu

SEQ ID NO: 19065 - RNA, 22 nt, Homo sapiens
uccagcaucagugauuuuguug

SEQ ID NO: 19066 - RNA, 23 nt, Homo sapiens
ucccccaggugugauucugauuu

SEQ ID NO: 19067 - RNA, 23 nt, Homo sapiens
caaagcgcuucucuuuagagugu

SEQ ID NO: 19068 - RNA, 21 nt, Homo sapiens
cuccagagggaaguacuuucu

SEQ ID NO: 19069 - RNA, 21 nt, Homo sapiens
cuccagagggaugcacuuucu

SEQ ID NO: 19070 - RNA, 21 nt, Homo sapiens
ucuuguguucucuagaucagu

SEQ ID NO: 19071 - RNA, 20 nt, Homo sapiens
guugugucaguuuaucaaac

SEQ ID NO: 19072 - RNA, 21 nt, Homo sapiens
agggggaaaguucuauagucc

SEQ ID NO: 19073 - RNA, 24 nt, Homo sapiens
acugggggcuuucgggcucugcgu

SEQ ID NO: 19074 - RNA, 24 nt, Homo sapiens
aaagacauaggauagagucaccuc

SEQ ID NO: 19075 - RNA, 23 nt, Homo sapiens
aggaagcccuggaggggcuggag

SEQ ID NO: 19076 - RNA, 20 nt, Homo sapiens
cggcucugggucugugggga

SEQ ID NO: 19077 - RNA, 21 nt, Homo sapiens
gaaggcgcuucccuuuggagu

SEQ ID NO: 19078 - RNA, 22 nt, Homo sapiens
ucugggcaacaaagugagaccu

SEQ ID NO: 19079 - RNA, 24 nt, Homo sapiens
uggcccugacugaagaccagcagu

SEQ ID NO: 19080 - RNA, 22 nt, Homo sapiens
uggguggucuggagauuugugc

SEQ ID NO: 19081 - RNA, 22 nt, Homo sapiens
uacccagagcaugcagugugaa

SEQ ID NO: 19082 - RNA, 20 nt, Homo sapiens
ccccagggcgacgcggcggg

SEQ ID NO: 19083 - RNA, 22 nt, Homo sapiens
gguccagaggggagauagguuc

SEQ ID NO: 19084 - RNA, 21 nt, Homo sapiens
ccaccaccgugucugacacuu

SEQ ID NO: 19085 - RNA, 24 nt, Homo sapiens
aauccuuggaaccuaggugugagu

SEQ ID NO: 19086 - RNA, 21 nt, Homo sapiens
acuggacuuggagucagaagg

SEQ ID NO: 19087 - RNA, 22 nt, Homo sapiens
acuggacuuagggucagaaggc

SEQ ID NO: 19088 - RNA, 21 nt, Homo sapiens
uugaaaggcuauuucuugguc

SEQ ID NO: 19089 - RNA, 25 nt, Homo sapiens
gcugggcagggcuucugagcuccuu

SEQ ID NO: 19090 - RNA, 24 nt, Homo sapiens
ugccugggucucuggccugcgcgu

SEQ ID NO: 19091 - RNA, 22 nt, Homo sapiens
gguggcccggccgugccugagg

SEQ ID NO: 19092 - RNA, 22 nt, Homo sapiens
ugagccccugugccgcccccag

SEQ ID NO: 19093 - RNA, 22 nt, Homo sapiens
uggagugugacaaugguguuug

SEQ ID NO: 19094 - RNA, 22 nt, Homo sapiens
uggagagaaaggcaguuccuga

SEQ ID NO: 19095 - RNA, 21 nt, Homo sapiens
cggcggggacggcgauugguc

SEQ ID NO: 19096 - RNA, 22 nt, Homo sapiens
cccugugcccggcccacuucug

SEQ ID NO: 19097 - RNA, 22 nt, Homo sapiens
aacuggccuacaaagucccagu

SEQ ID NO: 19098 - RNA, 22 nt, Homo sapiens
aacuggcccucaaagucccgcu

SEQ ID NO: 19099 - RNA, 22 nt, Homo sapiens
uggcaguguauuguuagcuggu

SEQ ID NO: 19100 - RNA, 22 nt, Homo sapiens
agaucagaaggugauuguggcu

SEQ ID NO: 19101 - RNA, 23 nt, Homo sapiens
uaagugcuuccauguuuugguga

SEQ ID NO: 19102 - RNA, 22 nt, Homo sapiens
cuggcccucucugcccuuccgu

SEQ ID NO: 19103 - RNA, 22 nt, Homo sapiens
uggugggcacagaaucuggacu

SEQ ID NO: 19104 - RNA, 19 nt, Homo sapiens
ugagcugcuguaccaaaau

SEQ ID NO: 19105 - RNA, 22 nt, Homo sapiens
uaacugguugaacaacugaacc

SEQ ID NO: 19106 - RNA, 25 nt, Homo sapiens
aggggugguguugggacagcuccgu

SEQ ID NO: 19107 - RNA, 22 nt, Homo sapiens
uggugggccgcagaacaugugc

SEQ ID NO: 19108 - RNA, 22 nt, Homo sapiens
aggcggggcgccgcgggaccgc

SEQ ID NO: 19109 - RNA, 22 nt, Homo sapiens
ugcggggcuagggcuaacagca

SEQ ID NO: 19110 - RNA, 20 nt, Homo sapiens
cggcucugggucugugggga

SEQ ID NO: 19111 - RNA, 21 nt, Homo sapiens
uugggacauacuuaugcuaaa

SEQ ID NO: 19112 - RNA, 22 nt, Homo sapiens
uggagagaaaggcaguuccuga

SEQ ID NO: 19113 - RNA, 23 nt, Homo sapiens
aggaccugcgggacaagauucuu

SEQ ID NO: 19114 - RNA, 22 nt, Homo sapiens
agacuucccauuugaagguggc

SEQ ID NO: 19115 - RNA, 23 nt, Homo sapiens
uacccuguagaaccgaauuugug

SEQ ID NO: 19116 - RNA, 21 nt, Homo sapiens
ccuguugaaguguaaucccca

SEQ ID NO: 19117 - RNA, 23 nt, Homo sapiens
uuauugcuuaagaauacgcguag

SEQ ID NO: 19118 - RNA, 27 nt, Homo sapiens
auugaucaucgacacuucgaacgcaau

SEQ ID NO: 19119 - RNA, 23 nt, Homo sapiens
aucaacagacauuaauugggcgc

SEQ ID NO: 19120 - RNA, 22 nt, Homo sapiens
aucaugaugggcuccucggugu

SEQ ID NO: 19121 - RNA, 21 nt, Homo sapiens
ucuaguaagaguggcagucga

SEQ ID NO: 19122 - RNA, 21 nt, Homo sapiens
uuaauaucggacaaccauugu

SEQ ID NO: 19123 - RNA, 20 nt, Homo sapiens
cgugccacccuuuuccccag

SEQ ID NO: 19124 - RNA, 22 nt, Homo sapiens
uuuagagacggggucuugcucu

SEQ ID NO: 19125 - RNA, 22 nt, Homo sapiens
uggacggagaacugauaagggu

SEQ ID NO: 19126 - RNA, 20 nt, Homo sapiens
ccccagggcgacgcggcggg

SEQ ID NO: 19127 - RNA, 22 nt, Homo sapiens
gguccagaggggagauagguuc

SEQ ID NO: 19128 - RNA, 22 nt, Homo sapiens
acaguagucugcacauugguua

SEQ ID NO: 19129 - RNA, 22 nt, Homo sapiens
acaguagucugcacauugguua

SEQ ID NO: 19130 - RNA, 21 nt, Homo sapiens
agcuacaucuggcuacugggu

SEQ ID NO: 19131 - RNA, 24 nt, Homo sapiens
uucuccaaaagaaagcacuuucug

SEQ ID NO: 19132 - RNA, 22 nt, Homo sapiens
aagugccuccuuuuagaguguu

SEQ ID NO: 19133 - RNA, 22 nt, Homo sapiens
caaaacuggcaauuacuuuugc

SEQ ID NO: 19134 - RNA, 22 nt, Homo sapiens
aaaaacugagacuacuuuugca

SEQ ID NO: 19135 - RNA, 19 nt, Homo sapiens
aaaaacuguaauuacuuuu

SEQ ID NO: 19136 - RNA, 20 nt, Homo sapiens
guccgcucggcgguggccca

SEQ ID NO: 19137 - RNA, 17 nt, Homo sapiens
ucccaccgcugccaccc

SEQ ID NO: 19138 - RNA, 17 nt, Homo sapiens
ucgccuccuccucuccc

SEQ ID NO: 19139 - RNA, 18 nt, Homo sapiens
cagggaggugaaugugau

SEQ ID NO: 19140 - RNA, 22 nt, Homo sapiens
ucaaaacugaggggcauuuucu

SEQ ID NO: 19141 - RNA, 23 nt, Homo sapiens
ucuggcuccgugucuucacuccc

SEQ ID NO: 19142 - RNA, 22 nt, Homo sapiens
ucucccaacccuuguaccagug

SEQ ID NO: 19143 - RNA, 22 nt, Homo sapiens
uggagagaaaggcaguuccuga

SEQ ID NO: 19144 - RNA, 22 nt, Homo sapiens
cauugcacuugucucggucuga

SEQ ID NO: 19145 - RNA, 22 nt, Homo sapiens
aguggggaacccuuccaugagg

SEQ ID NO: 19146 - RNA, 22 nt, Homo sapiens
ccaaaacugcaguuacuuuugc

SEQ ID NO: 19147 - RNA, 22 nt, Homo sapiens
gucccucuccaaaugugucuug

SEQ ID NO: 19148 - RNA, 21 nt, Homo sapiens
uggaggagaaggaaggugaug

SEQ ID NO: 19149 - RNA, 20 nt, Homo sapiens
ggggagcuguggaagcagua

SEQ ID NO: 19150 - RNA, 21 nt, Homo sapiens
uugcucacuguucuucccuag

SEQ ID NO: 19151 - RNA, 22 nt, Homo sapiens
ccucuuccccuugucucuccag

SEQ ID NO: 19152 - RNA, 22 nt, Homo sapiens
ucugggcaacaaagugagaccu

SEQ ID NO: 19153 - RNA, 20 nt, Homo sapiens
auuccuagaaauuguucaua

SEQ ID NO: 19154 - RNA, 20 nt, Homo sapiens
guagaggagauggcgcaggg

SEQ ID NO: 19155 - RNA, 21 nt, Homo sapiens
gcccuccgcccgugcaccccg

SEQ ID NO: 19156 - RNA, 23 nt, Homo sapiens
ucuggcuccgugucuucacuccc

SEQ ID NO: 19157 - RNA, 22 nt, Homo sapiens
cucuagagggaagcacuuucug

SEQ ID NO: 19158 - RNA, 22 nt, Homo sapiens
uggagagaaaggcaguuccuga

SEQ ID NO: 19159 - RNA, 22 nt, Homo sapiens
uguaaacauccuacacucagcu

SEQ ID NO: 19160 - RNA, 23 nt, Homo sapiens
ugaggggcagagagcgagacuuu

SEQ ID NO: 19161 - RNA, 19 nt, Homo sapiens
ugagcugcuguaccaaaau

SEQ ID NO: 19162 - RNA, 25 nt, Homo sapiens
ggcggagggaaguagguccguuggu

SEQ ID NO: 19163 - RNA, 23 nt, Homo sapiens
uggugcggagagggcccacagug

SEQ ID NO: 19164 - RNA, 23 nt, Homo sapiens
gagggucuugggagggaugugac

SEQ ID NO: 19165 - RNA, 21 nt, Homo sapiens
ucacagugaaccggucucuuu

SEQ ID NO: 19166 - RNA, 21 nt, Homo sapiens
uaccacaggguagaaccacgg

SEQ ID NO: 19167 - RNA, 22 nt, Homo sapiens
uguaacagcaacuccaugugga

SEQ ID NO: 19168 - RNA, 22 nt, Homo sapiens
agaucagaaggugauuguggcu

SEQ ID NO: 19169 - RNA, 21 nt, Homo sapiens
aggcaagaugcuggcauagcu

SEQ ID NO: 19170 - RNA, 21 nt, Homo sapiens
ucacuccucuccucccgucuu

SEQ ID NO: 19171 - RNA, 21 nt, Homo sapiens
uugaaaggcuauuucuugguc

SEQ ID NO: 19172 - RNA, 21 nt, Homo sapiens
cagcagcacacugugguuugu

SEQ ID NO: 19173 - RNA, 18 nt, Homo sapiens
ugcuuccuuucagagggu

SEQ ID NO: 19174 - RNA, 22 nt, Homo sapiens
aucuggagguaagaagcacuuu

SEQ ID NO: 19175 - RNA, 21 nt, Homo sapiens
guguugaaacaaucucuacug

SEQ ID NO: 19176 - RNA, 21 nt, Homo sapiens
cacuguguccuuucugcguag

SEQ ID NO: 19177 - RNA, 22 nt, Homo sapiens
uagcagcacauaaugguuugug

SEQ ID NO: 19178 - RNA, 22 nt, Homo sapiens
uagcagcacaucaugguuuaca

SEQ ID NO: 19179 - RNA, 22 nt, Homo sapiens
uagcagcacguaaauauuggcg

SEQ ID NO: 19180 - RNA, 21 nt, Homo sapiens
uagcagcacagaaauauuggc

SEQ ID NO: 19181 - RNA, 22 nt, Homo sapiens
cuggcccucucugcccuuccgu

SEQ ID NO: 19182 - RNA, 21 nt, Homo sapiens
gccccugggccuauccuagaa

SEQ ID NO: 19183 - RNA, 22 nt, Homo sapiens
cagcagcaauucauguuuugaa

SEQ ID NO: 19184 - RNA, 21 nt, Homo sapiens
cagcagcacacugugguuugu

SEQ ID NO: 19185 - RNA, 19 nt, Homo sapiens
aggcacggugucagcaggc

SEQ ID NO: 19186 - RNA, 19 nt, Homo sapiens
aagcagcugccucugaggc

SEQ ID NO: 19187 - RNA, 22 nt, Homo sapiens
gguggcccggccgugccugagg

SEQ ID NO: 19188 - RNA, 20 nt, Homo sapiens
ggggagcuguggaagcagua

SEQ ID NO: 19189 - RNA, 17 nt, Homo sapiens
ucgccuccuccucuccc

SEQ ID NO: 19190 - RNA, 18 nt, Homo sapiens
cagggaggugaaugugau

SEQ ID NO: 19191 - RNA, 21 nt, Homo sapiens
ucgaggagcucacagucuagu

SEQ ID NO: 19192 - RNA, 21 nt, Homo sapiens
cggcggggacggcgauugguc

SEQ ID NO: 19193 - RNA, 21 nt, Homo sapiens
agggcccccccucaauccugu

SEQ ID NO: 19194 - RNA, 23 nt, Homo sapiens
gaacgccuguucuugccaggugg

SEQ ID NO: 19195 - RNA, 22 nt, Homo sapiens
aggcggggcgccgcgggaccgc

SEQ ID NO: 19196 - RNA, 21 nt, Homo sapiens
uggaggagaaggaaggugaug

SEQ ID NO: 19197 - RNA, 21 nt, Homo sapiens
uggcagggaggcugggagggg

SEQ ID NO: 19198 - RNA, 22 nt, Homo sapiens
ugagccccugugccgcccccag

SEQ ID NO: 19199 - RNA, 23 nt, Homo sapiens
uaaggugcaucuagugcagauag

SEQ ID NO: 19200 - RNA, 22 nt, Homo sapiens
cgcaggggccgggugcucaccg

SEQ ID NO: 19201 - RNA, 22 nt, Homo sapiens
ucugcccccuccgcugcugcca

SEQ ID NO: 19202 - RNA, 21 nt, Homo sapiens
aucacauugccagggauuucc

SEQ ID NO: 19203 - RNA, 21 nt, Homo sapiens
aucacauugccagggauuacc

SEQ ID NO: 19204 - RNA, 20 nt, Homo sapiens
acugccccaggugcugcugg

SEQ ID NO: 19205 - RNA, 21 nt, Homo sapiens
cggggcagcucaguacaggau

SEQ ID NO: 19206 - RNA, 22 nt, Homo sapiens
caaaguuuaagauccuugaagu

SEQ ID NO: 19207 - RNA, 22 nt, Homo sapiens
uccgagccugggucucccucuu

SEQ ID NO: 19208 - RNA, 22 nt, Homo sapiens
ugcggggcuagggcuaacagca

SEQ ID NO: 19209 - RNA, 23 nt, Homo sapiens
aaaagugcuuacagugcagguag

SEQ ID NO: 19210 - RNA, 21 nt, Homo sapiens
uaaagugcugacagugcagau

SEQ ID NO: 19211 - RNA, 21 nt, Homo sapiens
uccuucugcuccgucccccag

SEQ ID NO: 19212 - RNA, 26 nt, Homo sapiens
gaugaugauggcagcaaauucugaaa

SEQ ID NO: 19213 - RNA, 23 nt, Homo sapiens
caaagugcuuacagugcagguag

SEQ ID NO: 19214 - RNA, 23 nt, Homo sapiens
uaaagugcuuauagugcagguag

SEQ ID NO: 19215 - RNA, 23 nt, Homo sapiens
caaagugcucauagugcagguag

SEQ ID NO: 19216 - RNA, 21 nt, Homo sapiens
aucauagaggaaaauccacgu

SEQ ID NO: 19217 - RNA, 22 nt, Homo sapiens
aucauagaggaaaauccauguu

SEQ ID NO: 19218 - RNA, 23 nt, Homo sapiens
cacucagccuugagggcacuuuc

SEQ ID NO: 19219 - RNA, 22 nt, Homo sapiens
aaagugcauccuuuuagagugu

SEQ ID NO: 19220 - RNA, 22 nt, Homo sapiens
aaagugcauccuuuuagagguu

SEQ ID NO: 19221 - RNA, 22 nt, Homo sapiens
aaagugcaucuuuuuagaggau

SEQ ID NO: 19222 - RNA, 22 nt, Homo sapiens
caaagugccucccuuuagagug

SEQ ID NO: 19223 - RNA, 23 nt, Homo sapiens
cucuugagggaagcacuuucugu

SEQ ID NO: 19224 - RNA, 21 nt, Homo sapiens
caaagguauuugugguuuuug

SEQ ID NO: 19225 - RNA, 23 nt, Homo sapiens
caaagugcuguucgugcagguag

SEQ ID NO: 19226 - RNA, 22 nt, Homo sapiens
acaggugagguucuugggagcc

SEQ ID NO: 19227 - RNA, 22 nt, Homo sapiens
ucugggcaacaaagugagaccu

SEQ ID NO: 19228 - RNA, 23 nt, Homo sapiens
caacggaaucccaaaagcagcug

SEQ ID NO: 19229 - RNA, 21 nt, Homo sapiens
uucacaguggcuaaguuccgc

SEQ ID NO: 19230 - RNA, 21 nt, Homo sapiens
agggcccccccucaauccugu

SEQ ID NO: 19231 - RNA, 22 nt, Homo sapiens
auauaauacaaccugcuaagug

SEQ ID NO: 19232 - RNA, 22 nt, Homo sapiens
uggugggcacagaaucuggacu

SEQ ID NO: 19233 - RNA, 22 nt, Homo sapiens
ugugucacucgaugaccacugu

SEQ ID NO: 19234 - RNA, 25 nt, Homo sapiens
gcugggcagggcuucugagcuccuu

SEQ ID NO: 19235 - RNA, 22 nt, Homo sapiens
uggugggccgcagaacaugugc

SEQ ID NO: 19236 - RNA, 21 nt, Homo sapiens
ccgucgccgccacccgagccg

SEQ ID NO: 19237 - RNA, 23 nt, Homo sapiens
ugaguaccgccaugucuguuggg

SEQ ID NO: 19238 - RNA, 22 nt, Homo sapiens
uacccagagcaugcagugugaa

SEQ ID NO: 19239 - RNA, 22 nt, Homo sapiens
acagcaggcacagacaggcagu

SEQ ID NO: 19240 - RNA, 21 nt, Homo sapiens
uucacaguggcuaaguuccgc

SEQ ID NO: 19241 - RNA, 21 nt, Homo sapiens
uucacaguggcuaaguucugc

SEQ ID NO: 19242 - RNA, 22 nt, Homo sapiens
uguaaacauccucgacuggaag

SEQ ID NO: 19243 - RNA, 22 nt, Homo sapiens
uguaaacauccuacacucagcu

SEQ ID NO: 19244 - RNA, 23 nt, Homo sapiens
uguaaacauccuacacucucagc

SEQ ID NO: 19245 - RNA, 22 nt, Homo sapiens
uguaaacauccccgacuggaag

SEQ ID NO: 19246 - RNA, 22 nt, Homo sapiens
uguaaacauccuugacuggaag

SEQ ID NO: 19247 - RNA, 22 nt, Homo sapiens
gccugcugggguggaaccuggu

SEQ ID NO: 19248 - RNA, 25 nt, Homo sapiens
aggggugguguugggacagcuccgu

SEQ ID NO: 19249 - RNA, 17 nt, Homo sapiens
ucucgcuggggccucca

SEQ ID NO: 19250 - RNA, 20 nt, Homo sapiens
ggggagcuguggaagcagua

SEQ ID NO: 19251 - RNA, 23 nt, Homo sapiens
uauggcuuuuuauuccuauguga

SEQ ID NO: 19252 - RNA, 23 nt, Homo sapiens
uauggcuuuucauuccuauguga

SEQ ID NO: 19253 - RNA, 22 nt, Homo sapiens
aaaaccgucuaguuacaguugu

SEQ ID NO: 19254 - RNA, 24 nt, Homo sapiens
uuuggcaaugguagaacucacacu

SEQ ID NO: 19255 - RNA, 20 nt, Homo sapiens
ugagcccuguccucccgcag

SEQ ID NO: 19256 - RNA, 20 nt, Homo sapiens
uaaggcacgcggugaaugcc

SEQ ID NO: 19257 - RNA, 23 nt, Homo sapiens
uggaguccaggaaucugcauuuu

SEQ ID NO: 19258 - RNA, 21 nt, Homo sapiens
aagugaucuaaaggccuacau

SEQ ID NO: 19259 - RNA, 18 nt, Homo sapiens
ugaggcaguagauugaau

SEQ ID NO: 19260 - RNA, 20 nt, Homo sapiens
agagguauagggcaugggaa

SEQ ID NO: 19261 - RNA, 21 nt, Homo sapiens
uaaggcacccuucugaguaga

SEQ ID NO: 19262 - RNA, 22 nt, Homo sapiens
aucgugcaucccuuuagagugu

SEQ ID NO: 19263 - RNA, 22 nt, Homo sapiens
aucgugcauccuuuuagagugu

SEQ ID NO: 19264 - RNA, 25 nt, Homo sapiens
ggcggagggaaguagguccguuggu

SEQ ID NO: 19265 - RNA, 22 nt, Homo sapiens
uauaccucaguuuuaucaggug

SEQ ID NO: 19266 - RNA, 22 nt, Homo sapiens
aggcagcgggguguaguggaua

SEQ ID NO: 19267 - RNA, 24 nt, Homo sapiens
agccugauuaaacacaugcucuga

SEQ ID NO: 19268 - RNA, 21 nt, Homo sapiens
cccggagccaggaugcagcuc

SEQ ID NO: 19269 - RNA, 17 nt, Homo sapiens
ucccuguucgggcgcca

SEQ ID NO: 19270 - RNA, 22 nt, Homo sapiens
ugcccuguggacucaguucugg

SEQ ID NO: 19271 - RNA, 21 nt, Homo sapiens
cucccacaugcaggguuugca

SEQ ID NO: 19272 - RNA, 21 nt, Homo sapiens
uaaagugcugacagugcagau

SEQ ID NO: 19273 - RNA, 23 nt, Homo sapiens
cagugcaaugauauugucaaagc

SEQ ID NO: 19274 - RNA, 19 nt, Homo sapiens
aagugugcagggcacuggu

SEQ ID NO: 19275 - RNA, 22 nt, Homo sapiens
ccucuuccccuugucucuccag

SEQ ID NO: 19276 - RNA, 18 nt, Homo sapiens
cagggaggugaaugugau

SEQ ID NO: 19277 - RNA, 20 nt, Homo sapiens
ccccagggcgacgcggcggg

SEQ ID NO: 19278 - RNA, 22 nt, Homo sapiens
cugugcgugugacagcggcuga

SEQ ID NO: 19279 - RNA, 22 nt, Homo sapiens
uggcucaguucagcaggaacag

SEQ ID NO: 19280 - RNA, 22 nt, Homo sapiens
ucaggcucaguccccucccgau

SEQ ID NO: 19281 - RNA, 22 nt, Homo sapiens
agaggcuggccgugaugaauuc

SEQ ID NO: 19282 - RNA, 22 nt, Homo sapiens
gucccucuccaaaugugucuug

SEQ ID NO: 19283 - RNA, 20 nt, Homo sapiens
guagaggagauggcgcaggg

SEQ ID NO: 19284 - RNA, 22 nt, Homo sapiens
ugugcgcagggagaccucuccc

SEQ ID NO: 19285 - RNA, 22 nt, Homo sapiens
ugugcgcagggagaccucuccc

SEQ ID NO: 19286 - RNA, 21 nt, Homo sapiens
uaaagugcugacagugcagau

SEQ ID NO: 19287 - RNA, 18 nt, Homo sapiens
aucccaccucugccacca

SEQ ID NO: 19288 - RNA, 17 nt, Homo sapiens
ucccaccgcugccaccc

SEQ ID NO: 19289 - RNA, 20 nt, Homo sapiens
ggggagcuguggaagcagua

SEQ ID NO: 19290 - RNA, 23 nt, Homo sapiens
cggcccgggcugcugcuguuccu

SEQ ID NO: 19291 - RNA, 21 nt, Homo sapiens
uccugcgcgucccagaugccc

SEQ ID NO: 19292 - RNA, 18 nt, Homo sapiens
uccagugcccuccucucc

SEQ ID NO: 19293 - RNA, 24 nt, Homo sapiens
agcagaagcagggagguucuccca

SEQ ID NO: 19294 - RNA, 21 nt, Homo sapiens
uaaagugcugacagugcagau

SEQ ID NO: 19295 - RNA, 23 nt, Homo sapiens
cagugcaaugauauugucaaagc

SEQ ID NO: 19296 - RNA, 21 nt, Homo sapiens
gaaggcgcuucccuuuggagu

SEQ ID NO: 19297 - RNA, 22 nt, Homo sapiens
gaaggcgcuucccuuuagagcg

SEQ ID NO: 19298 - RNA, 22 nt, Homo sapiens
ccucccacacccaaggcuugca

SEQ ID NO: 19299 - RNA, 22 nt, Homo sapiens
uggugggcacagaaucuggacu

SEQ ID NO: 19300 - RNA, 19 nt, Homo sapiens
aggcugcggaauucaggac

SEQ ID NO: 19301 - RNA, 22 nt, Homo sapiens
uggugggccgcagaacaugugc

SEQ ID NO: 19302 - RNA, 22 nt, Homo sapiens
ugugcgcagggagaccucuccc

SEQ ID NO: 19303 - RNA, 23 nt, Homo sapiens
cacccggcugugugcacaugugc

SEQ ID NO: 19304 - RNA, 21 nt, Homo sapiens
gugccagcugcagugggggag

SEQ ID NO: 19305 - RNA, 21 nt, Homo sapiens
ccccaccuccucucuccucag

SEQ ID NO: 19306 - RNA, 22 nt, Homo sapiens
aggcauugacuucucacuagcu

SEQ ID NO: 19307 - RNA, 22 nt, Homo sapiens
aggcauugacuucucacuagcu

SEQ ID NO: 19308 - RNA, 21 nt, Homo sapiens
aggggugcuaucugugauuga

SEQ ID NO: 19309 - RNA, 23 nt, Homo sapiens
ucccccaggugugauucugauuu

SEQ ID NO: 19310 - RNA, 22 nt, Homo sapiens
uaaugccccuaaaaauccuuau

SEQ ID NO: 19311 - RNA, 22 nt, Homo sapiens
uugggaucauuuugcauccaua

SEQ ID NO: 19312 - RNA, 22 nt, Homo sapiens
ugugacagauugauaacugaaa

SEQ ID NO: 19313 - RNA, 21 nt, Homo sapiens
caaagguauuugugguuuuug

SEQ ID NO: 19314 - RNA, 24 nt, Homo sapiens
acugggggcuuucgggcucugcgu

SEQ ID NO: 19315 - RNA, 24 nt, Homo sapiens
ugccugggucucuggccugcgcgu

SEQ ID NO: 19316 - RNA, 20 nt, Homo sapiens
accaggaggcugaggccccu

SEQ ID NO: 19317 - RNA, 22 nt, Homo sapiens
uuugugaccugguccacuaacc

SEQ ID NO: 19318 - RNA, 23 nt, Homo sapiens
cugggaucuccggggucuugguu

SEQ ID NO: 19319 - RNA, 20 nt, Homo sapiens
ggggagcuguggaagcagua

SEQ ID NO: 19320 - RNA, 20 nt, Homo sapiens
cgugccacccuuuuccccag

SEQ ID NO: 19321 - RNA, 22 nt, Homo sapiens
cagugcaauguuaaaagggcau

SEQ ID NO: 19322 - RNA, 18 nt, Homo sapiens
cagggaggugaaugugau

SEQ ID NO: 19323 - RNA, 22 nt, Homo sapiens
ugugacugguugaccagagggg

SEQ ID NO: 19324 - RNA, 23 nt, Homo sapiens
aacauucaacgcugucggugagu

SEQ ID NO: 19325 - RNA, 23 nt, Homo sapiens
aacauucauugcugucggugggu

SEQ ID NO: 19326 - RNA, 22 nt, Homo sapiens
aacauucaaccugucggugagu

SEQ ID NO: 19327 - RNA, 23 nt, Homo sapiens
aacauucauuguugucggugggu

SEQ ID NO: 19328 - RNA, 22 nt, Homo sapiens
ucaggccaggcacaguggcuca

SEQ ID NO: 19329 - RNA, 21 nt, Homo sapiens
aucacauugccagggauuucc

SEQ ID NO: 19330 - RNA, 21 nt, Homo sapiens
aucacauugccagggauuacc

SEQ ID NO: 19331 - RNA, 22 nt, Homo sapiens
uaugugggaugguaaaccgcuu

SEQ ID NO: 19332 - RNA, 23 nt, Homo sapiens
aucccuugcaggggcuguugggu

SEQ ID NO: 19333 - RNA, 21 nt, Homo sapiens
cugacuguugccguccuccag

SEQ ID NO: 19334 - RNA, 22 nt, Homo sapiens
uguaaacauccuacacucagcu

SEQ ID NO: 19335 - RNA, 22 nt, Homo sapiens
uuauaaagcaaugagacugauu

SEQ ID NO: 19336 - RNA, 21 nt, Homo sapiens
ugucuugcaggccgucaugca

SEQ ID NO: 19337 - RNA, 23 nt, Homo sapiens
ucggggaucaucaugucacgaga

SEQ ID NO: 19338 - RNA, 22 nt, Homo sapiens
auucuaauuucuccacgucuuu

SEQ ID NO: 19339 - RNA, 21 nt, Homo sapiens
uuggccacaauggguuagaac

SEQ ID NO: 19340 - RNA, 23 nt, Homo sapiens
uacccuguagaaccgaauuugug

SEQ ID NO: 19341 - RNA, 22 nt, Homo sapiens
ucugggcaacaaagugagaccu

SEQ ID NO: 19342 - RNA, 18 nt, Homo sapiens
cagggaggugaaugugau

SEQ ID NO: 19343 - RNA, 23 nt, Homo sapiens
ucuggcuccgugucuucacuccc

SEQ ID NO: 19344 - RNA, 22 nt, Homo sapiens
uggagagaaaggcaguuccuga

SEQ ID NO: 19345 - RNA, 22 nt, Homo sapiens
uggagagaaaggcaguuccuga

SEQ ID NO: 19346 - RNA, 22 nt, Homo sapiens
ucugcccccuccgcugcugcca

SEQ ID NO: 19347 - RNA, 20 nt, Homo sapiens
ccccagggcgacgcggcggg

SEQ ID NO: 19348 - RNA, 20 nt, Homo sapiens
acugccccaggugcugcugg

SEQ ID NO: 19349 - RNA, 21 nt, Homo sapiens
gccccugggccuauccuagaa

SEQ ID NO: 19350 - RNA, 21 nt, Homo sapiens
cggggcagcucaguacaggau

SEQ ID NO: 19351 - RNA, 25 nt, Homo sapiens
gcugggcagggcuucugagcuccuu

SEQ ID NO: 19352 - RNA, 21 nt, Homo sapiens
agggggaaaguucuauagucc

SEQ ID NO: 19353 - RNA, 24 nt, Homo sapiens
ugccugggucucuggccugcgcgu

SEQ ID NO: 19354 - RNA, 22 nt, Homo sapiens
acuccagccccacagccucagc

SEQ ID NO: 19355 - RNA, 20 nt, Homo sapiens
ggggagcuguggaagcagua

SEQ ID NO: 19356 - RNA, 24 nt, Homo sapiens
agccugauuaaacacaugcucuga

SEQ ID NO: 19357 - RNA, 22 nt, Homo sapiens
ucggccugaccacccaccccac

SEQ ID NO: 19358 - RNA, 17 nt, Homo sapiens
ucgccuccuccucuccc

SEQ ID NO: 19359 - RNA, 21 nt, Homo sapiens
cggcggggacggcgauugguc

SEQ ID NO: 19360 - RNA, 22 nt, Homo sapiens
agaguugagucuggacgucccg

SEQ ID NO: 19361 - RNA, 21 nt, Homo sapiens
agcuacaucuggcuacugggu

SEQ ID NO: 19362 - RNA, 23 nt, Homo sapiens
ccuaguagguguccaguaagugu

SEQ ID NO: 19363 - RNA, 22 nt, Homo sapiens
cgucaacacuugcugguuuccu

SEQ ID NO: 19364 - RNA, 22 nt, Homo sapiens
ugagaaccacgucugcucugag

SEQ ID NO: 19365 - RNA, 22 nt, Homo sapiens
aggcggggcgccgcgggaccgc

SEQ ID NO: 19366 - RNA, 21 nt, Homo sapiens
uggcagggaggcugggagggg

SEQ ID NO: 19367 - RNA, 25 nt, Homo sapiens
gggcgacaaagcaagacucuuucuu

SEQ ID NO: 19368 - RNA, 24 nt, Homo sapiens
uggcccugacugaagaccagcagu

SEQ ID NO: 19369 - RNA, 24 nt, Homo sapiens
uggcccugacugaagaccagcagu

SEQ ID NO: 19370 - RNA, 21 nt, Homo sapiens
cggcggggacggcgauugguc

SEQ ID NO: 19371 - RNA, 20 nt, Homo sapiens
ccccagggcgacgcggcggg

SEQ ID NO: 19372 - RNA, 23 nt, Homo sapiens
uacuccagagggcgucacucaug

SEQ ID NO: 19373 - RNA, 22 nt, Homo sapiens
aggcggggcgccgcgggaccgc

SEQ ID NO: 19374 - RNA, 20 nt, Homo sapiens
accaggaggcugaggccccu

SEQ ID NO: 19375 - RNA, 22 nt, Homo sapiens
ugcggggcuagggcuaacagca

SEQ ID NO: 19376 - RNA, 22 nt, Homo sapiens
uggaauguaaagaaguauguau

SEQ ID NO: 19377 - RNA, 21 nt, Homo sapiens
ugcaggaccaagaugagcccu

SEQ ID NO: 19378 - RNA, 23 nt, Homo sapiens
ucuggcuccgugucuucacuccc

SEQ ID NO: 19379 - RNA, 21 nt, Homo sapiens
uccugcgcgucccagaugccc

SEQ ID NO: 19380 - RNA, 23 nt, Homo sapiens
ugaguaccgccaugucuguuggg

SEQ ID NO: 19381 - RNA, 25 nt, Homo sapiens
cccccacaaccgcgcuugacuagcu

SEQ ID NO: 19382 - RNA, 22 nt, Homo sapiens
uggaauguaaggaagugugugg

SEQ ID NO: 19383 - RNA, 22 nt, Homo sapiens
uaugugggaugguaaaccgcuu

SEQ ID NO: 19384 - RNA, 22 nt, Homo sapiens
uaaugccccuaaaaauccuuau

SEQ ID NO: 19385 - RNA, 22 nt, Homo sapiens
aguggggaacccuuccaugagg

SEQ ID NO: 19386 - RNA, 22 nt, Homo sapiens
ugaaggucuacugugugccagg

SEQ ID NO: 19387 - RNA, 20 nt, Homo sapiens
aggaauguuccuucuuugcc

SEQ ID NO: 19388 - RNA, 22 nt, Homo sapiens
ugcggggcuagggcuaacagca

SEQ ID NO: 19389 - RNA, 22 nt, Homo sapiens
augggugaauuuguagaaggau

SEQ ID NO: 19390 - RNA, 22 nt, Homo sapiens
uuuucaacucuaaugggagaga

SEQ ID NO: 19391 - RNA, 21 nt, Homo sapiens
ucgaggagcucacagucuagu

SEQ ID NO: 19392 - RNA, 22 nt, Homo sapiens
ucugcccccuccgcugcugcca

SEQ ID NO: 19393 - RNA, 22 nt, Homo sapiens
uguaacagcaacuccaugugga

SEQ ID NO: 19394 - RNA, 20 nt, Homo sapiens
acugccccaggugcugcugg

SEQ ID NO: 19395 - RNA, 23 nt, Homo sapiens
ugucugcccgcaugccugccucu

SEQ ID NO: 19396 - RNA, 21 nt, Homo sapiens
cggggcagcucaguacaggau

SEQ ID NO: 19397 - RNA, 23 nt, Homo sapiens
ugucacucggcucggcccacuac

SEQ ID NO: 19398 - RNA, 21 nt, Homo sapiens
ccccaccuccucucuccucag

SEQ ID NO: 19399 - RNA, 18 nt, Homo sapiens
aucccaccucugccacca

SEQ ID NO: 19400 - RNA, 17 nt, Homo sapiens
ucgccuccuccucuccc

SEQ ID NO: 19401 - RNA, 24 nt, Homo sapiens
uggcccugacugaagaccagcagu

SEQ ID NO: 19402 - RNA, 23 nt, Homo sapiens
ucuggcuccgugucuucacuccc

SEQ ID NO: 19403 - RNA, 23 nt, Homo sapiens
cggcccgggcugcugcuguuccu

SEQ ID NO: 19404 - RNA, 23 nt, Homo sapiens
cggcccgggcugcugcuguuccu

SEQ ID NO: 19405 - RNA, 22 nt, Homo sapiens
uggacggagaacugauaagggu

SEQ ID NO: 19406 - RNA, 21 nt, Homo sapiens
cggcggggacggcgauugguc

SEQ ID NO: 19407 - RNA, 22 nt, Homo sapiens
cauugcacuugucucggucuga

SEQ ID NO: 19408 - RNA, 21 nt, Homo sapiens
agggcccccccucaauccugu

SEQ ID NO: 19409 - RNA, 22 nt, Homo sapiens
uguaaacauccuacacucagcu

SEQ ID NO: 19410 - RNA, 22 nt, Homo sapiens
caaccuggaggacuccaugcug

SEQ ID NO: 19411 - RNA, 22 nt, Homo sapiens
ccucccacacccaaggcuugca

SEQ ID NO: 19412 - RNA, 22 nt, Homo sapiens
aggcggggcgccgcgggaccgc

SEQ ID NO: 19413 - RNA, 22 nt, Homo sapiens
ugcggggcuagggcuaacagca

SEQ ID NO: 19414 - RNA, 22 nt, Homo sapiens
caaagugccucccuuuagagug

SEQ ID NO: 19415 - RNA, 22 nt, Homo sapiens
uauugcacucgucccggccucc

SEQ ID NO: 19416 - RNA, 23 nt, Homo sapiens
agcagcauuguacagggcuauga

SEQ ID NO: 19417 - RNA, 23 nt, Homo sapiens
agcagcauuguacagggcuauca

SEQ ID NO: 19418 - RNA, 20 nt, Homo sapiens
ucacaccugccucgcccccc

SEQ ID NO: 19419 - RNA, 22 nt, Homo sapiens
ucugggcaacaaagugagaccu

SEQ ID NO: 19420 - RNA, 22 nt, Homo sapiens
uagcagcacauaaugguuugug

SEQ ID NO: 19421 - RNA, 22 nt, Homo sapiens
uagcagcacaucaugguuuaca

SEQ ID NO: 19422 - RNA, 22 nt, Homo sapiens
uagcagcacguaaauauuggcg

SEQ ID NO: 19423 - RNA, 20 nt, Homo sapiens
ccccagggcgacgcggcggg

SEQ ID NO: 19424 - RNA, 21 nt, Homo sapiens
uagcagcacagaaauauuggc

SEQ ID NO: 19425 - RNA, 25 nt, Homo sapiens
cccccacaaccgcgcuugacuagcu

SEQ ID NO: 19426 - RNA, 23 nt, Homo sapiens
cgcauccccuagggcauuggugu

SEQ ID NO: 19427 - RNA, 22 nt, Homo sapiens
cagcagcaauucauguuuugaa

SEQ ID NO: 19428 - RNA, 22 nt, Homo sapiens
gugacaucacauauacggcagc

SEQ ID NO: 19429 - RNA, 21 nt, Homo sapiens
cagcagcacacugugguuugu

SEQ ID NO: 19430 - RNA, 22 nt, Homo sapiens
aacaucacagcaagucugugcu

SEQ ID NO: 19431 - RNA, 25 nt, Homo sapiens
gcugggcagggcuucugagcuccuu

SEQ ID NO: 19432 - RNA, 22 nt, Homo sapiens
ggggguccccggugcucggauc

SEQ ID NO: 19433 - RNA, 22 nt, Homo sapiens
agucauuggaggguuugagcag

SEQ ID NO: 19434 - RNA, 17 nt, Homo sapiens
ucucgcuggggccucca

SEQ ID NO: 19435 - RNA, 22 nt, Homo sapiens
uuugugaccugguccacuaacc

SEQ ID NO: 19436 - RNA, 23 nt, Homo sapiens
ucugcucauaccccaugguuucu

SEQ ID NO: 19437 - RNA, 22 nt, Homo sapiens
gugugcggaaaugcuucugcua

SEQ ID NO: 19438 - RNA, 21 nt, Homo sapiens
cggcggggacggcgauugguc

SEQ ID NO: 19439 - RNA, 22 nt, Homo sapiens
uguaaacauccuacacucagcu

SEQ ID NO: 19440 - RNA, 22 nt, Homo sapiens
aucacacaaaggcaacuuuugu

SEQ ID NO: 19441 - RNA, 21 nt, Homo sapiens
agggggaaaguucuauagucc

SEQ ID NO: 19442 - RNA, 22 nt, Homo sapiens
aggcggggcgccgcgggaccgc

SEQ ID NO: 19443 - RNA, 21 nt, Homo sapiens
uggaggagaaggaaggugaug

SEQ ID NO: 19444 - RNA, 22 nt, Homo sapiens
caaagugccucccuuuagagug

SEQ ID NO: 19445 - RNA, 22 nt, Homo sapiens
auccgcgcucugacucucugcc

SEQ ID NO: 19446 - RNA, 22 nt, Homo sapiens
gugugcggaaaugcuucugcua

SEQ ID NO: 19447 - RNA, 23 nt, Homo sapiens
ucuggcuccgugucuucacuccc

SEQ ID NO: 19448 - RNA, 21 nt, Homo sapiens
ucgaggagcucacagucuagu

SEQ ID NO: 19449 - RNA, 21 nt, Homo sapiens
cggcggggacggcgauugguc

SEQ ID NO: 19450 - RNA, 22 nt, Homo sapiens
cauugcacuugucucggucuga

SEQ ID NO: 19451 - RNA, 20 nt, Homo sapiens
ccucugggcccuuccuccag

SEQ ID NO: 19452 - RNA, 22 nt, Homo sapiens
ucucugggccugugucuuaggc

SEQ ID NO: 19453 - RNA, 23 nt, Homo sapiens
ugagcgccucgacgacagagccg

SEQ ID NO: 19454 - RNA, 22 nt, Homo sapiens
aggcggggcgccgcgggaccgc

SEQ ID NO: 19455 - RNA, 22 nt, Homo sapiens
ugcggggcuagggcuaacagca

SEQ ID NO: 19456 - RNA, 17 nt, Homo sapiens
gugggggagaggcuguc

SEQ ID NO: 19457 - RNA, 23 nt, Homo sapiens
ucuggcuccgugucuucacuccc

SEQ ID NO: 19458 - RNA, 24 nt, Homo sapiens
uuuggcaaugguagaacucacacu

SEQ ID NO: 19459 - RNA, 22 nt, Homo sapiens
uggcaguguauuguuagcuggu

SEQ ID NO: 19460 - RNA, 22 nt, Homo sapiens
aguggggaacccuuccaugagg

SEQ ID NO: 19461 - RNA, 22 nt, Homo sapiens
caaaaaccacaguuucuuuugc

SEQ ID NO: 19462 - RNA, 21 nt, Homo sapiens
ucuaguaagaguggcagucga

SEQ ID NO: 19463 - RNA, 22 nt, Homo sapiens
gucccucuccaaaugugucuug

SEQ ID NO: 19464 - RNA, 23 nt, Homo sapiens
gcagcagagaauaggacuacguc

SEQ ID NO: 19465 - RNA, 20 nt, Homo sapiens
ggggagcuguggaagcagua

SEQ ID NO: 19466 - RNA, 21 nt, Homo sapiens
gaaggcgcuucccuuuggagu

SEQ ID NO: 19467 - RNA, 22 nt, Homo sapiens
cuagguauggucccagggaucc

SEQ ID NO: 19468 - RNA, 23 nt, Homo sapiens
uaaauuucaccuuucugagaagg

SEQ ID NO: 19469 - RNA, 21 nt, Homo sapiens
caaagaggaaggucccauuac

SEQ ID NO: 19470 - RNA, 21 nt, Homo sapiens
gaagugugccguggugugucu

SEQ ID NO: 19471 - RNA, 22 nt, Homo sapiens
ucuucucuguuuuggccaugug

SEQ ID NO: 19472 - RNA, 21 nt, Homo sapiens
cugacuguugccguccuccag

SEQ ID NO: 19473 - RNA, 24 nt, Homo sapiens
agccuggaagcuggagccugcagu

SEQ ID NO: 19474 - RNA, 22 nt, Homo sapiens
acaggugagguucuugggagcc

SEQ ID NO: 19475 - RNA, 18 nt, Homo sapiens
gucccuguucaggcgcca

SEQ ID NO: 19476 - RNA, 18 nt, Homo sapiens
cagggaggugaaugugau

SEQ ID NO: 19477 - RNA, 22 nt, Homo sapiens
ugugacugguugaccagagggg

SEQ ID NO: 19478 - RNA, 21 nt, Homo sapiens
gcccuccgcccgugcaccccg

SEQ ID NO: 19479 - RNA, 22 nt, Homo sapiens
ucagugcaucacagaacuuugu

SEQ ID NO: 19480 - RNA, 23 nt, Homo sapiens
ucuggcuccgugucuucacuccc

SEQ ID NO: 19481 - RNA, 22 nt, Homo sapiens
ucugcccccuccgcugcugcca

SEQ ID NO: 19482 - RNA, 22 nt, Homo sapiens
cccugugcccggcccacuucug

SEQ ID NO: 19483 - RNA, 22 nt, Homo sapiens
acacagggcuguugugaagacu

SEQ ID NO: 19484 - RNA, 22 nt, Homo sapiens
cauugcacuugucucggucuga

SEQ ID NO: 19485 - RNA, 20 nt, Homo sapiens
acugccccaggugcugcugg

SEQ ID NO: 19486 - RNA, 21 nt, Homo sapiens
aggggugcuaucugugauuga

SEQ ID NO: 19487 - RNA, 23 nt, Homo sapiens
ugaggggcagagagcgagacuuu

SEQ ID NO: 19488 - RNA, 22 nt, Homo sapiens
ucaggcucaguccccucccgau

SEQ ID NO: 19489 - RNA, 21 nt, Homo sapiens
cggggcagcucaguacaggau

SEQ ID NO: 19490 - RNA, 22 nt, Homo sapiens
uccgagccugggucucccucuu

SEQ ID NO: 19491 - RNA, 25 nt, Homo sapiens
ggcggagggaaguagguccguuggu

SEQ ID NO: 19492 - RNA, 21 nt, Homo sapiens
cugacuguugccguccuccag

SEQ ID NO: 19493 - RNA, 20 nt, Homo sapiens
ucugcaggguuugcuuugag

SEQ ID NO: 19494 - RNA, 25 nt, Homo sapiens
gggcgacaaagcaagacucuuucuu

SEQ ID NO: 19495 - RNA, 17 nt, Homo sapiens
ucgccuccuccucuccc

SEQ ID NO: 19496 - RNA, 21 nt, Homo sapiens
ucgaggagcucacagucuagu

SEQ ID NO: 19497 - RNA, 21 nt, Homo sapiens
uccugcgcgucccagaugccc

SEQ ID NO: 19498 - RNA, 23 nt, Homo sapiens
caaagugcuuacagugcagguag

SEQ ID NO: 19499 - RNA, 22 nt, Homo sapiens
cgcaggggccgggugcucaccg

SEQ ID NO: 19500 - RNA, 22 nt, Homo sapiens
uacugcagacguggcaaucaug

SEQ ID NO: 19501 - RNA, 21 nt, Homo sapiens
uacugcagacaguggcaauca

SEQ ID NO: 19502 - RNA, 25 nt, Homo sapiens
aggggugguguugggacagcuccgu

SEQ ID NO: 19503 - RNA, 22 nt, Homo sapiens
ucugggcaacaaagugagaccu

SEQ ID NO: 19504 - RNA, 23 nt, Homo sapiens
acuccauuuguuuugaugaugga

SEQ ID NO: 19505 - RNA, 20 nt, Homo sapiens
ccucugggcccuuccuccag

SEQ ID NO: 19506 - RNA, 22 nt, Homo sapiens
ucucugggccugugucuuaggc

SEQ ID NO: 19507 - RNA, 22 nt, Homo sapiens
uaaugccccuaaaaauccuuau

SEQ ID NO: 19508 - RNA, 25 nt, Homo sapiens
gcugggcagggcuucugagcuccuu

SEQ ID NO: 19509 - RNA, 19 nt, Homo sapiens
aguguggcuuucuuagagc

SEQ ID NO: 19510 - RNA, 20 nt, Homo sapiens
cggcucugggucugugggga

SEQ ID NO: 19511 - RNA, 22 nt, Homo sapiens
uggagugugacaaugguguuug

SEQ ID NO: 19512 - RNA, 21 nt, Homo sapiens
gcccuccgcccgugcaccccg

SEQ ID NO: 19513 - RNA, 23 nt, Homo sapiens
ucuggcuccgugucuucacuccc

SEQ ID NO: 19514 - RNA, 22 nt, Homo sapiens
uggagagaaaggcaguuccuga

SEQ ID NO: 19515 - RNA, 21 nt, Homo sapiens
cggcggggacggcgauugguc

SEQ ID NO: 19516 - RNA, 22 nt, Homo sapiens
uguaaacauccuacacucagcu

SEQ ID NO: 19517 - RNA, 21 nt, Homo sapiens
aagccugcccggcuccucggg

SEQ ID NO: 19518 - RNA, 22 nt, Homo sapiens
gucccucuccaaaugugucuug

SEQ ID NO: 19519 - RNA, 25 nt, Homo sapiens
ggcggagggaaguagguccguuggu

SEQ ID NO: 19520 - RNA, 22 nt, Homo sapiens
aggcggggcgccgcgggaccgc

SEQ ID NO: 19521 - RNA, 22 nt, Homo sapiens
ugcggggcuagggcuaacagca

SEQ ID NO: 19522 - RNA, 22 nt, Homo sapiens
auccgcgcucugacucucugcc

SEQ ID NO: 19523 - RNA, 24 nt, Homo sapiens
uggcccugacugaagaccagcagu

SEQ ID NO: 19524 - RNA, 22 nt, Homo sapiens
cagugcaaugaugaaagggcau

SEQ ID NO: 19525 - RNA, 21 nt, Homo sapiens
gcccuccgcccgugcaccccg

SEQ ID NO: 19526 - RNA, 22 nt, Homo sapiens
ucagugcacuacagaacuuugu

SEQ ID NO: 19527 - RNA, 22 nt, Homo sapiens
ucagugcaucacagaacuuugu

SEQ ID NO: 19528 - RNA, 21 nt, Homo sapiens
ucagugcaugacagaacuugg

SEQ ID NO: 19529 - RNA, 18 nt, Homo sapiens
uccagugcccuccucucc

SEQ ID NO: 19530 - RNA, 22 nt, Homo sapiens
aacuggccuacaaagucccagu

SEQ ID NO: 19531 - RNA, 22 nt, Homo sapiens
aacuggcccucaaagucccgcu

SEQ ID NO: 19532 - RNA, 22 nt, Homo sapiens
cuggcccucucugcccuuccgu

SEQ ID NO: 19533 - RNA, 23 nt, Homo sapiens
uaauccuugcuaccugggugaga

SEQ ID NO: 19534 - RNA, 22 nt, Homo sapiens
aaugcacccgggcaaggauucu

SEQ ID NO: 19535 - RNA, 22 nt, Homo sapiens
aaugcaccugggcaaggauuca

SEQ ID NO: 19536 - RNA, 19 nt, Homo sapiens
ugagcugcuguaccaaaau

SEQ ID NO: 19537 - RNA, 20 nt, Homo sapiens
guccgcucggcgguggccca

SEQ ID NO: 19538 - RNA, 21 nt, Homo sapiens
caaagaggaaggucccauuac

SEQ ID NO: 19539 - RNA, 25 nt, Homo sapiens
ggcggagggaaguagguccguuggu

SEQ ID NO: 19540 - RNA, 21 nt, Homo sapiens
uggaggagaaggaaggugaug

SEQ ID NO: 19541 - RNA, 22 nt, Homo sapiens
auccgcgcucugacucucugcc

SEQ ID NO: 19542 - RNA, 22 nt, Homo sapiens
uauugcacucgucccggccucc

SEQ ID NO: 19543 - RNA, 21 nt, Homo sapiens
uggcagggaggcugggagggg

SEQ ID NO: 19544 - RNA, 22 nt, Homo sapiens
ccucuuccccuugucucuccag

SEQ ID NO: 19545 - RNA, 24 nt, Homo sapiens
ccagacagaauucuaugcacuuuc

SEQ ID NO: 19546 - RNA, 23 nt, Homo sapiens
uaaggugcaucuagugcagauag

SEQ ID NO: 19547 - RNA, 22 nt, Homo sapiens
cgcaggggccgggugcucaccg

SEQ ID NO: 19548 - RNA, 23 nt, Homo sapiens
ucaagagcaauaacgaaaaaugu

SEQ ID NO: 19549 - RNA, 22 nt, Homo sapiens
ugaaggucuacugugugccagg

SEQ ID NO: 19550 - RNA, 23 nt, Homo sapiens
cucuugagggaagcacuuucugu

SEQ ID NO: 19551 - RNA, 22 nt, Homo sapiens
ucagcaaacauuuauugugugc

SEQ ID NO: 19552 - RNA, 19 nt, Homo sapiens
gagccaguuggacaggagc

SEQ ID NO: 19553 - RNA, 22 nt, Homo sapiens
ggggguccccggugcucggauc

SEQ ID NO: 19554 - RNA, 22 nt, Homo sapiens
acuccagccccacagccucagc

SEQ ID NO: 19555 - RNA, 22 nt, Homo sapiens
cacuggcuccuuucuggguaga

SEQ ID NO: 19556 - RNA, 21 nt, Homo sapiens
cugacuguugccguccuccag

SEQ ID NO: 19557 - RNA, 22 nt, Homo sapiens
ucagugcacuacagaacuuugu

SEQ ID NO: 19558 - RNA, 22 nt, Homo sapiens
ucagugcaucacagaacuuugu

SEQ ID NO: 19559 - RNA, 22 nt, Homo sapiens
agaucagaaggugauuguggcu

SEQ ID NO: 19560 - RNA, 21 nt, Homo sapiens
cagcagcacacugugguuugu

SEQ ID NO: 19561 - RNA, 24 nt, Homo sapiens
uggggagcugaggcucugggggug

SEQ ID NO: 19562 - RNA, 21 nt, Homo sapiens
uggcagggaggcugggagggg

SEQ ID NO: 19563 - RNA, 22 nt, Homo sapiens
ucggccugaccacccaccccac

SEQ ID NO: 19564 - RNA, 23 nt, Homo sapiens
cggcccgggcugcugcuguuccu

SEQ ID NO: 19565 - RNA, 23 nt, Homo sapiens
uaaggugcaucuagugcagauag

SEQ ID NO: 19566 - RNA, 21 nt, Homo sapiens
ugucuugcaggccgucaugca

SEQ ID NO: 19567 - RNA, 22 nt, Homo sapiens
aaccagcaccccaacuuuggac

SEQ ID NO: 19568 - RNA, 20 nt, Homo sapiens
guagaggagauggcgcaggg

SEQ ID NO: 19569 - RNA, 23 nt, Homo sapiens
uauggcuuuuuauuccuauguga

SEQ ID NO: 19570 - RNA, 23 nt, Homo sapiens
uauggcuuuucauuccuauguga

SEQ ID NO: 19571 - RNA, 21 nt, Homo sapiens
gguuugguccuagccuuucua

SEQ ID NO: 19572 - RNA, 22 nt, Homo sapiens
uaaugccccuaaaaauccuuau

SEQ ID NO: 19573 - RNA, 22 nt, Homo sapiens
ugagaaccacgucugcucugag

SEQ ID NO: 19574 - RNA, 21 nt, Homo sapiens
gaagugugccguggugugucu

SEQ ID NO: 19575 - RNA, 22 nt, Homo sapiens
cacacacugcaauuacuuuugc

SEQ ID NO: 19576 - RNA, 23 nt, Homo sapiens
ucauagcccuguacaaugcugcu

SEQ ID NO: 19577 - RNA, 21 nt, Homo sapiens
gugccagcugcagugggggag

SEQ ID NO: 19578 - RNA, 22 nt, Homo sapiens
ucguaccgugaguaauaaugcg

SEQ ID NO: 19579 - RNA, 21 nt, Homo sapiens
uuaggccgcagaucuggguga

SEQ ID NO: 19580 - RNA, 22 nt, Homo sapiens
gauuagggugcuuagcuguuaa

SEQ ID NO: 19581 - RNA, 21 nt, Homo sapiens
ccacaccguaucugacacuuu

SEQ ID NO: 19582 - RNA, 23 nt, Homo sapiens
aucaacagacauuaauugggcgc

SEQ ID NO: 19583 - RNA, 22 nt, Homo sapiens
uuauaaagcaaugagacugauu

SEQ ID NO: 19584 - RNA, 23 nt, Homo sapiens
uucauuugguauaaaccgcgauu

SEQ ID NO: 19585 - RNA, 20 nt, Homo sapiens
aggguguuucucucaucucu

SEQ ID NO: 19586 - RNA, 22 nt, Homo sapiens
gugaacgggcgccaucccgagg

SEQ ID NO: 19587 - RNA, 21 nt, Homo sapiens
uacucaaaaagcugucaguca

SEQ ID NO: 19588 - RNA, 22 nt, Homo sapiens
ucaaaacugaggggcauuuucu

SEQ ID NO: 19589 - RNA, 20 nt, Homo sapiens
ccccagggcgacgcggcggg

SEQ ID NO: 19590 - RNA, 20 nt, Homo sapiens
uguuuugauaacaguaaugu

SEQ ID NO: 19591 - RNA, 22 nt, Homo sapiens
acagcaggcacagacaggcagu

SEQ ID NO: 19592 - RNA, 21 nt, Homo sapiens
uucaaguaauucaggauaggu

SEQ ID NO: 19593 - RNA, 22 nt, Homo sapiens
gccugcugggguggaaccuggu

SEQ ID NO: 19594 - RNA, 22 nt, Homo sapiens
agacccuggucugcacucuauc

SEQ ID NO: 19595 - RNA, 18 nt, Homo sapiens
uucacagggaggugucau

SEQ ID NO: 19596 - RNA, 22 nt, Homo sapiens
caaaacuggcaauuacuuuugc

SEQ ID NO: 19597 - RNA, 22 nt, Homo sapiens
aaaaacugagacuacuuuugca

SEQ ID NO: 19598 - RNA, 19 nt, Homo sapiens
aaaaacuguaauuacuuuu

SEQ ID NO: 19599 - RNA, 22 nt, Homo sapiens
ccaaaacugcaguuacuuuugc

SEQ ID NO: 19600 - RNA, 22 nt, Homo sapiens
uagcaaaaacugcaguuacuuu

SEQ ID NO: 19601 - RNA, 21 nt, Homo sapiens
aacaggugacugguuagacaa

SEQ ID NO: 19602 - RNA, 23 nt, Homo sapiens
agcagcauuguacagggcuauga

SEQ ID NO: 19603 - RNA, 23 nt, Homo sapiens
agcagcauuguacagggcuauca

SEQ ID NO: 19604 - RNA, 22 nt, Homo sapiens
uggacggagaacugauaagggu

SEQ ID NO: 19605 - RNA, 22 nt, Homo sapiens
uggagagaaaggcaguuccuga

SEQ ID NO: 19606 - RNA, 21 nt, Homo sapiens
cggcggggacggcgauugguc

SEQ ID NO: 19607 - RNA, 22 nt, Homo sapiens
uucccuuugucauccuaugccu

SEQ ID NO: 19608 - RNA, 23 nt, Homo sapiens
caaagugcucauagugcagguag

SEQ ID NO: 19609 - RNA, 22 nt, Homo sapiens
uucccuuugucauccuucgccu

SEQ ID NO: 19610 - RNA, 22 nt, Homo sapiens
aacuguuugcagaggaaacuga

SEQ ID NO: 19611 - RNA, 22 nt, Homo sapiens
aggcggggcgccgcgggaccgc

SEQ ID NO: 19612 - RNA, 22 nt, Homo sapiens
ugcggggcuagggcuaacagca

SEQ ID NO: 19613 - RNA, 21 nt, Homo sapiens
uggaggagaaggaaggugaug

SEQ ID NO: 19614 - RNA, 21 nt, Homo sapiens
uggaggagaaggaaggugaug

SEQ ID NO: 19615 - RNA, 21 nt, Homo sapiens
ccuggaaacacugagguugug

SEQ ID NO: 19616 - RNA, 22 nt, Homo sapiens
ucugcccccuccgcugcugcca

SEQ ID NO: 19617 - RNA, 20 nt, Homo sapiens
ccccagggcgacgcggcggg

SEQ ID NO: 19618 - RNA, 22 nt, Homo sapiens
cauugcacuugucucggucuga

SEQ ID NO: 19619 - RNA, 20 nt, Homo sapiens
acugccccaggugcugcugg

SEQ ID NO: 19620 - RNA, 21 nt, Homo sapiens
gccccugggccuauccuagaa

SEQ ID NO: 19621 - RNA, 21 nt, Homo sapiens
cggggcagcucaguacaggau

SEQ ID NO: 19622 - RNA, 19 nt, Homo sapiens
gggcgccugugaucccaac

SEQ ID NO: 19623 - RNA, 22 nt, Homo sapiens
ugcggggcuagggcuaacagca

SEQ ID NO: 19624 - RNA, 23 nt, Homo sapiens
cacccggcugugugcacaugugc

SEQ ID NO: 19625 - RNA, 22 nt, Homo sapiens
aaaaguaauugcggauuuugcc

SEQ ID NO: 19626 - RNA, 21 nt, Homo sapiens
caagucacuagugguuccguu

SEQ ID NO: 19627 - RNA, 22 nt, Homo sapiens
uggcaguguauuguuagcuggu

SEQ ID NO: 19628 - RNA, 23 nt, Homo sapiens
uuucaagccagggggcguuuuuc

SEQ ID NO: 19629 - RNA, 22 nt, Homo sapiens
cgucaacacuugcugguuuccu

SEQ ID NO: 19630 - RNA, 22 nt, Homo sapiens
aaaaugguucccuuuagagugu

SEQ ID NO: 19631 - RNA, 23 nt, Homo sapiens
gcagcagagaauaggacuacguc

SEQ ID NO: 19632 - RNA, 22 nt, Homo sapiens
ccucuuccccuugucucuccag

SEQ ID NO: 19633 - RNA, 21 nt, Homo sapiens
uccuucugcuccgucccccag

SEQ ID NO: 19634 - RNA, 22 nt, Homo sapiens
agaaggaaauugaauucauuua

SEQ ID NO: 19635 - RNA, 21 nt, Homo sapiens
ugagaugaagcacuguagcuc

SEQ ID NO: 19636 - RNA, 22 nt, Homo sapiens
ucugcccccuccgcugcugcca

SEQ ID NO: 19637 - RNA, 22 nt, Homo sapiens
cucccacugcuucacuugacua

SEQ ID NO: 19638 - RNA, 22 nt, Homo sapiens
agaucagaaggugauuguggcu

SEQ ID NO: 19639 - RNA, 22 nt, Homo sapiens
uguaaacauccuacacucagcu

SEQ ID NO: 19640 - RNA, 20 nt, Homo sapiens
acugccccaggugcugcugg

SEQ ID NO: 19641 - RNA, 21 nt, Homo sapiens
cggggcagcucaguacaggau

SEQ ID NO: 19642 - RNA, 21 nt, Homo sapiens
uggaggagaaggaaggugaug

SEQ ID NO: 19643 - RNA, 23 nt, Homo sapiens
ucugcucauaccccaugguuucu

SEQ ID NO: 19644 - RNA, 22 nt, Homo sapiens
ucucccaacccuuguaccagug

SEQ ID NO: 19645 - RNA, 22 nt, Homo sapiens
cagugcaauguuaaaagggcau

SEQ ID NO: 19646 - RNA, 21 nt, Homo sapiens
aucacauugccagggauuucc

SEQ ID NO: 19647 - RNA, 21 nt, Homo sapiens
aucacauugccagggauuacc

SEQ ID NO: 19648 - RNA, 20 nt, Homo sapiens
uaaggcacgcggugaaugcc

SEQ ID NO: 19649 - RNA, 18 nt, Homo sapiens
aucccaccucugccacca

SEQ ID NO: 19650 - RNA, 23 nt, Homo sapiens
uauggcuuuucauuccuauguga

SEQ ID NO: 19651 - RNA, 22 nt, Homo sapiens
cccugugcccggcccacuucug

SEQ ID NO: 19652 - RNA, 22 nt, Homo sapiens
ucaggccaggcacaguggcuca

SEQ ID NO: 19653 - RNA, 21 nt, Homo sapiens
agcuacaucuggcuacugggu

SEQ ID NO: 19654 - RNA, 22 nt, Homo sapiens
uagcaccaucugaaaucgguua

SEQ ID NO: 19655 - RNA, 23 nt, Homo sapiens
uagcaccauuugaaaucaguguu

SEQ ID NO: 19656 - RNA, 22 nt, Homo sapiens
uagcaccauuugaaaucgguua

SEQ ID NO: 19657 - RNA, 21 nt, Homo sapiens
uaaagugcugacagugcagau

SEQ ID NO: 19658 - RNA, 23 nt, Homo sapiens
cagugcaaugauauugucaaagc

SEQ ID NO: 19659 - RNA, 23 nt, Homo sapiens
ucucacacagaaaucgcacccgu

SEQ ID NO: 19660 - RNA, 22 nt, Homo sapiens
aucacacaaaggcaacuuuugu

SEQ ID NO: 19661 - RNA, 22 nt, Homo sapiens
caaccuggaggacuccaugcug

SEQ ID NO: 19662 - RNA, 21 nt, Homo sapiens
uaaggcacccuucugaguaga

SEQ ID NO: 19663 - RNA, 22 nt, Homo sapiens
ccucccacacccaaggcuugca

SEQ ID NO: 19664 - RNA, 22 nt, Homo sapiens
caagaaccucaguugcuuuugu

SEQ ID NO: 19665 - RNA, 23 nt, Homo sapiens
gacacgggcgacagcugcggccc

SEQ ID NO: 19666 - RNA, 24 nt, Homo sapiens
ugccugggucucuggccugcgcgu

SEQ ID NO: 19667 - RNA, 20 nt, Homo sapiens
guguguggaaaugcuucugc

SEQ ID NO: 19668 - RNA, 22 nt, Homo sapiens
aacuguuugcagaggaaacuga

SEQ ID NO: 19669 - RNA, 21 nt, Homo sapiens
uagcagcacagaaauauuggc

SEQ ID NO: 19670 - RNA, 22 nt, Homo sapiens
uuauaauacaaccugauaagug

SEQ ID NO: 19671 - RNA, 21 nt, Homo sapiens
ugguagacuauggaacguagg

SEQ ID NO: 19672 - RNA, 21 nt, Homo sapiens
uaguagaccguauagcguacg

SEQ ID NO: 19673 - RNA, 22 nt, Homo sapiens
ugaaggucuacugugugccagg

SEQ ID NO: 19674 - RNA, 21 nt, Homo sapiens
ugagcuaaaugugugcuggga

SEQ ID NO: 19675 - RNA, 21 nt, Homo sapiens
cacaagguauugguauuaccu

SEQ ID NO: 19676 - RNA, 20 nt, Homo sapiens
guagaggagauggcgcaggg

SEQ ID NO: 19677 - RNA, 21 nt, Homo sapiens
gcccuccgcccgugcaccccg

SEQ ID NO: 19678 - RNA, 21 nt, Homo sapiens
gcccuccgcccgugcaccccg

SEQ ID NO: 19679 - RNA, 21 nt, Homo sapiens
cggcggggacggcgauugguc

SEQ ID NO: 19680 - RNA, 23 nt, Homo sapiens
ugaggggcagagagcgagacuuu

SEQ ID NO: 19681 - RNA, 25 nt, Homo sapiens
ggcggagggaaguagguccguuggu

SEQ ID NO: 19682 - RNA, 22 nt, Homo sapiens
aggcggggcgccgcgggaccgc

SEQ ID NO: 19683 - RNA, 22 nt, Homo sapiens
ugcggggcuagggcuaacagca

SEQ ID NO: 19684 - RNA, 22 nt, Homo sapiens
acuccagccccacagccucagc

SEQ ID NO: 19685 - RNA, 23 nt, Homo sapiens
caagucuuauuugagcaccuguu

SEQ ID NO: 19686 - RNA, 22 nt, Homo sapiens
uuagggcccuggcuccaucucc

SEQ ID NO: 19687 - RNA, 23 nt, Homo sapiens
uaaggugcaucuagugcaguuag

SEQ ID NO: 19688 - RNA, 22 nt, Homo sapiens
cuggcccucucugcccuuccgu

SEQ ID NO: 19689 - RNA, 23 nt, Homo sapiens
uggugcggagagggcccacagug

SEQ ID NO: 19690 - RNA, 23 nt, Homo sapiens
uggaagacuagugauuuuguugu

SEQ ID NO: 19691 - RNA, 24 nt, Homo sapiens
uggggagcugaggcucugggggug

SEQ ID NO: 19692 - RNA, 21 nt, Homo sapiens
uaaagugcugacagugcagau

SEQ ID NO: 19693 - RNA, 20 nt, Homo sapiens
ucacuguucagacaggcgga

SEQ ID NO: 19694 - RNA, 24 nt, Homo sapiens
uugcagcugccugggagugacuuc

SEQ ID NO: 19695 - RNA, 21 nt, Homo sapiens
uccugcgcgucccagaugccc

SEQ ID NO: 19696 - RNA, 23 nt, Homo sapiens
ugaguaccgccaugucuguuggg

SEQ ID NO: 19697 - RNA, 20 nt, Homo sapiens
ccuccugcccuccuugcugu

SEQ ID NO: 19698 - RNA, 22 nt, Homo sapiens
uagcuuaucagacugauguuga

SEQ ID NO: 19699 - RNA, 22 nt, Homo sapiens
cacuagauugugagcuccugga

SEQ ID NO: 19700 - RNA, 19 nt, Homo sapiens
aagcagcugccucugaggc

SEQ ID NO: 19701 - RNA, 21 nt, Homo sapiens
aauggcgccacuaggguugug

SEQ ID NO: 19702 - RNA, 23 nt, Homo sapiens
aaggagcuuacaaucuagcuggg

SEQ ID NO: 19703 - RNA, 23 nt, Homo sapiens
guccaguuuucccaggaaucccu

SEQ ID NO: 19704 - RNA, 22 nt, Homo sapiens
cuccuauaugaugccuuucuuc

SEQ ID NO: 19705 - RNA, 21 nt, Homo sapiens
uugaaaggcuauuucuugguc

SEQ ID NO: 19706 - RNA, 22 nt, Homo sapiens
ugaguauuacauggccaaucuc

SEQ ID NO: 19707 - RNA, 23 nt, Homo sapiens
uacuccagagggcgucacucaug

SEQ ID NO: 19708 - RNA, 23 nt, Homo sapiens
ugagugugugugugugagugugu

SEQ ID NO: 19709 - RNA, 23 nt, Homo sapiens
aggaagcccuggaggggcuggag

SEQ ID NO: 19710 - RNA, 22 nt, Homo sapiens
aaaucucugcaggcaaauguga

SEQ ID NO: 19711 - RNA, 22 nt, Homo sapiens
agaggcuggccgugaugaauuc

SEQ ID NO: 19712 - RNA, 22 nt, Homo sapiens
uccgagccugggucucccucuu

SEQ ID NO: 19713 - RNA, 24 nt, Homo sapiens
gaccuggacauguuugugcccagu

SEQ ID NO: 19714 - RNA, 21 nt, Homo sapiens
ucuaguaagaguggcagucga

SEQ ID NO: 19715 - RNA, 20 nt, Homo sapiens
uaaagagcccuguggagaca

SEQ ID NO: 19716 - RNA, 22 nt, Homo sapiens
ucuacaaaggaaagcgcuuucu

SEQ ID NO: 19717 - RNA, 21 nt, Homo sapiens
gguuugguccuagccuuucua

SEQ ID NO: 19718 - RNA, 22 nt, Homo sapiens
caaaguuuaagauccuugaagu

SEQ ID NO: 19719 - RNA, 19 nt, Homo sapiens
aguguggcuuucuuagagc

SEQ ID NO: 19720 - RNA, 23 nt, Homo sapiens
ucaaaugcucagacuccuguggu

SEQ ID NO: 19721 - RNA, 22 nt, Homo sapiens
cccugugcccggcccacuucug

SEQ ID NO: 19722 - RNA, 23 nt, Homo sapiens
uaaagugcuuauagugcagguag

SEQ ID NO: 19723 - RNA, 21 nt, Homo sapiens
aggggugcuaucugugauuga

SEQ ID NO: 19724 - RNA, 25 nt, Homo sapiens
agggaucgcgggcggguggcggccu

SEQ ID NO: 19725 - RNA, 22 nt, Homo sapiens
cccugugcccggcccacuucug

SEQ ID NO: 19726 - RNA, 23 nt, Homo sapiens
ugugcaaaucuaugcaaaacuga

SEQ ID NO: 19727 - RNA, 23 nt, Homo sapiens
ugugcaaauccaugcaaaacuga

SEQ ID NO: 19728 - RNA, 20 nt, Homo sapiens
uguuuugauaacaguaaugu

SEQ ID NO: 19729 - RNA, 23 nt, Homo sapiens
uaaagugcuuauagugcagguag

SEQ ID NO: 19730 - RNA, 21 nt, Homo sapiens
caagucacuagugguuccguu

SEQ ID NO: 19731 - RNA, 22 nt, Homo sapiens
uggcaguguauuguuagcuggu

SEQ ID NO: 19732 - RNA, 22 nt, Homo sapiens
uuauaauacaaccugauaagug

SEQ ID NO: 19733 - RNA, 22 nt, Homo sapiens
auauaauacaaccugcuaagug

SEQ ID NO: 19734 - RNA, 21 nt, Homo sapiens
uuuugcaccuuuuggagugaa

SEQ ID NO: 19735 - RNA, 22 nt, Homo sapiens
aaaaguacuugcggauuuugcu

SEQ ID NO: 19736 - RNA, 23 nt, Homo sapiens
guuugcacgggugggccuugucu

SEQ ID NO: 19737 - RNA, 22 nt, Homo sapiens
aagauguggaaaaauuggaauc

SEQ ID NO: 19738 - RNA, 23 nt, Homo sapiens
ucuggcuccgugucuucacuccc

SEQ ID NO: 19739 - RNA, 23 nt, Homo sapiens
cggcccgggcugcugcuguuccu

SEQ ID NO: 19740 - RNA, 22 nt, Homo sapiens
cgcaggggccgggugcucaccg

SEQ ID NO: 19741 - RNA, 23 nt, Homo sapiens
ugaguaccgccaugucuguuggg

SEQ ID NO: 19742 - RNA, 23 nt, Homo sapiens
ucuuggaguaggucauugggugg

SEQ ID NO: 19743 - RNA, 24 nt, Homo sapiens
uucuccaaaagaaagcacuuucug

SEQ ID NO: 19744 - RNA, 22 nt, Homo sapiens
aagugccuccuuuuagaguguu

SEQ ID NO: 19745 - RNA, 23 nt, Homo sapiens
aggaagcccuggaggggcuggag

SEQ ID NO: 19746 - RNA, 21 nt, Homo sapiens
uggaggagaaggaaggugaug

SEQ ID NO: 19747 - RNA, 21 nt, Homo sapiens
ccgucgccgccacccgagccg

SEQ ID NO: 19748 - RNA, 21 nt, Homo sapiens
gcccuccgcccgugcaccccg

SEQ ID NO: 19749 - RNA, 21 nt, Homo sapiens
ucgaggagcucacagucuagu

SEQ ID NO: 19750 - RNA, 22 nt, Homo sapiens
cauugcacuugucucggucuga

SEQ ID NO: 19751 - RNA, 19 nt, Homo sapiens
aggcugcggaauucaggac

SEQ ID NO: 19752 - RNA, 25 nt, Homo sapiens
ggcggagggaaguagguccguuggu

SEQ ID NO: 19753 - RNA, 22 nt, Homo sapiens
aacccguagauccgaucuugug

SEQ ID NO: 19754 - RNA, 22 nt, Homo sapiens
cacccguagaaccgaccuugcg

SEQ ID NO: 19755 - RNA, 22 nt, Homo sapiens
uuugaggcuacagugagaugug

SEQ ID NO: 19756 - RNA, 22 nt, Homo sapiens
uggacggagaacugauaagggu

SEQ ID NO: 19757 - RNA, 23 nt, Homo sapiens
ugaguaccgccaugucuguuggg

SEQ ID NO: 19758 - RNA, 21 nt, Homo sapiens
aggggugcuaucugugauuga

SEQ ID NO: 19759 - RNA, 23 nt, Homo sapiens
ugagugugugugugugagugugu

SEQ ID NO: 19760 - RNA, 23 nt, Homo sapiens
ucauagcccuguacaaugcugcu

SEQ ID NO: 19761 - RNA, 21 nt, Homo sapiens
uggcagggaggcugggagggg

SEQ ID NO: 19762 - RNA, 18 nt, Homo sapiens
aucccaccucugccacca

SEQ ID NO: 19763 - RNA, 22 nt, Homo sapiens
cagugguuuuacccuaugguag

SEQ ID NO: 19764 - RNA, 22 nt, Homo sapiens
uggagagaaaggcaguuccuga

SEQ ID NO: 19765 - RNA, 22 nt, Homo sapiens
cgcaggggccgggugcucaccg

SEQ ID NO: 19766 - RNA, 22 nt, Homo sapiens
aagcugccaguugaagaacugu

SEQ ID NO: 19767 - RNA, 21 nt, Homo sapiens
uaaagugcugacagugcagau

SEQ ID NO: 19768 - RNA, 23 nt, Homo sapiens
cagugcaaugauauugucaaagc

SEQ ID NO: 19769 - RNA, 22 nt, Homo sapiens
ugaguauuacauggccaaucuc

SEQ ID NO: 19770 - RNA, 22 nt, Homo sapiens
ccucccacacccaaggcuugca

SEQ ID NO: 19771 - RNA, 22 nt, Homo sapiens
uggugggcacagaaucuggacu

SEQ ID NO: 19772 - RNA, 21 nt, Homo sapiens
uagauaaaauauugguaccug

SEQ ID NO: 19773 - RNA, 19 nt, Homo sapiens
ugucucugcugggguuucu

SEQ ID NO: 19774 - RNA, 19 nt, Homo sapiens
aagcagcugccucugaggc

SEQ ID NO: 19775 - RNA, 22 nt, Homo sapiens
uggugggccgcagaacaugugc

SEQ ID NO: 19776 - RNA, 23 nt, Homo sapiens
uauucauuuauccccagccuaca

SEQ ID NO: 19777 - RNA, 21 nt, Homo sapiens
cgcgggugcuuacugacccuu

SEQ ID NO: 19778 - RNA, 20 nt, Homo sapiens
ggggagcuguggaagcagua

SEQ ID NO: 19779 - RNA, 21 nt, Homo sapiens
uaggacacauggucuacuucu

SEQ ID NO: 19780 - RNA, 21 nt, Homo sapiens
ucguggccuggucuccauuau

SEQ ID NO: 19781 - RNA, 17 nt, Homo sapiens
ucgccuccuccucuccc

SEQ ID NO: 19782 - RNA, 23 nt, Homo sapiens
ucuggcuccgugucuucacuccc

SEQ ID NO: 19783 - RNA, 22 nt, Homo sapiens
ucaggccaggcacaguggcuca

SEQ ID NO: 19784 - RNA, 21 nt, Homo sapiens
aggggugcuaucugugauuga

SEQ ID NO: 19785 - RNA, 23 nt, Homo sapiens
ugaggggcagagagcgagacuuu

SEQ ID NO: 19786 - RNA, 20 nt, Homo sapiens
guugugucaguuuaucaaac

SEQ ID NO: 19787 - RNA, 24 nt, Homo sapiens
ugccugggucucuggccugcgcgu

SEQ ID NO: 19788 - RNA, 23 nt, Homo sapiens
uggugcggagagggcccacagug

SEQ ID NO: 19789 - RNA, 22 nt, Homo sapiens
ugcggggcuagggcuaacagca

SEQ ID NO: 19790 - RNA, 20 nt, Homo sapiens
uacaguauagaugauguacu

SEQ ID NO: 19791 - RNA, 21 nt, Homo sapiens
gcccuccgcccgugcaccccg

SEQ ID NO: 19792 - RNA, 21 nt, Homo sapiens
ucgaggagcucacagucuagu

SEQ ID NO: 19793 - RNA, 23 nt, Homo sapiens
cggcccgggcugcugcuguuccu

SEQ ID NO: 19794 - RNA, 22 nt, Homo sapiens
ugcggggcuagggcuaacagca

SEQ ID NO: 19795 - RNA, 23 nt, Homo sapiens
cgggucggaguuagcucaagcgg

SEQ ID NO: 19796 - RNA, 23 nt, Homo sapiens
ccugcagcgacuugauggcuucc

SEQ ID NO: 19797 - RNA, 23 nt, Homo sapiens
uacccuguagaaccgaauuugug

SEQ ID NO: 19798 - RNA, 21 nt, Homo sapiens
aagcauucuuucauugguugg

SEQ ID NO: 19799 - RNA, 22 nt, Homo sapiens
uguaacagcaacuccaugugga

SEQ ID NO: 19800 - RNA, 22 nt, Homo sapiens
uguaacagcaacuccaugugga

SEQ ID NO: 19801 - RNA, 21 nt, Homo sapiens
uugugcuugaucuaaccaugu

SEQ ID NO: 19802 - RNA, 21 nt, Homo sapiens
ugucuugcaggccgucaugca

SEQ ID NO: 19803 - RNA, 21 nt, Homo sapiens
aacaggugacugguuagacaa

SEQ ID NO: 19804 - RNA, 22 nt, Homo sapiens
uaacugguugaacaacugaacc

SEQ ID NO: 19805 - RNA, 22 nt, Homo sapiens
uaacacugucugguaaagaugg

SEQ ID NO: 19806 - RNA, 22 nt, Homo sapiens
cucccacugcuucacuugacua

SEQ ID NO: 19807 - RNA, 23 nt, Homo sapiens
agguuacccgagcaacuuugcau

SEQ ID NO: 19808 - RNA, 21 nt, Homo sapiens
aggaggcagcgcucucaggac

SEQ ID NO: 19809 - RNA, 22 nt, Homo sapiens
ugcaacgaaccugagccacuga

SEQ ID NO: 19810 - RNA, 21 nt, Homo sapiens
cccggagccaggaugcagcuc

SEQ ID NO: 19811 - RNA, 22 nt, Homo sapiens
acccgucccguucguccccgga

SEQ ID NO: 19812 - RNA, 17 nt, Homo sapiens
ucgccuccuccucuccc

SEQ ID NO: 19813 - RNA, 22 nt, Homo sapiens
uggagagaaaggcaguuccuga

SEQ ID NO: 19814 - RNA, 21 nt, Homo sapiens
cggcggggacggcgauugguc

SEQ ID NO: 19815 - RNA, 22 nt, Homo sapiens
cauugcacuugucucggucuga

SEQ ID NO: 19816 - RNA, 23 nt, Homo sapiens
ugaggggcagagagcgagacuuu

SEQ ID NO: 19817 - RNA, 19 nt, Homo sapiens
ugagcugcuguaccaaaau

SEQ ID NO: 19818 - RNA, 22 nt, Homo sapiens
aggcggggcgccgcgggaccgc

SEQ ID NO: 19819 - RNA, 22 nt, Homo sapiens
ugcggggcuagggcuaacagca

SEQ ID NO: 19820 - RNA, 22 nt, Homo sapiens
ugagguaguagguuguauaguu

SEQ ID NO: 19821 - RNA, 22 nt, Homo sapiens
ugagguaguagguugugugguu

SEQ ID NO: 19822 - RNA, 22 nt, Homo sapiens
ugagguaguagguuguaugguu

SEQ ID NO: 19823 - RNA, 22 nt, Homo sapiens
agagguaguagguugcauaguu

SEQ ID NO: 19824 - RNA, 22 nt, Homo sapiens
ugagguaggagguuguauaguu

SEQ ID NO: 19825 - RNA, 22 nt, Homo sapiens
ugagguaguagauuguauaguu

SEQ ID NO: 19826 - RNA, 22 nt, Homo sapiens
ugagguaguaguuuguacaguu

SEQ ID NO: 19827 - RNA, 22 nt, Homo sapiens
ugagguaguaguuugugcuguu

SEQ ID NO: 19828 - RNA, 22 nt, Homo sapiens
ucgugucuuguguugcagccgg

SEQ ID NO: 19829 - RNA, 22 nt, Homo sapiens
uaugugggaugguaaaccgcuu

SEQ ID NO: 19830 - RNA, 21 nt, Homo sapiens
ugguagacuauggaacguagg

SEQ ID NO: 19831 - RNA, 22 nt, Homo sapiens
uggugggcacagaaucuggacu

SEQ ID NO: 19832 - RNA, 22 nt, Homo sapiens
uggugggccgcagaacaugugc

SEQ ID NO: 19833 - RNA, 20 nt, Homo sapiens
cggcucugggucugugggga

SEQ ID NO: 19834 - RNA, 22 nt, Homo sapiens
ugagguaguaaguuguauuguu

SEQ ID NO: 19835 - RNA, 21 nt, Homo sapiens
ucguggccuggucuccauuau

SEQ ID NO: 19836 - RNA, 22 nt, Homo sapiens
uggagugugacaaugguguuug

SEQ ID NO: 19837 - RNA, 17 nt, Homo sapiens
ucgccuccuccucuccc

SEQ ID NO: 19838 - RNA, 21 nt, Homo sapiens
uugggacauacuuaugcuaaa

SEQ ID NO: 19839 - RNA, 22 nt, Homo sapiens
cuggcccucucugcccuuccgu

SEQ ID NO: 19840 - RNA, 21 nt, Homo sapiens
ucacuccucuccucccgucuu

SEQ ID NO: 19841 - RNA, 21 nt, Homo sapiens
caaagaggaaggucccauuac

SEQ ID NO: 19842 - RNA, 21 nt, Homo sapiens
uaauuuuauguauaagcuagu

SEQ ID NO: 19843 - RNA, 21 nt, Homo sapiens
guggcugcacucacuuccuuc

SEQ ID NO: 19844 - RNA, 22 nt, Homo sapiens
gguggcccggccgugccugagg

SEQ ID NO: 19845 - RNA, 21 nt, Homo sapiens
aaggcagggcccccgcucccc

SEQ ID NO: 19846 - RNA, 21 nt, Homo sapiens
ccccaccuccucucuccucag

SEQ ID NO: 19847 - RNA, 21 nt, Homo sapiens
acucuagcugccaaaggcgcu

SEQ ID NO: 19848 - RNA, 18 nt, Homo sapiens
aucccaccucugccacca

SEQ ID NO: 19849 - RNA, 22 nt, Homo sapiens
caaagaauucuccuuuugggcu

SEQ ID NO: 19850 - RNA, 22 nt, Homo sapiens
uggcaguguauuguuagcuggu

SEQ ID NO: 19851 - RNA, 23 nt, Homo sapiens
uaagugcuuccauguuuugguga

SEQ ID NO: 19852 - RNA, 22 nt, Homo sapiens
uguaaacauccuacacucagcu

SEQ ID NO: 19853 - RNA, 23 nt, Homo sapiens
gcaaagcacacggccugcagaga

SEQ ID NO: 19854 - RNA, 21 nt, Homo sapiens
uugaaaggcuauuucuugguc

SEQ ID NO: 19855 - RNA, 22 nt, Homo sapiens
ugaguauuacauggccaaucuc

SEQ ID NO: 19856 - RNA, 22 nt, Homo sapiens
aagugcuuccuuuuagaggguu

SEQ ID NO: 19857 - RNA, 22 nt, Homo sapiens
ccucccacacccaaggcuugca

SEQ ID NO: 19858 - RNA, 21 nt, Homo sapiens
uggaggagaaggaaggugaug

SEQ ID NO: 19859 - RNA, 21 nt, Homo sapiens
ccccaccuccucucuccucag

SEQ ID NO: 19860 - RNA, 22 nt, Homo sapiens
acccgucccguucguccccgga

SEQ ID NO: 19861 - RNA, 21 nt, Homo sapiens
uccugcgcgucccagaugccc

SEQ ID NO: 19862 - RNA, 22 nt, Homo sapiens
uggagagaaaggcaguuccuga

SEQ ID NO: 19863 - RNA, 22 nt, Homo sapiens
ucgugcaucccuuuagaguguu

SEQ ID NO: 19864 - RNA, 22 nt, Homo sapiens
ugagaaccacgucugcucugag

SEQ ID NO: 19865 - RNA, 24 nt, Homo sapiens
ugccugggucucuggccugcgcgu

SEQ ID NO: 19866 - RNA, 22 nt, Homo sapiens
uggagugugacaaugguguuug

SEQ ID NO: 19867 - RNA, 22 nt, Homo sapiens
uaacacugucugguaaagaugg

SEQ ID NO: 19868 - RNA, 22 nt, Homo sapiens
uaacacugucugguaacgaugu

SEQ ID NO: 19869 - RNA, 22 nt, Homo sapiens
uccuucauuccaccggagucug

SEQ ID NO: 19870 - RNA, 21 nt, Homo sapiens
gcgacccacucuugguuucca

SEQ ID NO: 19871 - RNA, 21 nt, Homo sapiens
gcgacccauacuugguuucag

SEQ ID NO: 19872 - RNA, 23 nt, Homo sapiens
uaaaucccauggugccuucuccu

SEQ ID NO: 19873 - RNA, 23 nt, Homo sapiens
ggcagguucucacccucucuagg

SEQ ID NO: 19874 - RNA, 21 nt, Homo sapiens
uacucaaaaagcugucaguca

SEQ ID NO: 19875 - RNA, 21 nt, Homo sapiens
uacucaaaaagcugucaguca

SEQ ID NO: 19876 - RNA, 23 nt, Homo sapiens
ucauagcccuguacaaugcugcu

SEQ ID NO: 19877 - RNA, 19 nt, Homo sapiens
gaugaugcugcugaugcug

SEQ ID NO: 19878 - RNA, 22 nt, Homo sapiens
uagcagcacauaaugguuugug

SEQ ID NO: 19879 - RNA, 23 nt, Homo sapiens
uaaggugcaucuagugcagauag

SEQ ID NO: 19880 - RNA, 22 nt, Homo sapiens
cccugugcccggcccacuucug

SEQ ID NO: 19881 - RNA, 22 nt, Homo sapiens
ucaggccaggcacaguggcuca

SEQ ID NO: 19882 - RNA, 23 nt, Homo sapiens
cccaguguucagacuaccuguuc

SEQ ID NO: 19883 - RNA, 23 nt, Homo sapiens
cccaguguuuagacuaucuguuc

SEQ ID NO: 19884 - RNA, 23 nt, Homo sapiens
uaauacugccggguaaugaugga

SEQ ID NO: 19885 - RNA, 22 nt, Homo sapiens
uggcucaguucagcaggaacag

SEQ ID NO: 19886 - RNA, 22 nt, Homo sapiens
agaggcuggccgugaugaauuc

SEQ ID NO: 19887 - RNA, 23 nt, Homo sapiens
agugccugagggaguaagagccc

SEQ ID NO: 19888 - RNA, 21 nt, Homo sapiens
guggcugcacucacuuccuuc

SEQ ID NO: 19889 - RNA, 21 nt, Homo sapiens
gcaggaacuugugagucuccu

SEQ ID NO: 19890 - RNA, 22 nt, Homo sapiens
cugcccuggcccgagggaccga

SEQ ID NO: 19891 - RNA, 22 nt, Homo sapiens
ucugggcaacaaagugagaccu

SEQ ID NO: 19892 - RNA, 20 nt, Homo sapiens
ccccagggcgacgcggcggg

SEQ ID NO: 19893 - RNA, 23 nt, Homo sapiens
caacggaaucccaaaagcagcug

SEQ ID NO: 19894 - RNA, 23 nt, Homo sapiens
ugucugcccgcaugccugccucu

SEQ ID NO: 19895 - RNA, 21 nt, Homo sapiens
gugucuuuugcucugcaguca

SEQ ID NO: 19896 - RNA, 25 nt, Homo sapiens
gcugggcagggcuucugagcuccuu

SEQ ID NO: 19897 - RNA, 22 nt, Homo sapiens
gugagucucuaagaaaagagga

SEQ ID NO: 19898 - RNA, 21 nt, Homo sapiens
aggaggcagcgcucucaggac

SEQ ID NO: 19899 - RNA, 22 nt, Homo sapiens
acuccagccccacagccucagc

SEQ ID NO: 19900 - RNA, 23 nt, Homo sapiens
ucauagcccuguacaaugcugcu

SEQ ID NO: 19901 - RNA, 20 nt, Homo sapiens
gugucugggcggacagcugc

SEQ ID NO: 19902 - RNA, 27 nt, Homo sapiens
accuucuuguauaagcacugugcuaaa

SEQ ID NO: 19903 - RNA, 22 nt, Homo sapiens
uggguggucuggagauuugugc

SEQ ID NO: 19904 - RNA, 22 nt, Homo sapiens
gguccagaggggagauagguuc

SEQ ID NO: 19905 - RNA, 22 nt, Homo sapiens
cugugcgugugacagcggcuga

SEQ ID NO: 19906 - RNA, 22 nt, Homo sapiens
aucacacaaaggcaacuuuugu

SEQ ID NO: 19907 - RNA, 21 nt, Homo sapiens
acuggacuuggagucagaagg

SEQ ID NO: 19908 - RNA, 22 nt, Homo sapiens
acuggacuuagggucagaaggc

SEQ ID NO: 19909 - RNA, 21 nt, Homo sapiens
uggaggagaaggaaggugaug

SEQ ID NO: 19910 - RNA, 22 nt, Homo sapiens
uggugguuuacaaaguaauuca

SEQ ID NO: 19911 - RNA, 22 nt, Homo sapiens
caaagugccucccuuuagagug

SEQ ID NO: 19912 - RNA, 20 nt, Homo sapiens
ggggagcuguggaagcagua

SEQ ID NO: 19913 - RNA, 19 nt, Homo sapiens
gugaggacucgggaggugg

SEQ ID NO: 19914 - RNA, 22 nt, Homo sapiens
cuggacugagccgugcuacugg

SEQ ID NO: 19915 - RNA, 22 nt, Homo sapiens
ugugacugguugaccagagggg

SEQ ID NO: 19916 - RNA, 20 nt, Homo sapiens
guguguggaaaugcuucugc

SEQ ID NO: 19917 - RNA, 25 nt, Homo sapiens
cccccacaaccgcgcuugacuagcu

SEQ ID NO: 19918 - RNA, 21 nt, Homo sapiens
uucacaguggcuaaguuccgc

SEQ ID NO: 19919 - RNA, 21 nt, Homo sapiens
uucacaguggcuaaguucugc

SEQ ID NO: 19920 - RNA, 22 nt, Homo sapiens
uuuugcaauauguuccugaaua

SEQ ID NO: 19921 - RNA, 22 nt, Homo sapiens
uuuugcaauauguuccugaaua

SEQ ID NO: 19922 - RNA, 21 nt, Homo sapiens
gcaguccaugggcauauacac

SEQ ID NO: 19923 - RNA, 20 nt, Homo sapiens
cugcaaagggaagcccuuuc

SEQ ID NO: 19924 - RNA, 20 nt, Homo sapiens
cugcaaagggaagcccuuuc

SEQ ID NO: 19925 - RNA, 20 nt, Homo sapiens
cugcaaagggaagcccuuuc

SEQ ID NO: 19926 - RNA, 20 nt, Homo sapiens
cugcaaagggaagcccuuuc

SEQ ID NO: 19927 - RNA, 22 nt, Homo sapiens
aaaaguauuugcggguuuuguc

SEQ ID NO: 19928 - RNA, 22 nt, Homo sapiens
caaaaguaauuguggauuuugu

SEQ ID NO: 19929 - RNA, 20 nt, Homo sapiens
aggguguuucucucaucucu

SEQ ID NO: 19930 - RNA, 23 nt, Homo sapiens
ucuuugguuaucuagcuguauga

SEQ ID NO: 19931 - RNA, 21 nt, Homo sapiens
cugacuguugccguccuccag

SEQ ID NO: 19932 - RNA, 23 nt, Homo sapiens
ccugcagcgacuugauggcuucc

SEQ ID NO: 19933 - RNA, 20 nt, Homo sapiens
ucugcaggguuugcuuugag

SEQ ID NO: 19934 - RNA, 18 nt, Homo sapiens
ucagcuggcccucauuuc

SEQ ID NO: 19935 - RNA, 18 nt, Homo sapiens
cagggaggugaaugugau

SEQ ID NO: 19936 - RNA, 23 nt, Homo sapiens
ucuggcuccgugucuucacuccc

SEQ ID NO: 19937 - RNA, 21 nt, Homo sapiens
cggcggggacggcgauugguc

SEQ ID NO: 19938 - RNA, 22 nt, Homo sapiens
cgcaggggccgggugcucaccg

SEQ ID NO: 19939 - RNA, 22 nt, Homo sapiens
ugggucuuugcgggcgagauga

SEQ ID NO: 19940 - RNA, 22 nt, Homo sapiens
aagcugccaguugaagaacugu

SEQ ID NO: 19941 - RNA, 22 nt, Homo sapiens
caaucacuaacuccacugccau

SEQ ID NO: 19942 - RNA, 23 nt, Homo sapiens
ugaggggcagagagcgagacuuu

SEQ ID NO: 19943 - RNA, 22 nt, Homo sapiens
agacccuggucugcacucuauc

SEQ ID NO: 19944 - RNA, 20 nt, Homo sapiens
guccgcucggcgguggccca

SEQ ID NO: 19945 - RNA, 22 nt, Homo sapiens
aggcggggcgccgcgggaccgc

SEQ ID NO: 19946 - RNA, 21 nt, Homo sapiens
gaaggcgcuucccuuuggagu

SEQ ID NO: 19947 - RNA, 21 nt, Homo sapiens
cccggagccaggaugcagcuc

SEQ ID NO: 19948 - RNA, 22 nt, Homo sapiens
ucuauacagacccuggcuuuuc

SEQ ID NO: 19949 - RNA, 22 nt, Homo sapiens
cucggcgcggggcgcgggcucc

SEQ ID NO: 19950 - RNA, 21 nt, Homo sapiens
uccugcgcgucccagaugccc

SEQ ID NO: 19951 - RNA, 22 nt, Homo sapiens
uaaugccccuaaaaauccuuau

SEQ ID NO: 19952 - RNA, 23 nt, Homo sapiens
ugaggggcagagagcgagacuuu

SEQ ID NO: 19953 - RNA, 23 nt, Homo sapiens
ucuuggaguaggucauugggugg

SEQ ID NO: 19954 - RNA, 20 nt, Homo sapiens
guccgcucggcgguggccca

SEQ ID NO: 19955 - RNA, 22 nt, Homo sapiens
agacuucccauuugaagguggc

SEQ ID NO: 19956 - RNA, 21 nt, Homo sapiens
aauggcgccacuaggguugug

SEQ ID NO: 19957 - RNA, 24 nt, Homo sapiens
agccuggaagcuggagccugcagu

SEQ ID NO: 19958 - RNA, 21 nt, Homo sapiens
gcccuccgcccgugcaccccg

SEQ ID NO: 19959 - RNA, 22 nt, Homo sapiens
uggcucaguucagcaggaacag

SEQ ID NO: 19960 - RNA, 22 nt, Homo sapiens
aaaagcuggguugagagggcga

SEQ ID NO: 19961 - RNA, 22 nt, Homo sapiens
aaaagcuggguugagagggcaa

SEQ ID NO: 19962 - RNA, 20 nt, Homo sapiens
aaaagcuggguugagagggu

SEQ ID NO: 19963 - RNA, 19 nt, Homo sapiens
aaaagcuggguugagagga

SEQ ID NO: 19964 - RNA, 22 nt, Homo sapiens
aauugcacgguauccaucugua

SEQ ID NO: 19965 - RNA, 20 nt, Homo sapiens
guccgcucggcgguggccca

SEQ ID NO: 19966 - RNA, 25 nt, Homo sapiens
ggcggagggaaguagguccguuggu

SEQ ID NO: 19967 - RNA, 22 nt, Homo sapiens
aggcagcgggguguaguggaua

SEQ ID NO: 19968 - RNA, 21 nt, Homo sapiens
cacuguguccuuucugcguag

SEQ ID NO: 19969 - RNA, 21 nt, Homo sapiens
gugccagcugcagugggggag

SEQ ID NO: 19970 - RNA, 22 nt, Homo sapiens
ccucuuccccuugucucuccag

SEQ ID NO: 19971 - RNA, 18 nt, Homo sapiens
gucccuguucaggcgcca

SEQ ID NO: 19972 - RNA, 21 nt, Homo sapiens
ccaguccugugccugccgccu

SEQ ID NO: 19973 - RNA, 23 nt, Homo sapiens
ugaguaccgccaugucuguuggg

SEQ ID NO: 19974 - RNA, 23 nt, Homo sapiens
ucccuguccuccaggagcucacg

SEQ ID NO: 19975 - RNA, 23 nt, Homo sapiens
agguuacccgagcaacuuugcau

SEQ ID NO: 19976 - RNA, 23 nt, Homo sapiens
ugaggggcagagagcgagacuuu

SEQ ID NO: 19977 - RNA, 22 nt, Homo sapiens
ucaggcucaguccccucccgau

SEQ ID NO: 19978 - RNA, 21 nt, Homo sapiens
aaagcgcuucccuucagagug

SEQ ID NO: 19979 - RNA, 22 nt, Homo sapiens
aggcagcgggguguaguggaua

SEQ ID NO: 19980 - RNA, 22 nt, Homo sapiens
ucggauccgucugagcuuggcu

SEQ ID NO: 19981 - RNA, 23 nt, Homo sapiens
ucuggcuccgugucuucacuccc

SEQ ID NO: 19982 - RNA, 21 nt, Homo sapiens
aucacauugccagggauuucc

SEQ ID NO: 19983 - RNA, 21 nt, Homo sapiens
aucacauugccagggauuacc

SEQ ID NO: 19984 - RNA, 22 nt, Homo sapiens
uguaaacauccuacacucagcu

SEQ ID NO: 19985 - RNA, 21 nt, Homo sapiens
aggggugcuaucugugauuga

SEQ ID NO: 19986 - RNA, 23 nt, Homo sapiens
agugccugagggaguaagagccc

SEQ ID NO: 19987 - RNA, 19 nt, Homo sapiens
aggcugcggaauucaggac

SEQ ID NO: 19988 - RNA, 21 nt, Homo sapiens
acagucugcugagguuggagc

SEQ ID NO: 19989 - RNA, 22 nt, Homo sapiens
caaagugccucccuuuagagug

SEQ ID NO: 19990 - RNA, 24 nt, Homo sapiens
uggggagcugaggcucugggggug

SEQ ID NO: 19991 - RNA, 21 nt, Homo sapiens
gcaguccaugggcauauacac

SEQ ID NO: 19992 - RNA, 23 nt, Homo sapiens
cggcccgggcugcugcuguuccu

SEQ ID NO: 19993 - RNA, 20 nt, Homo sapiens
ggggagcuguggaagcagua

SEQ ID NO: 19994 - RNA, 23 nt, Homo sapiens
acuugggcacugaaacaaugucc

SEQ ID NO: 19995 - RNA, 24 nt, Homo sapiens
gaccuggacauguuugugcccagu

SEQ ID NO: 19996 - RNA, 20 nt, Homo sapiens
auggagauagauauagaaau

SEQ ID NO: 19997 - RNA, 17 nt, Homo sapiens
ucgccuccuccucuccc

SEQ ID NO: 19998 - RNA, 22 nt, Homo sapiens
ucaccagcccuguguucccuag

SEQ ID NO: 19999 - RNA, 22 nt, Homo sapiens
gcugacuccuaguccagggcuc

SEQ ID NO: 20000 - RNA, 23 nt, Homo sapiens
ucuuugguuaucuagcuguauga

SEQ ID NO: 20001 - RNA, 22 nt, Homo sapiens
ucccucacacagaauuccagaa

SEQ ID NO: 20002 - RNA, 22 nt, Homo sapiens
agagcaagaccccgucucuaaa

SEQ ID NO: 20003 - RNA, 22 nt, Homo sapiens
aacccauggaauucaguucuca

SEQ ID NO: 20004 - RNA, 20 nt, Homo sapiens
gcagaagcauuuccacacac

SEQ ID NO: 20005 - RNA, 22 nt, Homo sapiens
cacaaaccauuaugugcugcua

SEQ ID NO: 20006 - RNA, 22 nt, Homo sapiens
uacagauggauaccgugcaauu

SEQ ID NO: 20007 - RNA, 23 nt, Homo sapiens
acacucuaaagagaagcgcuuug

SEQ ID NO: 20008 - RNA, 21 nt, Homo sapiens
agaaaguacuucccucuggag

SEQ ID NO: 20009 - RNA, 21 nt, Homo sapiens
agaaagugcaucccucuggag

SEQ ID NO: 20010 - RNA, 22 nt, Homo sapiens
aagaagugcaccgcgaauguuu

SEQ ID NO: 20011 - RNA, 21 nt, Homo sapiens
acugaucuagagaacacaaga

SEQ ID NO: 20012 - RNA, 19 nt, Homo sapiens
agaaaccccagcagagaca

SEQ ID NO: 20013 - RNA, 22 nt, Homo sapiens
cugcucaaacccuccaaugacu

SEQ ID NO: 20014 - RNA, 22 nt, Homo sapiens
agcucagaacccagaggucuca

SEQ ID NO: 20015 - RNA, 21 nt, Homo sapiens
cacaaccucaguguuuccagg

SEQ ID NO: 20016 - RNA, 21 nt, Homo sapiens
uuccacgaccuaauccuaacu

SEQ ID NO: 20017 - RNA, 24 nt, Homo sapiens
ucacagguuaaagggucucaggga

SEQ ID NO: 20018 - RNA, 22 nt, Homo sapiens
ucacaaguuagggucucaggga

SEQ ID NO: 20019 - RNA, 23 nt, Homo sapiens
agcccuguucuacagcccugagg

SEQ ID NO: 20020 - RNA, 24 nt, Homo sapiens
acugcuggucuucagucagggcca

SEQ ID NO: 20021 - RNA, 22 nt, Homo sapiens
ucacauuugccugcagagauuu

SEQ ID NO: 20022 - RNA, 20 nt, Homo sapiens
cuggaggaagggcccagagg

SEQ ID NO: 20023 - RNA, 22 nt, Homo sapiens
gccuaagacacaggcccagaga

SEQ ID NO: 20024 - RNA, 22 nt, Homo sapiens
caaaagucaagcuuauccuaaa

SEQ ID NO: 20025 - RNA, 23 nt, Homo sapiens
cccagcuagauuguaagcuccuu

SEQ ID NO: 20026 - RNA, 22 nt, Homo sapiens
uccggggacgaacgggacgggu

SEQ ID NO: 20027 - RNA, 23 nt, Homo sapiens
acacagcucuuccauaucuccag

SEQ ID NO: 20028 - RNA, 17 nt, Homo sapiens
gacagccucucccccac

SEQ ID NO: 20029 - RNA, 24 nt, Homo sapiens
acugcuggucuucagucagggcca

SEQ ID NO: 20030 - RNA, 23 nt, Homo sapiens
ccacccaaugaccuacuccaaga

SEQ ID NO: 20031 - RNA, 24 nt, Homo sapiens
cagaaagugcuuucuuuuggagaa

SEQ ID NO: 20032 - RNA, 22 nt, Homo sapiens
aacacucuaaaaggaggcacuu

SEQ ID NO: 20033 - RNA, 21 nt, Homo sapiens
acuggcugagucaggacuagc

SEQ ID NO: 20034 - RNA, 20 nt, Homo sapiens
auuucuauaucuaucuccau

SEQ ID NO: 20035 - RNA, 21 nt, Homo sapiens
gagcugcauccuggcuccggg

SEQ ID NO: 20036 - RNA, 22 nt, Homo sapiens
cugggggcggcacaggggcuca

SEQ ID NO: 20037 - RNA, 22 nt, Homo sapiens
gugggguggguggucaggccga

SEQ ID NO: 20038 - RNA, 24 nt, Homo sapiens
acugcaggcuccagcuuccaggcu

SEQ ID NO: 20039 - RNA, 17 nt, Homo sapiens
gggagaggaggaggcga

SEQ ID NO: 20040 - RNA, 25 nt, Homo sapiens
cagcgucugccggaacccguuccca

SEQ ID NO: 20041 - RNA, 21 nt, Homo sapiens
gaccaaucgccguccccgccg

SEQ ID NO: 20042 - RNA, 21 nt, Homo sapiens
acaggauugagggggggcccu

SEQ ID NO: 20043 - RNA, 21 nt, Homo sapiens
acaggauugagggggggcccu

SEQ ID NO: 20044 - RNA, 22 nt, Homo sapiens
gcggucccgcggcgccccgccu

SEQ ID NO: 20045 - RNA, 22 nt, Homo sapiens
ugcuguuagcccuagccccgca

SEQ ID NO: 20046 - RNA, 22 nt, Homo sapiens
agugaauucuaccagugccaua

SEQ ID NO: 20047 - RNA, 23 nt, Homo sapiens
cuaucugcacuagaugcaccuua

SEQ ID NO: 20048 - RNA, 22 nt, Homo sapiens
accuaauauaucaaacauauca

SEQ ID NO: 20049 - RNA, 20 nt, Homo sapiens
gcaaugcaacagcaaugcac

SEQ ID NO: 20050 - RNA, 21 nt, Homo sapiens
aagacgggaggagaggaguga

SEQ ID NO: 20051 - RNA, 22 nt, Homo sapiens
aacgcuccaaaagaaggcacuc

SEQ ID NO: 20052 - RNA, 22 nt, Homo sapiens
aacacucuaaaaggaggcacuu

SEQ ID NO: 20053 - RNA, 21 nt, Homo sapiens
caucaccuuccuucuccucca

SEQ ID NO: 20054 - RNA, 22 nt, Homo sapiens
uggcagcagcggagggggcaga

SEQ ID NO: 20055 - RNA, 22 nt, Homo sapiens
acaguucuucaacuggcagcuu

SEQ ID NO: 20056 - RNA, 22 nt, Homo sapiens
acaguucuucaacuggcagcuu

SEQ ID NO: 20057 - RNA, 20 nt, Homo sapiens
ccagcagcaccuggggcagu

SEQ ID NO: 20058 - RNA, 23 nt, Homo sapiens
acaccaaugcccuaggggaugcg

SEQ ID NO: 20059 - RNA, 23 nt, Homo sapiens
aaagucucgcucucugccccuca

SEQ ID NO: 20060 - RNA, 21 nt, Homo sapiens
auccuguacugagcugccccg

SEQ ID NO: 20061 - RNA, 22 nt, Homo sapiens
ccucauggaaggguuccccacu

SEQ ID NO: 20062 - RNA, 24 nt, Homo sapiens
cagaaagugcuuucuuuuggagaa

SEQ ID NO: 20063 - RNA, 23 nt, Homo sapiens
acacucuaaagagaagcgcuuug

SEQ ID NO: 20064 - RNA, 22 nt, Homo sapiens
aacacucuaaaaggaggcacuu

SEQ ID NO: 20065 - RNA, 21 nt, Homo sapiens
agaaaguacuucccucuggag

SEQ ID NO: 20066 - RNA, 21 nt, Homo sapiens
agaaagugcaucccucuggag

SEQ ID NO: 20067 - RNA, 21 nt, Homo sapiens
ggacuauagaacuuucccccu

SEQ ID NO: 20068 - RNA, 22 nt, Homo sapiens
cugggggcggcacaggggcuca

SEQ ID NO: 20069 - RNA, 22 nt, Homo sapiens
caaacaccauugucacacucca

SEQ ID NO: 20070 - RNA, 24 nt, Homo sapiens
acugcaggcuccagcuuccaggcu

SEQ ID NO: 20071 - RNA, 18 nt, Homo sapiens
cccccaccaccacgcccg

SEQ ID NO: 20072 - RNA, 21 nt, Homo sapiens
gaccaaucgccguccccgccg

SEQ ID NO: 20073 - RNA, 22 nt, Homo sapiens
ugagccacugugccuggccuga

SEQ ID NO: 20074 - RNA, 22 nt, Homo sapiens
aaagagguuaaccagguguguu

SEQ ID NO: 20075 - RNA, 23 nt, Homo sapiens
aaaucagaaucacaccuggggga

SEQ ID NO: 20076 - RNA, 22 nt, Homo sapiens
ugaauccuugaauagguguguu

SEQ ID NO: 20077 - RNA, 20 nt, Homo sapiens
ugggccaccgccgagcggac

SEQ ID NO: 20078 - RNA, 24 nt, Homo sapiens
acgcagagcccgaaagcccccagu

SEQ ID NO: 20079 - RNA, 25 nt, Homo sapiens
accaacggaccuacuucccuccgcc

SEQ ID NO: 20080 - RNA, 22 nt, Homo sapiens
gcggucccgcggcgccccgccu

SEQ ID NO: 20081 - RNA, 22 nt, Homo sapiens
ugcuguuagcccuagccccgca

SEQ ID NO: 20082 - RNA, 21 nt, Homo sapiens
caucaccuuccuucuccucca

SEQ ID NO: 20083 - RNA, 22 nt, Homo sapiens
gcugaggcuguggggcuggagu

SEQ ID NO: 20084 - RNA, 22 nt, Homo sapiens
ucaguggcucagguucguugca

SEQ ID NO: 20085 - RNA, 22 nt, Homo sapiens
caaacaccauugucacacucca

SEQ ID NO: 20086 - RNA, 21 nt, Homo sapiens
gaccaaucgccguccccgccg

SEQ ID NO: 20087 - RNA, 22 nt, Homo sapiens
cccaacaacaugaaacuaccua

SEQ ID NO: 20088 - RNA, 23 nt, Homo sapiens
acaccaaugcccuaggggaugcg

SEQ ID NO: 20089 - RNA, 21 nt, Homo sapiens
aacuccuguaugaagccguuc

SEQ ID NO: 20090 - RNA, 22 nt, Homo sapiens
ucaccauugcuaaagugcaauu

SEQ ID NO: 20091 - RNA, 22 nt, Homo sapiens
gcggucccgcggcgccccgccu

SEQ ID NO: 20092 - RNA, 22 nt, Homo sapiens
ugcuguuagcccuagccccgca

SEQ ID NO: 20093 - RNA, 22 nt, Homo sapiens
ugcuguuagcccuagccccgca

SEQ ID NO: 20094 - RNA, 26 nt, Homo sapiens
uuucagaauuugcugccaucaucauc

SEQ ID NO: 20095 - RNA, 18 nt, Homo sapiens
cagcagccuccuucucaa

SEQ ID NO: 20096 - RNA, 18 nt, Homo sapiens
aucacauucaccucccug

SEQ ID NO: 20097 - RNA, 23 nt, Homo sapiens
gggagugaagacacggagccaga

SEQ ID NO: 20098 - RNA, 22 nt, Homo sapiens
ucaguuuccucugcaaacaguu

SEQ ID NO: 20099 - RNA, 21 nt, Homo sapiens
ggcugucaauucauaggucag

SEQ ID NO: 20100 - RNA, 21 nt, Homo sapiens
gccaauauuucugugcugcua

SEQ ID NO: 20101 - RNA, 21 nt, Homo sapiens
gucugucaauucauaggucau

SEQ ID NO: 20102 - RNA, 23 nt, Homo sapiens
acacuuacuggacaccuacuagg

SEQ ID NO: 20103 - RNA, 23 nt, Homo sapiens
ucauacagcuagauaaccaaaga

SEQ ID NO: 20104 - RNA, 23 nt, Homo sapiens
agcaaaaaugugcuagugccaaa

SEQ ID NO: 20105 - RNA, 21 nt, Homo sapiens
cuagggaagaacagugagcaa

SEQ ID NO: 20106 - RNA, 23 nt, Homo sapiens
gucacaucccucccaagacccuc

SEQ ID NO: 20107 - RNA, 23 nt, Homo sapiens
ggaagccaucaagucgcugcagg

SEQ ID NO: 20108 - RNA, 17 nt, Homo sapiens
uggcgcccgaacaggga

SEQ ID NO: 20109 - RNA, 24 nt, Homo sapiens
acugcuggucuucagucagggcca

SEQ ID NO: 20110 - RNA, 24 nt, Homo sapiens
acugcuggucuucagucagggcca

SEQ ID NO: 20111 - RNA, 22 nt, Homo sapiens
ccagaacugaguccacagggca

SEQ ID NO: 20112 - RNA, 22 nt, Homo sapiens
cacaaaccauuaugugcugcua

SEQ ID NO: 20113 - RNA, 22 nt, Homo sapiens
uguaaaccaugaugugcugcua

SEQ ID NO: 20114 - RNA, 22 nt, Homo sapiens
cgccaauauuuacgugcugcua

SEQ ID NO: 20115 - RNA, 22 nt, Homo sapiens
ucaggaacugccuuucucucca

SEQ ID NO: 20116 - RNA, 21 nt, Homo sapiens
gccaauauuucugugcugcua

SEQ ID NO: 20117 - RNA, 23 nt, Homo sapiens
gaaacccagcagacaauguagcu

SEQ ID NO: 20118 - RNA, 21 nt, Homo sapiens
gcggaacuuagccacugugaa

SEQ ID NO: 20119 - RNA, 22 nt, Homo sapiens
agcugaguguaggauguuuaca

SEQ ID NO: 20120 - RNA, 23 nt, Homo sapiens
acauuuuucguuauugcucuuga

SEQ ID NO: 20121 - RNA, 22 nt, Homo sapiens
ucaccauugcuaaagugcaauu

SEQ ID NO: 20122 - RNA, 22 nt, Homo sapiens
cacuuaucagguuguauuauaa

SEQ ID NO: 20123 - RNA, 22 nt, Homo sapiens
uucaaaacaugaauugcugcug

SEQ ID NO: 20124 - RNA, 22 nt, Homo sapiens
gaauucaucacggccagccucu

SEQ ID NO: 20125 - RNA, 21 nt, Homo sapiens
acaaaccacagugugcugcug

SEQ ID NO: 20126 - RNA, 22 nt, Homo sapiens
gauagagugcagaccagggucu

SEQ ID NO: 20127 - RNA, 19 nt, Homo sapiens
ucccacaggaagcagacac

SEQ ID NO: 20128 - RNA, 21 nt, Homo sapiens
gaaggaagugagugcagccac

SEQ ID NO: 20129 - RNA, 22 nt, Homo sapiens
aaggugauggucagcagacaua

SEQ ID NO: 20130 - RNA, 23 nt, Homo sapiens
agaaaccaugggguaugagcaga

SEQ ID NO: 20131 - RNA, 19 nt, Homo sapiens
ccaccucccgaguccucac

SEQ ID NO: 20132 - RNA, 22 nt, Homo sapiens
caaacaccauugucacacucca

SEQ ID NO: 20133 - RNA, 22 nt, Homo sapiens
ggcucccaagaaccucaccugu

SEQ ID NO: 20134 - RNA, 23 nt, Homo sapiens
acacagcucuuccauaucuccag

SEQ ID NO: 20135 - RNA, 23 nt, Homo sapiens
acacagcucuuccauaucuccag

SEQ ID NO: 20136 - RNA, 22 nt, Homo sapiens
aggucucacuuuguugcccaga

SEQ ID NO: 20137 - RNA, 21 nt, Homo sapiens
gagcuacagugcuucaucuca

SEQ ID NO: 20138 - RNA, 21 nt, Homo sapiens
gagcuacagugcuucaucuca

SEQ ID NO: 20139 - RNA, 23 nt, Homo sapiens
cuaucugcacuagaugcaccuua

SEQ ID NO: 20140 - RNA, 20 nt, Homo sapiens
cccgccgcgucgcccugggg

SEQ ID NO: 20141 - RNA, 20 nt, Homo sapiens
acagcaaggagggcaggagg

SEQ ID NO: 20142 - RNA, 22 nt, Homo sapiens
acugccugucugugccugcugu

SEQ ID NO: 20143 - RNA, 22 nt, Homo sapiens
acugccugucugugccugcugu

SEQ ID NO: 20144 - RNA, 20 nt, Homo sapiens
gcaaugcaacagcaaugcac

SEQ ID NO: 20145 - RNA, 22 nt, Homo sapiens
accagguuccaccccagcaggc

SEQ ID NO: 20146 - RNA, 22 nt, Homo sapiens
accagguuccaccccagcaggc

SEQ ID NO: 20147 - RNA, 22 nt, Homo sapiens
aacgcuccaaaagaaggcacuc

SEQ ID NO: 20148 - RNA, 22 nt, Homo sapiens
aacacucuaaaaggaggcacuu

SEQ ID NO: 20149 - RNA, 23 nt, Homo sapiens
gggcucuuacucccucaggcacu

SEQ ID NO: 20150 - RNA, 25 nt, Homo sapiens
aaggagcucagaagcccugcccagc

SEQ ID NO: 20151 - RNA, 20 nt, Homo sapiens
auuucuauaucuaucuccau

SEQ ID NO: 20152 - RNA, 20 nt, Homo sapiens
auuucuauaucuaucuccau

SEQ ID NO: 20153 - RNA, 22 nt, Homo sapiens
ccucuaguaaauaugucagcau

SEQ ID NO: 20154 - RNA, 22 nt, Homo sapiens
ucggucccucgggccagggcag

SEQ ID NO: 20155 - RNA, 22 nt, Homo sapiens
gggagaggucucccugcgcaca

SEQ ID NO: 20156 - RNA, 20 nt, Homo sapiens
cugcgggaggacagggcuca

SEQ ID NO: 20157 - RNA, 17 nt, Homo sapiens
gacagccucucccccac

SEQ ID NO: 20158 - RNA, 22 nt, Homo sapiens
ccccucuggucaaccagucaca

SEQ ID NO: 20159 - RNA, 23 nt, Homo sapiens
gggagugaagacacggagccaga

SEQ ID NO: 20160 - RNA, 22 nt, Homo sapiens
ucaggaacugccuuucucucca

SEQ ID NO: 20161 - RNA, 22 nt, Homo sapiens
uggcagcagcggagggggcaga

SEQ ID NO: 20162 - RNA, 20 nt, Homo sapiens
cccgccgcgucgcccugggg

SEQ ID NO: 20163 - RNA, 21 nt, Homo sapiens
accuauccugaauuacuugaa

SEQ ID NO: 20164 - RNA, 20 nt, Homo sapiens
ccagcagcaccuggggcagu

SEQ ID NO: 20165 - RNA, 23 nt, Homo sapiens
cgugagcuccuggaggacaggga

SEQ ID NO: 20166 - RNA, 23 nt, Homo sapiens
aaaucagaaucacaccuggggga

SEQ ID NO: 20167 - RNA, 23 nt, Homo sapiens
acccuauaagcaauauugcacua

SEQ ID NO: 20168 - RNA, 22 nt, Homo sapiens
aguccagauucugugcccacca

SEQ ID NO: 20169 - RNA, 21 nt, Homo sapiens
aguucucccaacguaaaccca

SEQ ID NO: 20170 - RNA, 24 nt, Homo sapiens
acgcagagcccgaaagcccccagu

SEQ ID NO: 20171 - RNA, 22 nt, Homo sapiens
gcacauguucugcggcccacca

SEQ ID NO: 20172 - RNA, 24 nt, Homo sapiens
cacccccagagccucagcucccca

SEQ ID NO: 20173 - RNA, 21 nt, Homo sapiens
aguagugcuuucuacuuuaug

SEQ ID NO: 20174 - RNA, 21 nt, Homo sapiens
aacggaaccacuagugacuug

SEQ ID NO: 20175 - RNA, 23 nt, Homo sapiens
ucaccaaaacauggaagcacuua

SEQ ID NO: 20176 - RNA, 21 nt, Homo sapiens
ugcaaugcaacuacaaugcac

SEQ ID NO: 20177 - RNA, 22 nt, Homo sapiens
acaccgaggagcccaucaugau

SEQ ID NO: 20178 - RNA, 22 nt, Homo sapiens
acaccgaggagcccaucaugau

SEQ ID NO: 20179 - RNA, 22 nt, Homo sapiens
uccagcaaagggaagcgcuuuc

SEQ ID NO: 20180 - RNA, 22 nt, Homo sapiens
accucuaaaggggagcgcuuug

SEQ ID NO: 20181 - RNA, 23 nt, Homo sapiens
acacucuaaagagaagcgcuuug

SEQ ID NO: 20182 - RNA, 21 nt, Homo sapiens
gcuccaaagggaagcgcuuug

SEQ ID NO: 20183 - RNA, 21 nt, Homo sapiens
cacucugaagggaagcgcuuu

SEQ ID NO: 20184 - RNA, 21 nt, Homo sapiens
cacucugaagggaagcgcuuu

SEQ ID NO: 20185 - RNA, 21 nt, Homo sapiens
ccucuaaagagaagcgcuuuc

SEQ ID NO: 20186 - RNA, 20 nt, Homo sapiens
gaaagggcuucccuuuguag

SEQ ID NO: 20187 - RNA, 22 nt, Homo sapiens
acacucuaaagggaaccauuuu

SEQ ID NO: 20188 - RNA, 22 nt, Homo sapiens
gagaaagugcuucccuuuguag

SEQ ID NO: 20189 - RNA, 22 nt, Homo sapiens
agcaaaauccgcaaguacuuuu

SEQ ID NO: 20190 - RNA, 22 nt, Homo sapiens
gacaaaacccgcaaauacuuuu

SEQ ID NO: 20191 - RNA, 22 nt, Homo sapiens
acaaaauccacaauuacuuuug

SEQ ID NO: 20192 - RNA, 21 nt, Homo sapiens
acuuuccaggauucauuaacu

SEQ ID NO: 20193 - RNA, 21 nt, Homo sapiens
cagguaccaauauuuuaucua

SEQ ID NO: 20194 - RNA, 21 nt, Homo sapiens
cagguaccaauauuuuaucua

SEQ ID NO: 20195 - RNA, 21 nt, Homo sapiens
guuauagaucuggauuugaac

SEQ ID NO: 20196 - RNA, 18 nt, Homo sapiens
gaaaugagggccagcuga

SEQ ID NO: 20197 - RNA, 19 nt, Homo sapiens
ccaccucccgaguccucac

SEQ ID NO: 20198 - RNA, 22 nt, Homo sapiens
cgaccauggcuguagacuguua

SEQ ID NO: 20199 - RNA, 23 nt, Homo sapiens
gggagugaagacacggagccaga

SEQ ID NO: 20200 - RNA, 22 nt, Homo sapiens
agcccaaaaggagaauucuuug

SEQ ID NO: 20201 - RNA, 21 nt, Homo sapiens
ggccgugacuggagacuguua

SEQ ID NO: 20202 - RNA, 22 nt, Homo sapiens
uacagauggauaccgugcaauu

SEQ ID NO: 20203 - RNA, 23 nt, Homo sapiens
gcgcccaauuaaugucuguugau

SEQ ID NO: 20204 - RNA, 22 nt, Homo sapiens
aggaaaccagcaaguguugacg

SEQ ID NO: 20205 - RNA, 22 nt, Homo sapiens
aggaaaccagcaaguguugacg

SEQ ID NO: 20206 - RNA, 21 nt, Homo sapiens
cagguaccaauauuuuaucua

SEQ ID NO: 20207 - RNA, 23 nt, Homo sapiens
ucauacagcuagauaaccaaaga

SEQ ID NO: 20208 - RNA, 22 nt, Homo sapiens
aacccauggaauucaguucuca

SEQ ID NO: 20209 - RNA, 22 nt, Homo sapiens
cacaaaccauuaugugcugcua

SEQ ID NO: 20210 - RNA, 22 nt, Homo sapiens
uguaaaccaugaugugcugcua

SEQ ID NO: 20211 - RNA, 22 nt, Homo sapiens
cgccaauauuuacgugcugcua

SEQ ID NO: 20212 - RNA, 21 nt, Homo sapiens
gccaauauuucugugcugcua

SEQ ID NO: 20213 - RNA, 23 nt, Homo sapiens
aauaaauuaaauuuauauuacag

SEQ ID NO: 20214 - RNA, 22 nt, Homo sapiens
auggcaguggaguuagugauug

SEQ ID NO: 20215 - RNA, 22 nt, Homo sapiens
ccuggccgugugguuagugauu

SEQ ID NO: 20216 - RNA, 22 nt, Homo sapiens
uucaaaacaugaauugcugcug

SEQ ID NO: 20217 - RNA, 21 nt, Homo sapiens
acaaaccacagugugcugcug

SEQ ID NO: 20218 - RNA, 21 nt, Homo sapiens
cucacucagauggccaacuca

SEQ ID NO: 20219 - RNA, 23 nt, Homo sapiens
uguaggcuggggauaaaugaaua

SEQ ID NO: 20220 - RNA, 22 nt, Homo sapiens
ucaaugacucagguaaguugca

SEQ ID NO: 20221 - RNA, 22 nt, Homo sapiens
cacaagaucggaucuacggguu

SEQ ID NO: 20222 - RNA, 22 nt, Homo sapiens
cgcaaggucgguucuacgggug

SEQ ID NO: 20223 - RNA, 22 nt, Homo sapiens
cacaaguucggaucuacggguu

SEQ ID NO: 20224 - RNA, 20 nt, Homo sapiens
aguacaucaucuauacugua

SEQ ID NO: 20225 - RNA, 22 nt, Homo sapiens
acacucuaaaaggaugcacgau

SEQ ID NO: 20226 - RNA, 21 nt, Homo sapiens
gaccaaucgccguccccgccg

SEQ ID NO: 20227 - RNA, 22 nt, Homo sapiens
ucaucauuaccaggcaguauua

SEQ ID NO: 20228 - RNA, 23 nt, Homo sapiens
uccaucauuacccggcaguauua

SEQ ID NO: 20229 - RNA, 22 nt, Homo sapiens
cacucagcggccguuuccccaa

SEQ ID NO: 20230 - RNA, 22 nt, Homo sapiens
acgguuuuaccagacaguauua

SEQ ID NO: 20231 - RNA, 18 nt, Homo sapiens
acccucugaaaggaagca

SEQ ID NO: 20232 - RNA, 22 nt, Homo sapiens
aaagugcuucuuaccuccagau

SEQ ID NO: 20233 - RNA, 21 nt, Homo sapiens
gaaggaagugagugcagccac

SEQ ID NO: 20234 - RNA, 22 nt, Homo sapiens
gcggucccgcggcgccccgccu

SEQ ID NO: 20235 - RNA, 23 nt, Homo sapiens
cuccagccccuccagggcuuccu

SEQ ID NO: 20236 - RNA, 21 nt, Homo sapiens
auaauggagaccaggccacga

SEQ ID NO: 20237 - RNA, 22 nt, Homo sapiens
gcacaaaucuccagaccaccca

SEQ ID NO: 20238 - RNA, 21 nt, Homo sapiens
aagugucagacacgguggugg

SEQ ID NO: 20239 - RNA, 22 nt, Homo sapiens
acacaccaaggauaauuucucc

SEQ ID NO: 20240 - RNA, 22 nt, Homo sapiens
aguccagauucugugcccacca

SEQ ID NO: 20241 - RNA, 21 nt, Homo sapiens
guucuaacccauuguggccaa

SEQ ID NO: 20242 - RNA, 22 nt, Homo sapiens
gccaccuucaaaugggaagucu

SEQ ID NO: 20243 - RNA, 19 nt, Homo sapiens
gcucuaagaaagccacacu

SEQ ID NO: 20244 - RNA, 22 nt, Homo sapiens
gcacauguucugcggcccacca

SEQ ID NO: 20245 - RNA, 24 nt, Homo sapiens
acgcgcaggccagagacccaggca

SEQ ID NO: 20246 - RNA, 21 nt, Homo sapiens
cuagggaagaacagugagcaa

SEQ ID NO: 20247 - RNA, 18 nt, Homo sapiens
ccacugaaccacccaugc

SEQ ID NO: 20248 - RNA, 22 nt, Homo sapiens
uacagauggauaccgugcaauu

SEQ ID NO: 20249 - RNA, 23 nt, Homo sapiens
ucucacccagguagcaaggauua

SEQ ID NO: 20250 - RNA, 22 nt, Homo sapiens
agaauccuugcccgggugcauu

SEQ ID NO: 20251 - RNA, 22 nt, Homo sapiens
ugaauccuugcccaggugcauu

SEQ ID NO: 20252 - RNA, 23 nt, Homo sapiens
caugcucagacaaccauggugca

SEQ ID NO: 20253 - RNA, 22 nt, Homo sapiens
ucaggaacugccuuucucucca

SEQ ID NO: 20254 - RNA, 22 nt, Homo sapiens
ucccucacacagaauuccagaa

SEQ ID NO: 20255 - RNA, 22 nt, Homo sapiens
uucacacugcaugcucugggua

SEQ ID NO: 20256 - RNA, 22 nt, Homo sapiens
uaaccaaugugcagacuacugu

SEQ ID NO: 20257 - RNA, 22 nt, Homo sapiens
uaaccaaugugcagacuacugu

SEQ ID NO: 20258 - RNA, 21 nt, Homo sapiens
acccaguagccagauguagcu

SEQ ID NO: 20259 - RNA, 22 nt, Homo sapiens
cuuccagucgaggauguuuaca

SEQ ID NO: 20260 - RNA, 22 nt, Homo sapiens
cuuccagucggggauguuuaca

SEQ ID NO: 20261 - RNA, 22 nt, Homo sapiens
cuuccagucaaggauguuuaca

SEQ ID NO: 20262 - RNA, 20 nt, Homo sapiens
cuggaggaagggcccagagg

SEQ ID NO: 20263 - RNA, 22 nt, Homo sapiens
gccuaagacacaggcccagaga

SEQ ID NO: 20264 - RNA, 22 nt, Homo sapiens
uauucaggaacauauugcaaaa

SEQ ID NO: 20265 - RNA, 22 nt, Homo sapiens
uauucaggaacauauugcaaaa

SEQ ID NO: 20266 - RNA, 22 nt, Homo sapiens
cuacccacagacguaccaauca

SEQ ID NO: 20267 - RNA, 20 nt, Homo sapiens
gaaagggcuucccuuugcag

SEQ ID NO: 20268 - RNA, 23 nt, Homo sapiens
acacucuaaagagaagcgcuuug

SEQ ID NO: 20269 - RNA, 20 nt, Homo sapiens
gaaagggcuucccuuugcag

SEQ ID NO: 20270 - RNA, 23 nt, Homo sapiens
aaucgcgguuuauaccaaaugaa

SEQ ID NO: 20271 - RNA, 20 nt, Homo sapiens
agagaugagagaaacacccu

SEQ ID NO: 20272 - RNA, 21 nt, Homo sapiens
gaccaaucgccguccccgccg

SEQ ID NO: 20273 - RNA, 22 nt, Homo sapiens
ucagaccgagacaagugcaaug

SEQ ID NO: 20274 - RNA, 25 nt, Homo sapiens
accaacggaccuacuucccuccgcc

SEQ ID NO: 20275 - RNA, 22 nt, Homo sapiens
gcggucccgcggcgccccgccu

SEQ ID NO: 20276 - RNA, 22 nt, Homo sapiens
ugcuguuagcccuagccccgca

SEQ ID NO: 20277 - RNA, 22 nt, Homo sapiens
gugggguggguggucaggccga

SEQ ID NO: 20278 - RNA, 21 nt, Homo sapiens
cggggugcacgggcggagggc

SEQ ID NO: 20279 - RNA, 23 nt, Homo sapiens
aggaacagcagcagcccgggccg

SEQ ID NO: 20280 - RNA, 22 nt, Homo sapiens
ucaggaacugccuuucucucca

SEQ ID NO: 20281 - RNA, 22 nt, Homo sapiens
cacucagcggccguuuccccaa

SEQ ID NO: 20282 - RNA, 21 nt, Homo sapiens
acaggauugagggggggcccu

SEQ ID NO: 20283 - RNA, 23 nt, Homo sapiens
aaaucagaaucacaccuggggga

SEQ ID NO: 20284 - RNA, 22 nt, Homo sapiens
uacagauggauaccgugcaauu

SEQ ID NO: 20285 - RNA, 23 nt, Homo sapiens
aaagucucgcucucugccccuca

SEQ ID NO: 20286 - RNA, 22 nt, Homo sapiens
ccucauggaaggguuccccacu

SEQ ID NO: 20287 - RNA, 19 nt, Homo sapiens
guccugaauuccgcagccu

SEQ ID NO: 20288 - RNA, 24 nt, Homo sapiens
acgcagagcccgaaagcccccagu

SEQ ID NO: 20289 - RNA, 24 nt, Homo sapiens
acgcgcaggccagagacccaggca

SEQ ID NO: 20290 - RNA, 21 nt, Homo sapiens
caucaccuuccuucuccucca

SEQ ID NO: 20291 - RNA, 21 nt, Homo sapiens
aagggucaguaagcacccgcg

SEQ ID NO: 20292 - RNA, 20 nt, Homo sapiens
uacugcuuccacagcucccc

SEQ ID NO: 20293 - RNA, 22 nt, Homo sapiens
aggucucacuuuguugcccaga

SEQ ID NO: 20294 - RNA, 18 nt, Homo sapiens
ccacugaaccacccaugc

SEQ ID NO: 20295 - RNA, 22 nt, Homo sapiens
ucagaccgagacaagugcaaug

SEQ ID NO: 20296 - RNA, 22 nt, Homo sapiens
agcugaguguaggauguuuaca

SEQ ID NO: 20297 - RNA, 23 nt, Homo sapiens
aaagucucgcucucugccccuca

SEQ ID NO: 20298 - RNA, 25 nt, Homo sapiens
aaggagcucagaagcccugcccagc

SEQ ID NO: 20299 - RNA, 25 nt, Homo sapiens
accaacggaccuacuucccuccgcc

SEQ ID NO: 20300 - RNA, 21 nt, Homo sapiens
caucaccuuccuucuccucca

SEQ ID NO: 20301 - RNA, 23 nt, Homo sapiens
gucacaucccucccaagacccuc

SEQ ID NO: 20302 - RNA, 22 nt, Homo sapiens
caaacaccauugucacacucca

SEQ ID NO: 20303 - RNA, 22 nt, Homo sapiens
cuggagagacaaggggaagagg

SEQ ID NO: 20304 - RNA, 22 nt, Homo sapiens
aggucucacuuuguugcccaga

SEQ ID NO: 20305 - RNA, 22 nt, Homo sapiens
ucaggaacugccuuucucucca

SEQ ID NO: 20306 - RNA, 22 nt, Homo sapiens
cggugagcacccggccccugcg

SEQ ID NO: 20307 - RNA, 22 nt, Homo sapiens
ucaucucgcccgcaaagaccca

SEQ ID NO: 20308 - RNA, 22 nt, Homo sapiens
acugccugucugugccugcugu

SEQ ID NO: 20309 - RNA, 22 nt, Homo sapiens
ucacauuugccugcagagauuu

SEQ ID NO: 20310 - RNA, 20 nt, Homo sapiens
cuggaggaagggcccagagg

SEQ ID NO: 20311 - RNA, 22 nt, Homo sapiens
gccuaagacacaggcccagaga

SEQ ID NO: 20312 - RNA, 22 nt, Homo sapiens
accagguuccaccccagcaggc

SEQ ID NO: 20313 - RNA, 22 nt, Homo sapiens
gauagagugcagaccagggucu

SEQ ID NO: 20314 - RNA, 20 nt, Homo sapiens
ggcauucaccgcgugccuua

SEQ ID NO: 20315 - RNA, 25 nt, Homo sapiens
aaggagcucagaagcccugcccagc

SEQ ID NO: 20316 - RNA, 23 nt, Homo sapiens
acaacaaaaucacuagucuucca

SEQ ID NO: 20317 - RNA, 21 nt, Homo sapiens
ccccucccagccucccugcca

SEQ ID NO: 20318 - RNA, 18 nt, Homo sapiens
aucacauucaccucccug

SEQ ID NO: 20319 - RNA, 20 nt, Homo sapiens
aguacaucaucuauacugua

SEQ ID NO: 20320 - RNA, 23 nt, Homo sapiens
aggaacagcagcagcccgggccg

SEQ ID NO: 20321 - RNA, 23 nt, Homo sapiens
aggaacagcagcagcccgggccg

SEQ ID NO: 20322 - RNA, 22 nt, Homo sapiens
uggcagcagcggagggggcaga

SEQ ID NO: 20323 - RNA, 22 nt, Homo sapiens
acaguucuucaacuggcagcuu

SEQ ID NO: 20324 - RNA, 21 nt, Homo sapiens
ggaaaucccuggcaaugugau

SEQ ID NO: 20325 - RNA, 21 nt, Homo sapiens
gguaaucccuggcaaugugau

SEQ ID NO: 20326 - RNA, 21 nt, Homo sapiens
acaggauugagggggggcccu

SEQ ID NO: 20327 - RNA, 20 nt, Homo sapiens
ccagcagcaccuggggcagu

SEQ ID NO: 20328 - RNA, 23 nt, Homo sapiens
aaagucucgcucucugccccuca

SEQ ID NO: 20329 - RNA, 21 nt, Homo sapiens
auccuguacugagcugccccg

SEQ ID NO: 20330 - RNA, 19 nt, Homo sapiens
auuuugguacagcagcuca

SEQ ID NO: 20331 - RNA, 19 nt, Homo sapiens
gccugcugacaccgugccu

SEQ ID NO: 20332 - RNA, 24 nt, Homo sapiens
cacccccagagccucagcucccca

SEQ ID NO: 20333 - RNA, 23 nt, Homo sapiens
ggaagccaucaagucgcugcagg

SEQ ID NO: 20334 - RNA, 22 nt, Homo sapiens
ggcucccaagaaccucaccugu

SEQ ID NO: 20335 - RNA, 22 nt, Homo sapiens
ccagaacugaguccacagggca

SEQ ID NO: 20336 - RNA, 22 nt, Homo sapiens
ucaggaacugccuuucucucca

SEQ ID NO: 20337 - RNA, 22 nt, Homo sapiens
cagaagugggccgggcacaggg

SEQ ID NO: 20338 - RNA, 20 nt, Homo sapiens
acagcaaggagggcaggagg

SEQ ID NO: 20339 - RNA, 22 nt, Homo sapiens
cucaauagacugugagcuccuu

SEQ ID NO: 20340 - RNA, 23 nt, Homo sapiens
ucucugcaggccgugugcuuugc

SEQ ID NO: 20341 - RNA, 21 nt, Homo sapiens
uugucuaaccagucaccuguu

SEQ ID NO: 20342 - RNA, 23 nt, Homo sapiens
cccagcuagauuguaagcuccuu

SEQ ID NO: 20343 - RNA, 22 nt, Homo sapiens
ucggucccucgggccagggcag

SEQ ID NO: 20344 - RNA, 22 nt, Homo sapiens
aaccauacaaccuacuaccuca

SEQ ID NO: 20345 - RNA, 20 nt, Homo sapiens
ggcauucaccgcgugccuua

SEQ ID NO: 20346 - RNA, 17 nt, Homo sapiens
agaaagaagcaauauga

SEQ ID NO: 20347 - RNA, 21 nt, Homo sapiens
aaagagaccgguucacuguga

SEQ ID NO: 20348 - RNA, 22 nt, Homo sapiens
ccggcugcaacacaagacacga

SEQ ID NO: 20349 - RNA, 23 nt, Homo sapiens
cuaucugcacuagaugcaccuua

SEQ ID NO: 20350 - RNA, 22 nt, Homo sapiens
aggcauaggaugacaaagggaa

SEQ ID NO: 20351 - RNA, 22 nt, Homo sapiens
aggcgaaggaugacaaagggaa

SEQ ID NO: 20352 - RNA, 22 nt, Homo sapiens
cacucagcaccaggauauuguu

SEQ ID NO: 20353 - RNA, 21 nt, Homo sapiens
ucuacucagaagggugccuua

SEQ ID NO: 20354 - RNA, 23 nt, Homo sapiens
uguaggcuggggauaaaugaaua

SEQ ID NO: 20355 - RNA, 20 nt, Homo sapiens
aggggccucagccuccuggu

SEQ ID NO: 20356 - RNA, 23 nt, Homo sapiens
accacaggagucugagcauuuga

SEQ ID NO: 20357 - RNA, 21 nt, Homo sapiens
aaagagaccgguucacuguga

SEQ ID NO: 20358 - RNA, 22 nt, Homo sapiens
acaaaguucuguagugcacuga

SEQ ID NO: 20359 - RNA, 22 nt, Homo sapiens
acaaaguucugugaugcacuga

SEQ ID NO: 20360 - RNA, 21 nt, Homo sapiens
ccaaguucugucaugcacuga

SEQ ID NO: 20361 - RNA, 22 nt, Homo sapiens
uaaccgauuucagauggugcua

SEQ ID NO: 20362 - RNA, 23 nt, Homo sapiens
aacacugauuucaaauggugcua

SEQ ID NO: 20363 - RNA, 22 nt, Homo sapiens
uaaccgauuucaaauggugcua

SEQ ID NO: 20364 - RNA, 22 nt, Homo sapiens
guagaagggaaucuugcauaag

SEQ ID NO: 20365 - RNA, 22 nt, Homo sapiens
ccuggcacacaguagaccuuca

SEQ ID NO: 20366 - RNA, 22 nt, Homo sapiens
gcacacaauaaauguuugcuga

SEQ ID NO: 20367 - RNA, 21 nt, Homo sapiens
aaaacaaaaucucaccguuuu

SEQ ID NO: 20368 - RNA, 22 nt, Homo sapiens
cugcucaaacccuccaaugacu

SEQ ID NO: 20369 - RNA, 23 nt, Homo sapiens
caugcucagacaaccauggugca

SEQ ID NO: 20370 - RNA, 23 nt, Homo sapiens
acaaggaugaaucuuuguuacug

SEQ ID NO: 20371 - RNA, 23 nt, Homo sapiens
cacaaauucggaucuacagggua

SEQ ID NO: 20372 - RNA, 23 nt, Homo sapiens
cacaaauucgguucuacagggua

SEQ ID NO: 20373 - RNA, 23 nt, Homo sapiens
acacagcucuuccauaucuccag

SEQ ID NO: 20374 - RNA, 22 nt, Homo sapiens
augcccuuuuaacauugcacug

SEQ ID NO: 20375 - RNA, 22 nt, Homo sapiens
cgaaggcaacacggauaaccua

SEQ ID NO: 20376 - RNA, 22 nt, Homo sapiens
agcccaaaaggagaauucuuug

SEQ ID NO: 20377 - RNA, 22 nt, Homo sapiens
ucacaguugccagcugagauua

SEQ ID NO: 20378 - RNA, 21 nt, Homo sapiens
ggaaaucccuggcaaugugau

SEQ ID NO: 20379 - RNA, 21 nt, Homo sapiens
gguaaucccuggcaaugugau

SEQ ID NO: 20380 - RNA, 23 nt, Homo sapiens
cgugagcuccuggaggacaggga

SEQ ID NO: 20381 - RNA, 22 nt, Homo sapiens
aacuggaugucccuguaugauu

SEQ ID NO: 20382 - RNA, 23 nt, Homo sapiens
aaucgcgguuuauaccaaaugaa

SEQ ID NO: 20383 - RNA, 20 nt, Homo sapiens
auuucuauaucuaucuccau

SEQ ID NO: 20384 - RNA, 20 nt, Homo sapiens
acaaugagaacccauggucu

SEQ ID NO: 20385 - RNA, 22 nt, Homo sapiens
caaacaccauugucacacucca

SEQ ID NO: 20386 - RNA, 22 nt, Homo sapiens
cacgaccgacgccacgccgagu

SEQ ID NO: 20387 - RNA, 21 nt, Homo sapiens
gggcaucugggacgcgcagga

SEQ ID NO: 20388 - RNA, 24 nt, Homo sapiens
agugugaguucuaccauugccaaa

SEQ ID NO: 20389 - RNA, 23 nt, Homo sapiens
cccaacagacauggcgguacuca

SEQ ID NO: 20390 - RNA, 22 nt, Homo sapiens
cccaacaacaggaaacuaccua

SEQ ID NO: 20391 - RNA, 22 nt, Homo sapiens
aucgggaggggacugagccuga

SEQ ID NO: 20392 - RNA, 23 nt, Homo sapiens
cugcagaacuguucccgcugcua

SEQ ID NO: 20393 - RNA, 23 nt, Homo sapiens
ccaccuggcaagaacaggcguuc

SEQ ID NO: 20394 - RNA, 22 nt, Homo sapiens
aagagggagacccaggcucgga

SEQ ID NO: 20395 - RNA, 21 nt, Homo sapiens
aggagacucacaaguuccugc

SEQ ID NO: 20396 - RNA, 21 nt, Homo sapiens
agggcucaucuugguccugca

SEQ ID NO: 20397 - RNA, 22 nt, Homo sapiens
ucaggaacugccuuucucucca

SEQ ID NO: 20398 - RNA, 21 nt, Homo sapiens
gaccaaucgccguccccgccg

SEQ ID NO: 20399 - RNA, 23 nt, Homo sapiens
cccaacagacauggcgguacuca

SEQ ID NO: 20400 - RNA, 23 nt, Homo sapiens
gggcucuuacucccucaggcacu

SEQ ID NO: 20401 - RNA, 19 nt, Homo sapiens
gccugcugacaccgugccu

SEQ ID NO: 20402 - RNA, 19 nt, Homo sapiens
guccugaauuccgcagccu

SEQ ID NO: 20403 - RNA, 19 nt, Homo sapiens
guccugaauuccgcagccu

SEQ ID NO: 20404 - RNA, 22 nt, Homo sapiens
gcggucccgcggcgccccgccu

SEQ ID NO: 20405 - RNA, 22 nt, Homo sapiens
ugcuguuagcccuagccccgca

SEQ ID NO: 20406 - RNA, 21 nt, Homo sapiens
cucccccacugcagcuggcac

SEQ ID NO: 20407 - RNA, 18 nt, Homo sapiens
gaaaugagggccagcuga

SEQ ID NO: 20408 - RNA, 21 nt, Homo sapiens
gaccaaucgccguccccgccg

SEQ ID NO: 20409 - RNA, 22 nt, Homo sapiens
acaguucuucaacuggcagcuu

SEQ ID NO: 20410 - RNA, 23 nt, Homo sapiens
aaagucucgcucucugccccuca

SEQ ID NO: 20411 - RNA, 25 nt, Homo sapiens
acggagcugucccaacaccaccccu

SEQ ID NO: 20412 - RNA, 22 nt, Homo sapiens
gcggucccgcggcgccccgccu

SEQ ID NO: 20413 - RNA, 17 nt, Homo sapiens
uggaggccccagcgaga

SEQ ID NO: 20414 - RNA, 20 nt, Homo sapiens
uacugcuuccacagcucccc

SEQ ID NO: 20415 - RNA, 21 nt, Homo sapiens
agggcucaucuugguccugca

SEQ ID NO: 20416 - RNA, 22 nt, Homo sapiens
agacaacaaugccaaccucaca

SEQ ID NO: 20417 - RNA, 22 nt, Homo sapiens
ccagaacugaguccacagggca

SEQ ID NO: 20418 - RNA, 18 nt, Homo sapiens
auucaaucuacugccuca

SEQ ID NO: 20419 - RNA, 23 nt, Homo sapiens
cuaucugcacuagaugcaccuua

SEQ ID NO: 20420 - RNA, 21 nt, Homo sapiens
agagcucauccauaguuguca

SEQ ID NO: 20421 - RNA, 22 nt, Homo sapiens
acaguucuucaacuggcagcuu

SEQ ID NO: 20422 - RNA, 22 nt, Homo sapiens
agucuucacaacagcccugugu

SEQ ID NO: 20423 - RNA, 23 nt, Homo sapiens
gaaacccagcagacaauguagcu

SEQ ID NO: 20424 - RNA, 21 nt, Homo sapiens
acccaguagccagauguagcu

SEQ ID NO: 20425 - RNA, 21 nt, Homo sapiens
aacggaaccacuagugacuug

SEQ ID NO: 20426 - RNA, 22 nt, Homo sapiens
cucaauagacugugagcuccuu

SEQ ID NO: 20427 - RNA, 23 nt, Homo sapiens
ccacccaaugaccuacuccaaga

SEQ ID NO: 20428 - RNA, 22 nt, Homo sapiens
cuacccacagacguaccaauca

SEQ ID NO: 20429 - RNA, 19 nt, Homo sapiens
auuuugguacagcagcuca

SEQ ID NO: 20430 - RNA, 21 nt, Homo sapiens
cccgaggagccgggcaggcuu

SEQ ID NO: 20431 - RNA, 23 nt, Homo sapiens
cccagcuagauuguaagcuccuu

SEQ ID NO: 20432 - RNA, 22 nt, Homo sapiens
ucggucccucgggccagggcag

SEQ ID NO: 20433 - RNA, 21 nt, Homo sapiens
ccccucccagccucccugcca

SEQ ID NO: 20434 - RNA, 18 nt, Homo sapiens
auucaaucuacugccuca

SEQ ID NO: 20435 - RNA, 21 nt, Homo sapiens
gaccaaucgccguccccgccg

SEQ ID NO: 20436 - RNA, 22 nt, Homo sapiens
cggugagcacccggccccugcg

SEQ ID NO: 20437 - RNA, 21 nt, Homo sapiens
acaggauugagggggggcccu

SEQ ID NO: 20438 - RNA, 20 nt, Homo sapiens
cuggaggaagggcccagagg

SEQ ID NO: 20439 - RNA, 22 nt, Homo sapiens
gccuaagacacaggcccagaga

SEQ ID NO: 20440 - RNA, 20 nt, Homo sapiens
gcaaugcaacagcaaugcac

SEQ ID NO: 20441 - RNA, 23 nt, Homo sapiens
ucaacgggagugaucgugucauu

SEQ ID NO: 20442 - RNA, 21 nt, Homo sapiens
auccuguacugagcugccccg

SEQ ID NO: 20443 - RNA, 22 nt, Homo sapiens
gaccucagcuaugacagcacuu

SEQ ID NO: 20444 - RNA, 23 nt, Homo sapiens
gaaagugcccucaaggcugagug

SEQ ID NO: 20445 - RNA, 22 nt, Homo sapiens
aacgcuccaaaagaaggcacuc

SEQ ID NO: 20446 - RNA, 22 nt, Homo sapiens
aacacucuaaaaggaggcacuu

SEQ ID NO: 20447 - RNA, 23 nt, Homo sapiens
ucucgugacaugaugauccccga

SEQ ID NO: 20448 - RNA, 23 nt, Homo sapiens
gggcucuuacucccucaggcacu

SEQ ID NO: 20449 - RNA, 22 nt, Homo sapiens
aagagggagacccaggcucgga

SEQ ID NO: 20450 - RNA, 21 nt, Homo sapiens
guccugagagcgcugccuccu

SEQ ID NO: 20451 - RNA, 24 nt, Homo sapiens
acgcgcaggccagagacccaggca

SEQ ID NO: 20452 - RNA, 22 nt, Homo sapiens
gcggucccgcggcgccccgccu

SEQ ID NO: 20453 - RNA, 22 nt, Homo sapiens
ugcuguuagcccuagccccgca

SEQ ID NO: 20454 - RNA, 21 nt, Homo sapiens
caucaccuuccuucuccucca

SEQ ID NO: 20455 - RNA, 21 nt, Homo sapiens
ggggagcgggggcccugccuu

SEQ ID NO: 20456 - RNA, 22 nt, Homo sapiens
auagaugauaugcacaguacua

SEQ ID NO: 20457 - RNA, 22 nt, Homo sapiens
cgaccauggcuguagacuguua

SEQ ID NO: 20458 - RNA, 23 nt, Homo sapiens
aggaacagcagcagcccgggccg

SEQ ID NO: 20459 - RNA, 23 nt, Homo sapiens
cuaucugcacuagaugcaccuua

SEQ ID NO: 20460 - RNA, 23 nt, Homo sapiens
cuaacugcacuagaugcaccuua

SEQ ID NO: 20461 - RNA, 23 nt, Homo sapiens
cagcugcuuuugggauuccguug

SEQ ID NO: 20462 - RNA, 22 nt, Homo sapiens
cccaacaacaugaaacuaccua

SEQ ID NO: 20463 - RNA, 21 nt, Homo sapiens
ggccgugacuggagacuguua

SEQ ID NO: 20464 - RNA, 22 nt, Homo sapiens
ucaccauugcuaaagugcaauu

SEQ ID NO: 20465 - RNA, 22 nt, Homo sapiens
augggacauccuacauaugcaa

SEQ ID NO: 20466 - RNA, 20 nt, Homo sapiens
gaaagggcuucccuuuguag

SEQ ID NO: 20467 - RNA, 22 nt, Homo sapiens
gagaaagugcuucccuuuguag

SEQ ID NO: 20468 - RNA, 22 nt, Homo sapiens
cucauauuacaaugagcucauc

SEQ ID NO: 20469 - RNA, 22 nt, Homo sapiens
ggaccuaaaaauacaaugcaua

SEQ ID NO: 20470 - RNA, 22 nt, Homo sapiens
ugcuguuagcccuagccccgca

SEQ ID NO: 20471 - RNA, 22 nt, Homo sapiens
gcugaggcuguggggcuggagu

SEQ ID NO: 20472 - RNA, 23 nt, Homo sapiens
uggcccugacacgugguacugga

SEQ ID NO: 20473 - RNA, 22 nt, Homo sapiens
ucggucccucgggccagggcag

SEQ ID NO: 20474 - RNA, 22 nt, Homo sapiens
ggcucccaagaaccucaccugu

SEQ ID NO: 20475 - RNA, 24 nt, Homo sapiens
gaagucacucccaggcagcugcaa

SEQ ID NO: 20476 - RNA, 23 nt, Homo sapiens
cuaccugcacuauaagcacuuua

SEQ ID NO: 20477 - RNA, 22 nt, Homo sapiens
ucacaguugccagcugagauua

SEQ ID NO: 20478 - RNA, 22 nt, Homo sapiens
ucgcccucucaacccagcuuuu

SEQ ID NO: 20479 - RNA, 22 nt, Homo sapiens
uugcccucucaacccagcuuuu

SEQ ID NO: 20480 - RNA, 20 nt, Homo sapiens
acccucucaacccagcuuuu

SEQ ID NO: 20481 - RNA, 19 nt, Homo sapiens
uccucucaacccagcuuuu

SEQ ID NO: 20482 - RNA, 21 nt, Homo sapiens
uugucuaaccagucaccuguu

SEQ ID NO: 20483 - RNA, 22 nt, Homo sapiens
gcaaagguaauugcuguuuucg

SEQ ID NO: 20484 - RNA, 21 nt, Homo sapiens
agacacaccacggcacacuuc

SEQ ID NO: 20485 - RNA, 21 nt, Homo sapiens
ccccucccagccucccugcca

SEQ ID NO: 20486 - RNA, 23 nt, Homo sapiens
cugugggagggcaguggugagag

SEQ ID NO: 20487 - RNA, 21 nt, Homo sapiens
cggggugcacgggcggagggc

SEQ ID NO: 20488 - RNA, 23 nt, Homo sapiens
gggagugaagacacggagccaga

SEQ ID NO: 20489 - RNA, 22 nt, Homo sapiens
cacaaaccauuaugugcugcua

SEQ ID NO: 20490 - RNA, 22 nt, Homo sapiens
uguaaaccaugaugugcugcua

SEQ ID NO: 20491 - RNA, 22 nt, Homo sapiens
cgccaauauuuacgugcugcua

SEQ ID NO: 20492 - RNA, 22 nt, Homo sapiens
cggugagcacccggccccugcg

SEQ ID NO: 20493 - RNA, 22 nt, Homo sapiens
agcgggacuuugagggccaguu

SEQ ID NO: 20494 - RNA, 21 nt, Homo sapiens
gccaauauuucugugcugcua

SEQ ID NO: 20495 - RNA, 22 nt, Homo sapiens
uuaacagcuaagcacccuaauc

SEQ ID NO: 20496 - RNA, 21 nt, Homo sapiens
uagaaaggcuaggaccaaacc

SEQ ID NO: 20497 - RNA, 20 nt, Homo sapiens
uucccaugcccuauaccucu

SEQ ID NO: 20498 - RNA, 23 nt, Homo sapiens
gaaacccagcagacaauguagcu

SEQ ID NO: 20499 - RNA, 22 nt, Homo sapiens
uucaaaacaugaauugcugcug

SEQ ID NO: 20500 - RNA, 22 nt, Homo sapiens
gaauucaucacggccagccucu

SEQ ID NO: 20501 - RNA, 21 nt, Homo sapiens
acaaaccacagugugcugcug

SEQ ID NO: 20502 - RNA, 25 nt, Homo sapiens
accaacggaccuacuucccuccgcc

SEQ ID NO: 20503 - RNA, 20 nt, Homo sapiens
uacugcuuccacagcucccc

SEQ ID NO: 20504 - RNA, 21 nt, Homo sapiens
agaaguagaccauguguccua

SEQ ID NO: 20505 - RNA, 26 nt, Homo sapiens
aaccaucucauacaaaccaacuacuu

SEQ ID NO: 20506 - RNA, 17 nt, Homo sapiens
gacagccucucccccac

SEQ ID NO: 20507 - RNA, 24 nt, Homo sapiens
gaagucacucccaggcagcugcaa

SEQ ID NO: 20508 - RNA, 22 nt, Homo sapiens
aacccauggaauucaguucuca

SEQ ID NO: 20509 - RNA, 22 nt, Homo sapiens
aacccauggaauucaguucuca

SEQ ID NO: 20510 - RNA, 22 nt, Homo sapiens
agccuauggaauucaguucuca

SEQ ID NO: 20511 - RNA, 22 nt, Homo sapiens
acaaaguucuguagugcacuga

SEQ ID NO: 20512 - RNA, 23 nt, Homo sapiens
gggagugaagacacggagccaga

SEQ ID NO: 20513 - RNA, 18 nt, Homo sapiens
auucaaucuacugccuca

SEQ ID NO: 20514 - RNA, 23 nt, Homo sapiens
ccacccaaugaccuacuccaaga

SEQ ID NO: 20515 - RNA, 23 nt, Homo sapiens
ucucacccagguagcaaggauua

SEQ ID NO: 20516 - RNA, 22 nt, Homo sapiens
uuucaguuaucaaucugucaca

SEQ ID NO: 20517 - RNA, 19 nt, Homo sapiens
auuuugguacagcagcuca

SEQ ID NO: 20518 - RNA, 20 nt, Homo sapiens
agagaugagagaaacacccu

SEQ ID NO: 20519 - RNA, 22 nt, Homo sapiens
caagacacauuuggagagggac

SEQ ID NO: 20520 - RNA, 21 nt, Homo sapiens
guccugagagcgcugccuccu

SEQ ID NO: 20521 - RNA, 21 nt, Homo sapiens
ggucagaacccaucauucacu

SEQ ID NO: 20522 - RNA, 18 nt, Homo sapiens
aucacauucaccucccug

SEQ ID NO: 20523 - RNA, 20 nt, Homo sapiens
uacugcuuccacagcucccc

SEQ ID NO: 20524 - RNA, 22 nt, Homo sapiens
cagaaagugcuucccucuagag

SEQ ID NO: 20525 - RNA, 22 nt, Homo sapiens
uccacauggaguugcuguuaca

SEQ ID NO: 20526 - RNA, 22 nt, Homo sapiens
uagucaagugaagcagugggag

SEQ ID NO: 20527 - RNA, 22 nt, Homo sapiens
aggcauaggaugacaaagggaa

SEQ ID NO: 20528 - RNA, 22 nt, Homo sapiens
aggcgaaggaugacaaagggaa

SEQ ID NO: 20529 - RNA, 21 nt, Homo sapiens
acccaguagccagauguagcu

SEQ ID NO: 20530 - RNA, 22 nt, Homo sapiens
cacuuaucagguuguauuauaa

SEQ ID NO: 20531 - RNA, 22 nt, Homo sapiens
cacuuagcagguuguauuauau

SEQ ID NO: 20532 - RNA, 22 nt, Homo sapiens
gccagcuaacaauacacugccu

SEQ ID NO: 20533 - RNA, 22 nt, Homo sapiens
gaauucaucacggccagccucu

SEQ ID NO: 20534 - RNA, 18 nt, Homo sapiens
acccucugaaaggaagca

SEQ ID NO: 20535 - RNA, 22 nt, Homo sapiens
aaagugcuucuuaccuccagau

SEQ ID NO: 20536 - RNA, 22 nt, Homo sapiens
aaaguaacugcaguuuuugcua

SEQ ID NO: 20537 - RNA, 20 nt, Homo sapiens
gcaaaugguacagcuacuuu

SEQ ID NO: 20538 - RNA, 21 nt, Homo sapiens
gaaggaagugagugcagccac

SEQ ID NO: 20539 - RNA, 22 nt, Homo sapiens
caacuccgauaugcaaugggua

SEQ ID NO: 20540 - RNA, 21 nt, Homo sapiens
cugaggagagaggaggugggg

SEQ ID NO: 20541 - RNA, 17 nt, Homo sapiens
caccugaauuacuugaa

SEQ ID NO: 20542 - RNA, 22 nt, Homo sapiens
ucaggaacugccuuucucucca

SEQ ID NO: 20543 - RNA, 22 nt, Homo sapiens
cacucagcggccguuuccccaa

SEQ ID NO: 20544 - RNA, 21 nt, Homo sapiens
accuauccugaauuacuugaa

SEQ ID NO: 20545 - RNA, 23 nt, Homo sapiens
ucaacgggagugaucgugucauu

SEQ ID NO: 20546 - RNA, 22 nt, Homo sapiens
ccucauggaaggguuccccacu

SEQ ID NO: 20547 - RNA, 22 nt, Homo sapiens
acacaccaaggauaauuucucc

SEQ ID NO: 20548 - RNA, 22 nt, Homo sapiens
gacaaaacccgcaaauacuuuu

SEQ ID NO: 20549 - RNA, 22 nt, Homo sapiens
acaaaauccacaauuacuuuug

SEQ ID NO: 20550 - RNA, 20 nt, Homo sapiens
cccugcgccaucuccucuac

SEQ ID NO: 20551 - RNA, 22 nt, Homo sapiens
ggcagagagucagagcgcggau

SEQ ID NO: 20552 - RNA, 21 nt, Homo sapiens
auaauggagaccaggccacga

SEQ ID NO: 20553 - RNA, 21 nt, Homo sapiens
cugaggagagaggaggugggg

SEQ ID NO: 20554 - RNA, 22 nt, Homo sapiens
caaacaccauugucacacucca

SEQ ID NO: 20555 - RNA, 19 nt, Homo sapiens
aagccaaagccuuauccau

SEQ ID NO: 20556 - RNA, 21 nt, Homo sapiens
uggggauuacacuucaacagg

SEQ ID NO: 20557 - RNA, 17 nt, Homo sapiens
ggguggcagcgguggga

SEQ ID NO: 20558 - RNA, 17 nt, Homo sapiens
gggagaggaggaggcga

SEQ ID NO: 20559 - RNA, 21 nt, Homo sapiens
agggcucaucuugguccugca

SEQ ID NO: 20560 - RNA, 22 nt, Homo sapiens
acaacuguaacuagacgguuuu

SEQ ID NO: 20561 - RNA, 22 nt, Homo sapiens
uggcagcagcggagggggcaga

SEQ ID NO: 20562 - RNA, 21 nt, Homo sapiens
aaagugucagauacggugugg

SEQ ID NO: 20563 - RNA, 20 nt, Homo sapiens
ccagcagcaccuggggcagu

SEQ ID NO: 20564 - RNA, 23 nt, Homo sapiens
acgggugcgauuucugugugaga

SEQ ID NO: 20565 - RNA, 23 nt, Homo sapiens
gcgcccaauuaaugucuguugau

SEQ ID NO: 20566 - RNA, 22 nt, Homo sapiens
aacucaguaaugguaacgguuu

SEQ ID NO: 20567 - RNA, 23 nt, Homo sapiens
ugcgaacucaccacggacaaccu

SEQ ID NO: 20568 - RNA, 22 nt, Homo sapiens
gaauucaucacggccagccucu

SEQ ID NO: 20569 - RNA, 21 nt, Homo sapiens
auccuguacugagcugccccg

SEQ ID NO: 20570 - RNA, 22 nt, Homo sapiens
aguccagauucugugcccacca

SEQ ID NO: 20571 - RNA, 21 nt, Homo sapiens
uugucuaaccagucaccuguu

SEQ ID NO: 20572 - RNA, 20 nt, Homo sapiens
ugggccaccgccgagcggac

SEQ ID NO: 20573 - RNA, 21 nt, Homo sapiens
guucuaacccauuguggccaa

SEQ ID NO: 20574 - RNA, 21 nt, Homo sapiens
guucuaacccauuguggccaa

SEQ ID NO: 20575 - RNA, 22 nt, Homo sapiens
gcacauguucugcggcccacca

SEQ ID NO: 20576 - RNA, 25 nt, Homo sapiens
accaacggaccuacuucccuccgcc

SEQ ID NO: 20577 - RNA, 20 nt, Homo sapiens
uacugcuuccacagcucccc

SEQ ID NO: 20578 - RNA, 21 nt, Homo sapiens
ugcaggcugaucuucuucucu

SEQ ID NO: 20579 - RNA, 24 nt, Homo sapiens
acugcaggcuccagcuuccaggcu

SEQ ID NO: 20580 - RNA, 18 nt, Homo sapiens
cagcagccuccuucucaa

SEQ ID NO: 20581 - RNA, 22 nt, Homo sapiens
aacccauggaauucaguucuca

SEQ ID NO: 20582 - RNA, 22 nt, Homo sapiens
agccuauggaauucaguucuca

SEQ ID NO: 20583 - RNA, 21 nt, Homo sapiens
cccuccaccaugcaagggaug

SEQ ID NO: 20584 - RNA, 21 nt, Homo sapiens
agcuaugccagcaucuugccu

SEQ ID NO: 20585 - RNA, 23 nt, Homo sapiens
acaccaaugcccuaggggaugcg

SEQ ID NO: 20586 - RNA, 22 nt, Homo sapiens
auaaacgacaccuccuugagaa

SEQ ID NO: 20587 - RNA, 22 nt, Homo sapiens
gguucaguuguucaaccaguua

SEQ ID NO: 20588 - RNA, 23 nt, Homo sapiens
acccaacagccccugcaagggau

SEQ ID NO: 20589 - RNA, 23 nt, Homo sapiens
acaaggaugaaucuuuguuacug

SEQ ID NO: 20590 - RNA, 22 nt, Homo sapiens
acuggguucaccuuuaagggca

SEQ ID NO: 20591 - RNA, 22 nt, Homo sapiens
acacacccacgcgagccggaaa

SEQ ID NO: 20592 - RNA, 18 nt, Homo sapiens
ugguggcagaggugggau

SEQ ID NO: 20593 - RNA, 23 nt, Homo sapiens
ucaguuuugcauagauuugcaca

SEQ ID NO: 20594 - RNA, 23 nt, Homo sapiens
ucaguuuugcauggauuugcaca

SEQ ID NO: 20595 - RNA, 21 nt, Homo sapiens
uucacuccaaaaggugcaaaa

SEQ ID NO: 20596 - RNA, 22 nt, Homo sapiens
ugcaagccuugggugugggagg

SEQ ID NO: 20597 - RNA, 23 nt, Homo sapiens
agacaaggcccacccgugcaaac

SEQ ID NO: 20598 - RNA, 22 nt, Homo sapiens
acuucaaggaucuuaaacuuug

SEQ ID NO: 20599 - RNA, 25 nt, Homo sapiens
acggagcugucccaacaccaccccu

SEQ ID NO: 20600 - RNA, 22 nt, Homo sapiens
aagagggagacccaggcucgga

SEQ ID NO: 20601 - RNA, 22 nt, Homo sapiens
ugcuguuagcccuagccccgca

SEQ ID NO: 20602 - RNA, 21 nt, Homo sapiens
auaauggagaccaggccacga

SEQ ID NO: 20603 - RNA, 22 nt, Homo sapiens
acaccuggcuccacacgcgggc

SEQ ID NO: 20604 - RNA, 22 nt, Homo sapiens
cacaaaccauuaugugcugcua

SEQ ID NO: 20605 - RNA, 22 nt, Homo sapiens
uguaaaccaugaugugcugcua

SEQ ID NO: 20606 - RNA, 22 nt, Homo sapiens
cgccaauauuuacgugcugcua

SEQ ID NO: 20607 - RNA, 21 nt, Homo sapiens
gaccaaucgccguccccgccg

SEQ ID NO: 20608 - RNA, 23 nt, Homo sapiens
cccaacagacauggcgguacuca

SEQ ID NO: 20609 - RNA, 21 nt, Homo sapiens
gccaauauuucugugcugcua

SEQ ID NO: 20610 - RNA, 22 nt, Homo sapiens
cuguuccugcugaacugagcca

SEQ ID NO: 20611 - RNA, 22 nt, Homo sapiens
uucaaaacaugaauugcugcug

SEQ ID NO: 20612 - RNA, 21 nt, Homo sapiens
acaaaccacagugugcugcug

SEQ ID NO: 20613 - RNA, 19 nt, Homo sapiens
agaaaccccagcagagaca

SEQ ID NO: 20614 - RNA, 22 nt, Homo sapiens
gauccgagcaccggggaccccc

SEQ ID NO: 20615 - RNA, 22 nt, Homo sapiens
gcggucccgcggcgccccgccu

SEQ ID NO: 20616 - RNA, 22 nt, Homo sapiens
ccucaggcacggccgggccacc

SEQ ID NO: 20617 - RNA, 23 nt, Homo sapiens
caugcucagacaaccauggugca

SEQ ID NO: 20618 - RNA, 22 nt, Homo sapiens
gggagaggucucccugcgcaca

SEQ ID NO: 20619 - RNA, 22 nt, Homo sapiens
ggcucccaagaaccucaccugu

SEQ ID NO: 20620 - RNA, 18 nt, Homo sapiens
cccccaccaccacgcccg

SEQ ID NO: 20621 - RNA, 20 nt, Homo sapiens
ugucuccacagggcucuuua

SEQ ID NO: 20622 - RNA, 17 nt, Homo sapiens
ggguggcagcgguggga

SEQ ID NO: 20623 - RNA, 20 nt, Homo sapiens
aagcagaaaaaggcaaacga

SEQ ID NO: 20624 - RNA, 21 nt, Homo sapiens
gaccaaucgccguccccgccg

SEQ ID NO: 20625 - RNA, 21 nt, Homo sapiens
uucuaggauaggcccaggggc

SEQ ID NO: 20626 - RNA, 22 nt, Homo sapiens
acaaccagcuaagacacugcca

SEQ ID NO: 20627 - RNA, 22 nt, Homo sapiens
aguccagauucugugcccacca

SEQ ID NO: 20628 - RNA, 22 nt, Homo sapiens
uuucaguuaucaaucugucaca

SEQ ID NO: 20629 - RNA, 22 nt, Homo sapiens
gcacacaauaaauguuugcuga

SEQ ID NO: 20630 - RNA, 25 nt, Homo sapiens
acggagcugucccaacaccaccccu

SEQ ID NO: 20631 - RNA, 22 nt, Homo sapiens
gcacauguucugcggcccacca

SEQ ID NO: 20632 - RNA, 22 nt, Homo sapiens
gcggucccgcggcgccccgccu

SEQ ID NO: 20633 - RNA, 22 nt, Homo sapiens
ugcuguuagcccuagccccgca

SEQ ID NO: 20634 - RNA, 20 nt, Homo sapiens
uacugcuuccacagcucccc

SEQ ID NO: 20635 - RNA, 20 nt, Homo sapiens
uacugcuuccacagcucccc

SEQ ID NO: 20636 - RNA, 22 nt, Homo sapiens
aacuauacaaccuacuaccuca

SEQ ID NO: 20637 - RNA, 22 nt, Homo sapiens
aaccacacaaccuacuaccuca

SEQ ID NO: 20638 - RNA, 22 nt, Homo sapiens
aaccauacaaccuacuaccuca

SEQ ID NO: 20639 - RNA, 22 nt, Homo sapiens
aacuaugcaaccuacuaccucu

SEQ ID NO: 20640 - RNA, 22 nt, Homo sapiens
aacuauacaaccuccuaccuca

SEQ ID NO: 20641 - RNA, 22 nt, Homo sapiens
aacuauacaaucuacuaccuca

SEQ ID NO: 20642 - RNA, 22 nt, Homo sapiens
aacuguacaaacuacuaccuca

SEQ ID NO: 20643 - RNA, 22 nt, Homo sapiens
aacagcacaaacuacuaccuca

SEQ ID NO: 20644 - RNA, 22 nt, Homo sapiens
cuggagagacaaggggaagagg

SEQ ID NO: 20645 - RNA, 22 nt, Homo sapiens
ccccucuggucaaccagucaca

SEQ ID NO: 20646 - RNA, 23 nt, Homo sapiens
uccaucauuacccggcaguauua

SEQ ID NO: 20647 - RNA, 22 nt, Homo sapiens
acaagcuuuuugcucgucuuau

SEQ ID NO: 20648 - RNA, 22 nt, Homo sapiens
acaaaccuuuuguucgucuuau

SEQ ID NO: 20649 - RNA, 20 nt, Homo sapiens
cuggaggaagggcccagagg

SEQ ID NO: 20650 - RNA, 22 nt, Homo sapiens
gccuaagacacaggcccagaga

SEQ ID NO: 20651 - RNA, 21 nt, Homo sapiens
ccuacguuccauagucuacca

SEQ ID NO: 20652 - RNA, 22 nt, Homo sapiens
cuacccacagacguaccaauca

SEQ ID NO: 20653 - RNA, 23 nt, Homo sapiens
gggcucuuacucccucaggcacu

SEQ ID NO: 20654 - RNA, 20 nt, Homo sapiens
cccugcgccaucuccucuac

SEQ ID NO: 20655 - RNA, 22 nt, Homo sapiens
ggaggccgggacgagugcaaua

SEQ ID NO: 20656 - RNA, 22 nt, Homo sapiens
aacaauacaacuuacuaccuca

SEQ ID NO: 20657 - RNA, 22 nt, Homo sapiens
uaaaugaauucaauuuccuucu

SEQ ID NO: 20658 - RNA, 22 nt, Homo sapiens
acaaaguucuguagugcacuga

SEQ ID NO: 20659 - RNA, 22 nt, Homo sapiens
acaaaguucugugaugcacuga

SEQ ID NO: 20660 - RNA, 21 nt, Homo sapiens
ccaaguucugucaugcacuga

SEQ ID NO: 20661 - RNA, 18 nt, Homo sapiens
ggagaggagggcacugga

SEQ ID NO: 20662 - RNA, 23 nt, Homo sapiens
acauuuuucguuauugcucuuga

SEQ ID NO: 20663 - RNA, 23 nt, Homo sapiens
aaaucagaaucacaccuggggga

SEQ ID NO: 20664 - RNA, 23 nt, Homo sapiens
acucagaaggacaaguagaguuu

SEQ ID NO: 20665 - RNA, 24 nt, Homo sapiens
acgcagagcccgaaagcccccagu

SEQ ID NO: 20666 - RNA, 24 nt, Homo sapiens
acgcgcaggccagagacccaggca

SEQ ID NO: 20667 - RNA, 22 nt, Homo sapiens
cugggggcggcacaggggcuca

SEQ ID NO: 20668 - RNA, 22 nt, Homo sapiens
gugggguggguggucaggccga

SEQ ID NO: 20669 - RNA, 24 nt, Homo sapiens
ucacagguuaaagggucucaggga

SEQ ID NO: 20670 - RNA, 22 nt, Homo sapiens
ucacaaguuagggucucaggga

SEQ ID NO: 20671 - RNA, 23 nt, Homo sapiens
agcccuguucuacagcccugagg

SEQ ID NO: 20672 - RNA, 23 nt, Homo sapiens
aggaacagcagcagcccgggccg

SEQ ID NO: 20673 - RNA, 21 nt, Homo sapiens
gaccaaucgccguccccgccg

SEQ ID NO: 20674 - RNA, 23 nt, Homo sapiens
cagcugcuuuugggauuccguug

SEQ ID NO: 20675 - RNA, 22 nt, Homo sapiens
cuguuccugcugaacugagcca

SEQ ID NO: 20676 - RNA, 19 nt, Homo sapiens
guugggaucacaggcgccc

SEQ ID NO: 20677 - RNA, 25 nt, Homo sapiens
acggagcugucccaacaccaccccu

SEQ ID NO: 20678 - RNA, 24 nt, Homo sapiens
acgcgcaggccagagacccaggca

SEQ ID NO: 20679 - RNA, 22 nt, Homo sapiens
gcggucccgcggcgccccgccu

SEQ ID NO: 20680 - RNA, 22 nt, Homo sapiens
ugcuguuagcccuagccccgca

SEQ ID NO: 20681 - RNA, 23 nt, Homo sapiens
ccgcuugagcuaacuccgacccg

SEQ ID NO: 20682 - RNA, 20 nt, Homo sapiens
uacugcuuccacagcucccc

SEQ ID NO: 20683 - RNA, 23 nt, Homo sapiens
gcacaugugcacacagccgggug

SEQ ID NO: 20684 - RNA, 21 nt, Homo sapiens
aucugcacugucagcacuuua

SEQ ID NO: 20685 - RNA, 20 nt, Homo sapiens
ugucuccacagggcucuuua

SEQ ID NO: 20686 - RNA, 18 nt, Homo sapiens
ggagaggagggcacugga

SEQ ID NO: 20687 - RNA, 21 nt, Homo sapiens
gaccaaucgccguccccgccg

SEQ ID NO: 20688 - RNA, 22 nt, Homo sapiens
uggcagcagcggagggggcaga

SEQ ID NO: 20689 - RNA, 20 nt, Homo sapiens
ccagcagcaccuggggcagu

SEQ ID NO: 20690 - RNA, 21 nt, Homo sapiens
auccuguacugagcugccccg

SEQ ID NO: 20691 - RNA, 23 nt, Homo sapiens
gaaagugcccucaaggcugagug

SEQ ID NO: 20692 - RNA, 21 nt, Homo sapiens
caaaaaccacaaauaccuuug

SEQ ID NO: 20693 - RNA, 21 nt, Homo sapiens
uggaaaccaagagugggucgc

SEQ ID NO: 20694 - RNA, 21 nt, Homo sapiens
cugaaaccaaguaugggucgc

SEQ ID NO: 20695 - RNA, 19 nt, Homo sapiens
agaaaccccagcagagaca

SEQ ID NO: 20696 - RNA, 19 nt, Homo sapiens
ucagcaguaccagccuaga

SEQ ID NO: 20697 - RNA, 22 nt, Homo sapiens
ugcuguuagcccuagccccgca

SEQ ID NO: 20698 - RNA, 19 nt, Homo sapiens
ccaccucccgaguccucac

SEQ ID NO: 20699 - RNA, 24 nt, Homo sapiens
acugcaggcuccagcuuccaggcu

SEQ ID NO: 20700 - RNA, 23 nt, Homo sapiens
ucacauaggaauaaaaagccaua

SEQ ID NO: 20701 - RNA, 23 nt, Homo sapiens
ucacauaggaaugaaaagccaua

SEQ ID NO: 20702 - RNA, 21 nt, Homo sapiens
gaccaaucgccguccccgccg

SEQ ID NO: 20703 - RNA, 22 nt, Homo sapiens
accuaauauaucaaacauauca

SEQ ID NO: 20704 - RNA, 23 nt, Homo sapiens
gaaacccagcagacaauguagcu

SEQ ID NO: 20705 - RNA, 23 nt, Homo sapiens
aaagucucgcucucugccccuca

SEQ ID NO: 20706 - RNA, 21 nt, Homo sapiens
cacaacccuaguggcgccauu

SEQ ID NO: 20707 - RNA, 22 nt, Homo sapiens
gcggucccgcggcgccccgccu

SEQ ID NO: 20708 - RNA, 22 nt, Homo sapiens
ugcuguuagcccuagccccgca

SEQ ID NO: 20709 - RNA, 22 nt, Homo sapiens
uauccacuacaccccgcugccu

SEQ ID NO: 20710 - RNA, 22 nt, Homo sapiens
ggcagagagucagagcgcggau

SEQ ID NO: 20711 - RNA, 22 nt, Homo sapiens
uccggggacgaacgggacgggu

SEQ ID NO: 20712 - RNA, 25 nt, Homo sapiens
aagaaagagucuugcuuugucgccc

SEQ ID NO: 20713 - RNA, 23 nt, Homo sapiens
aggaacagcagcagcccgggccg

SEQ ID NO: 20714 - RNA, 22 nt, Homo sapiens
cccaacaacaggaaacuaccua

SEQ ID NO: 20715 - RNA, 21 nt, Homo sapiens
uucuaggauaggcccaggggc

SEQ ID NO: 20716 - RNA, 22 nt, Homo sapiens
uuucaguuaucaaucugucaca

SEQ ID NO: 20717 - RNA, 22 nt, Homo sapiens
ggaggccgggacgagugcaaua

SEQ ID NO: 20718 - RNA, 22 nt, Homo sapiens
ggcagagagucagagcgcggau

SEQ ID NO: 20719 - RNA, 22 nt, Homo sapiens
aggucucacuuuguugcccaga

SEQ ID NO: 20720 - RNA, 21 nt, Homo sapiens
ucuccagaucagggcagucca

SEQ ID NO: 20721 - RNA, 22 nt, Homo sapiens
accuaauauaucaaacauauca

SEQ ID NO: 20722 - RNA, 21 nt, Homo sapiens
aacccaauaucaaacauauca

SEQ ID NO: 20723 - RNA, 21 nt, Homo sapiens
aggcggcaggcacaggacugg

SEQ ID NO: 20724 - RNA, 22 nt, Homo sapiens
cccaacaacaugaaacuaccua

SEQ ID NO: 20725 - RNA, 22 nt, Homo sapiens
uagucaagugaagcagugggag

SEQ ID NO: 20726 - RNA, 22 nt, Homo sapiens
ugcaagccuugggugugggagg

SEQ ID NO: 20727 - RNA, 22 nt, Homo sapiens
gcaaaaguaacugcaguuuugg

SEQ ID NO: 20728 - RNA, 25 nt, Homo sapiens
aaggagcucagaagcccugcccagc

SEQ ID NO: 20729 - RNA, 24 nt, Homo sapiens
acgcgcaggccagagacccaggca

SEQ ID NO: 20730 - RNA, 20 nt, Homo sapiens
aggggccucagccuccuggu

SEQ ID NO: 20731 - RNA, 22 nt, Homo sapiens
ugcuguuagcccuagccccgca

SEQ ID NO: 20732 - RNA, 18 nt, Homo sapiens
gaaaugagggccagcuga

SEQ ID NO: 20733 - RNA, 22 nt, Homo sapiens
caaacaccauugucacacucca

SEQ ID NO: 20734 - RNA, 22 nt, Homo sapiens
gcacaaaucuccagaccaccca

SEQ ID NO: 20735 - RNA, 18 nt, Homo sapiens
aucacauucaccucccug

SEQ ID NO: 20736 - RNA, 23 nt, Homo sapiens
gggagugaagacacggagccaga

SEQ ID NO: 20737 - RNA, 22 nt, Homo sapiens
cacucagcggccguuuccccaa

SEQ ID NO: 20738 - RNA, 22 nt, Homo sapiens
gcgaacgcgccacggaccaccu

SEQ ID NO: 20739 - RNA, 20 nt, Homo sapiens
cuggaggaagggcccagagg

SEQ ID NO: 20740 - RNA, 22 nt, Homo sapiens
gccuaagacacaggcccagaga

SEQ ID NO: 20741 - RNA, 25 nt, Homo sapiens
acggagcugucccaacaccaccccu

SEQ ID NO: 20742 - RNA, 22 nt, Homo sapiens
caagacacauuuggagagggac

SEQ ID NO: 20743 - RNA, 22 nt, Homo sapiens
cugggggcggcacaggggcuca

SEQ ID NO: 20744 - RNA, 23 nt, Homo sapiens
gggagugaagacacggagccaga

SEQ ID NO: 20745 - RNA, 21 nt, Homo sapiens
gaccaaucgccguccccgccg

SEQ ID NO: 20746 - RNA, 22 nt, Homo sapiens
ucaacaucagucugauaagcua

SEQ ID NO: 20747 - RNA, 21 nt, Homo sapiens
gcagaacuuagccacugugaa

SEQ ID NO: 20748 - RNA, 23 nt, Homo sapiens
aaagucucgcucucugccccuca

SEQ ID NO: 20749 - RNA, 22 nt, Homo sapiens
cugcacuuuuaugaauaagcuc

SEQ ID NO: 20750 - RNA, 22 nt, Homo sapiens
gcggucccgcggcgccccgccu

SEQ ID NO: 20751 - RNA, 22 nt, Homo sapiens
ugcuguuagcccuagccccgca

SEQ ID NO: 20752 - RNA, 24 nt, Homo sapiens
cacccccagagccucagcucccca

SEQ ID NO: 20753 - RNA, 22 nt, Homo sapiens
cacaagaucggaucuacggguu

SEQ ID NO: 20754 - RNA, 22 nt, Homo sapiens
cgcaaggucgguucuacgggug

SEQ ID NO: 20755 - RNA, 23 nt, Homo sapiens
cugcagaacuguucccgcugcua

SEQ ID NO: 20756 - RNA, 22 nt, Homo sapiens
aaagugcuucuuaccuccagau

SEQ ID NO: 20757 - RNA, 22 nt, Homo sapiens
aaagugcuucuuaccuccagau

SEQ ID NO: 20758 - RNA, 23 nt, Homo sapiens
acacucuaaagagaagcgcuuug

SEQ ID NO: 20759 - RNA, 21 nt, Homo sapiens
agaaaguacuucccucuggag

SEQ ID NO: 20760 - RNA, 21 nt, Homo sapiens
agaaagugcaucccucuggag

SEQ ID NO: 20761 - RNA, 22 nt, Homo sapiens
gguaaaacucgcaauuacuuuu

SEQ ID NO: 20762 - RNA, 22 nt, Homo sapiens
ggcaaaaaccgcaauuacuuuu

SEQ ID NO: 20763 - RNA, 22 nt, Homo sapiens
ggcaaaaaccacaauuacuuuu

SEQ ID NO: 20764 - RNA, 22 nt, Homo sapiens
gacaaaaaccgcgauuacuuuu

SEQ ID NO: 20765 - RNA, 22 nt, Homo sapiens
ggcaaaauccgcaauuacuuuu

SEQ ID NO: 20766 - RNA, 22 nt, Homo sapiens
accaaagaccgcaauuacuuuu

SEQ ID NO: 20767 - RNA, 21 nt, Homo sapiens
uuuuggugcauauuuacuuua

SEQ ID NO: 20768 - RNA, 20 nt, Homo sapiens
aggggccucagccuccuggu

SEQ ID NO: 20769 - RNA, 20 nt, Homo sapiens
aggggccucagccuccuggu

SEQ ID NO: 20770 - RNA, 22 nt, Homo sapiens
agcucagaacccagaggucuca

SEQ ID NO: 20771 - RNA, 22 nt, Homo sapiens
aacuauacaaccuacuaccuca

SEQ ID NO: 20772 - RNA, 22 nt, Homo sapiens
aaccacacaaccuacuaccuca

SEQ ID NO: 20773 - RNA, 22 nt, Homo sapiens
aaccauacaaccuacuaccuca

SEQ ID NO: 20774 - RNA, 22 nt, Homo sapiens
aacuaugcaaccuacuaccucu

SEQ ID NO: 20775 - RNA, 22 nt, Homo sapiens
aacuauacaaccuccuaccuca

SEQ ID NO: 20776 - RNA, 22 nt, Homo sapiens
aacuauacaaucuacuaccuca

SEQ ID NO: 20777 - RNA, 22 nt, Homo sapiens
aacuguacaaacuacuaccuca

SEQ ID NO: 20778 - RNA, 22 nt, Homo sapiens
aacagcacaaacuacuaccuca

SEQ ID NO: 20779 - RNA, 21 nt, Homo sapiens
ccccucccagccucccugcca

SEQ ID NO: 20780 - RNA, 22 nt, Homo sapiens
ggagauggagccagggcccuaa

SEQ ID NO: 20781 - RNA, 23 nt, Homo sapiens
cuaacugcacuagaugcaccuua

SEQ ID NO: 20782 - RNA, 22 nt, Homo sapiens
cggugagcacccggccccugcg

SEQ ID NO: 20783 - RNA, 22 nt, Homo sapiens
uuaacagcuaagcacccuaauc

SEQ ID NO: 20784 - RNA, 21 nt, Homo sapiens
acaggauugagggggggcccu

SEQ ID NO: 20785 - RNA, 22 nt, Homo sapiens
aaucagucucauugcuuuauaa

SEQ ID NO: 20786 - RNA, 25 nt, Homo sapiens
acggagcugucccaacaccaccccu

SEQ ID NO: 20787 - RNA, 24 nt, Homo sapiens
acgcgcaggccagagacccaggca

SEQ ID NO: 20788 - RNA, 20 nt, Homo sapiens
uccccacagacccagagccg

SEQ ID NO: 20789 - RNA, 23 nt, Homo sapiens
ccgcuugagcuaacuccgacccg

SEQ ID NO: 20790 - RNA, 20 nt, Homo sapiens
uacugcuuccacagcucccc

SEQ ID NO: 20791 - RNA, 22 nt, Homo sapiens
aacaauacaacuuacuaccuca

SEQ ID NO: 20792 - RNA, 21 nt, Homo sapiens
ccccucccagccucccugcca

SEQ ID NO: 20793 - RNA, 22 nt, Homo sapiens
ugaagaagggggggaagggcgu

SEQ ID NO: 20794 - RNA, 18 nt, Homo sapiens
cccccaccaccacgcccg

SEQ ID NO: 20795 - RNA, 22 nt, Homo sapiens
agaaagcgcuuuccuuuguaga

SEQ ID NO: 20796 - RNA, 23 nt, Homo sapiens
gggagugaagacacggagccaga

SEQ ID NO: 20797 - RNA, 22 nt, Homo sapiens
acacucuaaaaggaugcacgau

SEQ ID NO: 20798 - RNA, 18 nt, Homo sapiens
auucaaucuacugccuca

SEQ ID NO: 20799 - RNA, 22 nt, Homo sapiens
ucaggaacugccuuucucucca

SEQ ID NO: 20800 - RNA, 22 nt, Homo sapiens
ccggcugcaacacaagacacga

SEQ ID NO: 20801 - RNA, 22 nt, Homo sapiens
cggugagcacccggccccugcg

SEQ ID NO: 20802 - RNA, 22 nt, Homo sapiens
ucaucauuaccaggcaguauua

SEQ ID NO: 20803 - RNA, 23 nt, Homo sapiens
uccaucauuacccggcaguauua

SEQ ID NO: 20804 - RNA, 20 nt, Homo sapiens
cuggaggaagggcccagagg

SEQ ID NO: 20805 - RNA, 22 nt, Homo sapiens
gccuaagacacaggcccagaga

SEQ ID NO: 20806 - RNA, 22 nt, Homo sapiens
acgguuuuaccagacaguauua

SEQ ID NO: 20807 - RNA, 19 nt, Homo sapiens
guccugaauuccgcagccu

SEQ ID NO: 20808 - RNA, 25 nt, Homo sapiens
accaacggaccuacuucccuccgcc

SEQ ID NO: 20809 - RNA, 23 nt, Homo sapiens
gggagugaagacacggagccaga

SEQ ID NO: 20810 - RNA, 23 nt, Homo sapiens
aggaacagcagcagcccgggccg

SEQ ID NO: 20811 - RNA, 21 nt, Homo sapiens
gaccaaucgccguccccgccg

SEQ ID NO: 20812 - RNA, 23 nt, Homo sapiens
aaagucucgcucucugccccuca

SEQ ID NO: 20813 - RNA, 22 nt, Homo sapiens
ccucauggaaggguuccccacu

SEQ ID NO: 20814 - RNA, 21 nt, Homo sapiens
uagcacccagauagcaaggau

SEQ ID NO: 20815 - RNA, 22 nt, Homo sapiens
aaagugcuucuuaccuccagau

SEQ ID NO: 20816 - RNA, 23 nt, Homo sapiens
acacucuaaagagaagcgcuuug

SEQ ID NO: 20817 - RNA, 21 nt, Homo sapiens
agaaaguacuucccucuggag

SEQ ID NO: 20818 - RNA, 21 nt, Homo sapiens
agaaagugcaucccucuggag

SEQ ID NO: 20819 - RNA, 23 nt, Homo sapiens
gucagaccccgagggguccucgc

SEQ ID NO: 20820 - RNA, 23 nt, Homo sapiens
ccaccuggcaagaacaggcguuc

SEQ ID NO: 20821 - RNA, 22 nt, Homo sapiens
gcggucccgcggcgccccgccu

SEQ ID NO: 20822 - RNA, 22 nt, Homo sapiens
ugcuguuagcccuagccccgca

SEQ ID NO: 20823 - RNA, 20 nt, Homo sapiens
uacugcuuccacagcucccc

SEQ ID NO: 20824 - RNA, 22 nt, Homo sapiens
cuagggaacacagggcugguga

SEQ ID NO: 20825 - RNA, 22 nt, Homo sapiens
uaaaugaauucaauuuccuucu

SEQ ID NO: 20826 - RNA, 17 nt, Homo sapiens
gggagaggaggaggcga

SEQ ID NO: 20827 - RNA, 23 nt, Homo sapiens
cggccugauucacaacaccagcu

SEQ ID NO: 20828 - RNA, 21 nt, Homo sapiens
gggcaucugggacgcgcagga

SEQ ID NO: 20829 - RNA, 22 nt, Homo sapiens
uggcagcagcggagggggcaga

SEQ ID NO: 20830 - RNA, 20 nt, Homo sapiens
acagcaaggagggcaggagg

SEQ ID NO: 20831 - RNA, 23 nt, Homo sapiens
cuaccugcacuauaagcacuuua

SEQ ID NO: 20832 - RNA, 22 nt, Homo sapiens
cucaauagacugugagcuccuu

SEQ ID NO: 20833 - RNA, 20 nt, Homo sapiens
ccagcagcaccuggggcagu

SEQ ID NO: 20834 - RNA, 22 nt, Homo sapiens
gagcccuggacuaggagucagc

SEQ ID NO: 20835 - RNA, 21 nt, Homo sapiens
auccuguacugagcugccccg

SEQ ID NO: 20836 - RNA, 21 nt, Homo sapiens
uugucuaaccagucaccuguu

SEQ ID NO: 20837 - RNA, 23 nt, Homo sapiens
cccagcuagauuguaagcuccuu

SEQ ID NO: 20838 - RNA, 21 nt, Homo sapiens
ccccucccagccucccugcca

SEQ ID NO: 20839 - RNA, 21 nt, Homo sapiens
cugaggagagaggaggugggg

SEQ ID NO: 20840 - RNA, 22 nt, Homo sapiens
cuggagagacaaggggaagagg

SEQ ID NO: 20841 - RNA, 22 nt, Homo sapiens
ggcucccaagaaccucaccugu

SEQ ID NO: 20842 - RNA, 24 nt, Homo sapiens
gaaagugcauagaauucugucugg

SEQ ID NO: 20843 - RNA, 23 nt, Homo sapiens
aggaacagcagcagcccgggccg

SEQ ID NO: 20844 - RNA, 18 nt, Homo sapiens
auucaaucuacugccuca

SEQ ID NO: 20845 - RNA, 23 nt, Homo sapiens
cuaucugcacuagaugcaccuua

SEQ ID NO: 20846 - RNA, 22 nt, Homo sapiens
cggugagcacccggccccugcg

SEQ ID NO: 20847 - RNA, 21 nt, Homo sapiens
acaggauugagggggggcccu

SEQ ID NO: 20848 - RNA, 21 nt, Homo sapiens
acaggauugagggggggcccu

SEQ ID NO: 20849 - RNA, 22 nt, Homo sapiens
gagcccuggacuaggagucagc

SEQ ID NO: 20850 - RNA, 22 nt, Homo sapiens
gugauugccacucuccugagua

SEQ ID NO: 20851 - RNA, 19 nt, Homo sapiens
aagacauuuucagacagcu

SEQ ID NO: 20852 - RNA, 19 nt, Homo sapiens
ucccacaggaagcagacac

SEQ ID NO: 20853 - RNA, 23 nt, Homo sapiens
agaaaccaugggguaugagcaga

SEQ ID NO: 20854 - RNA, 21 nt, Homo sapiens
aggagacucacaaguuccugc

SEQ ID NO: 20855 - RNA, 20 nt, Homo sapiens
cccugcgccaucuccucuac

SEQ ID NO: 20856 - RNA, 21 nt, Homo sapiens
ggggagcgggggcccugccuu

SEQ ID NO: 20857 - RNA, 23 nt, Homo sapiens
cacaaauucgguucuacagggua

SEQ ID NO: 20858 - RNA, 22 nt, Homo sapiens
gaggcucagaauggcucaggag

SEQ ID NO: 20859 - RNA, 21 nt, Homo sapiens
cugaggagagaggaggugggg

SEQ ID NO: 20860 - RNA, 17 nt, Homo sapiens
ggguggcagcgguggga

SEQ ID NO: 20861 - RNA, 21 nt, Homo sapiens
gagcuacagugcuucaucuca

SEQ ID NO: 20862 - RNA, 23 nt, Homo sapiens
agggauuccugggaaaacuggac

SEQ ID NO: 20863 - RNA, 22 nt, Homo sapiens
agcugaguguaggauguuuaca

SEQ ID NO: 20864 - RNA, 21 nt, Homo sapiens
ucaaucacagauagcaccccu

SEQ ID NO: 20865 - RNA, 20 nt, Homo sapiens
uacugcuuccacagcucccc

SEQ ID NO: 20866 - RNA, 22 nt, Homo sapiens
gugggguggguggucaggccga

SEQ ID NO: 20867 - RNA, 22 nt, Homo sapiens
ggagauggagccagggcccuaa

SEQ ID NO: 20868 - RNA, 22 nt, Homo sapiens
ggagauggagccagggcccuaa

SEQ ID NO: 20869 - RNA, 23 nt, Homo sapiens
gggagugaagacacggagccaga

SEQ ID NO: 20870 - RNA, 18 nt, Homo sapiens
ggagaggagggcacugga

SEQ ID NO: 20871 - RNA, 21 nt, Homo sapiens
ugcaaacccugcaugugggag

SEQ ID NO: 20872 - RNA, 22 nt, Homo sapiens
acugggacuuuguaggccaguu

SEQ ID NO: 20873 - RNA, 22 nt, Homo sapiens
agcgggacuuugagggccaguu

SEQ ID NO: 20874 - RNA, 22 nt, Homo sapiens
uccacauggaguugcuguuaca

SEQ ID NO: 20875 - RNA, 22 nt, Homo sapiens
uagucaagugaagcagugggag

SEQ ID NO: 20876 - RNA, 21 nt, Homo sapiens
aaagugucagauacggugugg

SEQ ID NO: 20877 - RNA, 23 nt, Homo sapiens
gcgcccaauuaaugucuguugau

SEQ ID NO: 20878 - RNA, 21 nt, Homo sapiens
acaggauugagggggggcccu

SEQ ID NO: 20879 - RNA, 22 nt, Homo sapiens
agcugaguguaggauguuuaca

SEQ ID NO: 20880 - RNA, 22 nt, Homo sapiens
acggaagggcagagagggccag

SEQ ID NO: 20881 - RNA, 23 nt, Homo sapiens
acacucaaaagauggcggcacuu

SEQ ID NO: 20882 - RNA, 23 nt, Homo sapiens
aaagucucgcucucugccccuca

SEQ ID NO: 20883 - RNA, 21 nt, Homo sapiens
gaccaagaaauagccuuucaa

SEQ ID NO: 20884 - RNA, 22 nt, Homo sapiens
ugcaagccuugggugugggagg

SEQ ID NO: 20885 - RNA, 22 nt, Homo sapiens
ggaggccgggacgagugcaaua

SEQ ID NO: 20886 - RNA, 21 nt, Homo sapiens
ccccucccagccucccugcca

SEQ ID NO: 20887 - RNA, 20 nt, Homo sapiens
gcagaagcauuuccacacac

SEQ ID NO: 20888 - RNA, 23 nt, Homo sapiens
gggagugaagacacggagccaga

SEQ ID NO: 20889 - RNA, 23 nt, Homo sapiens
cuaucugcacuagaugcaccuua

SEQ ID NO: 20890 - RNA, 22 nt, Homo sapiens
cggugagcacccggccccugcg

SEQ ID NO: 20891 - RNA, 22 nt, Homo sapiens
aaagagguuaaccagguguguu

SEQ ID NO: 20892 - RNA, 21 nt, Homo sapiens
ucaaucacagauagcaccccu

SEQ ID NO: 20893 - RNA, 22 nt, Homo sapiens
ugaauccuugaauagguguguu

SEQ ID NO: 20894 - RNA, 23 nt, Homo sapiens
gaaagugcccucaaggcugagug

SEQ ID NO: 20895 - RNA, 22 nt, Homo sapiens
uccucuuuucuuagagacucac

SEQ ID NO: 20896 - RNA, 21 nt, Homo sapiens
gaaggaagugagugcagccac

SEQ ID NO: 20897 - RNA, 23 nt, Homo sapiens
gucacaucccucccaagacccuc

SEQ ID NO: 20898 - RNA, 20 nt, Homo sapiens
uccgccugucugaacaguga

SEQ ID NO: 20899 - RNA, 22 nt, Homo sapiens
agcuagugagaagucaaugccu

SEQ ID NO: 20900 - RNA, 22 nt, Homo sapiens
cgcauuauuacucacgguacga

SEQ ID NO: 20901 - RNA, 19 nt, Homo sapiens
aagccaaagccuuauccau

SEQ ID NO: 20902 - RNA, 22 nt, Homo sapiens
uggcagcagcggagggggcaga

SEQ ID NO: 20903 - RNA, 20 nt, Homo sapiens
ccagcagcaccuggggcagu

SEQ ID NO: 20904 - RNA, 21 nt, Homo sapiens
auccuguacugagcugccccg

SEQ ID NO: 20905 - RNA, 22 nt, Homo sapiens
gcacacaauaaauguuugcuga

SEQ ID NO: 20906 - RNA, 22 nt, Homo sapiens
gacaaaacccgcaaauacuuuu

SEQ ID NO: 20907 - RNA, 23 nt, Homo sapiens
acaacaaaaucacuagucuucca

SEQ ID NO: 20908 - RNA, 22 nt, Homo sapiens
cucauccgauguacaauaauuu

SEQ ID NO: 20909 - RNA, 21 nt, Homo sapiens
uagaaaggcuaggaccaaacc

SEQ ID NO: 20910 - RNA, 21 nt, Homo sapiens
ggaaaucccuggcaaugugau

SEQ ID NO: 20911 - RNA, 21 nt, Homo sapiens
gguaaucccuggcaaugugau

SEQ ID NO: 20912 - RNA, 21 nt, Homo sapiens
acaggauugagggggggcccu

SEQ ID NO: 20913 - RNA, 21 nt, Homo sapiens
acaggauugagggggggcccu

SEQ ID NO: 20914 - RNA, 22 nt, Homo sapiens
auguaugugggacgguaaacca

SEQ ID NO: 20915 - RNA, 22 nt, Homo sapiens
uaaccgauuucagauggugcua

SEQ ID NO: 20916 - RNA, 23 nt, Homo sapiens
aacacugauuucaaauggugcua

SEQ ID NO: 20917 - RNA, 22 nt, Homo sapiens
uaaccgauuucaaauggugcua

SEQ ID NO: 20918 - RNA, 23 nt, Homo sapiens
cgugagcuccuggaggacaggga

SEQ ID NO: 20919 - RNA, 22 nt, Homo sapiens
gacucuugaacaacacagguuu

SEQ ID NO: 20920 - RNA, 22 nt, Homo sapiens
aaccauacaaccuacuaccuca

SEQ ID NO: 20921 - RNA, 22 nt, Homo sapiens
aggucucacuuuguugcccaga

SEQ ID NO: 20922 - RNA, 22 nt, Homo sapiens
cacgaccgacgccacgccgagu

SEQ ID NO: 20923 - RNA, 22 nt, Homo sapiens
ucagaccgagacaagugcaaug

SEQ ID NO: 20924 - RNA, 22 nt, Homo sapiens
gagguuucccguguauguuuca

SEQ ID NO: 20925 - RNA, 25 nt, Homo sapiens
aaggagcucagaagcccugcccagc

SEQ ID NO: 20926 - RNA, 22 nt, Homo sapiens
ugcuguuagcccuagccccgca

SEQ ID NO: 20927 - RNA, 21 nt, Homo sapiens
ugacugacagcuuuuugagua

SEQ ID NO: 20928 - RNA, 20 nt, Homo sapiens
uacugcuuccacagcucccc

SEQ ID NO: 20929 - RNA, 24 nt, Homo sapiens
cacccccagagccucagcucccca

SEQ ID NO: 20930 - RNA, 26 nt, Homo sapiens
uuucagaauuugcugccaucaucauc

SEQ ID NO: 20931 - RNA, 21 nt, Homo sapiens
cuagggaagaacagugagcaa

SEQ ID NO: 20932 - RNA, 20 nt, Homo sapiens
ggcauucaccgcgugccuua

SEQ ID NO: 20933 - RNA, 18 nt, Homo sapiens
ugguggcagaggugggau

SEQ ID NO: 20934 - RNA, 21 nt, Homo sapiens
auguaggccuuuagaucacuu

SEQ ID NO: 20935 - RNA, 22 nt, Homo sapiens
cagaagugggccgggcacaggg

SEQ ID NO: 20936 - RNA, 21 nt, Homo sapiens
ucuacucagaagggugccuua

SEQ ID NO: 20937 - RNA, 23 nt, Homo sapiens
ccuagagagggugagaaccugcc

SEQ ID NO: 20938 - RNA, 21 nt, Homo sapiens
ggggagcgggggcccugccuu

SEQ ID NO: 20939 - RNA, 22 nt, Homo sapiens
gugggguggguggucaggccga

SEQ ID NO: 20940 - RNA, 21 nt, Homo sapiens
cugggggacggagcagaagga

SEQ ID NO: 20941 - RNA, 20 nt, Homo sapiens
ggcauucaccgcgugccuua

SEQ ID NO: 20942 - RNA, 24 nt, Homo sapiens
ucacagguuaaagggucucaggga

SEQ ID NO: 20943 - RNA, 22 nt, Homo sapiens
ucacaaguuagggucucaggga

SEQ ID NO: 20944 - RNA, 23 nt, Homo sapiens
agcccuguucuacagcccugagg

SEQ ID NO: 20945 - RNA, 22 nt, Homo sapiens
ucccucacacagaauuccagaa

SEQ ID NO: 20946 - RNA, 23 nt, Homo sapiens
cccaacagacauggcgguacuca

SEQ ID NO: 20947 - RNA, 22 nt, Homo sapiens
acggaagggcagagagggccag

SEQ ID NO: 20948 - RNA, 20 nt, Homo sapiens
gcaaugcaacagcaaugcac

SEQ ID NO: 20949 - RNA, 23 nt, Homo sapiens
ucaacgggagugaucgugucauu

SEQ ID NO: 20950 - RNA, 21 nt, Homo sapiens
ucuacucagaagggugccuua

SEQ ID NO: 20951 - RNA, 22 nt, Homo sapiens
gugauugccacucuccugagua

SEQ ID NO: 20952 - RNA, 22 nt, Homo sapiens
aacgcuccaaaagaaggcacuc

SEQ ID NO: 20953 - RNA, 18 nt, Homo sapiens
acccucugaaaggaagca

SEQ ID NO: 20954 - RNA, 22 nt, Homo sapiens
aaagugcuucuuaccuccagau

SEQ ID NO: 20955 - RNA, 22 nt, Homo sapiens
aacacucuaaaaggaggcacuu

SEQ ID NO: 20956 - RNA, 21 nt, Homo sapiens
cacaaccucaguguuuccagg

SEQ ID NO: 20957 - RNA, 21 nt, Homo sapiens
ggggagcgggggcccugccuu

SEQ ID NO: 20958 - RNA, 21 nt, Homo sapiens
ccccucccagccucccugcca

SEQ ID NO: 20959 - RNA, 22 nt, Homo sapiens
ggcucccaagaaccucaccugu

SEQ ID NO: 20960 - RNA, 21 nt, Homo sapiens
cggggugcacgggcggagggc

SEQ ID NO: 20961 - RNA, 21 nt, Homo sapiens
ugcaaacccugcaugugggag

SEQ ID NO: 20962 - RNA, 23 nt, Homo sapiens
cuaucugcacuagaugcaccuua

SEQ ID NO: 20963 - RNA, 21 nt, Homo sapiens
gaccaaucgccguccccgccg

SEQ ID NO: 20964 - RNA, 22 nt, Homo sapiens
cuguuccugcugaacugagcca

SEQ ID NO: 20965 - RNA, 22 nt, Homo sapiens
ucagaccgagacaagugcaaug

SEQ ID NO: 20966 - RNA, 23 nt, Homo sapiens
gaaagugcccucaaggcugagug

SEQ ID NO: 20967 - RNA, 25 nt, Homo sapiens
accaacggaccuacuucccuccgcc

SEQ ID NO: 20968 - RNA, 22 nt, Homo sapiens
gcggucccgcggcgccccgccu

SEQ ID NO: 20969 - RNA, 22 nt, Homo sapiens
ugcuguuagcccuagccccgca

SEQ ID NO: 20970 - RNA, 22 nt, Homo sapiens
ucggucccucgggccagggcag

SEQ ID NO: 20971 - RNA, 22 nt, Homo sapiens
uauccacuacaccccgcugccu

SEQ ID NO: 20972 - RNA, 22 nt, Homo sapiens
aacuauacaaccuacuaccuca

SEQ ID NO: 20973 - RNA, 22 nt, Homo sapiens
aaccacacaaccuacuaccuca

SEQ ID NO: 20974 - RNA, 22 nt, Homo sapiens
aaccauacaaccuacuaccuca

SEQ ID NO: 20975 - RNA, 22 nt, Homo sapiens
aacuaugcaaccuacuaccucu

SEQ ID NO: 20976 - RNA, 22 nt, Homo sapiens
aacuauacaaccuccuaccuca

SEQ ID NO: 20977 - RNA, 22 nt, Homo sapiens
aacuauacaaucuacuaccuca

SEQ ID NO: 20978 - RNA, 22 nt, Homo sapiens
aacuguacaaacuacuaccuca

SEQ ID NO: 20979 - RNA, 22 nt, Homo sapiens
aacagcacaaacuacuaccuca

SEQ ID NO: 20980 - RNA, 22 nt, Homo sapiens
agacaacaaugccaaccucaca

SEQ ID NO: 20981 - RNA, 22 nt, Homo sapiens
augcccuuucaucauugcacug

SEQ ID NO: 20982 - RNA, 23 nt, Homo sapiens
cccaacagacauggcgguacuca

SEQ ID NO: 20983 - RNA, 23 nt, Homo sapiens
aaaucagaaucacaccuggggga

SEQ ID NO: 20984 - RNA, 22 nt, Homo sapiens
agccacaaucaccuucugaucu

SEQ ID NO: 20985 - RNA, 22 nt, Homo sapiens
ccuggcacacaguagaccuuca

SEQ ID NO: 20986 - RNA, 22 nt, Homo sapiens
uccagcaaagggaagcgcuuuc

SEQ ID NO: 20987 - RNA, 22 nt, Homo sapiens
accucuaaaggggagcgcuuug

SEQ ID NO: 20988 - RNA, 23 nt, Homo sapiens
acacucuaaagagaagcgcuuug

SEQ ID NO: 20989 - RNA, 21 nt, Homo sapiens
gcuccaaagggaagcgcuuug

SEQ ID NO: 20990 - RNA, 21 nt, Homo sapiens
ccucuaaagagaagcgcuuuc

SEQ ID NO: 20991 - RNA, 25 nt, Homo sapiens
acggagcugucccaacaccaccccu

SEQ ID NO: 20992 - RNA, 21 nt, Homo sapiens
ucccagcacacauuuagcuca

SEQ ID NO: 20993 - RNA, 24 nt, Homo sapiens
acgcagagcccgaaagcccccagu

SEQ ID NO: 20994 - RNA, 21 nt, Homo sapiens
caucaccuuccuucuccucca

SEQ ID NO: 20995 - RNA, 20 nt, Homo sapiens
cccugcgccaucuccucuac

SEQ ID NO: 20996 - RNA, 20 nt, Homo sapiens
cccugcgccaucuccucuac

SEQ ID NO: 20997 - RNA, 20 nt, Homo sapiens
uacugcuuccacagcucccc

SEQ ID NO: 20998 - RNA, 22 nt, Homo sapiens
aacaauacaacuuacuaccuca

SEQ ID NO: 20999 - RNA, 22 nt, Homo sapiens
acacacccacgcgagccggaaa

SEQ ID NO: 21000 - RNA, 22 nt, Homo sapiens
gugggguggguggucaggccga

SEQ ID NO: 21001 - RNA, 22 nt, Homo sapiens
ggcucccaagaaccucaccugu

SEQ ID NO: 21002 - RNA, 22 nt, Homo sapiens
cacgaccgacgccacgccgagu

SEQ ID NO: 21003 - RNA, 21 nt, Homo sapiens
acuagacugugagcuccucga

SEQ ID NO: 21004 - RNA, 22 nt, Homo sapiens
acugccugucugugccugcugu

SEQ ID NO: 21005 - RNA, 22 nt, Homo sapiens
cucaauagacugugagcuccuu

SEQ ID NO: 21006 - RNA, 22 nt, Homo sapiens
agcugaguguaggauguuuaca

SEQ ID NO: 21007 - RNA, 23 nt, Homo sapiens
agaggcaggcaugcgggcagaca

SEQ ID NO: 21008 - RNA, 22 nt, Homo sapiens
accagguuccaccccagcaggc

SEQ ID NO: 21009 - RNA, 22 nt, Homo sapiens
cuacccacagacguaccaauca

SEQ ID NO: 21010 - RNA, 22 nt, Homo sapiens
cuacccacagacguaccaauca

SEQ ID NO: 21011 - RNA, 18 nt, Homo sapiens
augacaccucccugugaa

SEQ ID NO: 21012 - RNA, 22 nt, Homo sapiens
ugcaagccuugggugugggagg

SEQ ID NO: 21013 - RNA, 19 nt, Homo sapiens
guccugaauuccgcagccu

SEQ ID NO: 21014 - RNA, 23 nt, Homo sapiens
cccagcuagauuguaagcuccuu

SEQ ID NO: 21015 - RNA, 23 nt, Homo sapiens
aaaaugcagauuccuggacucca

SEQ ID NO: 21016 - RNA, 24 nt, Homo sapiens
acugcuggucuucagucagggcca

SEQ ID NO: 21017 - RNA, 22 nt, Homo sapiens
ccagaacugaguccacagggca

SEQ ID NO: 21018 - RNA, 22 nt, Homo sapiens
acaccuggcuccacacgcgggc

SEQ ID NO: 21019 - RNA, 22 nt, Homo sapiens
agugaauucuaccagugccaua

SEQ ID NO: 21020 - RNA, 21 nt, Homo sapiens
cccuccaccaugcaagggaug

SEQ ID NO: 21021 - RNA, 23 nt, Homo sapiens
cagcugcuuuugggauuccguug

SEQ ID NO: 21022 - RNA, 22 nt, Homo sapiens
uuaacagcuaagcacccuaauc

SEQ ID NO: 21023 - RNA, 22 nt, Homo sapiens
aaagagguuaaccagguguguu

SEQ ID NO: 21024 - RNA, 23 nt, Homo sapiens
cgugagcuccuggaggacaggga

SEQ ID NO: 21025 - RNA, 22 nt, Homo sapiens
ugaauccuugaauagguguguu

SEQ ID NO: 21026 - RNA, 22 nt, Homo sapiens
cagcauggaguccuccagguug

SEQ ID NO: 21027 - RNA, 23 nt, Homo sapiens
caugagugacgcccucuggagua

SEQ ID NO: 21028 - RNA, 22 nt, Homo sapiens
acaucaucgcauauugacacaa

SEQ ID NO: 21029 - RNA, 22 nt, Homo sapiens
acaguggucaucgagugacaca

SEQ ID NO: 21030 - RNA, 23 nt, Homo sapiens
acccaacagccccugcaagggau

SEQ ID NO: 21031 - RNA, 22 nt, Homo sapiens
ucggucccucgggccagggcag

SEQ ID NO: 21032 - RNA, 21 nt, Homo sapiens
cugggggacggagcagaagga

SEQ ID NO: 21033 - RNA, 22 nt, Homo sapiens
cgaccauggcuguagacuguua

SEQ ID NO: 21034 - RNA, 21 nt, Homo sapiens
ggccgugacuggagacuguua

SEQ ID NO: 21035 - RNA, 21 nt, Homo sapiens
acaugguuagaucaagcacaa

SEQ ID NO: 21036 - RNA, 22 nt, Homo sapiens
acaaccagcuaagacacugcca

SEQ ID NO: 21037 - RNA, 22 nt, Homo sapiens
auggcaguggaguuagugauug

SEQ ID NO: 21038 - RNA, 23 nt, Homo sapiens
gcaaucagcuaacuacacugccu

SEQ ID NO: 21039 - RNA, 21 nt, Homo sapiens
ccuucugacuccaaguccagu

SEQ ID NO: 21040 - RNA, 22 nt, Homo sapiens
accagcuaacaauacacugcca

SEQ ID NO: 21041 - RNA, 22 nt, Homo sapiens
gccagcuaacaauacacugccu

SEQ ID NO: 21042 - RNA, 22 nt, Homo sapiens
gcaaaaguaauugagauuuuug

SEQ ID NO: 21043 - RNA, 22 nt, Homo sapiens
gcaaagguaauugcuguuuucg

SEQ ID NO: 21044 - RNA, 22 nt, Homo sapiens
ccuaaugauucaucauucucaa

SEQ ID NO: 21045 - RNA, 19 nt, Homo sapiens
accagugcccugcacacuu

SEQ ID NO: 21046 - RNA, 21 nt, Homo sapiens
cuggaggacggcaacagucag

SEQ ID NO: 21047 - RNA, 21 nt, Homo sapiens
cucccccacugcagcuggcac

SEQ ID NO: 21048 - RNA, 21 nt, Homo sapiens
cugaggagagaggaggugggg

SEQ ID NO: 21049 - RNA, 18 nt, Homo sapiens
aucacauucaccucccug

SEQ ID NO: 21050 - RNA, 23 nt, Homo sapiens
gggagugaagacacggagccaga

SEQ ID NO: 21051 - RNA, 22 nt, Homo sapiens
acaguucuucaacuggcagcuu

SEQ ID NO: 21052 - RNA, 20 nt, Homo sapiens
cuggaggaagggcccagagg

SEQ ID NO: 21053 - RNA, 22 nt, Homo sapiens
gccuaagacacaggcccagaga

SEQ ID NO: 21054 - RNA, 19 nt, Homo sapiens
auuuugguacagcagcuca

SEQ ID NO: 21055 - RNA, 21 nt, Homo sapiens
ggggagcgggggcccugccuu

SEQ ID NO: 21056 - RNA, 22 nt, Homo sapiens
cuggagagacaaggggaagagg

SEQ ID NO: 21057 - RNA, 22 nt, Homo sapiens
uaaaugaauucaauuuccuucu

SEQ ID NO: 21058 - RNA, 17 nt, Homo sapiens
gggagaggaggaggcga

SEQ ID NO: 21059 - RNA, 20 nt, Homo sapiens
acagcaaggagggcaggagg

SEQ ID NO: 21060 - RNA, 22 nt, Homo sapiens
ucagaccgagacaagugcaaug

SEQ ID NO: 21061 - RNA, 20 nt, Homo sapiens
cuggaggaagggcccagagg

SEQ ID NO: 21062 - RNA, 22 nt, Homo sapiens
gccuaagacacaggcccagaga

SEQ ID NO: 21063 - RNA, 23 nt, Homo sapiens
gaaagugcccucaaggcugagug

SEQ ID NO: 21064 - RNA, 21 nt, Homo sapiens
caucaccuuccuucuccucca

SEQ ID NO: 21065 - RNA, 20 nt, Homo sapiens
cccugcgccaucuccucuac

SEQ ID NO: 21066 - RNA, 22 nt, Homo sapiens
uauccacuacaccccgcugccu

SEQ ID NO: 21067 - RNA, 22 nt, Homo sapiens
ggagcccgcgccccgcgccgag

SEQ ID NO: 21068 - RNA, 22 nt, Homo sapiens
acugccugucugugccugcugu

SEQ ID NO: 21069 - RNA, 22 nt, Homo sapiens
accagguuccaccccagcaggc

SEQ ID NO: 21070 - RNA, 21 nt, Homo sapiens
guucuaacccauuguggccaa

SEQ ID NO: 21071 - RNA, 23 nt, Homo sapiens
agaaaccaugggguaugagcaga

SEQ ID NO: 21072 - RNA, 22 nt, Homo sapiens
uauccacuacaccccgcugccu

SEQ ID NO: 21073 - RNA, 25 nt, Homo sapiens
gaauccugguucugucccucacuag

SEQ ID NO: 21074 - RNA, 22 nt, Homo sapiens
gggagaggucucccugcgcaca

SEQ ID NO: 21075 - RNA, 22 nt, Homo sapiens
uccggggacgaacgggacgggu

SEQ ID NO: 21076 - RNA, 21 nt, Homo sapiens
gaccaaucgccguccccgccg

SEQ ID NO: 21077 - RNA, 21 nt, Homo sapiens
gaccaaucgccguccccgccg

SEQ ID NO: 21078 - RNA, 22 nt, Homo sapiens
ucagaccgagacaagugcaaug

SEQ ID NO: 21079 - RNA, 21 nt, Homo sapiens
acaggauugagggggggcccu

SEQ ID NO: 21080 - RNA, 22 nt, Homo sapiens
aucgggaggggacugagccuga

SEQ ID NO: 21081 - RNA, 21 nt, Homo sapiens
cccgaggagccgggcaggcuu

SEQ ID NO: 21082 - RNA, 22 nt, Homo sapiens
gcggucccgcggcgccccgccu

SEQ ID NO: 21083 - RNA, 22 nt, Homo sapiens
gcggucccgcggcgccccgccu

SEQ ID NO: 21084 - RNA, 22 nt, Homo sapiens
ugcuguuagcccuagccccgca

SEQ ID NO: 21085 - RNA, 22 nt, Homo sapiens
ugcuguuagcccuagccccgca

SEQ ID NO: 21086 - RNA, 21 nt, Homo sapiens
caucaccuuccuucuccucca

SEQ ID NO: 21087 - RNA, 21 nt, Homo sapiens
aagggucaguaagcacccgcg

SEQ ID NO: 21088 - RNA, 17 nt, Homo sapiens
gggagaggaggaggcga

SEQ ID NO: 21089 - RNA, 18 nt, Homo sapiens
aucacauucaccucccug

SEQ ID NO: 21090 - RNA, 22 nt, Homo sapiens
acaccuggcuccacacgcgggc

SEQ ID NO: 21091 - RNA, 21 nt, Homo sapiens
gaccaaucgccguccccgccg

SEQ ID NO: 21092 - RNA, 22 nt, Homo sapiens
caagacacauuuggagagggac

SEQ ID NO: 21093 - RNA, 24 nt, Homo sapiens
cacccccagagccucagcucccca

SEQ ID NO: 21094 - RNA, 18 nt, Homo sapiens
ccacugaaccacccaugc

SEQ ID NO: 21095 - RNA, 23 nt, Homo sapiens
gggagugaagacacggagccaga

SEQ ID NO: 21096 - RNA, 22 nt, Homo sapiens
uguaaaccaugaugugcugcua

SEQ ID NO: 21097 - RNA, 22 nt, Homo sapiens
acugccugucugugccugcugu

SEQ ID NO: 21098 - RNA, 22 nt, Homo sapiens
cuguuccugcugaacugagcca

SEQ ID NO: 21099 - RNA, 22 nt, Homo sapiens
accagcuaacaauacacugcca

SEQ ID NO: 21100 - RNA, 21 nt, Homo sapiens
agaggucgaccguguaaugug

SEQ ID NO: 21101 - RNA, 21 nt, Homo sapiens
ugcaaugcaacuacaaugcac

SEQ ID NO: 21102 - RNA, 22 nt, Homo sapiens
accagguuccaccccagcaggc

SEQ ID NO: 21103 - RNA, 21 nt, Homo sapiens
gaccaagaaauagccuuucaa

SEQ ID NO: 21104 - RNA, 21 nt, Homo sapiens
acuuuccaggauucauuaacu

SEQ ID NO: 21105 - RNA, 19 nt, Homo sapiens
gcuccuguccaacuggcuc

SEQ ID NO: 21106 - RNA, 19 nt, Homo sapiens
agaaaccccagcagagaca

SEQ ID NO: 21107 - RNA, 22 nt, Homo sapiens
ucuacccagaaaggagccagug

SEQ ID NO: 21108 - RNA, 22 nt, Homo sapiens
gggagaggucucccugcgcaca

SEQ ID NO: 21109 - RNA, 19 nt, Homo sapiens
ccaccucccgaguccucac

SEQ ID NO: 21110 - RNA, 24 nt, Homo sapiens
acugcuggucuucagucagggcca

SEQ ID NO: 21111 - RNA, 21 nt, Homo sapiens
auguaggccuuuagaucacuu

SEQ ID NO: 21112 - RNA, 23 nt, Homo sapiens
aggaacagcagcagcccgggccg

SEQ ID NO: 21113 - RNA, 20 nt, Homo sapiens
cccgccgcgucgcccugggg

SEQ ID NO: 21114 - RNA, 22 nt, Homo sapiens
cacucagcggccguuuccccaa

SEQ ID NO: 21115 - RNA, 22 nt, Homo sapiens
ucagaccgagacaagugcaaug

SEQ ID NO: 21116 - RNA, 22 nt, Homo sapiens
acggaagggcagagagggccag

SEQ ID NO: 21117 - RNA, 21 nt, Homo sapiens
gaccaagaaauagccuuucaa

SEQ ID NO: 21118 - RNA, 25 nt, Homo sapiens
accaacggaccuacuucccuccgcc

SEQ ID NO: 21119 - RNA, 22 nt, Homo sapiens
ggaggccgggacgagugcaaua

SEQ ID NO: 21120 - RNA, 20 nt, Homo sapiens
uccgccugucugaacaguga

SEQ ID NO: 21121 - RNA, 25 nt, Homo sapiens
cagcgucugccggaacccguuccca

SEQ ID NO: 21122 - RNA, 22 nt, Homo sapiens
aacccauggaauucaguucuca

SEQ ID NO: 21123 - RNA, 22 nt, Homo sapiens
agccuauggaauucaguucuca

SEQ ID NO: 21124 - RNA, 22 nt, Homo sapiens
cacucagcggccguuuccccaa

SEQ ID NO: 21125 - RNA, 22 nt, Homo sapiens
cgaauccaccacgaacaacuuc

SEQ ID NO: 21126 - RNA, 22 nt, Homo sapiens
ucaguuuccucugcaaacaguu

SEQ ID NO: 21127 - RNA, 22 nt, Homo sapiens
ccucauggaaggguuccccacu

SEQ ID NO: 21128 - RNA, 21 nt, Homo sapiens
agagcucauccauaguuguca

SEQ ID NO: 21129 - RNA, 25 nt, Homo sapiens
acggagcugucccaacaccaccccu

SEQ ID NO: 21130 - RNA, 20 nt, Homo sapiens
uacugcuuccacagcucccc

SEQ ID NO: 21131 - RNA, 20 nt, Homo sapiens
ugucuccacagggcucuuua

SEQ ID NO: 21132 - RNA, 22 nt, Homo sapiens
cacugguacaaggguugggaga

SEQ ID NO: 21133 - RNA, 22 nt, Homo sapiens
cacaaaccauuaugugcugcua

SEQ ID NO: 21134 - RNA, 22 nt, Homo sapiens
uguaaaccaugaugugcugcua

SEQ ID NO: 21135 - RNA, 22 nt, Homo sapiens
cgccaauauuuacgugcugcua

SEQ ID NO: 21136 - RNA, 21 nt, Homo sapiens
gccaauauuucugugcugcua

SEQ ID NO: 21137 - RNA, 24 nt, Homo sapiens
ugggagaaccucccugcuucugcu

SEQ ID NO: 21138 - RNA, 23 nt, Homo sapiens
ucucugcaggccgugugcuuugc

SEQ ID NO: 21139 - RNA, 22 nt, Homo sapiens
uucaaaacaugaauugcugcug

SEQ ID NO: 21140 - RNA, 22 nt, Homo sapiens
ucaguuuccucugcaaacaguu

SEQ ID NO: 21141 - RNA, 22 nt, Homo sapiens
gcugccguauaugugaugucac

SEQ ID NO: 21142 - RNA, 21 nt, Homo sapiens
acaaaccacagugugcugcug

SEQ ID NO: 21143 - RNA, 23 nt, Homo sapiens
acacucuaaagagaagcgcuuug

SEQ ID NO: 21144 - RNA, 21 nt, Homo sapiens
agaaaguacuucccucuggag

SEQ ID NO: 21145 - RNA, 21 nt, Homo sapiens
agaaagugcaucccucuggag

SEQ ID NO: 21146 - RNA, 21 nt, Homo sapiens
ggacuauagaacuuucccccu

SEQ ID NO: 21147 - RNA, 23 nt, Homo sapiens
guagugggccgagccgagugaca

SEQ ID NO: 21148 - RNA, 21 nt, Homo sapiens
ccccucccagccucccugcca

SEQ ID NO: 21149 - RNA, 20 nt, Homo sapiens
cuggggaaaaggguggcacg

SEQ ID NO: 21150 - RNA, 24 nt, Homo sapiens
acugcuggucuucagucagggcca

SEQ ID NO: 21151 - RNA, 23 nt, Homo sapiens
aggaacagcagcagcccgggccg

SEQ ID NO: 21152 - RNA, 22 nt, Homo sapiens
aaagugcuucuuaccuccagau

SEQ ID NO: 21153 - RNA, 25 nt, Homo sapiens
acggagcugucccaacaccaccccu

SEQ ID NO: 21154 - RNA, 20 nt, Homo sapiens
uacugcuuccacagcucccc

SEQ ID NO: 21155 - RNA, 24 nt, Homo sapiens
acugcuggucuucagucagggcca

SEQ ID NO: 21156 - RNA, 18 nt, Homo sapiens
aucacauucaccucccug

SEQ ID NO: 21157 - RNA, 22 nt, Homo sapiens
ccagaacugaguccacagggca

SEQ ID NO: 21158 - RNA, 23 nt, Homo sapiens
gggagugaagacacggagccaga

SEQ ID NO: 21159 - RNA, 22 nt, Homo sapiens
ucaggaacugccuuucucucca

SEQ ID NO: 21160 - RNA, 21 nt, Homo sapiens
gaccaaucgccguccccgccg

SEQ ID NO: 21161 - RNA, 22 nt, Homo sapiens
cggugagcacccggccccugcg

SEQ ID NO: 21162 - RNA, 25 nt, Homo sapiens
agcuagucaagcgcgguuguggggg

SEQ ID NO: 21163 - RNA, 22 nt, Homo sapiens
acggaagggcagagagggccag

SEQ ID NO: 21164 - RNA, 23 nt, Homo sapiens
cgugagcuccuggaggacaggga

SEQ ID NO: 21165 - RNA, 21 nt, Homo sapiens
auccuguacugagcugccccg

SEQ ID NO: 21166 - RNA, 22 nt, Homo sapiens
ccucauggaaggguuccccacu

SEQ ID NO: 21167 - RNA, 22 nt, Homo sapiens
gcggucccgcggcgccccgccu

SEQ ID NO: 21168 - RNA, 20 nt, Homo sapiens
uacugcuuccacagcucccc

SEQ ID NO: 21169 - RNA, 24 nt, Homo sapiens
cacccccagagccucagcucccca

SEQ ID NO: 21170 - RNA, 22 nt, Homo sapiens
cacauggccaaaacagagaaga

SEQ ID NO: 21171 - RNA, 21 nt, Homo sapiens
uuccacgaccuaauccuaacu

SEQ ID NO: 21172 - RNA, 21 nt, Homo sapiens
auguaggccuuuagaucacuu

SEQ ID NO: 21173 - RNA, 22 nt, Homo sapiens
cagacuccgguggaaugaagga

SEQ ID NO: 21174 - RNA, 23 nt, Homo sapiens
gaaaaacgcccccuggcuugaaa

SEQ ID NO: 21175 - RNA, 23 nt, Homo sapiens
gaaagugcccucaaggcugagug

SEQ ID NO: 21176 - RNA, 21 nt, Homo sapiens
agagcucauccauaguuguca

SEQ ID NO: 21177 - RNA, 22 nt, Homo sapiens
acuucaaggaucuuaaacuuug

SEQ ID NO: 21178 - RNA, 21 nt, Homo sapiens
gaaggaagugagugcagccac

SEQ ID NO: 21179 - RNA, 22 nt, Homo sapiens
caaaagucaagcuuauccuaaa

SEQ ID NO: 21180 - RNA, 22 nt, Homo sapiens
gggagaggucucccugcgcaca

SEQ ID NO: 21181 - RNA, 21 nt, Homo sapiens
cugaggagagaggaggugggg

SEQ ID NO: 21182 - RNA, 17 nt, Homo sapiens
gacagccucucccccac

SEQ ID NO: 21183 - RNA, 22 nt, Homo sapiens
uucacacugcaugcucugggua

SEQ ID NO: 21184 - RNA, 22 nt, Homo sapiens
ucaacaucagucugauaagcua

SEQ ID NO: 21185 - RNA, 20 nt, Homo sapiens
cuggaggaagggcccagagg

SEQ ID NO: 21186 - RNA, 22 nt, Homo sapiens
gccuaagacacaggcccagaga

SEQ ID NO: 21187 - RNA, 22 nt, Homo sapiens
aaucagucucauugcuuuauaa

SEQ ID NO: 21188 - RNA, 22 nt, Homo sapiens
gaauucaucacggccagccucu

SEQ ID NO: 21189 - RNA, 22 nt, Homo sapiens
cugcacuuuuaugaauaagcuc

SEQ ID NO: 21190 - RNA, 20 nt, Homo sapiens
cugcgggaggacagggcuca

SEQ ID NO: 21191 - RNA, 22 nt, Homo sapiens
uaaaugaauucaauuuccuucu

SEQ ID NO: 21192 - RNA, 18 nt, Homo sapiens
ugguggcagaggugggau

SEQ ID NO: 21193 - RNA, 22 nt, Homo sapiens
ucccucacacagaauuccagaa

SEQ ID NO: 21194 - RNA, 22 nt, Homo sapiens
augcuuuuugggguaagggcuu

SEQ ID NO: 21195 - RNA, 18 nt, Homo sapiens
aucacauucaccucccug

SEQ ID NO: 21196 - RNA, 23 nt, Homo sapiens
gggagugaagacacggagccaga

SEQ ID NO: 21197 - RNA, 23 nt, Homo sapiens
cccaacagacauggcgguacuca

SEQ ID NO: 21198 - RNA, 20 nt, Homo sapiens
gcaaugcaacagcaaugcac

SEQ ID NO: 21199 - RNA, 23 nt, Homo sapiens
ucaacgggagugaucgugucauu

SEQ ID NO: 21200 - RNA, 22 nt, Homo sapiens
aacgcuccaaaagaaggcacuc

SEQ ID NO: 21201 - RNA, 22 nt, Homo sapiens
aacacucuaaaaggaggcacuu

SEQ ID NO: 21202 - RNA, 23 nt, Homo sapiens
gggcucuuacucccucaggcacu

SEQ ID NO: 21203 - RNA, 21 nt, Homo sapiens
gagcugcauccuggcuccggg

SEQ ID NO: 21204 - RNA, 22 nt, Homo sapiens
caaacaccauugucacacucca

SEQ ID NO: 21205 - RNA, 20 nt, Homo sapiens
cugcgggaggacagggcuca

SEQ ID NO: 21206 - RNA, 17 nt, Homo sapiens
gggagaggaggaggcga

SEQ ID NO: 21207 - RNA, 21 nt, Homo sapiens
acuagacugugagcuccucga

SEQ ID NO: 21208 - RNA, 22 nt, Homo sapiens
uggcagcagcggagggggcaga

SEQ ID NO: 21209 - RNA, 22 nt, Homo sapiens
ucagaccgagacaagugcaaug

SEQ ID NO: 21210 - RNA, 20 nt, Homo sapiens
ccagcagcaccuggggcagu

SEQ ID NO: 21211 - RNA, 23 nt, Homo sapiens
cggcucugucgucgaggcgcuca

SEQ ID NO: 21212 - RNA, 22 nt, Homo sapiens
acaaccagcuaagacacugcca

SEQ ID NO: 21213 - RNA, 23 nt, Homo sapiens
gcaaucagcuaacuacacugccu

SEQ ID NO: 21214 - RNA, 22 nt, Homo sapiens
accagcuaacaauacacugcca

SEQ ID NO: 21215 - RNA, 22 nt, Homo sapiens
gccagcuaacaauacacugccu

SEQ ID NO: 21216 - RNA, 25 nt, Homo sapiens
accaacggaccuacuucccuccgcc

SEQ ID NO: 21217 - RNA, 17 nt, Homo sapiens
gggagaggaggaggcga

SEQ ID NO: 21218 - RNA, 22 nt, Homo sapiens
augcccuuucaucauugcacug

SEQ ID NO: 21219 - RNA, 21 nt, Homo sapiens
gaccaaucgccguccccgccg

SEQ ID NO: 21220 - RNA, 22 nt, Homo sapiens
ucagaccgagacaagugcaaug

SEQ ID NO: 21221 - RNA, 21 nt, Homo sapiens
guaaugggaccuuccucuuug

SEQ ID NO: 21222 - RNA, 25 nt, Homo sapiens
accaacggaccuacuucccuccgcc

SEQ ID NO: 21223 - RNA, 22 nt, Homo sapiens
gcggucccgcggcgccccgccu

SEQ ID NO: 21224 - RNA, 21 nt, Homo sapiens
cggggugcacgggcggagggc

SEQ ID NO: 21225 - RNA, 22 nt, Homo sapiens
ucagaccgagacaagugcaaug

SEQ ID NO: 21226 - RNA, 22 nt, Homo sapiens
acggaagggcagagagggccag

SEQ ID NO: 21227 - RNA, 25 nt, Homo sapiens
accaacggaccuacuucccuccgcc

SEQ ID NO: 21228 - RNA, 23 nt, Homo sapiens
ucaccaaaacauggaagcacuua

SEQ ID NO: 21229 - RNA, 23 nt, Homo sapiens
cuacuaaaacauggaagcacuua

SEQ ID NO: 21230 - RNA, 23 nt, Homo sapiens
ccacugaaacauggaagcacuua

SEQ ID NO: 21231 - RNA, 23 nt, Homo sapiens
acacucaaacauggaagcacuua

SEQ ID NO: 21232 - RNA, 17 nt, Homo sapiens
aagcauggaagcacuua

SEQ ID NO: 21233 - RNA, 20 nt, Homo sapiens
gcaaugcaacagcaaugcac

SEQ ID NO: 21234 - RNA, 23 nt, Homo sapiens
acgcucaaaugucgcagcacuuu

SEQ ID NO: 21235 - RNA, 23 nt, Homo sapiens
acaccccaaaaucgaagcacuuc

SEQ ID NO: 21236 - RNA, 22 nt, Homo sapiens
aacgcuccaaaagaaggcacuc

SEQ ID NO: 21237 - RNA, 22 nt, Homo sapiens
aacacucuaaaaggaggcacuu

SEQ ID NO: 21238 - RNA, 22 nt, Homo sapiens
acaguccaaagggaagcacuuu

SEQ ID NO: 21239 - RNA, 21 nt, Homo sapiens
cccucuaaaaggaagcacuuu

SEQ ID NO: 21240 - RNA, 22 nt, Homo sapiens
acccucuaaaaggaagcacuuu

SEQ ID NO: 21241 - RNA, 22 nt, Homo sapiens
acccaccaaagagaagcacuuu

SEQ ID NO: 21242 - RNA, 21 nt, Homo sapiens
cccucaaaaaggaagcacuuu

SEQ ID NO: 21243 - RNA, 21 nt, Homo sapiens
guaaugggaccuuccucuuug

SEQ ID NO: 21244 - RNA, 22 nt, Homo sapiens
caaacaccauugucacacucca

SEQ ID NO: 21245 - RNA, 21 nt, Homo sapiens
cggggugcacgggcggagggc

SEQ ID NO: 21246 - RNA, 21 nt, Homo sapiens
gaccaaucgccguccccgccg

SEQ ID NO: 21247 - RNA, 21 nt, Homo sapiens
aggcggcaggcacaggacugg

SEQ ID NO: 21248 - RNA, 23 nt, Homo sapiens
gaaacccagcagacaauguagcu

SEQ ID NO: 21249 - RNA, 22 nt, Homo sapiens
ucagaccgagacaagugcaaug

SEQ ID NO: 21250 - RNA, 22 nt, Homo sapiens
cucaauagacugugagcuccuu

SEQ ID NO: 21251 - RNA, 21 nt, Homo sapiens
agcuaugccagcaucuugccu

SEQ ID NO: 21252 - RNA, 23 nt, Homo sapiens
aaagucucgcucucugccccuca

SEQ ID NO: 21253 - RNA, 23 nt, Homo sapiens
aagaaucuugucccgcagguccu

SEQ ID NO: 21254 - RNA, 25 nt, Homo sapiens
accaacggaccuacuucccuccgcc

SEQ ID NO: 21255 - RNA, 22 nt, Homo sapiens
gcggucccgcggcgccccgccu

SEQ ID NO: 21256 - RNA, 20 nt, Homo sapiens
aggggccucagccuccuggu

SEQ ID NO: 21257 - RNA, 23 nt, Homo sapiens
cccagcuagauuguaagcuccuu

SEQ ID NO: 21258 - RNA, 22 nt, Homo sapiens
ugcuguuagcccuagccccgca

SEQ ID NO: 21259 - RNA, 22 nt, Homo sapiens
caaacaccauugucacacucca

SEQ ID NO: 21260 - RNA, 22 nt, Homo sapiens
cuggagagacaaggggaagagg

SEQ ID NO: 21261 - RNA, 21 nt, Homo sapiens
ggucagaacccaucauucacu

SEQ ID NO: 21262 - RNA, 23 nt, Homo sapiens
uccaucaucaaaacaaauggagu

SEQ ID NO: 21263 - RNA, 23 nt, Homo sapiens
gggagugaagacacggagccaga

SEQ ID NO: 21264 - RNA, 22 nt, Homo sapiens
agcccaaaaggagaauucuuug

SEQ ID NO: 21265 - RNA, 23 nt, Homo sapiens
cuaucugcacuagaugcaccuua

SEQ ID NO: 21266 - RNA, 23 nt, Homo sapiens
aaagucucgcucucugccccuca

SEQ ID NO: 21267 - RNA, 22 nt, Homo sapiens
aggaaaccagcaaguguugacg

SEQ ID NO: 21268 - RNA, 23 nt, Homo sapiens
gaaagugcccucaaggcugagug

SEQ ID NO: 21269 - RNA, 22 nt, Homo sapiens
aagagggagacccaggcucgga

SEQ ID NO: 21270 - RNA, 23 nt, Homo sapiens
ggacauuguuucagugcccaagu

SEQ ID NO: 21271 - RNA, 20 nt, Homo sapiens
aggggccucagccuccuggu

SEQ ID NO: 21272 - RNA, 21 nt, Homo sapiens
caucaccuuccuucuccucca

SEQ ID NO: 21273 - RNA, 20 nt, Homo sapiens
cccugcgccaucuccucuac

SEQ ID NO: 21274 - RNA, 22 nt, Homo sapiens
gggagaggucucccugcgcaca

SEQ ID NO: 21275 - RNA, 22 nt, Homo sapiens
aucagagcccucugagcuucag

SEQ ID NO: 21276 - RNA, 17 nt, Homo sapiens
gggagaggaggaggcga

SEQ ID NO: 21277 - RNA, 23 nt, Homo sapiens
gggagugaagacacggagccaga

SEQ ID NO: 21278 - RNA, 22 nt, Homo sapiens
cacugguacaaggguugggaga

SEQ ID NO: 21279 - RNA, 24 nt, Homo sapiens
agugugaguucuaccauugccaaa

SEQ ID NO: 21280 - RNA, 21 nt, Homo sapiens
agagcucauccauaguuguca

SEQ ID NO: 21281 - RNA, 22 nt, Homo sapiens
auguaugugggacgguaaacca

SEQ ID NO: 21282 - RNA, 22 nt, Homo sapiens
accagcuaacaauacacugcca

SEQ ID NO: 21283 - RNA, 22 nt, Homo sapiens
agcugaguguaggauguuuaca

SEQ ID NO: 21284 - RNA, 22 nt, Homo sapiens
agcugaguguaggauguuuaca

SEQ ID NO: 21285 - RNA, 22 nt, Homo sapiens
ucggucccucgggccagggcag

SEQ ID NO: 21286 - RNA, 17 nt, Homo sapiens
ggguggcagcgguggga

SEQ ID NO: 21287 - RNA, 17 nt, Homo sapiens
gggagaggaggaggcga

SEQ ID NO: 21288 - RNA, 22 nt, Homo sapiens
cacaucucacuguagccucaaa

SEQ ID NO: 21289 - RNA, 23 nt, Homo sapiens
gggagugaagacacggagccaga

SEQ ID NO: 21290 - RNA, 23 nt, Homo sapiens
aggaacagcagcagcccgggccg

SEQ ID NO: 21291 - RNA, 21 nt, Homo sapiens
gaccaaucgccguccccgccg

SEQ ID NO: 21292 - RNA, 21 nt, Homo sapiens
acaggauugagggggggcccu

SEQ ID NO: 21293 - RNA, 22 nt, Homo sapiens
aucgggaggggacugagccuga

SEQ ID NO: 21294 - RNA, 22 nt, Homo sapiens
aguccagauucugugcccacca

SEQ ID NO: 21295 - RNA, 21 nt, Homo sapiens
gaaggaagugagugcagccac

SEQ ID NO: 21296 - RNA, 22 nt, Homo sapiens
gcacauguucugcggcccacca

SEQ ID NO: 21297 - RNA, 24 nt, Homo sapiens
acgcgcaggccagagacccaggca

SEQ ID NO: 21298 - RNA, 22 nt, Homo sapiens
gcggucccgcggcgccccgccu

SEQ ID NO: 21299 - RNA, 20 nt, Homo sapiens
aggggccucagccuccuggu

SEQ ID NO: 21300 - RNA, 22 nt, Homo sapiens
ugcuguuagcccuagccccgca

SEQ ID NO: 21301 - RNA, 22 nt, Homo sapiens
cuagggaacacagggcugguga

SEQ ID NO: 21302 - RNA, 20 nt, Homo sapiens
cugcgggaggacagggcuca

SEQ ID NO: 21303 - RNA, 27 nt, Homo sapiens
uuuagcacagugcuuauacaagaaggu

SEQ ID NO: 21304 - RNA, 22 nt, Homo sapiens
ucccucacacagaauuccagaa

SEQ ID NO: 21305 - RNA, 18 nt, Homo sapiens
aucacauucaccucccug

SEQ ID NO: 21306 - RNA, 23 nt, Homo sapiens
ucacauaggaauaaaaagccaua

SEQ ID NO: 21307 - RNA, 23 nt, Homo sapiens
uccaucaucaaaacaaauggagu

SEQ ID NO: 21308 - RNA, 23 nt, Homo sapiens
cggccugauucacaacaccagcu

SEQ ID NO: 21309 - RNA, 23 nt, Homo sapiens
gggagugaagacacggagccaga

SEQ ID NO: 21310 - RNA, 21 nt, Homo sapiens
cccuccaccaugcaagggaug

SEQ ID NO: 21311 - RNA, 22 nt, Homo sapiens
aggaaaccagcaaguguugacg

SEQ ID NO: 21312 - RNA, 23 nt, Homo sapiens
acacucuaaagagaagcgcuuug

SEQ ID NO: 21313 - RNA, 21 nt, Homo sapiens
agaaaguacuucccucuggag

SEQ ID NO: 21314 - RNA, 21 nt, Homo sapiens
agaaagugcaucccucuggag

SEQ ID NO: 21315 - RNA, 22 nt, Homo sapiens
acacaccaaggauaauuucucc

SEQ ID NO: 21316 - RNA, 22 nt, Homo sapiens
cucauauuacaaugagcucauc

SEQ ID NO: 21317 - RNA, 23 nt, Homo sapiens
aggagaaggcaccaugggauuua

SEQ ID NO: 21318 - RNA, 22 nt, Homo sapiens
aagagggagacccaggcucgga

SEQ ID NO: 21319 - RNA, 22 nt, Homo sapiens
guccaaaguuggggugcugguu

SEQ ID NO: 21320 - RNA, 21 nt, Homo sapiens
guccugagagcgcugccuccu

SEQ ID NO: 21321 - RNA, 23 nt, Homo sapiens
agaaaccaugggguaugagcaga

SEQ ID NO: 21322 - RNA, 21 nt, Homo sapiens
cacaaccucaguguuuccagg

SEQ ID NO: 21323 - RNA, 22 nt, Homo sapiens
uggugauucacaaagaaaucca

SEQ ID NO: 21324 - RNA, 23 nt, Homo sapiens
gacguaguccuauucucugcugc

SEQ ID NO: 21325 - RNA, 23 nt, Homo sapiens
ucauagcccuguacaaugcugcu

SEQ ID NO: 21326 - RNA, 23 nt, Homo sapiens
ugauagcccuguacaaugcugcu

SEQ ID NO: 21327 - RNA, 22 nt, Homo sapiens
uaaaugaauucaauuuccuucu

SEQ ID NO: 21328 - RNA, 17 nt, Homo sapiens
gggagaggaggaggcga

SEQ ID NO: 21329 - RNA, 18 nt, Homo sapiens
aucacauucaccucccug

SEQ ID NO: 21330 - RNA, 22 nt, Homo sapiens
ccaucuuuaccagacaguguua

SEQ ID NO: 21331 - RNA, 18 nt, Homo sapiens
auucaaucuacugccuca

SEQ ID NO: 21332 - RNA, 21 nt, Homo sapiens
gaccaaucgccguccccgccg

SEQ ID NO: 21333 - RNA, 22 nt, Homo sapiens
acaucguuaccagacaguguua

SEQ ID NO: 21334 - RNA, 22 nt, Homo sapiens
acaaccagcuaagacacugcca

SEQ ID NO: 21335 - RNA, 22 nt, Homo sapiens
auggcaguggaguuagugauug

SEQ ID NO: 21336 - RNA, 23 nt, Homo sapiens
gcaaucagcuaacuacacugccu

SEQ ID NO: 21337 - RNA, 22 nt, Homo sapiens
accagcuaacaauacacugcca

SEQ ID NO: 21338 - RNA, 22 nt, Homo sapiens
gccagcuaacaauacacugccu

SEQ ID NO: 21339 - RNA, 23 nt, Homo sapiens
ucucgugacaugaugauccccga

SEQ ID NO: 21340 - RNA, 21 nt, Homo sapiens
aucagagguucagcuuacccu

SEQ ID NO: 21341 - RNA, 21 nt, Homo sapiens
guccugagagcgcugccuccu

SEQ ID NO: 21342 - RNA, 22 nt, Homo sapiens
gcggucccgcggcgccccgccu

SEQ ID NO: 21343 - RNA, 23 nt, Homo sapiens
cacugugggcccucuccgcacca

SEQ ID NO: 21344 - RNA, 21 nt, Homo sapiens
caucaccuuccuucuccucca

SEQ ID NO: 21345 - RNA, 22 nt, Homo sapiens
cacauggccaaaacagagaaga

SEQ ID NO: 21346 - RNA, 21 nt, Homo sapiens
gaccaaucgccguccccgccg

SEQ ID NO: 21347 - RNA, 22 nt, Homo sapiens
ucagaccgagacaagugcaaug

SEQ ID NO: 21348 - RNA, 24 nt, Homo sapiens
ugggagaaccucccugcuucugcu

SEQ ID NO: 21349 - RNA, 23 nt, Homo sapiens
aaagucucgcucucugccccuca

SEQ ID NO: 21350 - RNA, 23 nt, Homo sapiens
ucucgugacaugaugauccccga

SEQ ID NO: 21351 - RNA, 22 nt, Homo sapiens
gcggucccgcggcgccccgccu

SEQ ID NO: 21352 - RNA, 22 nt, Homo sapiens
ugcuguuagcccuagccccgca

SEQ ID NO: 21353 - RNA, 22 nt, Homo sapiens
acacacccacgcgagccggaaa

SEQ ID NO: 21354 - RNA, 24 nt, Homo sapiens
gaagucacucccaggcagcugcaa

SEQ ID NO: 21355 - RNA, 21 nt, Homo sapiens
gggcaucugggacgcgcagga

SEQ ID NO: 21356 - RNA, 23 nt, Homo sapiens
cccaacagacauggcgguacuca

SEQ ID NO: 21357 - RNA, 23 nt, Homo sapiens
acaccaaugcccuaggggaugcg

SEQ ID NO: 21358 - RNA, 23 nt, Homo sapiens
cugcagaacuguucccgcugcua

SEQ ID NO: 21359 - RNA, 19 nt, Homo sapiens
auuuugguacagcagcuca

SEQ ID NO: 21360 - RNA, 19 nt, Homo sapiens
gccugcugacaccgugccu

SEQ ID NO: 21361 - RNA, 22 nt, Homo sapiens
gcugaggcuguggggcuggagu

SEQ ID NO: 21362 - RNA, 22 nt, Homo sapiens
uauccacuacaccccgcugccu

SEQ ID NO: 21363 - RNA, 22 nt, Homo sapiens
ucaggaacugccuuucucucca

SEQ ID NO: 21364 - RNA, 21 nt, Homo sapiens
gaccaaucgccguccccgccg

SEQ ID NO: 21365 - RNA, 23 nt, Homo sapiens
ucaguuuugcauagauuugcaca

SEQ ID NO: 21366 - RNA, 22 nt, Homo sapiens
cacucagcaccaggauauuguu

SEQ ID NO: 21367 - RNA, 22 nt, Homo sapiens
aacuaugcaaccuacuaccucu

SEQ ID NO: 21368 - RNA, 22 nt, Homo sapiens
gaauucaucacggccagccucu

SEQ ID NO: 21369 - RNA, 21 nt, Homo sapiens
gaccaagaaauagccuuucaa

SEQ ID NO: 21370 - RNA, 23 nt, Homo sapiens
caugagugacgcccucuggagua

SEQ ID NO: 21371 - RNA, 19 nt, Homo sapiens
guccugaauuccgcagccu

SEQ ID NO: 21372 - RNA, 22 nt, Homo sapiens
aagagggagacccaggcucgga

SEQ ID NO: 21373 - RNA, 22 nt, Homo sapiens
gcggucccgcggcgccccgccu

SEQ ID NO: 21374 - RNA, 22 nt, Homo sapiens
ugcuguuagcccuagccccgca

SEQ ID NO: 21375 - RNA, 21 nt, Homo sapiens
aagggucaguaagcacccgcg

SEQ ID NO: 21376 - RNA, 20 nt, Homo sapiens
uacugcuuccacagcucccc

SEQ ID NO: 21377 - RNA, 20 nt, Homo sapiens
ugucuccacagggcucuuua

SEQ ID NO: 21378 - RNA, 19 nt, Homo sapiens
ucccugauccaaaaaucca

SEQ ID NO: 21379 - RNA, 22 nt, Homo sapiens
gcaaaaguaauugagauuuuug

SEQ ID NO: 21380 - RNA, 22 nt, Homo sapiens
aaaguaacugcaguuuuugcua

SEQ ID NO: 21381 - RNA, 21 nt, Homo sapiens
acuagcuuauacauaaaauua

SEQ ID NO: 21382 - RNA, 23 nt, Homo sapiens
uguaggcuggggauaaaugaaua

SEQ ID NO: 21383 - RNA, 21 nt, Homo sapiens
cugggggacggagcagaagga

SEQ ID NO: 21384 - RNA, 22 nt, Homo sapiens
cacuccuauaauugauccaguu

SEQ ID NO: 21385 - RNA, 23 nt, Homo sapiens
accccuaucacgauuagcauuaa

SEQ ID NO: 21386 - RNA, 22 nt, Homo sapiens
ucaggaacugccuuucucucca

SEQ ID NO: 21387 - RNA, 23 nt, Homo sapiens
gaacagguagucugaacacuggg

SEQ ID NO: 21388 - RNA, 23 nt, Homo sapiens
gaacagauagucuaaacacuggg

SEQ ID NO: 21389 - RNA, 22 nt, Homo sapiens
cacucagcggccguuuccccaa

SEQ ID NO: 21390 - RNA, 24 nt, Homo sapiens
ugggagaaccucccugcuucugcu

SEQ ID NO: 21391 - RNA, 22 nt, Homo sapiens
auaaaugacaccuccuugugaa

SEQ ID NO: 21392 - RNA, 22 nt, Homo sapiens
gcaaaagaaacugugguuuuug

SEQ ID NO: 21393 - RNA, 20 nt, Homo sapiens
gcaaaugguacagcuacuuu

SEQ ID NO: 21394 - RNA, 20 nt, Homo sapiens
agagaugagagaaacacccu

SEQ ID NO: 21395 - RNA, 21 nt, Homo sapiens
agaggcagguuccuggaucau

SEQ ID NO: 21396 - RNA, 23 nt, Homo sapiens
gacguaguccuauucucugcugc

SEQ ID NO: 21397 - RNA, 21 nt, Homo sapiens
gcaagcccagaccgcaaaaag

SEQ ID NO: 21398 - RNA, 23 nt, Homo sapiens
cccaacagacauggcgguacuca

SEQ ID NO: 21399 - RNA, 22 nt, Homo sapiens
uccacauggaguugcuguuaca

SEQ ID NO: 21400 - RNA, 22 nt, Homo sapiens
ugagccacugugccuggccuga

SEQ ID NO: 21401 - RNA, 20 nt, Homo sapiens
gcaaaugguacagcuacuuu

SEQ ID NO: 21402 - RNA, 19 nt, Homo sapiens
agaaaccccagcagagaca

SEQ ID NO: 21403 - RNA, 20 nt, Homo sapiens
aggggccucagccuccuggu

SEQ ID NO: 21404 - RNA, 24 nt, Homo sapiens
ucagagcauguguuuaaucaggcu

SEQ ID NO: 21405 - RNA, 20 nt, Homo sapiens
ggggggcgaggcagguguga

SEQ ID NO: 21406 - RNA, 22 nt, Homo sapiens
agacaacaaugccaaccucaca

SEQ ID NO: 21407 - RNA, 23 nt, Homo sapiens
ucacauaggaauaaaaagccaua

SEQ ID NO: 21408 - RNA, 22 nt, Homo sapiens
acaguucuucaacuggcagcuu

SEQ ID NO: 21409 - RNA, 24 nt, Homo sapiens
ugggagaaccucccugcuucugcu

SEQ ID NO: 21410 - RNA, 23 nt, Homo sapiens
acgggugcgauuucugugugaga

SEQ ID NO: 21411 - RNA, 22 nt, Homo sapiens
gcugccguauaugugaugucac

SEQ ID NO: 21412 - RNA, 18 nt, Homo sapiens
augacaccucccugugaa

SEQ ID NO: 21413 - RNA, 22 nt, Homo sapiens
agcaaaauccgcaaguacuuuu

SEQ ID NO: 21414 - RNA, 19 nt, Homo sapiens
auuuugguacagcagcuca

SEQ ID NO: 21415 - RNA, 23 nt, Homo sapiens
gacguaguccuauucucugcugc

SEQ ID NO: 21416 - RNA, 26 nt, Homo sapiens
aaccaucucauacaaaccaacuacuu

SEQ ID NO: 21417 - RNA, 21 nt, Homo sapiens
ugcaggcugaucuucuucucu

SEQ ID NO: 21418 - RNA, 21 nt, Homo sapiens
gagcuacagugcuucaucuca

SEQ ID NO: 21419 - RNA, 22 nt, Homo sapiens
gaagaaaggcaucauauaggag

SEQ ID NO: 21420 - RNA, 22 nt, Homo sapiens
gagcccuggacuaggagucagc

SEQ ID NO: 21421 - RNA, 22 nt, Homo sapiens
auggcaguggaguuagugauug

SEQ ID NO: 21422 - RNA, 21 nt, Homo sapiens
ccuucugacuccaaguccagu

SEQ ID NO: 21423 - RNA, 22 nt, Homo sapiens
cacauggccaaaacagagaaga

SEQ ID NO: 21424 - RNA, 23 nt, Homo sapiens
aggaacagcagcagcccgggccg

SEQ ID NO: 21425 - RNA, 18 nt, Homo sapiens
acccucugaaaggaagca

SEQ ID NO: 21426 - RNA, 22 nt, Homo sapiens
aaagugcuucuuaccuccagau

SEQ ID NO: 21427 - RNA, 22 nt, Homo sapiens
gcggucccgcggcgccccgccu

SEQ ID NO: 21428 - RNA, 23 nt, Homo sapiens
cuccagccccuccagggcuuccu

SEQ ID NO: 21429 - RNA, 22 nt, Homo sapiens
ugcuguuagcccuagccccgca

SEQ ID NO: 21430 - RNA, 22 nt, Homo sapiens
ggcagagagucagagcgcggau

SEQ ID NO: 21431 - RNA, 24 nt, Homo sapiens
cacccccagagccucagcucccca

SEQ ID NO: 21432 - RNA, 22 nt, Homo sapiens
cuggagagacaaggggaagagg

SEQ ID NO: 21433 - RNA, 17 nt, Homo sapiens
gacagccucucccccac

SEQ ID NO: 21434 - RNA, 23 nt, Homo sapiens
cagcugcuuuugggauuccguug

SEQ ID NO: 21435 - RNA, 22 nt, Homo sapiens
uucacacugcaugcucugggua

SEQ ID NO: 21436 - RNA, 21 nt, Homo sapiens
gcggaacuuagccacugugaa

SEQ ID NO: 21437 - RNA, 21 nt, Homo sapiens
aucugcacugucagcacuuua

SEQ ID NO: 21438 - RNA, 23 nt, Homo sapiens
gcuuugacaauaucauugcacug

SEQ ID NO: 21439 - RNA, 23 nt, Homo sapiens
acauuuuucguuauugcucuuga

SEQ ID NO: 21440 - RNA, 21 nt, Homo sapiens
aucagagguucagcuuacccu

SEQ ID NO: 21441 - RNA, 21 nt, Homo sapiens
ggacuauagaacuuucccccu

SEQ ID NO: 21442 - RNA, 20 nt, Homo sapiens
uacugcuuccacagcucccc

SEQ ID NO: 21443 - RNA, 21 nt, Homo sapiens
cugggggacggagcagaagga

SEQ ID NO: 21444 - RNA, 17 nt, Homo sapiens
ggguggcagcgguggga

SEQ ID NO: 21445 - RNA, 23 nt, Homo sapiens
gggagugaagacacggagccaga

SEQ ID NO: 21446 - RNA, 22 nt, Homo sapiens
ucaggaacugccuuucucucca

SEQ ID NO: 21447 - RNA, 21 nt, Homo sapiens
gaccaaucgccguccccgccg

SEQ ID NO: 21448 - RNA, 22 nt, Homo sapiens
acaguucuucaacuggcagcuu

SEQ ID NO: 21449 - RNA, 22 nt, Homo sapiens
cucaauagacugugagcuccuu

SEQ ID NO: 21450 - RNA, 23 nt, Homo sapiens
aaagucucgcucucugccccuca

SEQ ID NO: 21451 - RNA, 23 nt, Homo sapiens
ucucacccagguagcaaggauua

SEQ ID NO: 21452 - RNA, 22 nt, Homo sapiens
gcggucccgcggcgccccgccu

SEQ ID NO: 21453 - RNA, 23 nt, Homo sapiens
cccagcuagauuguaagcuccuu

SEQ ID NO: 21454 - RNA, 22 nt, Homo sapiens
ugcuguuagcccuagccccgca

SEQ ID NO: 21455 - RNA, 23 nt, Homo sapiens
ccgcuugagcuaacuccgacccg

SEQ ID NO: 21456 - RNA, 20 nt, Homo sapiens
uacugcuuccacagcucccc

SEQ ID NO: 21457 - RNA, 23 nt, Homo sapiens
gcacaugugcacacagccgggug

SEQ ID NO: 21458 - RNA, 23 nt, Homo sapiens
ucauagcccuguacaaugcugcu

SEQ ID NO: 21459 - RNA, 23 nt, Homo sapiens
ugauagcccuguacaaugcugcu

SEQ ID NO: 21460 - RNA, 17 nt, Homo sapiens
gacagccucucccccac

SEQ ID NO: 21461 - RNA, 22 nt, Homo sapiens
cacaaaccauuaugugcugcua

SEQ ID NO: 21462 - RNA, 22 nt, Homo sapiens
uguaaaccaugaugugcugcua

SEQ ID NO: 21463 - RNA, 22 nt, Homo sapiens
cgccaauauuuacgugcugcua

SEQ ID NO: 21464 - RNA, 21 nt, Homo sapiens
gccaauauuucugugcugcua

SEQ ID NO: 21465 - RNA, 22 nt, Homo sapiens
cacuuaucagguuguauuauaa

SEQ ID NO: 21466 - RNA, 22 nt, Homo sapiens
uucaaaacaugaauugcugcug

SEQ ID NO: 21467 - RNA, 22 nt, Homo sapiens
gaauucaucacggccagccucu

SEQ ID NO: 21468 - RNA, 21 nt, Homo sapiens
acaaaccacagugugcugcug

SEQ ID NO: 21469 - RNA, 23 nt, Homo sapiens
aaucgcgguuuauaccaaaugaa

SEQ ID NO: 21470 - RNA, 22 nt, Homo sapiens
cucagagcagacgugguucuca

SEQ ID NO: 21471 - RNA, 21 nt, Homo sapiens
gaaggaagugagugcagccac

SEQ ID NO: 21472 - RNA, 20 nt, Homo sapiens
uacugcuuccacagcucccc

SEQ ID NO: 21473 - RNA, 22 nt, Homo sapiens
gggagaggucucccugcgcaca

SEQ ID NO: 21474 - RNA, 20 nt, Homo sapiens
gcagcuguccgcccagacac

SEQ ID NO: 21475 - RNA, 17 nt, Homo sapiens
ggguggcagcgguggga

SEQ ID NO: 21476 - RNA, 22 nt, Homo sapiens
cacaaaccauuaugugcugcua

SEQ ID NO: 21477 - RNA, 22 nt, Homo sapiens
uguaaaccaugaugugcugcua

SEQ ID NO: 21478 - RNA, 22 nt, Homo sapiens
cgccaauauuuacgugcugcua

SEQ ID NO: 21479 - RNA, 22 nt, Homo sapiens
ucaggaacugccuuucucucca

SEQ ID NO: 21480 - RNA, 21 nt, Homo sapiens
gccaauauuucugugcugcua

SEQ ID NO: 21481 - RNA, 23 nt, Homo sapiens
gaacagguagucugaacacuggg

SEQ ID NO: 21482 - RNA, 23 nt, Homo sapiens
gaacagauagucuaaacacuggg

SEQ ID NO: 21483 - RNA, 22 nt, Homo sapiens
acugccugucugugccugcugu

SEQ ID NO: 21484 - RNA, 24 nt, Homo sapiens
ugggagaaccucccugcuucugcu

SEQ ID NO: 21485 - RNA, 22 nt, Homo sapiens
accagguuccaccccagcaggc

SEQ ID NO: 21486 - RNA, 23 nt, Homo sapiens
aaagucucgcucucugccccuca

SEQ ID NO: 21487 - RNA, 22 nt, Homo sapiens
uucaaaacaugaauugcugcug

SEQ ID NO: 21488 - RNA, 21 nt, Homo sapiens
acaaaccacagugugcugcug

SEQ ID NO: 21489 - RNA, 22 nt, Homo sapiens
aggaaaccagcaaguguugacg

SEQ ID NO: 21490 - RNA, 24 nt, Homo sapiens
acgcgcaggccagagacccaggca

SEQ ID NO: 21491 - RNA, 22 nt, Homo sapiens
ccucaggcacggccgggccacc

SEQ ID NO: 21492 - RNA, 20 nt, Homo sapiens
uacugcuuccacagcucccc

SEQ ID NO: 21493 - RNA, 22 nt, Homo sapiens
cacauggccaaaacagagaaga

SEQ ID NO: 21494 - RNA, 22 nt, Homo sapiens
cgcauuauuacucacgguacga

SEQ ID NO: 21495 - RNA, 24 nt, Homo sapiens
agugugaguucuaccauugccaaa

SEQ ID NO: 21496 - RNA, 23 nt, Homo sapiens
cuacuaaaacauggaagcacuua

SEQ ID NO: 21497 - RNA, 23 nt, Homo sapiens
acacucaaacauggaagcacuua

SEQ ID NO: 21498 - RNA, 21 nt, Homo sapiens
agcuaugccagcaucuugccu

SEQ ID NO: 21499 - RNA, 20 nt, Homo sapiens
gaaagggcuucccuuuguag

SEQ ID NO: 21500 - RNA, 22 nt, Homo sapiens
gagaaagugcuucccuuuguag

SEQ ID NO: 21501 - RNA, 22 nt, Homo sapiens
uccucuuuucuuagagacucac

SEQ ID NO: 21502 - RNA, 21 nt, Homo sapiens
gaaggaagugagugcagccac

SEQ ID NO: 21503 - RNA, 21 nt, Homo sapiens
agagguugacuguauaauauu

SEQ ID NO: 21504 - RNA, 23 nt, Homo sapiens
cccagcuagauuguaagcuccuu

SEQ ID NO: 21505 - RNA, 22 nt, Homo sapiens
cucauccgauguacaauaauuu

SEQ ID NO: 21506 - RNA, 22 nt, Homo sapiens
caaacaccauugucacacucca

SEQ ID NO: 21507 - RNA, 21 nt, Homo sapiens
gaccaaucgccguccccgccg

SEQ ID NO: 21508 - RNA, 23 nt, Homo sapiens
cccaacagacauggcgguacuca

SEQ ID NO: 21509 - RNA, 21 nt, Homo sapiens
uagaaaggcuaggaccaaacc

SEQ ID NO: 21510 - RNA, 22 nt, Homo sapiens
uagucaagugaagcagugggag

SEQ ID NO: 21511 - RNA, 21 nt, Homo sapiens
agagcucauccauaguuguca

SEQ ID NO: 21512 - RNA, 21 nt, Homo sapiens
acaggauugagggggggcccu

SEQ ID NO: 21513 - RNA, 22 nt, Homo sapiens
acggaagggcagagagggccag

SEQ ID NO: 21514 - RNA, 23 nt, Homo sapiens
aaaucagaaucacaccuggggga

SEQ ID NO: 21515 - RNA, 21 nt, Homo sapiens
aagacgggaggagaggaguga

SEQ ID NO: 21516 - RNA, 19 nt, Homo sapiens
aagacauuuucagacagcu

SEQ ID NO: 21517 - RNA, 24 nt, Homo sapiens
acgcagagcccgaaagcccccagu

SEQ ID NO: 21518 - RNA, 22 nt, Homo sapiens
gcggucccgcggcgccccgccu

SEQ ID NO: 21519 - RNA, 23 nt, Homo sapiens
guagugggccgagccgagugaca

SEQ ID NO: 21520 - RNA, 23 nt, Homo sapiens
cccagcuagauuguaagcuccuu

SEQ ID NO: 21521 - RNA, 17 nt, Homo sapiens
gacagccucucccccac

SEQ ID NO: 21522 - RNA, 21 nt, Homo sapiens
cggggugcacgggcggagggc

SEQ ID NO: 21523 - RNA, 22 nt, Homo sapiens
acaaaguucugugaugcacuga

SEQ ID NO: 21524 - RNA, 22 nt, Homo sapiens
agucuucacaacagcccugugu

SEQ ID NO: 21525 - RNA, 22 nt, Homo sapiens
ccucauggaaggguuccccacu

SEQ ID NO: 21526 - RNA, 22 nt, Homo sapiens
ucucacccagggacaaaggauu

SEQ ID NO: 21527 - RNA, 18 nt, Homo sapiens
augacaccucccugugaa

SEQ ID NO: 21528 - RNA, 22 nt, Homo sapiens
ugacgaugacaacgaugacgua

SEQ ID NO: 21529 - RNA, 25 nt, Homo sapiens
acggagcugucccaacaccaccccu

SEQ ID NO: 21530 - RNA, 22 nt, Homo sapiens
cugcucaaacccuccaaugacu

SEQ ID NO: 21531 - RNA, 25 nt, Homo sapiens
accaacggaccuacuucccuccgcc

SEQ ID NO: 21532 - RNA, 20 nt, Homo sapiens
uacugcuuccacagcucccc

SEQ ID NO: 21533 - RNA, 22 nt, Homo sapiens
acacacccacgcgagccggaaa

SEQ ID NO: 21534 - RNA, 21 nt, Homo sapiens
cggcucggguggcggcgacgg

SEQ ID NO: 21535 - RNA, 22 nt, Homo sapiens
uccggggacgaacgggacgggu

SEQ ID NO: 21536 - RNA, 22 nt, Homo sapiens
auccuucuacaaauucacccau

SEQ ID NO: 21537 - RNA, 21 nt, Homo sapiens
cggggugcacgggcggagggc

SEQ ID NO: 21538 - RNA, 21 nt, Homo sapiens
gggcaucugggacgcgcagga

SEQ ID NO: 21539 - RNA, 21 nt, Homo sapiens
gaccaaucgccguccccgccg

SEQ ID NO: 21540 - RNA, 22 nt, Homo sapiens
cagaagugggccgggcacaggg

SEQ ID NO: 21541 - RNA, 22 nt, Homo sapiens
ucagaccgagacaagugcaaug

SEQ ID NO: 21542 - RNA, 23 nt, Homo sapiens
acaccaaugcccuaggggaugcg

SEQ ID NO: 21543 - RNA, 23 nt, Homo sapiens
aaagucucgcucucugccccuca

SEQ ID NO: 21544 - RNA, 22 nt, Homo sapiens
cucggggcagcucaguacagga

SEQ ID NO: 21545 - RNA, 23 nt, Homo sapiens
ucucgugacaugaugauccccga

SEQ ID NO: 21546 - RNA, 25 nt, Homo sapiens
acggagcugucccaacaccaccccu

SEQ ID NO: 21547 - RNA, 22 nt, Homo sapiens
gcggucccgcggcgccccgccu

SEQ ID NO: 21548 - RNA, 23 nt, Homo sapiens
cuccagccccuccagggcuuccu

SEQ ID NO: 21549 - RNA, 22 nt, Homo sapiens
ugcuguuagcccuagccccgca

SEQ ID NO: 21550 - RNA, 20 nt, Homo sapiens
uacugcuuccacagcucccc

SEQ ID NO: 21551 - RNA, 22 nt, Homo sapiens
ggaggccgggacgagugcaaua

SEQ ID NO: 21552 - RNA, 21 nt, Homo sapiens
gaccaaucgccguccccgccg

SEQ ID NO: 21553 - RNA, 23 nt, Homo sapiens
aaagucucgcucucugccccuca

SEQ ID NO: 21554 - RNA, 22 nt, Homo sapiens
gaauucaucacggccagccucu

SEQ ID NO: 21555 - RNA, 22 nt, Homo sapiens
gcggucccgcggcgccccgccu

SEQ ID NO: 21556 - RNA, 22 nt, Homo sapiens
ugcuguuagcccuagccccgca

SEQ ID NO: 21557 - RNA, 21 nt, Homo sapiens
ugcaggcugaucuucuucucu

SEQ ID NO: 21558 - RNA, 17 nt, Homo sapiens
gacagccucucccccac

SEQ ID NO: 21559 - RNA, 23 nt, Homo sapiens
gggagugaagacacggagccaga

SEQ ID NO: 21560 - RNA, 23 nt, Homo sapiens
cuaucugcacuagaugcaccuua

SEQ ID NO: 21561 - RNA, 22 nt, Homo sapiens
gaaccuaucuccccucuggacc

SEQ ID NO: 21562 - RNA, 22 nt, Homo sapiens
acaguucuucaacuggcagcuu

SEQ ID NO: 21563 - RNA, 20 nt, Homo sapiens
cuggaggaagggcccagagg

SEQ ID NO: 21564 - RNA, 22 nt, Homo sapiens
gccuaagacacaggcccagaga

SEQ ID NO: 21565 - RNA, 23 nt, Homo sapiens
aaaucagaaucacaccuggggga

SEQ ID NO: 21566 - RNA, 22 nt, Homo sapiens
auaaggauuuuuaggggcauua

SEQ ID NO: 21567 - RNA, 23 nt, Homo sapiens
acacucuaaagagaagcgcuuug

SEQ ID NO: 21568 - RNA, 21 nt, Homo sapiens
agaaaguacuucccucuggag

SEQ ID NO: 21569 - RNA, 21 nt, Homo sapiens
agaaagugcaucccucuggag

SEQ ID NO: 21570 - RNA, 19 nt, Homo sapiens
auuuugguacagcagcuca

SEQ ID NO: 21571 - RNA, 24 nt, Homo sapiens
acgcagagcccgaaagcccccagu

SEQ ID NO: 21572 - RNA, 22 nt, Homo sapiens
gcugaggcuguggggcuggagu

SEQ ID NO: 21573 - RNA, 20 nt, Homo sapiens
uacugcuuccacagcucccc

SEQ ID NO: 21574 - RNA, 22 nt, Homo sapiens
cacauggccaaaacagagaaga

SEQ ID NO: 21575 - RNA, 18 nt, Homo sapiens
gaaaugagggccagcuga

SEQ ID NO: 21576 - RNA, 18 nt, Homo sapiens
gaaaugagggccagcuga

SEQ ID NO: 21577 - RNA, 21 nt, Homo sapiens
ccccucccagccucccugcca

SEQ ID NO: 21578 - RNA, 20 nt, Homo sapiens
gcagcuguccgcccagacac

SEQ ID NO: 21579 - RNA, 18 nt, Homo sapiens
auucaaucuacugccuca

SEQ ID NO: 21580 - RNA, 22 nt, Homo sapiens
cggugagcacccggccccugcg

SEQ ID NO: 21581 - RNA, 22 nt, Homo sapiens
acugccugucugugccugcugu

SEQ ID NO: 21582 - RNA, 22 nt, Homo sapiens
accagguuccaccccagcaggc

SEQ ID NO: 21583 - RNA, 21 nt, Homo sapiens
gaaggaagugagugcagccac

SEQ ID NO: 21584 - RNA, 23 nt, Homo sapiens
guagugggccgagccgagugaca

SEQ ID NO: 21585 - RNA, 22 nt, Homo sapiens
agcucagaacccagaggucuca

SEQ ID NO: 21586 - RNA, 21 nt, Homo sapiens
ggggagcgggggcccugccuu

SEQ ID NO: 21587 - RNA, 22 nt, Homo sapiens
gaggcucagaauggcucaggag

SEQ ID NO: 21588 - RNA, 21 nt, Homo sapiens
auguaggccuuuagaucacuu

SEQ ID NO: 21589 - RNA, 23 nt, Homo sapiens
cuaucugcacuagaugcaccuua

SEQ ID NO: 21590 - RNA, 23 nt, Homo sapiens
cccaacagacauggcgguacuca

SEQ ID NO: 21591 - RNA, 22 nt, Homo sapiens
cagaagugggccgggcacaggg

SEQ ID NO: 21592 - RNA, 22 nt, Homo sapiens
acugggacuuuguaggccaguu

SEQ ID NO: 21593 - RNA, 22 nt, Homo sapiens
agcgggacuuugagggccaguu

SEQ ID NO: 21594 - RNA, 22 nt, Homo sapiens
ucacauuugccugcagagauuu

SEQ ID NO: 21595 - RNA, 22 nt, Homo sapiens
acaguucuucaacuggcagcuu

SEQ ID NO: 21596 - RNA, 22 nt, Homo sapiens
cuguuccugcugaacugagcca

SEQ ID NO: 21597 - RNA, 22 nt, Homo sapiens
aucgggaggggacugagccuga

SEQ ID NO: 21598 - RNA, 22 nt, Homo sapiens
cuacccacagacguaccaauca

SEQ ID NO: 21599 - RNA, 22 nt, Homo sapiens
ucaaugacucagguaaguugca

SEQ ID NO: 21600 - RNA, 20 nt, Homo sapiens
uacugcuuccacagcucccc

SEQ ID NO: 21601 - RNA, 22 nt, Homo sapiens
uccggggacgaacgggacgggu

SEQ ID NO: 21602 - RNA, 24 nt, Homo sapiens
acugcuggucuucagucagggcca

SEQ ID NO: 21603 - RNA, 22 nt, Homo sapiens
agacaacaaugccaaccucaca

SEQ ID NO: 21604 - RNA, 22 nt, Homo sapiens
uucacacugcaugcucugggua

SEQ ID NO: 21605 - RNA, 22 nt, Homo sapiens
uaaccgauuucagauggugcua

SEQ ID NO: 21606 - RNA, 20 nt, Homo sapiens
cuggaggaagggcccagagg

SEQ ID NO: 21607 - RNA, 22 nt, Homo sapiens
gccuaagacacaggcccagaga

SEQ ID NO: 21608 - RNA, 22 nt, Homo sapiens
acaaccagcuaagacacugcca

SEQ ID NO: 21609 - RNA, 22 nt, Homo sapiens
agggguucaccgagcaacauuc

SEQ ID NO: 21610 - RNA, 22 nt, Homo sapiens
ccucauggaaggguuccccacu

SEQ ID NO: 21611 - RNA, 21 nt, Homo sapiens
acuuuccaggauucauuaacu

SEQ ID NO: 21612 - RNA, 21 nt, Homo sapiens
caguagagauuguuucaacac

SEQ ID NO: 21613 - RNA, 22 nt, Homo sapiens
ggaggccgggacgagugcaaua

SEQ ID NO: 21614 - RNA, 21 nt, Homo sapiens
ccccucccagccucccugcca

SEQ ID NO: 21615 - RNA, 25 nt, Homo sapiens
aagaaagagucuugcuuugucgccc

SEQ ID NO: 21616 - RNA, 18 nt, Homo sapiens
aucacauucaccucccug

SEQ ID NO: 21617 - RNA, 20 nt, Homo sapiens
gcagaagcauuuccacacac

SEQ ID NO: 21618 - RNA, 21 nt, Homo sapiens
cggggugcacgggcggagggc

SEQ ID NO: 21619 - RNA, 22 nt, Homo sapiens
cacugguacaaggguugggaga

SEQ ID NO: 21620 - RNA, 21 nt, Homo sapiens
gaccaaucgccguccccgccg

SEQ ID NO: 21621 - RNA, 22 nt, Homo sapiens
cccaacaacaggaaacuaccua

SEQ ID NO: 21622 - RNA, 25 nt, Homo sapiens
agcuagucaagcgcgguuguggggg

SEQ ID NO: 21623 - RNA, 21 nt, Homo sapiens
aucugcacugucagcacuuua

SEQ ID NO: 21624 - RNA, 23 nt, Homo sapiens
gcuuugacaauaucauugcacug

SEQ ID NO: 21625 - RNA, 22 nt, Homo sapiens
aaagagguuaaccagguguguu

SEQ ID NO: 21626 - RNA, 22 nt, Homo sapiens
ugaauccuugaauagguguguu

SEQ ID NO: 21627 - RNA, 23 nt, Homo sapiens
ucucgugacaugaugauccccga

SEQ ID NO: 21628 - RNA, 21 nt, Homo sapiens
agguaauaccaauaccuugug

SEQ ID NO: 21629 - RNA, 22 nt, Homo sapiens
gcggucccgcggcgccccgccu

SEQ ID NO: 21630 - RNA, 23 nt, Homo sapiens
acaacaaaaucacuagucuucca

SEQ ID NO: 21631 - RNA, 22 nt, Homo sapiens
cacucuaaagggaggcacuuug

SEQ ID NO: 21632 - RNA, 22 nt, Homo sapiens
aaaauacauauauaucuacgua

SEQ ID NO: 21633 - RNA, 18 nt, Homo sapiens
aucacauucaccucccug

SEQ ID NO: 21634 - RNA, 23 nt, Homo sapiens
gggagugaagacacggagccaga

SEQ ID NO: 21635 - RNA, 21 nt, Homo sapiens
uagaaaggcuaggaccaaacc

SEQ ID NO: 21636 - RNA, 22 nt, Homo sapiens
ggagagccuccacccaacccuc

SEQ ID NO: 21637 - RNA, 22 nt, Homo sapiens
aagauguggaccauauuacaua

SEQ ID NO: 21638 - RNA, 21 nt, Homo sapiens
aagacgggaggagaggaguga

SEQ ID NO: 21639 - RNA, 19 nt, Homo sapiens
gggaaacguaugucaaccu

SEQ ID NO: 21640 - RNA, 22 nt, Homo sapiens
caagacacauuuggagagggac

SEQ ID NO: 21641 - RNA, 21 nt, Homo sapiens
cuggaggacggcaacagucag

SEQ ID NO: 21642 - RNA, 22 nt, Homo sapiens
aacuauacaaccuacuaccuca

SEQ ID NO: 21643 - RNA, 22 nt, Homo sapiens
aaccacacaaccuacuaccuca

SEQ ID NO: 21644 - RNA, 19 nt, Homo sapiens
agaaaccccagcagagaca

SEQ ID NO: 21645 - RNA, 22 nt, Homo sapiens
cacaaguucggaucuacggguu

SEQ ID NO: 21646 - RNA, 22 nt, Homo sapiens
aucagagcccucugagcuucag

SEQ ID NO: 21647 - RNA, 22 nt, Homo sapiens
ucacaguugccagcugagauua

SEQ ID NO: 21648 - RNA, 20 nt, Homo sapiens
guguguauacauuuauacau

SEQ ID NO: 21649 - RNA, 21 nt, Homo sapiens
agguaagcgcuguugcuagcc

SEQ ID NO: 21650 - RNA, 21 nt, Homo sapiens
agguaauaccaauaccuugug

SEQ ID NO: 21651 - RNA, 20 nt, Homo sapiens
acaaugagaacccauggucu

SEQ ID NO: 21652 - RNA, 22 nt, Homo sapiens
caaacaccauugucacacucca

SEQ ID NO: 21653 - RNA, 23 nt, Homo sapiens
agcaaaaaugugcuagugccaaa

SEQ ID NO: 21654 - RNA, 17 nt, Homo sapiens
uggcgcccgaacaggga

SEQ ID NO: 21655 - RNA, 23 nt, Homo sapiens
aggaacagcagcagcccgggccg

SEQ ID NO: 21656 - RNA, 21 nt, Homo sapiens
acaggauugagggggggcccu

SEQ ID NO: 21657 - RNA, 21 nt, Homo sapiens
ucaaucacagauagcaccccu

SEQ ID NO: 21658 - RNA, 23 nt, Homo sapiens
aaaucagaaucacaccuggggga

SEQ ID NO: 21659 - RNA, 24 nt, Homo sapiens
acgcagagcccgaaagcccccagu

SEQ ID NO: 21660 - RNA, 23 nt, Homo sapiens
cacugugggcccucuccgcacca

SEQ ID NO: 21661 - RNA, 20 nt, Homo sapiens
gcaagacaucacaagacucu

SEQ ID NO: 21662 - RNA, 20 nt, Homo sapiens
uccgccugucugaacaguga

SEQ ID NO: 21663 - RNA, 21 nt, Homo sapiens
cugaggagagaggaggugggg

SEQ ID NO: 21664 - RNA, 21 nt, Homo sapiens
uggggauuacacuucaacagg

SEQ ID NO: 21665 - RNA, 22 nt, Homo sapiens
cagaaagugcuucccucuagag

SEQ ID NO: 21666 - RNA, 22 nt, Homo sapiens
ucaggaacugccuuucucucca

SEQ ID NO: 21667 - RNA, 22 nt, Homo sapiens
uccacauggaguugcuguuaca

SEQ ID NO: 21668 - RNA, 22 nt, Homo sapiens
uagucaagugaagcagugggag

SEQ ID NO: 21669 - RNA, 21 nt, Homo sapiens
aucugcacugucagcacuuua

SEQ ID NO: 21670 - RNA, 23 nt, Homo sapiens
gcuuugacaauaucauugcacug

SEQ ID NO: 21671 - RNA, 23 nt, Homo sapiens
gcgcccaauuaaugucuguugau

SEQ ID NO: 21672 - RNA, 22 nt, Homo sapiens
guagaagggaaucuugcauaag

SEQ ID NO: 21673 - RNA, 22 nt, Homo sapiens
ccuggcacacaguagaccuuca

SEQ ID NO: 21674 - RNA, 22 nt, Homo sapiens
aggaaaccagcaaguguugacg

SEQ ID NO: 21675 - RNA, 22 nt, Homo sapiens
ugcaagccuugggugugggagg

SEQ ID NO: 21676 - RNA, 21 nt, Homo sapiens
uugucuaaccagucaccuguu

SEQ ID NO: 21677 - RNA, 22 nt, Homo sapiens
ccucaggcacggccgggccacc

SEQ ID NO: 21678 - RNA, 20 nt, Homo sapiens
uacugcuuccacagcucccc

SEQ ID NO: 21679 - RNA, 22 nt, Homo sapiens
cacauggccaaaacagagaaga

SEQ ID NO: 21680 - RNA, 22 nt, Homo sapiens
gugggguggguggucaggccga

SEQ ID NO: 21681 - RNA, 24 nt, Homo sapiens
acugcaggcuccagcuuccaggcu

SEQ ID NO: 21682 - RNA, 18 nt, Homo sapiens
cccccaccaccacgcccg

SEQ ID NO: 21683 - RNA, 23 nt, Homo sapiens
aaaaugcagauuccuggacucca

SEQ ID NO: 21684 - RNA, 21 nt, Homo sapiens
gggcaucugggacgcgcagga

SEQ ID NO: 21685 - RNA, 21 nt, Homo sapiens
gaccaaucgccguccccgccg

SEQ ID NO: 21686 - RNA, 22 nt, Homo sapiens
cggugagcacccggccccugcg

SEQ ID NO: 21687 - RNA, 23 nt, Homo sapiens
cggcucugucgucgaggcgcuca

SEQ ID NO: 21688 - RNA, 22 nt, Homo sapiens
gcggucccgcggcgccccgccu

SEQ ID NO: 21689 - RNA, 22 nt, Homo sapiens
ugcuguuagcccuagccccgca

SEQ ID NO: 21690 - RNA, 22 nt, Homo sapiens
ggcagagagucagagcgcggau

SEQ ID NO: 21691 - RNA, 22 nt, Homo sapiens
aggucucacuuuguugcccaga

SEQ ID NO: 21692 - RNA, 23 nt, Homo sapiens
cuacgcguauucuuaagcaauaa

SEQ ID NO: 21693 - RNA, 23 nt, Homo sapiens
gggagugaagacacggagccaga

SEQ ID NO: 21694 - RNA, 23 nt, Homo sapiens
gggagugaagacacggagccaga

SEQ ID NO: 21695 - RNA, 23 nt, Homo sapiens
cuaucugcacuagaugcaccuua

SEQ ID NO: 21696 - RNA, 20 nt, Homo sapiens
acagcaaggagggcaggagg

SEQ ID NO: 21697 - RNA, 22 nt, Homo sapiens
agucuucacaacagcccugugu

SEQ ID NO: 21698 - RNA, 22 nt, Homo sapiens
ggagagccuccacccaacccuc

SEQ ID NO: 21699 - RNA, 22 nt, Homo sapiens
gccagcuaacaauacacugccu

SEQ ID NO: 21700 - RNA, 22 nt, Homo sapiens
aggaaaccagcaaguguugacg

SEQ ID NO: 21701 - RNA, 25 nt, Homo sapiens
aaggagcucagaagcccugcccagc

SEQ ID NO: 21702 - RNA, 19 nt, Homo sapiens
gcucuaagaaagccacacu

SEQ ID NO: 21703 - RNA, 20 nt, Homo sapiens
aggggccucagccuccuggu

SEQ ID NO: 21704 - RNA, 20 nt, Homo sapiens
uccccacagacccagagccg

SEQ ID NO: 21705 - RNA, 22 nt, Homo sapiens
ucggucccucgggccagggcag

SEQ ID NO: 21706 - RNA, 23 nt, Homo sapiens
cacaaauucggaucuacagggua

SEQ ID NO: 21707 - RNA, 23 nt, Homo sapiens
cacaaauucgguucuacagggua

SEQ ID NO: 21708 - RNA, 17 nt, Homo sapiens
uggcgcccgaacaggga

SEQ ID NO: 21709 - RNA, 17 nt, Homo sapiens
ggguggcagcgguggga

SEQ ID NO: 21710 - RNA, 22 nt, Homo sapiens
augcccuuucaucauugcacug

SEQ ID NO: 21711 - RNA, 22 nt, Homo sapiens
accuaauauaucaaacauauca

SEQ ID NO: 21712 - RNA, 21 nt, Homo sapiens
aacccaauaucaaacauauca

SEQ ID NO: 21713 - RNA, 21 nt, Homo sapiens
accuauccugaauuacuugaa

SEQ ID NO: 21714 - RNA, 22 nt, Homo sapiens
ccucauggaaggguuccccacu

SEQ ID NO: 21715 - RNA, 22 nt, Homo sapiens
cucagagcagacgugguucuca

SEQ ID NO: 21716 - RNA, 20 nt, Homo sapiens
cccugcgccaucuccucuac

SEQ ID NO: 21717 - RNA, 20 nt, Homo sapiens
uacugcuuccacagcucccc

SEQ ID NO: 21718 - RNA, 22 nt, Homo sapiens
gggagaggucucccugcgcaca

SEQ ID NO: 21719 - RNA, 22 nt, Homo sapiens
ugaagaagggggggaagggcgu

SEQ ID NO: 21720 - RNA, 23 nt, Homo sapiens
gggagugaagacacggagccaga

SEQ ID NO: 21721 - RNA, 21 nt, Homo sapiens
gggcaucugggacgcgcagga

SEQ ID NO: 21722 - RNA, 20 nt, Homo sapiens
cccgccgcgucgcccugggg

SEQ ID NO: 21723 - RNA, 22 nt, Homo sapiens
ucaucucgcccgcaaagaccca

SEQ ID NO: 21724 - RNA, 21 nt, Homo sapiens
uucuaggauaggcccaggggc

SEQ ID NO: 21725 - RNA, 23 nt, Homo sapiens
cugcagaacuguucccgcugcua

SEQ ID NO: 21726 - RNA, 20 nt, Homo sapiens
aggggccucagccuccuggu

SEQ ID NO: 21727 - RNA, 23 nt, Homo sapiens
acaacaaaaucacuagucuucca

SEQ ID NO: 21728 - RNA, 22 nt, Homo sapiens
ccacacacuuccuuacauucca

SEQ ID NO: 21729 - RNA, 22 nt, Homo sapiens
aucagagcccucugagcuucag

SEQ ID NO: 21730 - RNA, 22 nt, Homo sapiens
agacaacaaugccaaccucaca

SEQ ID NO: 21731 - RNA, 21 nt, Homo sapiens
aggcggcaggcacaggacugg

SEQ ID NO: 21732 - RNA, 22 nt, Homo sapiens
uagucaagugaagcagugggag

SEQ ID NO: 21733 - RNA, 23 nt, Homo sapiens
acggcuaguggaccaggugaagu

SEQ ID NO: 21734 - RNA, 22 nt, Homo sapiens
gcugccguauaugugaugucac

SEQ ID NO: 21735 - RNA, 23 nt, Homo sapiens
caugagugacgcccucuggagua

SEQ ID NO: 21736 - RNA, 21 nt, Homo sapiens
caucaccuuccuucuccucca

SEQ ID NO: 21737 - RNA, 20 nt, Homo sapiens
aguacaucaucuauacugua

SEQ ID NO: 21738 - RNA, 22 nt, Homo sapiens
ugggguauuugacaaacugaca

SEQ ID NO: 21739 - RNA, 23 nt, Homo sapiens
acauuuuucguuauugcucuuga

SEQ ID NO: 21740 - RNA, 22 nt, Homo sapiens
gagcccuggacuaggagucagc

SEQ ID NO: 21741 - RNA, 21 nt, Homo sapiens
ccuucugacuccaaguccagu

SEQ ID NO: 21742 - RNA, 22 nt, Homo sapiens
ccuggcacacaguagaccuuca

SEQ ID NO: 21743 - RNA, 22 nt, Homo sapiens
uuucaguuaucaaucugucaca

SEQ ID NO: 21744 - RNA, 21 nt, Homo sapiens
cugaaaccaaguaugggucgc

SEQ ID NO: 21745 - RNA, 22 nt, Homo sapiens
uggugauucacaaagaaaucca

SEQ ID NO: 21746 - RNA, 23 nt, Homo sapiens
cacaaauucggaucuacagggua

SEQ ID NO: 21747 - RNA, 23 nt, Homo sapiens
cacaaauucgguucuacagggua

SEQ ID NO: 21748 - RNA, 22 nt, Homo sapiens
gaggcucagaauggcucaggag

SEQ ID NO: 21749 - RNA, 26 nt, Homo sapiens
aaccaucucauacaaaccaacuacuu

SEQ ID NO: 21750 - RNA, 17 nt, Homo sapiens
uggcgcccgaacaggga

SEQ ID NO: 21751 - RNA, 22 nt, Homo sapiens
augcccuuucaucauugcacug

SEQ ID NO: 21752 - RNA, 22 nt, Homo sapiens
ccaucuuuaccagacaguguua

SEQ ID NO: 21753 - RNA, 22 nt, Homo sapiens
acaucguuaccagacaguguua

SEQ ID NO: 21754 - RNA, 22 nt, Homo sapiens
ugggguauuugacaaacugaca

SEQ ID NO: 21755 - RNA, 21 nt, Homo sapiens
gcggaacuuagccacugugaa

SEQ ID NO: 21756 - RNA, 21 nt, Homo sapiens
gcagaacuuagccacugugaa

SEQ ID NO: 21757 - RNA, 23 nt, Homo sapiens
gcgguagcggaagcgguaacugg

SEQ ID NO: 21758 - RNA, 21 nt, Homo sapiens
cuggaggacggcaacagucag

SEQ ID NO: 21759 - RNA, 21 nt, Homo sapiens
ccccucccagccucccugcca

SEQ ID NO: 21760 - RNA, 22 nt, Homo sapiens
caaacaccauugucacacucca

SEQ ID NO: 21761 - RNA, 22 nt, Homo sapiens
ucccucacacagaauuccagaa

SEQ ID NO: 21762 - RNA, 22 nt, Homo sapiens
augcuuuuugggguaagggcuu

SEQ ID NO: 21763 - RNA, 23 nt, Homo sapiens
cuaucugcacuagaugcaccuua

SEQ ID NO: 21764 - RNA, 20 nt, Homo sapiens
cccgccgcgucgcccugggg

SEQ ID NO: 21765 - RNA, 22 nt, Homo sapiens
uaaccgauuucagauggugcua

SEQ ID NO: 21766 - RNA, 22 nt, Homo sapiens
aggaaaccagcaaguguugacg

SEQ ID NO: 21767 - RNA, 22 nt, Homo sapiens
aaagaugagcuaaugguaauau

SEQ ID NO: 21768 - RNA, 20 nt, Homo sapiens
guguguauacauuuauacau

SEQ ID NO: 21769 - RNA, 22 nt, Homo sapiens
ucggucccucgggccagggcag

SEQ ID NO: 21770 - RNA, 22 nt, Homo sapiens
ucggucccucgggccagggcag

SEQ ID NO: 21771 - RNA, 21 nt, Homo sapiens
gagcugcauccuggcuccggg

SEQ ID NO: 21772 - RNA, 20 nt, Homo sapiens
cugcgggaggacagggcuca

SEQ ID NO: 21773 - RNA, 23 nt, Homo sapiens
aaaaugcagauuccuggacucca

SEQ ID NO: 21774 - RNA, 21 nt, Homo sapiens
acuagacugugagcuccucga

SEQ ID NO: 21775 - RNA, 23 nt, Homo sapiens
aggaacagcagcagcccgggccg

SEQ ID NO: 21776 - RNA, 21 nt, Homo sapiens
gaccaaucgccguccccgccg

SEQ ID NO: 21777 - RNA, 21 nt, Homo sapiens
acaggauugagggggggcccu

SEQ ID NO: 21778 - RNA, 22 nt, Homo sapiens
agcugaguguaggauguuuaca

SEQ ID NO: 21779 - RNA, 22 nt, Homo sapiens
caacaaaaucacugaugcugga

SEQ ID NO: 21780 - RNA, 22 nt, Homo sapiens
auaaggauuuuuaggggcauua

SEQ ID NO: 21781 - RNA, 22 nt, Homo sapiens
gccaccuucaaaugggaagucu

SEQ ID NO: 21782 - RNA, 22 nt, Homo sapiens
gcggucccgcggcgccccgccu

SEQ ID NO: 21783 - RNA, 21 nt, Homo sapiens
cugaggagagaggaggugggg

SEQ ID NO: 21784 - RNA, 21 nt, Homo sapiens
acccaguagccagauguagcu

SEQ ID NO: 21785 - RNA, 22 nt, Homo sapiens
ugggguauuugacaaacugaca

SEQ ID NO: 21786 - RNA, 22 nt, Homo sapiens
gagcccuggacuaggagucagc

SEQ ID NO: 21787 - RNA, 22 nt, Homo sapiens
auaaggauuuuuaggggcauua

SEQ ID NO: 21788 - RNA, 20 nt, Homo sapiens
uaugaacaauuucuaggaau

SEQ ID NO: 21789 - RNA, 23 nt, Homo sapiens
augcaaaguugcucggguaaccu

SEQ ID NO: 21790 - RNA, 22 nt, Homo sapiens
ccucauggaaggguuccccacu

SEQ ID NO: 21791 - RNA, 22 nt, Homo sapiens
gccaccuucaaaugggaagucu

SEQ ID NO: 21792 - RNA, 19 nt, Homo sapiens
ucccacaggaagcagacac

SEQ ID NO: 21793 - RNA, 22 nt, Homo sapiens
aaggugauggucagcagacaua

SEQ ID NO: 21794 - RNA, 22 nt, Homo sapiens
ggcagagagucagagcgcggau

SEQ ID NO: 21795 - RNA, 22 nt, Homo sapiens
agcuagugagaagucaaugccu

SEQ ID NO: 21796 - RNA, 21 nt, Homo sapiens
cggggugcacgggcggagggc

SEQ ID NO: 21797 - RNA, 22 nt, Homo sapiens
acaaaguucugugaugcacuga

SEQ ID NO: 21798 - RNA, 22 nt, Homo sapiens
cacugguacaaggguugggaga

SEQ ID NO: 21799 - RNA, 25 nt, Homo sapiens
accaacggaccuacuucccuccgcc

SEQ ID NO: 21800 - RNA, 20 nt, Homo sapiens
uacugcuuccacagcucccc

SEQ ID NO: 21801 - RNA, 22 nt, Homo sapiens
ggcagagagucagagcgcggau

SEQ ID NO: 21802 - RNA, 22 nt, Homo sapiens
aacuauacaaccuacuaccuca

SEQ ID NO: 21803 - RNA, 22 nt, Homo sapiens
aaccacacaaccuacuaccuca

SEQ ID NO: 21804 - RNA, 19 nt, Homo sapiens
agaaaccccagcagagaca

SEQ ID NO: 21805 - RNA, 23 nt, Homo sapiens
accacaggagucugagcauuuga

SEQ ID NO: 21806 - RNA, 22 nt, Homo sapiens
agccacaaucaccuucugaucu

SEQ ID NO: 21807 - RNA, 22 nt, Homo sapiens
gcacacaauaaauguuugcuga

SEQ ID NO: 21808 - RNA, 21 nt, Homo sapiens
cugaaaccaaguaugggucgc

SEQ ID NO: 21809 - RNA, 20 nt, Homo sapiens
guguguauacauuuauacau

SEQ ID NO: 21810 - RNA, 21 nt, Homo sapiens
acaauccuagagcacaagaag

SEQ ID NO: 21811 - RNA, 22 nt, Homo sapiens
caagacacauuuggagagggac

SEQ ID NO: 21812 - RNA, 23 nt, Homo sapiens
cacaaauucggaucuacagggua

SEQ ID NO: 21813 - RNA, 23 nt, Homo sapiens
cacaaauucgguucuacagggua

SEQ ID NO: 21814 - RNA, 23 nt, Homo sapiens
gucacaucccucccaagacccuc

SEQ ID NO: 21815 - RNA, 21 nt, Homo sapiens
uagaaaggcuaggaccaaacc

SEQ ID NO: 21816 - RNA, 22 nt, Homo sapiens
ucaacaucagucugauaagcua

SEQ ID NO: 21817 - RNA, 23 nt, Homo sapiens
cgugagcuccuggaggacaggga

SEQ ID NO: 21818 - RNA, 23 nt, Homo sapiens
acaccccaaaaucgaagcacuuc

SEQ ID NO: 21819 - RNA, 23 nt, Homo sapiens
aaagucucgcucucugccccuca

SEQ ID NO: 21820 - RNA, 22 nt, Homo sapiens
gauagagugcagaccagggucu

SEQ ID NO: 21821 - RNA, 21 nt, Homo sapiens
cucacucagauggccaacuca

SEQ ID NO: 21822 - RNA, 21 nt, Homo sapiens
acuagcuuauacauaaaauua

SEQ ID NO: 21823 - RNA, 22 nt, Homo sapiens
cugcucaaacccuccaaugacu

SEQ ID NO: 21824 - RNA, 17 nt, Homo sapiens
uggcgcccgaacaggga

SEQ ID NO: 21825 - RNA, 22 nt, Homo sapiens
agaaagcgcuuuccuuuguaga

SEQ ID NO: 21826 - RNA, 21 nt, Homo sapiens
aacggaaccacuagugacuug

SEQ ID NO: 21827 - RNA, 22 nt, Homo sapiens
cacuuaucagguuguauuauaa

SEQ ID NO: 21828 - RNA, 23 nt, Homo sapiens
ccacccaaugaccuacuccaaga

SEQ ID NO: 21829 - RNA, 21 nt, Homo sapiens
gaccaagaaauagccuuucaa

SEQ ID NO: 21830 - RNA, 20 nt, Homo sapiens
gaaagggcuucccuuuguag

SEQ ID NO: 21831 - RNA, 22 nt, Homo sapiens
acacucuaaagggaaccauuuu

SEQ ID NO: 21832 - RNA, 22 nt, Homo sapiens
gagaaagugcuucccuuuguag

SEQ ID NO: 21833 - RNA, 22 nt, Homo sapiens
aaagacguggagaaauuagaau

SEQ ID NO: 21834 - RNA, 23 nt, Homo sapiens
acucagaaggacaaguagaguuu

SEQ ID NO: 21835 - RNA, 23 nt, Homo sapiens
ucauacagcuagauaaccaaaga

SEQ ID NO: 21836 - RNA, 21 nt, Homo sapiens
aucugcacugucagcacuuua

SEQ ID NO: 21837 - RNA, 23 nt, Homo sapiens
ggaagccaucaagucgcugcagg

SEQ ID NO: 21838 - RNA, 21 nt, Homo sapiens
gagcugcauccuggcuccggg

SEQ ID NO: 21839 - RNA, 21 nt, Homo sapiens
ccccucccagccucccugcca

SEQ ID NO: 21840 - RNA, 17 nt, Homo sapiens
gggagaggaggaggcga

SEQ ID NO: 21841 - RNA, 21 nt, Homo sapiens
gaccaaucgccguccccgccg

SEQ ID NO: 21842 - RNA, 22 nt, Homo sapiens
cggugagcacccggccccugcg

SEQ ID NO: 21843 - RNA, 22 nt, Homo sapiens
uggcagcagcggagggggcaga

SEQ ID NO: 21844 - RNA, 20 nt, Homo sapiens
ccagcagcaccuggggcagu

SEQ ID NO: 21845 - RNA, 22 nt, Homo sapiens
acaaccagcuaagacacugcca

SEQ ID NO: 21846 - RNA, 23 nt, Homo sapiens
gcaaucagcuaacuacacugccu

SEQ ID NO: 21847 - RNA, 22 nt, Homo sapiens
accagcuaacaauacacugcca

SEQ ID NO: 21848 - RNA, 22 nt, Homo sapiens
gccagcuaacaauacacugccu

SEQ ID NO: 21849 - RNA, 21 nt, Homo sapiens
auccuguacugagcugccccg

SEQ ID NO: 21850 - RNA, 22 nt, Homo sapiens
aguccagauucugugcccacca

SEQ ID NO: 21851 - RNA, 19 nt, Homo sapiens
guccugaauuccgcagccu

SEQ ID NO: 21852 - RNA, 22 nt, Homo sapiens
gcacauguucugcggcccacca

SEQ ID NO: 21853 - RNA, 22 nt, Homo sapiens
gcggucccgcggcgccccgccu

SEQ ID NO: 21854 - RNA, 21 nt, Homo sapiens
caucaccuuccuucuccucca

SEQ ID NO: 21855 - RNA, 23 nt, Homo sapiens
aggaacagcagcagcccgggccg

SEQ ID NO: 21856 - RNA, 21 nt, Homo sapiens
aguucucccaacguaaaccca

SEQ ID NO: 21857 - RNA, 23 nt, Homo sapiens
aggaacagcagcagcccgggccg

SEQ ID NO: 21858 - RNA, 22 nt, Homo sapiens
ucaggaacugccuuucucucca

SEQ ID NO: 21859 - RNA, 21 nt, Homo sapiens
gaccaaucgccguccccgccg

SEQ ID NO: 21860 - RNA, 23 nt, Homo sapiens
aaagucucgcucucugccccuca

SEQ ID NO: 21861 - RNA, 21 nt, Homo sapiens
aaacaucacugcaagucuuaa

SEQ ID NO: 21862 - RNA, 22 nt, Homo sapiens
aaagugcuucuuaccuccagau

SEQ ID NO: 21863 - RNA, 21 nt, Homo sapiens
acuccaaagggaagcgccuuc

SEQ ID NO: 21864 - RNA, 22 nt, Homo sapiens
cgcucuaaagggaagcgccuuc

SEQ ID NO: 21865 - RNA, 19 nt, Homo sapiens
guugggaucacaggcgccc

SEQ ID NO: 21866 - RNA, 19 nt, Homo sapiens
guugggaucacaggcgccc

SEQ ID NO: 21867 - RNA, 22 nt, Homo sapiens
gccaccuucaaaugggaagucu

SEQ ID NO: 21868 - RNA, 21 nt, Homo sapiens
cacaacccuaguggcgccauu

SEQ ID NO: 21869 - RNA, 24 nt, Homo sapiens
acgcgcaggccagagacccaggca

SEQ ID NO: 21870 - RNA, 22 nt, Homo sapiens
gcggucccgcggcgccccgccu

SEQ ID NO: 21871 - RNA, 22 nt, Homo sapiens
gcggucccgcggcgccccgccu

SEQ ID NO: 21872 - RNA, 20 nt, Homo sapiens
cugcgggaggacagggcuca

SEQ ID NO: 21873 - RNA, 22 nt, Homo sapiens
ugaagaagggggggaagggcgu

SEQ ID NO: 21874 - RNA, 21 nt, Homo sapiens
uggggauuacacuucaacagg

SEQ ID NO: 21875 - RNA, 22 nt, Homo sapiens
ucccucacacagaauuccagaa

SEQ ID NO: 21876 - RNA, 22 nt, Homo sapiens
augcuuuuugggguaagggcuu

SEQ ID NO: 21877 - RNA, 22 nt, Homo sapiens
agaaaaugccccucaguuuuga

SEQ ID NO: 21878 - RNA, 22 nt, Homo sapiens
uccacauggaguugcuguuaca

SEQ ID NO: 21879 - RNA, 20 nt, Homo sapiens
acauuacuguuaucaaaaca

SEQ ID NO: 21880 - RNA, 22 nt, Homo sapiens
agccacaaucaccuucugaucu

SEQ ID NO: 21881 - RNA, 22 nt, Homo sapiens
acaaccagcuaagacacugcca

SEQ ID NO: 21882 - RNA, 23 nt, Homo sapiens
gcaaucagcuaacuacacugccu

SEQ ID NO: 21883 - RNA, 23 nt, Homo sapiens
gcgcccaauuaaugucuguugau

SEQ ID NO: 21884 - RNA, 22 nt, Homo sapiens
accagcuaacaauacacugcca

SEQ ID NO: 21885 - RNA, 22 nt, Homo sapiens
gccagcuaacaauacacugccu

SEQ ID NO: 21886 - RNA, 22 nt, Homo sapiens
gcaaaaguaauugagauuuuug

SEQ ID NO: 21887 - RNA, 22 nt, Homo sapiens
gcaaaaguaacugcaguuuugg

SEQ ID NO: 21888 - RNA, 21 nt, Homo sapiens
cugaaaccaaguaugggucgc

SEQ ID NO: 21889 - RNA, 19 nt, Homo sapiens
uagcauacagauacgccca

SEQ ID NO: 21890 - RNA, 21 nt, Homo sapiens
gguggagcccugagaaccgga

SEQ ID NO: 21891 - RNA, 20 nt, Homo sapiens
uccccacagacccagagccg

SEQ ID NO: 21892 - RNA, 22 nt, Homo sapiens
ccucgggauggcgcccguucac

SEQ ID NO: 21893 - RNA, 20 nt, Homo sapiens
uacugcuuccacagcucccc

SEQ ID NO: 21894 - RNA, 24 nt, Homo sapiens
ucacagguuaaagggucucaggga

SEQ ID NO: 21895 - RNA, 22 nt, Homo sapiens
ucacaaguuagggucucaggga

SEQ ID NO: 21896 - RNA, 23 nt, Homo sapiens
agcccuguucuacagcccugagg

SEQ ID NO: 21897 - RNA, 19 nt, Homo sapiens
ucccugauccaaaaaucca

SEQ ID NO: 21898 - RNA, 18 nt, Homo sapiens
aucacauucaccucccug

SEQ ID NO: 21899 - RNA, 22 nt, Homo sapiens
cagaagugggccgggcacaggg

SEQ ID NO: 21900 - RNA, 21 nt, Homo sapiens
gcagaacuuagccacugugaa

SEQ ID NO: 21901 - RNA, 22 nt, Homo sapiens
cacucagcaccaggauauuguu

SEQ ID NO: 21902 - RNA, 23 nt, Homo sapiens
acggcuaguggaccaggugaagu

SEQ ID NO: 21903 - RNA, 22 nt, Homo sapiens
gccagcuaacaauacacugccu

SEQ ID NO: 21904 - RNA, 22 nt, Homo sapiens
ccuggcacacaguagaccuuca

SEQ ID NO: 21905 - RNA, 22 nt, Homo sapiens
gcaaaaguaauugagauuuuug

SEQ ID NO: 21906 - RNA, 23 nt, Homo sapiens
uguaggcuggggauaaaugaaua

SEQ ID NO: 21907 - RNA, 20 nt, Homo sapiens
cccugcgccaucuccucuac

SEQ ID NO: 21908 - RNA, 22 nt, Homo sapiens
cgcauuauuacucacgguacga

SEQ ID NO: 21909 - RNA, 23 nt, Homo sapiens
acucaccgacagcguugaauguu

SEQ ID NO: 21910 - RNA, 23 nt, Homo sapiens
acccaccgacagcaaugaauguu

SEQ ID NO: 21911 - RNA, 22 nt, Homo sapiens
acucaccgacagguugaauguu

SEQ ID NO: 21912 - RNA, 23 nt, Homo sapiens
acccaccgacaacaaugaauguu

SEQ ID NO: 21913 - RNA, 22 nt, Homo sapiens
agcccaaaaggagaauucuuug

SEQ ID NO: 21914 - RNA, 22 nt, Homo sapiens
ucaacaucagucugauaagcua

SEQ ID NO: 21915 - RNA, 21 nt, Homo sapiens
ggaaaucccuggcaaugugau

SEQ ID NO: 21916 - RNA, 21 nt, Homo sapiens
gguaaucccuggcaaugugau

SEQ ID NO: 21917 - RNA, 22 nt, Homo sapiens
ucgcccucucaacccagcuuuu

SEQ ID NO: 21918 - RNA, 22 nt, Homo sapiens
uugcccucucaacccagcuuuu

SEQ ID NO: 21919 - RNA, 20 nt, Homo sapiens
acccucucaacccagcuuuu

SEQ ID NO: 21920 - RNA, 19 nt, Homo sapiens
uccucucaacccagcuuuu

SEQ ID NO: 21921 - RNA, 21 nt, Homo sapiens
ugcaaugcaacuacaaugcac

SEQ ID NO: 21922 - RNA, 22 nt, Homo sapiens
acacaccaaggauaauuucucc

SEQ ID NO: 21923 - RNA, 22 nt, Homo sapiens
aagaagugcaccgcgaauguuu

SEQ ID NO: 21924 - RNA, 23 nt, Homo sapiens
aaucgcgguuuauaccaaaugaa

SEQ ID NO: 21925 - RNA, 21 nt, Homo sapiens
guucuaacccauuguggccaa

SEQ ID NO: 21926 - RNA, 23 nt, Homo sapiens
uuuauugugguagauacuauuag

SEQ ID NO: 21927 - RNA, 19 nt, Homo sapiens
ucagcaguaccagccuaga

SEQ ID NO: 21928 - RNA, 23 nt, Homo sapiens
uguaggcuggggauaaaugaaua

SEQ ID NO: 21929 - RNA, 21 nt, Homo sapiens
uggggauuacacuucaacagg

SEQ ID NO: 21930 - RNA, 23 nt, Homo sapiens
ucacauaggaauaaaaagccaua

SEQ ID NO: 21931 - RNA, 23 nt, Homo sapiens
ucacauaggaaugaaaagccaua

SEQ ID NO: 21932 - RNA, 20 nt, Homo sapiens
uacugcuuccacagcucccc

SEQ ID NO: 21933 - RNA, 24 nt, Homo sapiens
ugggagaaccucccugcuucugcu

SEQ ID NO: 21934 - RNA, 22 nt, Homo sapiens
uaaccgauuucagauggugcua

SEQ ID NO: 21935 - RNA, 23 nt, Homo sapiens
gcgcccaauuaaugucuguugau

SEQ ID NO: 21936 - RNA, 22 nt, Homo sapiens
gaauucaucacggccagccucu

SEQ ID NO: 21937 - RNA, 23 nt, Homo sapiens
ccuucucagaaaggugaaauuua

SEQ ID NO: 21938 - RNA, 23 nt, Homo sapiens
ccuucucagaaaggugaaauuua

SEQ ID NO: 21939 - RNA, 22 nt, Homo sapiens
acacaccaaggauaauuucucc

SEQ ID NO: 21940 - RNA, 22 nt, Homo sapiens
acacaccaaggauaauuucucc

SEQ ID NO: 21941 - RNA, 21 nt, Homo sapiens
aguucucccaacguaaaccca

SEQ ID NO: 21942 - RNA, 21 nt, Homo sapiens
caguagagauuguuucaacac

SEQ ID NO: 21943 - RNA, 17 nt, Homo sapiens
uggaggccccagcgaga

SEQ ID NO: 21944 - RNA, 22 nt, Homo sapiens
ucccucacacagaauuccagaa

SEQ ID NO: 21945 - RNA, 20 nt, Homo sapiens
gcagaagcauuuccacacac

SEQ ID NO: 21946 - RNA, 23 nt, Homo sapiens
gggagugaagacacggagccaga

SEQ ID NO: 21947 - RNA, 21 nt, Homo sapiens
ugcaaacccugcaugugggag

SEQ ID NO: 21948 - RNA, 22 nt, Homo sapiens
ggagagccuccacccaacccuc

SEQ ID NO: 21949 - RNA, 22 nt, Homo sapiens
agcugaguguaggauguuuaca

SEQ ID NO: 21950 - RNA, 22 nt, Homo sapiens
caacaaaaucacugaugcugga

SEQ ID NO: 21951 - RNA, 22 nt, Homo sapiens
gaauucaucacggccagccucu

SEQ ID NO: 21952 - RNA, 23 nt, Homo sapiens
acacucuaaagagaagcgcuuug

SEQ ID NO: 21953 - RNA, 21 nt, Homo sapiens
agaaaguacuucccucuggag

SEQ ID NO: 21954 - RNA, 21 nt, Homo sapiens
agaaagugcaucccucuggag

SEQ ID NO: 21955 - RNA, 22 nt, Homo sapiens
ugcaagccuugggugugggagg

SEQ ID NO: 21956 - RNA, 23 nt, Homo sapiens
acacacucacacacacacacuca

SEQ ID NO: 21957 - RNA, 22 nt, Homo sapiens
gcaaaaguaauugcagugugug

SEQ ID NO: 21958 - RNA, 21 nt, Homo sapiens
caucaccuuccuucuccucca

SEQ ID NO: 21959 - RNA, 20 nt, Homo sapiens
ugucuccacagggcucuuua

SEQ ID NO: 21960 - RNA, 22 nt, Homo sapiens
augcccuuucaucauugcacug

SEQ ID NO: 21961 - RNA, 21 nt, Homo sapiens
uucuaggauaggcccaggggc

SEQ ID NO: 21962 - RNA, 23 nt, Homo sapiens
aaaucagaaucacaccuggggga

SEQ ID NO: 21963 - RNA, 25 nt, Homo sapiens
acggagcugucccaacaccaccccu

SEQ ID NO: 21964 - RNA, 24 nt, Homo sapiens
acgcagagcccgaaagcccccagu

SEQ ID NO: 21965 - RNA, 21 nt, Homo sapiens
aagggucaguaagcacccgcg

SEQ ID NO: 21966 - RNA, 20 nt, Homo sapiens
uacugcuuccacagcucccc

SEQ ID NO: 21967 - RNA, 23 nt, Homo sapiens
aacaggugcucaaauaagacuug

SEQ ID NO: 21968 - RNA, 22 nt, Homo sapiens
ucccucacacagaauuccagaa

SEQ ID NO: 21969 - RNA, 20 nt, Homo sapiens
aguacaucaucuauacugua

SEQ ID NO: 21970 - RNA, 23 nt, Homo sapiens
guaaauagagguuuaauuaacac

SEQ ID NO: 21971 - RNA, 23 nt, Homo sapiens
aauaaauuaaauuuauauuacag

SEQ ID NO: 21972 - RNA, 21 nt, Homo sapiens
ugcaaugcaacuacaaugcac

SEQ ID NO: 21973 - RNA, 21 nt, Homo sapiens
ucuacucacagaagugucaau

SEQ ID NO: 21974 - RNA, 21 nt, Homo sapiens
agagguugacuguauaauauu

SEQ ID NO: 21975 - RNA, 21 nt, Homo sapiens
cacaaccucaguguuuccagg

SEQ ID NO: 21976 - RNA, 22 nt, Homo sapiens
gaggcucagaauggcucaggag

SEQ ID NO: 21977 - RNA, 21 nt, Homo sapiens
aaaagcuaagucaucauauau

SEQ ID NO: 21978 - RNA, 22 nt, Homo sapiens
ugagugcuugcuaggugccaag

SEQ ID NO: 21979 - RNA, 22 nt, Homo sapiens
accuaauauaucaaacauauca

SEQ ID NO: 21980 - RNA, 22 nt, Homo sapiens
cccaacaacaggaaacuaccua

SEQ ID NO: 21981 - RNA, 22 nt, Homo sapiens
ucacaguugccagcugagauua

SEQ ID NO: 21982 - RNA, 22 nt, Homo sapiens
cucaauagacugugagcuccuu

SEQ ID NO: 21983 - RNA, 23 nt, Homo sapiens
acauuuuucguuauugcucuuga

SEQ ID NO: 21984 - RNA, 22 nt, Homo sapiens
aucgggaggggacugagccuga

SEQ ID NO: 21985 - RNA, 24 nt, Homo sapiens
cagaaagugcuuucuuuuggagaa

SEQ ID NO: 21986 - RNA, 20 nt, Homo sapiens
ggcauucaccgcgugccuua

SEQ ID NO: 21987 - RNA, 22 nt, Homo sapiens
cagaaagugcuucccucuagag

SEQ ID NO: 21988 - RNA, 21 nt, Homo sapiens
cacucugaagggaagcgcuuu

SEQ ID NO: 21989 - RNA, 21 nt, Homo sapiens
ccucuaaagagaagcgcuuuc

SEQ ID NO: 21990 - RNA, 22 nt, Homo sapiens
acacucuaaaaggaugcacuuu

SEQ ID NO: 21991 - RNA, 22 nt, Homo sapiens
cagaaagcgcuucccucuagag

SEQ ID NO: 21992 - RNA, 22 nt, Homo sapiens
cagaaagcgcuucccucuagag

SEQ ID NO: 21993 - RNA, 22 nt, Homo sapiens
aacacucuaaaaggaggcacuu

SEQ ID NO: 21994 - RNA, 22 nt, Homo sapiens
cagaaagugcuucccucuagag

SEQ ID NO: 21995 - RNA, 22 nt, Homo sapiens
acacucuaaagggaaccauuuu

SEQ ID NO: 21996 - RNA, 23 nt, Homo sapiens
acccucuauagggaagcgcguuc

SEQ ID NO: 21997 - RNA, 22 nt, Homo sapiens
cagaaagugcuucccucuagag

SEQ ID NO: 21998 - RNA, 21 nt, Homo sapiens
ucccagcacacauuuagcuca

SEQ ID NO: 21999 - RNA, 23 nt, Homo sapiens
cccagcuagauuguaagcuccuu

SEQ ID NO: 22000 - RNA, 22 nt, Homo sapiens
cacucuaaagggaggcacuuug

SEQ ID NO: 22001 - RNA, 23 nt, Homo sapiens
agcaaaaaugugcuagugccaaa

SEQ ID NO: 22002 - RNA, 26 nt, Homo sapiens
uuucagaauuugcugccaucaucauc

SEQ ID NO: 22003 - RNA, 23 nt, Homo sapiens
cacaaauucggaucuacagggua

SEQ ID NO: 22004 - RNA, 21 nt, Homo sapiens
ucuccagaucagggcagucca

SEQ ID NO: 22005 - RNA, 17 nt, Homo sapiens
caccugaauuacuugaa

SEQ ID NO: 22006 - RNA, 21 nt, Homo sapiens
aggcggcaggcacaggacugg

SEQ ID NO: 22007 - RNA, 23 nt, Homo sapiens
cuaccugcacuauaagcacuuua

SEQ ID NO: 22008 - RNA, 22 nt, Homo sapiens
cacucagcggccguuuccccaa

SEQ ID NO: 22009 - RNA, 23 nt, Homo sapiens
uccaaucaguuccugaugcagua

SEQ ID NO: 22010 - RNA, 22 nt, Homo sapiens
agccuauccuggauuacuugaa

SEQ ID NO: 22011 - RNA, 21 nt, Homo sapiens
accuauccugaauuacuugaa

SEQ ID NO: 22012 - RNA, 22 nt, Homo sapiens
cagcauggaguccuccagguug

SEQ ID NO: 22013 - RNA, 22 nt, Homo sapiens
gacaaaacccgcaaauacuuuu

SEQ ID NO: 22014 - RNA, 22 nt, Homo sapiens
acaaaauccacaauuacuuuug

SEQ ID NO: 22015 - RNA, 22 nt, Homo sapiens
acuucaaggaucuuaaacuuug

SEQ ID NO: 22016 - RNA, 20 nt, Homo sapiens
aggggccucagccuccuggu

SEQ ID NO: 22017 - RNA, 20 nt, Homo sapiens
acaaugagaacccauggucu

SEQ ID NO: 22018 - RNA, 22 nt, Homo sapiens
caaacaccauugucacacucca

SEQ ID NO: 22019 - RNA, 21 nt, Homo sapiens
acaaugguuguccgauauuaa

SEQ ID NO: 22020 - RNA, 20 nt, Homo sapiens
ggcauucaccgcgugccuua

SEQ ID NO: 22021 - RNA, 21 nt, Homo sapiens
ugcaaacccugcaugugggag

SEQ ID NO: 22022 - RNA, 22 nt, Homo sapiens
acugggacuuuguaggccaguu

SEQ ID NO: 22023 - RNA, 22 nt, Homo sapiens
agcgggacuuugagggccaguu

SEQ ID NO: 22024 - RNA, 20 nt, Homo sapiens
gcaaugcaacagcaaugcac

SEQ ID NO: 22025 - RNA, 22 nt, Homo sapiens
ucucacccagggacaaaggauu

SEQ ID NO: 22026 - RNA, 21 nt, Homo sapiens
ucuacucagaagggugccuua

SEQ ID NO: 22027 - RNA, 22 nt, Homo sapiens
aacgcuccaaaagaaggcacuc

SEQ ID NO: 22028 - RNA, 22 nt, Homo sapiens
aacacucuaaaaggaggcacuu

SEQ ID NO: 22029 - RNA, 21 nt, Homo sapiens
agguaauaccaauaccuugug

SEQ ID NO: 22030 - RNA, 23 nt, Homo sapiens
uggcccugacacgugguacugga

SEQ ID NO: 22031 - RNA, 22 nt, Homo sapiens
cacauggccaaaacagagaaga

SEQ ID NO: 22032 - RNA, 22 nt, Homo sapiens
ugagugcuugcuaggugccaag

SEQ ID NO: 22033 - RNA, 22 nt, Homo sapiens
uguaaaccaugaugugcugcua

SEQ ID NO: 22034 - RNA, 22 nt, Homo sapiens
agcccaaaaggagaauucuuug

SEQ ID NO: 22035 - RNA, 20 nt, Homo sapiens
cccgccgcgucgcccugggg

SEQ ID NO: 22036 - RNA, 22 nt, Homo sapiens
aaucagucucauugcuuuauaa

SEQ ID NO: 22037 - RNA, 22 nt, Homo sapiens
auggcaguggaguuagugauug

SEQ ID NO: 22038 - RNA, 23 nt, Homo sapiens
gacguaguccuauucucugcugc

SEQ ID NO: 22039 - RNA, 23 nt, Homo sapiens
agcaaaaaugugcuagugccaaa

SEQ ID NO: 22040 - RNA, 22 nt, Homo sapiens
cugggggcggcacaggggcuca

SEQ ID NO: 22041 - RNA, 22 nt, Homo sapiens
ggcucccaagaaccucaccugu

SEQ ID NO: 22042 - RNA, 20 nt, Homo sapiens
gcagaagcauuuccacacac

SEQ ID NO: 22043 - RNA, 22 nt, Homo sapiens
uagcagaagcauuuccgcacac

SEQ ID NO: 22044 - RNA, 23 nt, Homo sapiens
aggaacagcagcagcccgggccg

SEQ ID NO: 22045 - RNA, 24 nt, Homo sapiens
agugugaguucuaccauugccaaa

SEQ ID NO: 22046 - RNA, 20 nt, Homo sapiens
cccgccgcgucgcccugggg

SEQ ID NO: 22047 - RNA, 22 nt, Homo sapiens
aggcauaggaugacaaagggaa

SEQ ID NO: 22048 - RNA, 22 nt, Homo sapiens
aggcgaaggaugacaaagggaa

SEQ ID NO: 22049 - RNA, 22 nt, Homo sapiens
acugccugucugugccugcugu

SEQ ID NO: 22050 - RNA, 21 nt, Homo sapiens
uucuaggauaggcccaggggc

SEQ ID NO: 22051 - RNA, 22 nt, Homo sapiens
aaucagucucauugcuuuauaa

SEQ ID NO: 22052 - RNA, 22 nt, Homo sapiens
acaaccagcuaagacacugcca

SEQ ID NO: 22053 - RNA, 23 nt, Homo sapiens
gcaaucagcuaacuacacugccu

SEQ ID NO: 22054 - RNA, 22 nt, Homo sapiens
accagguuccaccccagcaggc

SEQ ID NO: 22055 - RNA, 22 nt, Homo sapiens
accagcuaacaauacacugcca

SEQ ID NO: 22056 - RNA, 22 nt, Homo sapiens
gccagcuaacaauacacugccu

SEQ ID NO: 22057 - RNA, 23 nt, Homo sapiens
aagaaucuugucccgcagguccu

SEQ ID NO: 22058 - RNA, 18 nt, Homo sapiens
acccucugaaaggaagca

SEQ ID NO: 22059 - RNA, 22 nt, Homo sapiens
aaagugcuucuuaccuccagau

SEQ ID NO: 22060 - RNA, 22 nt, Homo sapiens
ugugggugugugcaugagcgug

SEQ ID NO: 22061 - RNA, 20 nt, Homo sapiens
cccugcgccaucuccucuac

SEQ ID NO: 22062 - RNA, 22 nt, Homo sapiens
uauccacuacaccccgcugccu

SEQ ID NO: 22063 - RNA, 22 nt, Homo sapiens
cuagggaacacagggcugguga

SEQ ID NO: 22064 - RNA, 22 nt, Homo sapiens
caaacaccauugucacacucca

SEQ ID NO: 22065 - RNA, 18 nt, Homo sapiens
ugguggcagaggugggau

SEQ ID NO: 22066 - RNA, 22 nt, Homo sapiens
ggagauggagccagggcccuaa

SEQ ID NO: 22067 - RNA, 23 nt, Homo sapiens
cggccugauucacaacaccagcu

SEQ ID NO: 22068 - RNA, 20 nt, Homo sapiens
aguacaucaucuauacugua

SEQ ID NO: 22069 - RNA, 23 nt, Homo sapiens
agggauuccugggaaaacuggac

SEQ ID NO: 22070 - RNA, 22 nt, Homo sapiens
acaacuguaacuagacgguuuu

SEQ ID NO: 22071 - RNA, 20 nt, Homo sapiens
acauuacuguuaucaaaaca

SEQ ID NO: 22072 - RNA, 23 nt, Homo sapiens
cuacuaaaacauggaagcacuua

SEQ ID NO: 22073 - RNA, 23 nt, Homo sapiens
acacucaaacauggaagcacuua

SEQ ID NO: 22074 - RNA, 22 nt, Homo sapiens
aacucaguaaugguaacgguuu

SEQ ID NO: 22075 - RNA, 22 nt, Homo sapiens
ucaguuuccucugcaaacaguu

SEQ ID NO: 22076 - RNA, 22 nt, Homo sapiens
ugcaagccuugggugugggagg

SEQ ID NO: 22077 - RNA, 21 nt, Homo sapiens
cugaaaccaaguaugggucgc

SEQ ID NO: 22078 - RNA, 21 nt, Homo sapiens
aaaacaaaaucucaccguuuu

SEQ ID NO: 22079 - RNA, 21 nt, Homo sapiens
caucaccuuccuucuccucca

SEQ ID NO: 22080 - RNA, 21 nt, Homo sapiens
ccccucccagccucccugcca

SEQ ID NO: 22081 - RNA, 22 nt, Homo sapiens
caaacaccauugucacacucca

SEQ ID NO: 22082 - RNA, 23 nt, Homo sapiens
gggagugaagacacggagccaga

SEQ ID NO: 22083 - RNA, 21 nt, Homo sapiens
gaccaaucgccguccccgccg

SEQ ID NO: 22084 - RNA, 22 nt, Homo sapiens
cggugagcacccggccccugcg

SEQ ID NO: 22085 - RNA, 24 nt, Homo sapiens
cagaaagugcuuucuuuuggagaa

SEQ ID NO: 22086 - RNA, 22 nt, Homo sapiens
aacacucuaaaaggaggcacuu

SEQ ID NO: 22087 - RNA, 21 nt, Homo sapiens
ggacuauagaacuuucccccu

SEQ ID NO: 22088 - RNA, 21 nt, Homo sapiens
aguucucccaacguaaaccca

SEQ ID NO: 22089 - RNA, 22 nt, Homo sapiens
gcggucccgcggcgccccgccu

SEQ ID NO: 22090 - RNA, 21 nt, Homo sapiens
ggggagcgggggcccugccuu

SEQ ID NO: 22091 - RNA, 21 nt, Homo sapiens
agaaguagaccauguguccua

SEQ ID NO: 22092 - RNA, 18 nt, Homo sapiens
cccccaccaccacgcccg

SEQ ID NO: 22093 - RNA, 22 nt, Homo sapiens
ggagcccgcgccccgcgccgag

SEQ ID NO: 22094 - RNA, 23 nt, Homo sapiens
gggagugaagacacggagccaga

SEQ ID NO: 22095 - RNA, 22 nt, Homo sapiens
cacugguacaaggguugggaga

SEQ ID NO: 22096 - RNA, 23 nt, Homo sapiens
aggaacagcagcagcccgggccg

SEQ ID NO: 22097 - RNA, 22 nt, Homo sapiens
agcugaguguaggauguuuaca

SEQ ID NO: 22098 - RNA, 21 nt, Homo sapiens
aagacgggaggagaggaguga

SEQ ID NO: 22099 - RNA, 25 nt, Homo sapiens
acggagcugucccaacaccaccccu

SEQ ID NO: 22100 - RNA, 22 nt, Homo sapiens
ccucaggcacggccgggccacc

SEQ ID NO: 22101 - RNA, 20 nt, Homo sapiens
aggggccucagccuccuggu

SEQ ID NO: 22102 - RNA, 23 nt, Homo sapiens
ccgcuugagcuaacuccgacccg

SEQ ID NO: 22103 - RNA, 22 nt, Homo sapiens
cacucuaaagggaggcacuuug

SEQ ID NO: 22104 - RNA, 23 nt, Homo sapiens
cuaccugcacuguaagcacuuuu

SEQ ID NO: 22105 - RNA, 19 nt, Homo sapiens
ucccugauccaaaaaucca

SEQ ID NO: 22106 - RNA, 22 nt, Homo sapiens
ucaggaacugccuuucucucca

SEQ ID NO: 22107 - RNA, 21 nt, Homo sapiens
ugcaaacccugcaugugggag

SEQ ID NO: 22108 - RNA, 22 nt, Homo sapiens
aagcgguuuaccaucccacaua

SEQ ID NO: 22109 - RNA, 22 nt, Homo sapiens
acaaccagcuaagacacugcca

SEQ ID NO: 22110 - RNA, 23 nt, Homo sapiens
aggagaaggcaccaugggauuua

SEQ ID NO: 22111 - RNA, 22 nt, Homo sapiens
uccucuuuucuuagagacucac

SEQ ID NO: 22112 - RNA, 21 nt, Homo sapiens
aagggucaguaagcacccgcg

SEQ ID NO: 22113 - RNA, 20 nt, Homo sapiens
uacugcuuccacagcucccc

SEQ ID NO: 22114 - RNA, 22 nt, Homo sapiens
gaggcucagaauggcucaggag

SEQ ID NO: 22115 - RNA, 22 nt, Homo sapiens
ggcucccaagaaccucaccugu

SEQ ID NO: 22116 - RNA, 22 nt, Homo sapiens
gcuggguggagaagguggugaa

SEQ ID NO: 22117 - RNA, 21 nt, Homo sapiens
accuauccugaauuacuugaa

SEQ ID NO: 22118 - RNA, 22 nt, Homo sapiens
cuuccagucgaggauguuuaca

SEQ ID NO: 22119 - RNA, 22 nt, Homo sapiens
agcugaguguaggauguuuaca

SEQ ID NO: 22120 - RNA, 23 nt, Homo sapiens
gcugagaguguaggauguuuaca

SEQ ID NO: 22121 - RNA, 22 nt, Homo sapiens
cuuccagucggggauguuuaca

SEQ ID NO: 22122 - RNA, 22 nt, Homo sapiens
cuuccagucaaggauguuuaca

SEQ ID NO: 22123 - RNA, 22 nt, Homo sapiens
gugauugccacucuccugagua

SEQ ID NO: 22124 - RNA, 21 nt, Homo sapiens
uugucuaaccagucaccuguu

SEQ ID NO: 22125 - RNA, 22 nt, Homo sapiens
cucagagcagacgugguucuca

SEQ ID NO: 22126 - RNA, 23 nt, Homo sapiens
accacaggagucugagcauuuga

SEQ ID NO: 22127 - RNA, 21 nt, Homo sapiens
gcaagcccagaccgcaaaaag

SEQ ID NO: 22128 - RNA, 23 nt, Homo sapiens
ucacauaggaauaaaaagccaua

SEQ ID NO: 22129 - RNA, 20 nt, Homo sapiens
uacugcuuccacagcucccc

SEQ ID NO: 22130 - RNA, 21 nt, Homo sapiens
gugacagagccaagcacaaau

SEQ ID NO: 22131 - RNA, 22 nt, Homo sapiens
agucuucacaacagcccugugu

SEQ ID NO: 22132 - RNA, 23 nt, Homo sapiens
ucucugcaggccgugugcuuugc

SEQ ID NO: 22133 - RNA, 22 nt, Homo sapiens
auaaggauuuuuaggggcauua

SEQ ID NO: 22134 - RNA, 22 nt, Homo sapiens
guagaagggaaucuugcauaag

SEQ ID NO: 22135 - RNA, 22 nt, Homo sapiens
gguaaaacucgcaauuacuuuu

SEQ ID NO: 22136 - RNA, 22 nt, Homo sapiens
ggccaaaaccacaauuacuuuu

SEQ ID NO: 22137 - RNA, 22 nt, Homo sapiens
ggcaaaaaccgcaauuacuuuu

SEQ ID NO: 22138 - RNA, 22 nt, Homo sapiens
ggcaaaaaccacaauuacuuuu

SEQ ID NO: 22139 - RNA, 22 nt, Homo sapiens
gacaaaaaccgcgauuacuuuu

SEQ ID NO: 22140 - RNA, 22 nt, Homo sapiens
ggcaaaauccgcaauuacuuuu

SEQ ID NO: 22141 - RNA, 22 nt, Homo sapiens
accaaagaccgcaauuacuuuu

SEQ ID NO: 22142 - RNA, 22 nt, Homo sapiens
aaaguaacugcaguuuuugcua

SEQ ID NO: 22143 - RNA, 21 nt, Homo sapiens
uuuuggugcauauuuacuuua

SEQ ID NO: 22144 - RNA, 23 nt, Homo sapiens
guucuguccuggaagaacauacu

SEQ ID NO: 22145 - RNA, 23 nt, Homo sapiens
acaaggaugaaucuuuguuacug

SEQ ID NO: 22146 - RNA, 22 nt, Homo sapiens
cacauggccaaaacagagaaga

SEQ ID NO: 22147 - RNA, 21 nt, Homo sapiens
cucccccacugcagcuggcac

SEQ ID NO: 22148 - RNA, 21 nt, Homo sapiens
aaaggccacauccagcaccgu

SEQ ID NO: 22149 - RNA, 17 nt, Homo sapiens
gacagccucucccccac

SEQ ID NO: 22150 - RNA, 17 nt, Homo sapiens
gggagaggaggaggcga

SEQ ID NO: 22151 - RNA, 22 nt, Homo sapiens
agcccaaaaggagaauucuuug

SEQ ID NO: 22152 - RNA, 21 nt, Homo sapiens
gugacagagccaagcacaaau

SEQ ID NO: 22153 - RNA, 23 nt, Homo sapiens
ucaccaaaacauggaagcacuua

SEQ ID NO: 22154 - RNA, 23 nt, Homo sapiens
cuacuaaaacauggaagcacuua

SEQ ID NO: 22155 - RNA, 23 nt, Homo sapiens
ccacugaaacauggaagcacuua

SEQ ID NO: 22156 - RNA, 23 nt, Homo sapiens
acacucaaacauggaagcacuua

SEQ ID NO: 22157 - RNA, 17 nt, Homo sapiens
aagcauggaagcacuua

SEQ ID NO: 22158 - RNA, 23 nt, Homo sapiens
acgcucaaaugucgcagcacuuu

SEQ ID NO: 22159 - RNA, 23 nt, Homo sapiens
acaccccaaaaucgaagcacuuc

SEQ ID NO: 22160 - RNA, 22 nt, Homo sapiens
gaccucagcuaugacagcacuu

SEQ ID NO: 22161 - RNA, 22 nt, Homo sapiens
acaguccaaagggaagcacuuu

SEQ ID NO: 22162 - RNA, 21 nt, Homo sapiens
cccucuaaaaggaagcacuuu

SEQ ID NO: 22163 - RNA, 22 nt, Homo sapiens
acccucuaaaaggaagcacuuu

SEQ ID NO: 22164 - RNA, 22 nt, Homo sapiens
acccaccaaagagaagcacuuu

SEQ ID NO: 22165 - RNA, 21 nt, Homo sapiens
cccucaaaaaggaagcacuuu

SEQ ID NO: 22166 - RNA, 22 nt, Homo sapiens
acaucaucgcauauugacacaa

SEQ ID NO: 22167 - RNA, 22 nt, Homo sapiens
acaguggucaucgagugacaca

SEQ ID NO: 22168 - RNA, 20 nt, Homo sapiens
guuugauaaacugacacaac

SEQ ID NO: 22169 - RNA, 21 nt, Homo sapiens
gcugaggucugggccaggucu

SEQ ID NO: 22170 - RNA, 21 nt, Homo sapiens
gagcugcauccuggcuccggg

SEQ ID NO: 22171 - RNA, 23 nt, Homo sapiens
gggagugaagacacggagccaga

SEQ ID NO: 22172 - RNA, 22 nt, Homo sapiens
gaauucaucacggccagccucu

SEQ ID NO: 22173 - RNA, 19 nt, Homo sapiens
guccugaauuccgcagccu

SEQ ID NO: 22174 - RNA, 22 nt, Homo sapiens
gcugaggcuguggggcuggagu

SEQ ID NO: 22175 - RNA, 22 nt, Homo sapiens
ggcagagagucagagcgcggau

SEQ ID NO: 22176 - RNA, 24 nt, Homo sapiens
cacccccagagccucagcucccca

SEQ ID NO: 22177 - RNA, 22 nt, Homo sapiens
auacauacuucuuuacauucca

SEQ ID NO: 22178 - RNA, 23 nt, Homo sapiens
gucacaucccucccaagacccuc

SEQ ID NO: 22179 - RNA, 21 nt, Homo sapiens
cugaggagagaggaggugggg

SEQ ID NO: 22180 - RNA, 22 nt, Homo sapiens
gcacaaaucuccagaccaccca

SEQ ID NO: 22181 - RNA, 22 nt, Homo sapiens
cacaaaccauuaugugcugcua

SEQ ID NO: 22182 - RNA, 22 nt, Homo sapiens
uguaaaccaugaugugcugcua

SEQ ID NO: 22183 - RNA, 22 nt, Homo sapiens
cgccaauauuuacgugcugcua

SEQ ID NO: 22184 - RNA, 22 nt, Homo sapiens
ucaguuuccucugcaaacaguu

SEQ ID NO: 22185 - RNA, 22 nt, Homo sapiens
ucaguuuccucugcaaacaguu

SEQ ID NO: 22186 - RNA, 21 nt, Homo sapiens
gccaauauuucugugcugcua

SEQ ID NO: 22187 - RNA, 21 nt, Homo sapiens
gccaauauuucugugcugcua

SEQ ID NO: 22188 - RNA, 21 nt, Homo sapiens
gccaauauuucugugcugcua

SEQ ID NO: 22189 - RNA, 22 nt, Homo sapiens
ccacacacuuccuuacauucca

SEQ ID NO: 22190 - RNA, 21 nt, Homo sapiens
aagugucagacacgguggugg

SEQ ID NO: 22191 - RNA, 22 nt, Homo sapiens
uaaccgauuucagauggugcua

SEQ ID NO: 22192 - RNA, 23 nt, Homo sapiens
aacacugauuucaaauggugcua

SEQ ID NO: 22193 - RNA, 22 nt, Homo sapiens
uaaccgauuucaaauggugcua

SEQ ID NO: 22194 - RNA, 21 nt, Homo sapiens
aucugcacugucagcacuuua

SEQ ID NO: 22195 - RNA, 23 nt, Homo sapiens
gcuuugacaauaucauugcacug

SEQ ID NO: 22196 - RNA, 22 nt, Homo sapiens
acaaccagcuaagacacugcca

SEQ ID NO: 22197 - RNA, 22 nt, Homo sapiens
aagauguggaccauauuacaua

SEQ ID NO: 22198 - RNA, 22 nt, Homo sapiens
uucaaaacaugaauugcugcug

SEQ ID NO: 22199 - RNA, 21 nt, Homo sapiens
acaaaccacagugugcugcug

SEQ ID NO: 22200 - RNA, 21 nt, Homo sapiens
cucacucagauggccaacuca

SEQ ID NO: 22201 - RNA, 25 nt, Homo sapiens
acggagcugucccaacaccaccccu

SEQ ID NO: 22202 - RNA, 20 nt, Homo sapiens
ggcaaagaaggaacauuccu

SEQ ID NO: 22203 - RNA, 23 nt, Homo sapiens
acucagaaggacaaguagaguuu

SEQ ID NO: 22204 - RNA, 19 nt, Homo sapiens
aagacauuuucagacagcu

SEQ ID NO: 22205 - RNA, 20 nt, Homo sapiens
uacugcuuccacagcucccc

SEQ ID NO: 22206 - RNA, 22 nt, Homo sapiens
cugcgauuccucccucuacugu

SEQ ID NO: 22207 - RNA, 22 nt, Homo sapiens
aacuauacaaccuacuaccuca

SEQ ID NO: 22208 - RNA, 22 nt, Homo sapiens
aaccacacaaccuacuaccuca

SEQ ID NO: 22209 - RNA, 22 nt, Homo sapiens
aaccauacaaccuacuaccuca

SEQ ID NO: 22210 - RNA, 22 nt, Homo sapiens
aacuaugcaaccuacuaccucu

SEQ ID NO: 22211 - RNA, 22 nt, Homo sapiens
aacuauacaaccuccuaccuca

SEQ ID NO: 22212 - RNA, 22 nt, Homo sapiens
aacuauacaaucuacuaccuca

SEQ ID NO: 22213 - RNA, 22 nt, Homo sapiens
aacuguacaaacuacuaccuca

SEQ ID NO: 22214 - RNA, 22 nt, Homo sapiens
aacagcacaaacuacuaccuca

SEQ ID NO: 22215 - RNA, 21 nt, Homo sapiens
ccccucccagccucccugcca

SEQ ID NO: 22216 - RNA, 18 nt, Homo sapiens
cccccaccaccacgcccg

SEQ ID NO: 22217 - RNA, 22 nt, Homo sapiens
aggucucacuuuguugcccaga

SEQ ID NO: 22218 - RNA, 19 nt, Homo sapiens
ucccugauccaaaaaucca

SEQ ID NO: 22219 - RNA, 22 nt, Homo sapiens
uccacauggaguugcuguuaca

SEQ ID NO: 22220 - RNA, 21 nt, Homo sapiens
ucaaucacagauagcaccccu

SEQ ID NO: 22221 - RNA, 22 nt, Homo sapiens
gagcccuggacuaggagucagc

SEQ ID NO: 22222 - RNA, 22 nt, Homo sapiens
auaaggauuuuuaggggcauua

SEQ ID NO: 22223 - RNA, 25 nt, Homo sapiens
acggagcugucccaacaccaccccu

SEQ ID NO: 22224 - RNA, 25 nt, Homo sapiens
aaggagcucagaagcccugcccagc

SEQ ID NO: 22225 - RNA, 21 nt, Homo sapiens
aguucucccaacguaaaccca

SEQ ID NO: 22226 - RNA, 20 nt, Homo sapiens
uacugcuuccacagcucccc

SEQ ID NO: 22227 - RNA, 21 nt, Homo sapiens
ggggagcgggggcccugccuu

SEQ ID NO: 22228 - RNA, 22 nt, Homo sapiens
aacaauacaacuuacuaccuca

SEQ ID NO: 22229 - RNA, 22 nt, Homo sapiens
gugggguggguggucaggccga

SEQ ID NO: 22230 - RNA, 24 nt, Homo sapiens
acugcaggcuccagcuuccaggcu

SEQ ID NO: 22231 - RNA, 18 nt, Homo sapiens
uggcgccugaacagggac

SEQ ID NO: 22232 - RNA, 17 nt, Homo sapiens
gacagccucucccccac

SEQ ID NO: 22233 - RNA, 20 nt, Homo sapiens
ugucuccacagggcucuuua

SEQ ID NO: 22234 - RNA, 22 nt, Homo sapiens
augcccuuucaucauugcacug

SEQ ID NO: 22235 - RNA, 18 nt, Homo sapiens
aucacauucaccucccug

SEQ ID NO: 22236 - RNA, 18 nt, Homo sapiens
auucaaucuacugccuca

SEQ ID NO: 22237 - RNA, 23 nt, Homo sapiens
ucaguuuugcauagauuugcaca

SEQ ID NO: 22238 - RNA, 22 nt, Homo sapiens
cacucagcaccaggauauuguu

SEQ ID NO: 22239 - RNA, 22 nt, Homo sapiens
aacuaugcaaccuacuaccucu

SEQ ID NO: 22240 - RNA, 23 nt, Homo sapiens
cgugagcuccuggaggacaggga

SEQ ID NO: 22241 - RNA, 21 nt, Homo sapiens
cccgaggagccgggcaggcuu

SEQ ID NO: 22242 - RNA, 21 nt, Homo sapiens
guccugagagcgcugccuccu

SEQ ID NO: 22243 - RNA, 23 nt, Homo sapiens
cuccagccccuccagggcuuccu

SEQ ID NO: 22244 - RNA, 24 nt, Homo sapiens
cacccccagagccucagcucccca

SEQ ID NO: 22245 - RNA, 18 nt, Homo sapiens
gaaaugagggccagcuga

SEQ ID NO: 22246 - RNA, 18 nt, Homo sapiens
gaaaugagggccagcuga

SEQ ID NO: 22247 - RNA, 22 nt, Homo sapiens
cuagggaacacagggcugguga

SEQ ID NO: 22248 - RNA, 24 nt, Homo sapiens
ucacagguuaaagggucucaggga

SEQ ID NO: 22249 - RNA, 22 nt, Homo sapiens
ucacaaguuagggucucaggga

SEQ ID NO: 22250 - RNA, 23 nt, Homo sapiens
agcccuguucuacagcccugagg

SEQ ID NO: 22251 - RNA, 23 nt, Homo sapiens
cggccugauucacaacaccagcu

SEQ ID NO: 22252 - RNA, 22 nt, Homo sapiens
cacucagcggccguuuccccaa

SEQ ID NO: 22253 - RNA, 21 nt, Homo sapiens
ggaaaucccuggcaaugugau

SEQ ID NO: 22254 - RNA, 21 nt, Homo sapiens
gguaaucccuggcaaugugau

SEQ ID NO: 22255 - RNA, 23 nt, Homo sapiens
aaaucagaaucacaccuggggga

SEQ ID NO: 22256 - RNA, 22 nt, Homo sapiens
aucgggaggggacugagccuga

SEQ ID NO: 22257 - RNA, 22 nt, Homo sapiens
ccucauggaaggguuccccacu

SEQ ID NO: 22258 - RNA, 24 nt, Homo sapiens
acacucuaaagggaagcacuuugu

SEQ ID NO: 22259 - RNA, 22 nt, Homo sapiens
acucuaaagggaagcacuuugu

SEQ ID NO: 22260 - RNA, 25 nt, Homo sapiens
acggagcugucccaacaccaccccu

SEQ ID NO: 22261 - RNA, 23 nt, Homo sapiens
acccaacagccccugcaagggau

SEQ ID NO: 22262 - RNA, 24 nt, Homo sapiens
acgcagagcccgaaagcccccagu

SEQ ID NO: 22263 - RNA, 24 nt, Homo sapiens
acgcgcaggccagagacccaggca

SEQ ID NO: 22264 - RNA, 22 nt, Homo sapiens
gcugaggcuguggggcuggagu

SEQ ID NO: 22265 - RNA, 20 nt, Homo sapiens
uacugcuuccacagcucccc

SEQ ID NO: 22266 - RNA, 27 nt, Homo sapiens
ugcccacucucaccaucaccuacagug

SEQ ID NO: 22267 - RNA, 18 nt, Homo sapiens
gaaaugagggccagcuga

SEQ ID NO: 22268 - RNA, 17 nt, Homo sapiens
gacagccucucccccac

SEQ ID NO: 22269 - RNA, 22 nt, Homo sapiens
cuggagacacgugcacuguaga

SEQ ID NO: 22270 - RNA, 22 nt, Homo sapiens
ucaggaacugccuuucucucca

SEQ ID NO: 22271 - RNA, 23 nt, Homo sapiens
aaaucagaaucacaccuggggga

SEQ ID NO: 22272 - RNA, 21 nt, Homo sapiens
ggacuauagaacuuucccccu

SEQ ID NO: 22273 - RNA, 24 nt, Homo sapiens
acgcagagcccgaaagcccccagu

SEQ ID NO: 22274 - RNA, 22 nt, Homo sapiens
caagacacauuuggagagggac

SEQ ID NO: 22275 - RNA, 20 nt, Homo sapiens
cccugcgccaucuccucuac

SEQ ID NO: 22276 - RNA, 22 nt, Homo sapiens
cacauggccaaaacagagaaga

SEQ ID NO: 22277 - RNA, 22 nt, Homo sapiens
gaggcucagaauggcucaggag

SEQ ID NO: 22278 - RNA, 21 nt, Homo sapiens
ccccucccagccucccugcca

SEQ ID NO: 22279 - RNA, 22 nt, Homo sapiens
cagcugguugaaggggaccaaa

SEQ ID NO: 22280 - RNA, 22 nt, Homo sapiens
ggaucccugggaccauaccuag

SEQ ID NO: 22281 - RNA, 23 nt, Homo sapiens
ucucacccagguagcaaggauua

SEQ ID NO: 22282 - RNA, 22 nt, Homo sapiens
auaaaugacaccuccuugugaa

SEQ ID NO: 22283 - RNA, 22 nt, Homo sapiens
uuucaguuaucaaucugucaca

SEQ ID NO: 22284 - RNA, 22 nt, Homo sapiens
guccaaaguuggggugcugguu

SEQ ID NO: 22285 - RNA, 21 nt, Homo sapiens
gaaggaagugagugcagccac

SEQ ID NO: 22286 - RNA, 21 nt, Homo sapiens
ggggagcgggggcccugccuu

SEQ ID NO: 22287 - RNA, 22 nt, Homo sapiens
cgaaggcaacacggauaaccua

SEQ ID NO: 22288 - RNA, 21 nt, Homo sapiens
caugcacaugcacacauacau

SEQ ID NO: 22289 - RNA, 23 nt, Homo sapiens
ucucugcaggccgugugcuuugc

SEQ ID NO: 22290 - RNA, 21 nt, Homo sapiens
acaggccaucuguguuauauu

SEQ ID NO: 22291 - RNA, 23 nt, Homo sapiens
cacugugggcccucuccgcacca

SEQ ID NO: 22292 - RNA, 20 nt, Homo sapiens
uccgccugucugaacaguga

SEQ ID NO: 22293 - RNA, 21 nt, Homo sapiens
ggucagaacccaucauucacu

SEQ ID NO: 22294 - RNA, 22 nt, Homo sapiens
cgcauuauuacucacgguacga

SEQ ID NO: 22295 - RNA, 21 nt, Homo sapiens
ccgugguucuacccuguggua

SEQ ID NO: 22296 - RNA, 21 nt, Homo sapiens
uagaaaggcuaggaccaaacc

SEQ ID NO: 22297 - RNA, 23 nt, Homo sapiens
aauaaauuaaauuuauauuacag

SEQ ID NO: 22298 - RNA, 23 nt, Homo sapiens
cuacuaaaacauggaagcacuua

SEQ ID NO: 22299 - RNA, 23 nt, Homo sapiens
acacucaaacauggaagcacuua

SEQ ID NO: 22300 - RNA, 22 nt, Homo sapiens
ucaguuuccucugcaaacaguu

SEQ ID NO: 22301 - RNA, 21 nt, Homo sapiens
acuagcuuauacauaaaauua

SEQ ID NO: 22302 - RNA, 23 nt, Homo sapiens
gagcaaggcucuugucuguaagu

SEQ ID NO: 22303 - RNA, 23 nt, Homo sapiens
acaacaaaaucacuagucuucca

SEQ ID NO: 22304 - RNA, 18 nt, Homo sapiens
gaaaugagggccagcuga

SEQ ID NO: 22305 - RNA, 18 nt, Homo sapiens
gaaaugagggccagcuga

SEQ ID NO: 22306 - RNA, 17 nt, Homo sapiens
gggagaggaggaggcga

SEQ ID NO: 22307 - RNA, 22 nt, Homo sapiens
aggucucacuuuguugcccaga

SEQ ID NO: 22308 - RNA, 22 nt, Homo sapiens
aggucucacuuuguugcccaga

SEQ ID NO: 22309 - RNA, 21 nt, Homo sapiens
cggggugcacgggcggagggc

SEQ ID NO: 22310 - RNA, 23 nt, Homo sapiens
gggagugaagacacggagccaga

SEQ ID NO: 22311 - RNA, 25 nt, Homo sapiens
agcuagucaagcgcgguuguggggg

SEQ ID NO: 22312 - RNA, 20 nt, Homo sapiens
acagcaaggagggcaggagg

SEQ ID NO: 22313 - RNA, 22 nt, Homo sapiens
ucagaccgagacaagugcaaug

SEQ ID NO: 22314 - RNA, 21 nt, Homo sapiens
aagacgggaggagaggaguga

SEQ ID NO: 22315 - RNA, 22 nt, Homo sapiens
gaauucaucacggccagccucu

SEQ ID NO: 22316 - RNA, 22 nt, Homo sapiens
aggaaaccagcaaguguugacg

SEQ ID NO: 22317 - RNA, 19 nt, Homo sapiens
guccugaauuccgcagccu

SEQ ID NO: 22318 - RNA, 25 nt, Homo sapiens
aaggagcucagaagcccugcccagc

SEQ ID NO: 22319 - RNA, 25 nt, Homo sapiens
aaggagcucagaagcccugcccagc

SEQ ID NO: 22320 - RNA, 21 nt, Homo sapiens
ggacuauagaacuuucccccu

SEQ ID NO: 22321 - RNA, 25 nt, Homo sapiens
accaacggaccuacuucccuccgcc

SEQ ID NO: 22322 - RNA, 20 nt, Homo sapiens
aggggccucagccuccuggu

SEQ ID NO: 22323 - RNA, 22 nt, Homo sapiens
gcugaggcuguggggcuggagu

SEQ ID NO: 22324 - RNA, 22 nt, Homo sapiens
gcugaggcuguggggcuggagu

SEQ ID NO: 22325 - RNA, 23 nt, Homo sapiens
agggauuccugggaaaacuggac

SEQ ID NO: 22326 - RNA, 22 nt, Homo sapiens
agugaauucuaccagugccaua

SEQ ID NO: 22327 - RNA, 24 nt, Homo sapiens
ugggagaaccucccugcuucugcu

SEQ ID NO: 22328 - RNA, 23 nt, Homo sapiens
acauuuuucguuauugcucuuga

SEQ ID NO: 22329 - RNA, 22 nt, Homo sapiens
ucaguuuccucugcaaacaguu

SEQ ID NO: 22330 - RNA, 22 nt, Homo sapiens
auaaacgacaccuccuugagaa

SEQ ID NO: 22331 - RNA, 23 nt, Homo sapiens
gaaagugcuucuuuccucgagaa

SEQ ID NO: 22332 - RNA, 23 nt, Homo sapiens
acagaaagugcuucccucaagag

SEQ ID NO: 22333 - RNA, 22 nt, Homo sapiens
uauccacuacaccccgcugccu

SEQ ID NO: 22334 - RNA, 22 nt, Homo sapiens
cacucuaaagggaggcacuuug

SEQ ID NO: 22335 - RNA, 17 nt, Homo sapiens
gggagaggaggaggcga

SEQ ID NO: 22336 - RNA, 22 nt, Homo sapiens
aggucucacuuuguugcccaga

SEQ ID NO: 22337 - RNA, 21 nt, Homo sapiens
gaccaaucgccguccccgccg

SEQ ID NO: 22338 - RNA, 21 nt, Homo sapiens
gaccaaucgccguccccgccg

SEQ ID NO: 22339 - RNA, 22 nt, Homo sapiens
cagaagugggccgggcacaggg

SEQ ID NO: 22340 - RNA, 22 nt, Homo sapiens
ucaucucgcccgcaaagaccca

SEQ ID NO: 22341 - RNA, 22 nt, Homo sapiens
agcgggacuuugagggccaguu

SEQ ID NO: 22342 - RNA, 22 nt, Homo sapiens
ucagaccgagacaagugcaaug

SEQ ID NO: 22343 - RNA, 22 nt, Homo sapiens
agcugaguguaggauguuuaca

SEQ ID NO: 22344 - RNA, 21 nt, Homo sapiens
agcuaugccagcaucuugccu

SEQ ID NO: 22345 - RNA, 20 nt, Homo sapiens
cuggaggaagggcccagagg

SEQ ID NO: 22346 - RNA, 22 nt, Homo sapiens
gccuaagacacaggcccagaga

SEQ ID NO: 22347 - RNA, 21 nt, Homo sapiens
ugcaugacggccugcaagaca

SEQ ID NO: 22348 - RNA, 22 nt, Homo sapiens
aucgggaggggacugagccuga

SEQ ID NO: 22349 - RNA, 25 nt, Homo sapiens
aaggagcucagaagcccugcccagc

SEQ ID NO: 22350 - RNA, 22 nt, Homo sapiens
gcggucccgcggcgccccgccu

SEQ ID NO: 22351 - RNA, 22 nt, Homo sapiens
gcggucccgcggcgccccgccu

SEQ ID NO: 22352 - RNA, 20 nt, Homo sapiens
aggggccucagccuccuggu

SEQ ID NO: 22353 - RNA, 22 nt, Homo sapiens
ugcuguuagcccuagccccgca

SEQ ID NO: 22354 - RNA, 22 nt, Homo sapiens
auacauacuucuuuacauucca

SEQ ID NO: 22355 - RNA, 23 nt, Homo sapiens
ggaagccaucaagucgcugcagg

SEQ ID NO: 22356 - RNA, 23 nt, Homo sapiens
ggaagccaucaagucgcugcagg

SEQ ID NO: 22357 - RNA, 22 nt, Homo sapiens
augcccuuuuaacauugcacug

SEQ ID NO: 22358 - RNA, 22 nt, Homo sapiens
ccaucuuuaccagacaguguua

SEQ ID NO: 22359 - RNA, 22 nt, Homo sapiens
uggcagcagcggagggggcaga

SEQ ID NO: 22360 - RNA, 23 nt, Homo sapiens
gaacagguagucugaacacuggg

SEQ ID NO: 22361 - RNA, 23 nt, Homo sapiens
gaacagauagucuaaacacuggg

SEQ ID NO: 22362 - RNA, 22 nt, Homo sapiens
acaucguuaccagacaguguua

SEQ ID NO: 22363 - RNA, 22 nt, Homo sapiens
ccacacacuuccuuacauucca

SEQ ID NO: 22364 - RNA, 21 nt, Homo sapiens
ggaaaucccuggcaaugugau

SEQ ID NO: 22365 - RNA, 21 nt, Homo sapiens
gguaaucccuggcaaugugau

SEQ ID NO: 22366 - RNA, 21 nt, Homo sapiens
aucugcacugucagcacuuua

SEQ ID NO: 22367 - RNA, 23 nt, Homo sapiens
gcuuugacaauaucauugcacug

SEQ ID NO: 22368 - RNA, 20 nt, Homo sapiens
ccagcagcaccuggggcagu

SEQ ID NO: 22369 - RNA, 21 nt, Homo sapiens
auccuguacugagcugccccg

SEQ ID NO: 22370 - RNA, 22 nt, Homo sapiens
gcacacaauaaauguuugcuga

SEQ ID NO: 22371 - RNA, 20 nt, Homo sapiens
ggcaaagaaggaacauuccu

SEQ ID NO: 22372 - RNA, 24 nt, Homo sapiens
acgcgcaggccagagacccaggca

SEQ ID NO: 22373 - RNA, 22 nt, Homo sapiens
gcugaggcuguggggcuggagu

SEQ ID NO: 22374 - RNA, 26 nt, Homo sapiens
uuucagaauuugcugccaucaucauc

SEQ ID NO: 22375 - RNA, 22 nt, Homo sapiens
aucagagcccucugagcuucag

SEQ ID NO: 22376 - RNA, 18 nt, Homo sapiens
cagcagccuccuucucaa

SEQ ID NO: 22377 - RNA, 18 nt, Homo sapiens
cagcagccuccuucucaa

SEQ ID NO: 22378 - RNA, 24 nt, Homo sapiens
gaagucacucccaggcagcugcaa

SEQ ID NO: 22379 - RNA, 22 nt, Homo sapiens
cacaucucacuguagccucaaa

SEQ ID NO: 22380 - RNA, 22 nt, Homo sapiens
augcccuuucaucauugcacug

SEQ ID NO: 22381 - RNA, 21 nt, Homo sapiens
ugacugcagagcaaaagacac

SEQ ID NO: 22382 - RNA, 20 nt, Homo sapiens
gaaagggcuucccuuugcag

SEQ ID NO: 22383 - RNA, 24 nt, Homo sapiens
acacucuaaagggaagcacuuugu

SEQ ID NO: 22384 - RNA, 22 nt, Homo sapiens
acucuaaagggaagcacuuugu

SEQ ID NO: 22385 - RNA, 23 nt, Homo sapiens
acagaaagugcuucccucaagag

SEQ ID NO: 22386 - RNA, 20 nt, Homo sapiens
gaaagggcuucccuuugcag

SEQ ID NO: 22387 - RNA, 20 nt, Homo sapiens
agagaugagagaaacacccu

SEQ ID NO: 22388 - RNA, 21 nt, Homo sapiens
ccccucccagccucccugcca

SEQ ID NO: 22389 - RNA, 22 nt, Homo sapiens
caaacaccauugucacacucca

SEQ ID NO: 22390 - RNA, 22 nt, Homo sapiens
gugggguggguggucaggccga

SEQ ID NO: 22391 - RNA, 24 nt, Homo sapiens
acugcuggucuucagucagggcca

SEQ ID NO: 22392 - RNA, 23 nt, Homo sapiens
gggagugaagacacggagccaga

SEQ ID NO: 22393 - RNA, 22 nt, Homo sapiens
ucaggaacugccuuucucucca

SEQ ID NO: 22394 - RNA, 21 nt, Homo sapiens
gaccaaucgccguccccgccg

SEQ ID NO: 22395 - RNA, 22 nt, Homo sapiens
cggugagcacccggccccugcg

SEQ ID NO: 22396 - RNA, 22 nt, Homo sapiens
uggcagcagcggagggggcaga

SEQ ID NO: 22397 - RNA, 20 nt, Homo sapiens
ccagcagcaccuggggcagu

SEQ ID NO: 22398 - RNA, 22 nt, Homo sapiens
acaaccagcuaagacacugcca

SEQ ID NO: 22399 - RNA, 23 nt, Homo sapiens
gcaaucagcuaacuacacugccu

SEQ ID NO: 22400 - RNA, 23 nt, Homo sapiens
aaaucagaaucacaccuggggga

SEQ ID NO: 22401 - RNA, 21 nt, Homo sapiens
acaggccaucuguguuauauu

SEQ ID NO: 22402 - RNA, 22 nt, Homo sapiens
accagcuaacaauacacugcca

SEQ ID NO: 22403 - RNA, 22 nt, Homo sapiens
gccagcuaacaauacacugccu

SEQ ID NO: 22404 - RNA, 21 nt, Homo sapiens
auccuguacugagcugccccg

SEQ ID NO: 22405 - RNA, 23 nt, Homo sapiens
acacacucacacacacacacuca

SEQ ID NO: 22406 - RNA, 24 nt, Homo sapiens
acgcagagcccgaaagcccccagu

SEQ ID NO: 22407 - RNA, 24 nt, Homo sapiens
acgcgcaggccagagacccaggca

SEQ ID NO: 22408 - RNA, 22 nt, Homo sapiens
gcggucccgcggcgccccgccu

SEQ ID NO: 22409 - RNA, 22 nt, Homo sapiens
augcccuuucaucauugcacug

SEQ ID NO: 22410 - RNA, 21 nt, Homo sapiens
ccucaaggagcuucagucuag

SEQ ID NO: 22411 - RNA, 22 nt, Homo sapiens
cagaaagugcuucccucuagag

SEQ ID NO: 22412 - RNA, 22 nt, Homo sapiens
acugggacuuuguaggccaguu

SEQ ID NO: 22413 - RNA, 22 nt, Homo sapiens
agcgggacuuugagggccaguu

SEQ ID NO: 22414 - RNA, 22 nt, Homo sapiens
uccacauggaguugcuguuaca

SEQ ID NO: 22415 - RNA, 20 nt, Homo sapiens
acagcaaggagggcaggagg

SEQ ID NO: 22416 - RNA, 22 nt, Homo sapiens
uagucaagugaagcagugggag

SEQ ID NO: 22417 - RNA, 22 nt, Homo sapiens
cacucagcggccguuuccccaa

SEQ ID NO: 22418 - RNA, 22 nt, Homo sapiens
uccaggagcucacaaucuagug

SEQ ID NO: 22419 - RNA, 22 nt, Homo sapiens
agcugaguguaggauguuuaca

SEQ ID NO: 22420 - RNA, 22 nt, Homo sapiens
agccacaaucaccuucugaucu

SEQ ID NO: 22421 - RNA, 20 nt, Homo sapiens
uaugaacaauuucuaggaau

SEQ ID NO: 22422 - RNA, 22 nt, Homo sapiens
ccucauggaaggguuccccacu

SEQ ID NO: 22423 - RNA, 22 nt, Homo sapiens
acacucuaaaaggaugcacuuu

SEQ ID NO: 22424 - RNA, 22 nt, Homo sapiens
aaccucuaaaaggaugcacuuu

SEQ ID NO: 22425 - RNA, 22 nt, Homo sapiens
auccucuaaaaagaugcacuuu

SEQ ID NO: 22426 - RNA, 22 nt, Homo sapiens
ugcaagccuugggugugggagg

SEQ ID NO: 22427 - RNA, 22 nt, Homo sapiens
gguaaaacucgcaauuacuuuu

SEQ ID NO: 22428 - RNA, 22 nt, Homo sapiens
ggccaaaaccacaauuacuuuu

SEQ ID NO: 22429 - RNA, 22 nt, Homo sapiens
ggcaaaaaccgcaauuacuuuu

SEQ ID NO: 22430 - RNA, 22 nt, Homo sapiens
ggcaaaaaccacaauuacuuuu

SEQ ID NO: 22431 - RNA, 22 nt, Homo sapiens
gacaaaaaccgcgauuacuuuu

SEQ ID NO: 22432 - RNA, 22 nt, Homo sapiens
ggcaaaauccgcaauuacuuuu

SEQ ID NO: 22433 - RNA, 22 nt, Homo sapiens
accaaagaccgcaauuacuuuu

SEQ ID NO: 22434 - RNA, 21 nt, Homo sapiens
uuuuggugcauauuuacuuua

SEQ ID NO: 22435 - RNA, 21 nt, Homo sapiens
guaaugggaccuuccucuuug

SEQ ID NO: 22436 - RNA, 25 nt, Homo sapiens
acggagcugucccaacaccaccccu

SEQ ID NO: 22437 - RNA, 21 nt, Homo sapiens
guccugagagcgcugccuccu

SEQ ID NO: 22438 - RNA, 20 nt, Homo sapiens
uacugcuuccacagcucccc

SEQ ID NO: 22439 - RNA, 22 nt, Homo sapiens
gggagaggucucccugcgcaca

SEQ ID NO: 22440 - RNA, 22 nt, Homo sapiens
cacauggccaaaacagagaaga

SEQ ID NO: 22441 - RNA, 21 nt, Homo sapiens
ccccucccagccucccugcca

SEQ ID NO: 22442 - RNA, 23 nt, Homo sapiens
gggagugaagacacggagccaga

SEQ ID NO: 22443 - RNA, 21 nt, Homo sapiens
gaccaaucgccguccccgccg

SEQ ID NO: 22444 - RNA, 22 nt, Homo sapiens
cggugagcacccggccccugcg

SEQ ID NO: 22445 - RNA, 20 nt, Homo sapiens
cccgccgcgucgcccugggg

SEQ ID NO: 22446 - RNA, 22 nt, Homo sapiens
agcgggacuuugagggccaguu

SEQ ID NO: 22447 - RNA, 20 nt, Homo sapiens
acauuacuguuaucaaaaca

SEQ ID NO: 22448 - RNA, 23 nt, Homo sapiens
aaaucagaaucacaccuggggga

SEQ ID NO: 22449 - RNA, 18 nt, Homo sapiens
acccucugaaaggaagca

SEQ ID NO: 22450 - RNA, 22 nt, Homo sapiens
aaagugcuucuuaccuccagau

SEQ ID NO: 22451 - RNA, 21 nt, Homo sapiens
uggaaaccaagagugggucgc

SEQ ID NO: 22452 - RNA, 21 nt, Homo sapiens
cugaaaccaaguaugggucgc

SEQ ID NO: 22453 - RNA, 24 nt, Homo sapiens
acgcagagcccgaaagcccccagu

SEQ ID NO: 22454 - RNA, 22 nt, Homo sapiens
gcggucccgcggcgccccgccu

SEQ ID NO: 22455 - RNA, 23 nt, Homo sapiens
ccgcuugagcuaacuccgacccg

SEQ ID NO: 22456 - RNA, 20 nt, Homo sapiens
uacugcuuccacagcucccc

SEQ ID NO: 22457 - RNA, 23 nt, Homo sapiens
ucauagcccuguacaaugcugcu

SEQ ID NO: 22458 - RNA, 23 nt, Homo sapiens
ugauagcccuguacaaugcugcu

SEQ ID NO: 22459 - RNA, 23 nt, Homo sapiens
gggagugaagacacggagccaga

SEQ ID NO: 22460 - RNA, 22 nt, Homo sapiens
cacaaaccauuaugugcugcua

SEQ ID NO: 22461 - RNA, 22 nt, Homo sapiens
uguaaaccaugaugugcugcua

SEQ ID NO: 22462 - RNA, 22 nt, Homo sapiens
cgccaauauuuacgugcugcua

SEQ ID NO: 22463 - RNA, 22 nt, Homo sapiens
uucacacugcaugcucugggua

SEQ ID NO: 22464 - RNA, 22 nt, Homo sapiens
uggcagcagcggagggggcaga

SEQ ID NO: 22465 - RNA, 23 nt, Homo sapiens
cagcugcuuuugggauuccguug

SEQ ID NO: 22466 - RNA, 21 nt, Homo sapiens
gccaauauuucugugcugcua

SEQ ID NO: 22467 - RNA, 20 nt, Homo sapiens
ccagcagcaccuggggcagu

SEQ ID NO: 22468 - RNA, 22 nt, Homo sapiens
uacagauggauaccgugcaauu

SEQ ID NO: 22469 - RNA, 22 nt, Homo sapiens
uucaaaacaugaauugcugcug

SEQ ID NO: 22470 - RNA, 22 nt, Homo sapiens
gaauucaucacggccagccucu

SEQ ID NO: 22471 - RNA, 21 nt, Homo sapiens
auccuguacugagcugccccg

SEQ ID NO: 22472 - RNA, 21 nt, Homo sapiens
acaaaccacagugugcugcug

SEQ ID NO: 22473 - RNA, 25 nt, Homo sapiens
acggagcugucccaacaccaccccu

SEQ ID NO: 22474 - RNA, 21 nt, Homo sapiens
guccugagagcgcugccuccu

SEQ ID NO: 22475 - RNA, 23 nt, Homo sapiens
agaaaccaugggguaugagcaga

SEQ ID NO: 22476 - RNA, 22 nt, Homo sapiens
cacucuaaagggaggcacuuug

SEQ ID NO: 22477 - RNA, 23 nt, Homo sapiens
gcgguagcggaagcgguaacugg

SEQ ID NO: 22478 - RNA, 23 nt, Homo sapiens
cuaccugcacuguaagcacuuuu

SEQ ID NO: 22479 - RNA, 26 nt, Homo sapiens
aaccaucucauacaaaccaacuacuu

SEQ ID NO: 22480 - RNA, 27 nt, Homo sapiens
auugcguucgaagugucgaugaucaau

SEQ ID NO: 22481 - RNA, 22 nt, Homo sapiens
cgaauccaccacgaacaacuuc

SEQ ID NO: 22482 - RNA, 22 nt, Homo sapiens
uauucaggaacauauugcaaaa

SEQ ID NO: 22483 - RNA, 20 nt, Homo sapiens
gaaagggcuucccuuugcag

SEQ ID NO: 22484 - RNA, 20 nt, Homo sapiens
gaaagggcuucccuuugcag

SEQ ID NO: 22485 - RNA, 21 nt, Homo sapiens
aucuuugauuuucaguaguuu

SEQ ID NO: 22486 - RNA, 22 nt, Homo sapiens
gguuaguggaccaggucacaaa

SEQ ID NO: 22487 - RNA, 23 nt, Homo sapiens
aaucuacuuucuuugcucauccu

SEQ ID NO: 22488 - RNA, 22 nt, Homo sapiens
aaccacuuucuuugcucauccg

SEQ ID NO: 22489 - RNA, 22 nt, Homo sapiens
auccuucuacaaauucacccau

SEQ ID NO: 22490 - RNA, 17 nt, Homo sapiens
gacagccucucccccac

SEQ ID NO: 22491 - RNA, 18 nt, Homo sapiens
aucacauucaccucccug

SEQ ID NO: 22492 - RNA, 23 nt, Homo sapiens
gggagugaagacacggagccaga

SEQ ID NO: 22493 - RNA, 23 nt, Homo sapiens
gggagugaagacacggagccaga

SEQ ID NO: 22494 - RNA, 22 nt, Homo sapiens
ucaggaacugccuuucucucca

SEQ ID NO: 22495 - RNA, 21 nt, Homo sapiens
gaccaaucgccguccccgccg

SEQ ID NO: 22496 - RNA, 22 nt, Homo sapiens
aaucagucucauugcuuuauaa

SEQ ID NO: 22497 - RNA, 23 nt, Homo sapiens
aaagucucgcucucugccccuca

SEQ ID NO: 22498 - RNA, 25 nt, Homo sapiens
acggagcugucccaacaccaccccu

SEQ ID NO: 22499 - RNA, 22 nt, Homo sapiens
gcggucccgcggcgccccgccu

SEQ ID NO: 22500 - RNA, 21 nt, Homo sapiens
caucaccuuccuucuccucca

SEQ ID NO: 22501 - RNA, 21 nt, Homo sapiens
aagggucaguaagcacccgcg

SEQ ID NO: 22502 - RNA, 20 nt, Homo sapiens
uacugcuuccacagcucccc

SEQ ID NO: 22503 - RNA, 22 nt, Homo sapiens
caaacaccauugucacacucca

SEQ ID NO: 22504 - RNA, 22 nt, Homo sapiens
ugagugcuugcuaggugccaag

SEQ ID NO: 22505 - RNA, 18 nt, Homo sapiens
aucacauucaccucccug

SEQ ID NO: 22506 - RNA, 21 nt, Homo sapiens
ggcugucaauucauaggucag

SEQ ID NO: 22507 - RNA, 22 nt, Homo sapiens
cccaacaacaugaaacuaccua

SEQ ID NO: 22508 - RNA, 22 nt, Homo sapiens
ucaccauugcuaaagugcaauu

SEQ ID NO: 22509 - RNA, 23 nt, Homo sapiens
ucucacccagguagcaaggauua

SEQ ID NO: 22510 - RNA, 23 nt, Homo sapiens
ucucacccagguagcaaggauua

SEQ ID NO: 22511 - RNA, 22 nt, Homo sapiens
aguccagauucugugcccacca

SEQ ID NO: 22512 - RNA, 23 nt, Homo sapiens
acccaacagccccugcaagggau

SEQ ID NO: 22513 - RNA, 22 nt, Homo sapiens
ugcuguuagcccuagccccgca

SEQ ID NO: 22514 - RNA, 23 nt, Homo sapiens
agcaaaaaugugcuagugccaaa

SEQ ID NO: 22515 - RNA, 20 nt, Homo sapiens
ggggggcgaggcagguguga

SEQ ID NO: 22516 - RNA, 21 nt, Homo sapiens
cugggggacggagcagaagga

SEQ ID NO: 22517 - RNA, 21 nt, Homo sapiens
gcaagcccagaccgcaaaaag

SEQ ID NO: 22518 - RNA, 18 nt, Homo sapiens
cagcagccuccuucucaa

SEQ ID NO: 22519 - RNA, 22 nt, Homo sapiens
augcccuuucaucauugcacug

SEQ ID NO: 22520 - RNA, 21 nt, Homo sapiens
cccuccaccaugcaagggaug

SEQ ID NO: 22521 - RNA, 22 nt, Homo sapiens
aggcauaggaugacaaagggaa

SEQ ID NO: 22522 - RNA, 22 nt, Homo sapiens
aggcgaaggaugacaaagggaa

SEQ ID NO: 22523 - RNA, 23 nt, Homo sapiens
gaaagugcccucaaggcugagug

SEQ ID NO: 22524 - RNA, 23 nt, Homo sapiens
agaaaccaugggguaugagcaga

SEQ ID NO: 22525 - RNA, 18 nt, Homo sapiens
aucacauucaccucccug

SEQ ID NO: 22526 - RNA, 22 nt, Homo sapiens
ucaacaucagucugauaagcua

SEQ ID NO: 22527 - RNA, 22 nt, Homo sapiens
acaguucuucaacuggcagcuu

SEQ ID NO: 22528 - RNA, 23 nt, Homo sapiens
ccacccaaugaccuacuccaaga

SEQ ID NO: 22529 - RNA, 19 nt, Homo sapiens
auuuugguacagcagcuca

SEQ ID NO: 22530 - RNA, 22 nt, Homo sapiens
caagacacauuuggagagggac

SEQ ID NO: 22531 - RNA, 21 nt, Homo sapiens
caucaccuuccuucuccucca

SEQ ID NO: 22532 - RNA, 21 nt, Homo sapiens
caacugaugccuuuccaagua

SEQ ID NO: 22533 - RNA, 21 nt, Homo sapiens
ccccucccagccucccugcca

SEQ ID NO: 22534 - RNA, 22 nt, Homo sapiens
acucaccgacagguugaauguu

SEQ ID NO: 22535 - RNA, 23 nt, Homo sapiens
cccaacagacauggcgguacuca

SEQ ID NO: 22536 - RNA, 22 nt, Homo sapiens
uaaccgauuucaaauggugcua

SEQ ID NO: 22537 - RNA, 20 nt, Homo sapiens
agugcccccacaguuugagu

SEQ ID NO: 22538 - RNA, 23 nt, Homo sapiens
caugagugacgcccucuggagua

SEQ ID NO: 22539 - RNA, 22 nt, Homo sapiens
ugugggugugugcaugagcgug

SEQ ID NO: 22540 - RNA, 22 nt, Homo sapiens
gacucuugaacaacacagguuu

SEQ ID NO: 22541 - RNA, 22 nt, Homo sapiens
gcugaggcuguggggcuggagu

SEQ ID NO: 22542 - RNA, 22 nt, Homo sapiens
cacucuaaagggaggcacuuug

SEQ ID NO: 22543 - RNA, 21 nt, Homo sapiens
ggggagcgggggcccugccuu

SEQ ID NO: 22544 - RNA, 23 nt, Homo sapiens
gggagugaagacacggagccaga

SEQ ID NO: 22545 - RNA, 22 nt, Homo sapiens
ucaggaacugccuuucucucca

SEQ ID NO: 22546 - RNA, 23 nt, Homo sapiens
cccaacagacauggcgguacuca

SEQ ID NO: 22547 - RNA, 21 nt, Homo sapiens
cugcugggccacaacguggga

SEQ ID NO: 22548 - RNA, 21 nt, Homo sapiens
cugcugggccacaacguggga

SEQ ID NO: 22549 - RNA, 23 nt, Homo sapiens
cuccagccccuccagggcuuccu

SEQ ID NO: 22550 - RNA, 23 nt, Homo sapiens
agaaaccaugggguaugagcaga

SEQ ID NO: 22551 - RNA, 23 nt, Homo sapiens
ccgcuugagcuaacuccgacccg

SEQ ID NO: 22552 - RNA, 18 nt, Homo sapiens
aucacauucaccucccug

SEQ ID NO: 22553 - RNA, 23 nt, Homo sapiens
cuaucugcacuagaugcaccuua

SEQ ID NO: 22554 - RNA, 22 nt, Homo sapiens
cccaacaacaggaaacuaccua

SEQ ID NO: 22555 - RNA, 20 nt, Homo sapiens
acagcaaggagggcaggagg

SEQ ID NO: 22556 - RNA, 21 nt, Homo sapiens
acuccaaagggaagcgccuuc

SEQ ID NO: 22557 - RNA, 22 nt, Homo sapiens
cgcucuaaagggaagcgccuuc

SEQ ID NO: 22558 - RNA, 19 nt, Homo sapiens
guugggaucacaggcgccc

SEQ ID NO: 22559 - RNA, 23 nt, Homo sapiens
acagcgcucgcaaccgcagcgau

SEQ ID NO: 22560 - RNA, 22 nt, Homo sapiens
caagacacauuuggagagggac

SEQ ID NO: 22561 - RNA, 21 nt, Homo sapiens
guccugagagcgcugccuccu

SEQ ID NO: 22562 - RNA, 22 nt, Homo sapiens
ucggucccucgggccagggcag

SEQ ID NO: 22563 - RNA, 23 nt, Homo sapiens
gcacaugugcacacagccgggug

SEQ ID NO: 22564 - RNA, 26 nt, Homo sapiens
uuucagaauuugcugccaucaucauc

SEQ ID NO: 22565 - RNA, 23 nt, Homo sapiens
gucacaucccucccaagacccuc

SEQ ID NO: 22566 - RNA, 23 nt, Homo sapiens
gggagugaagacacggagccaga

SEQ ID NO: 22567 - RNA, 22 nt, Homo sapiens
cacaaaccauuaugugcugcua

SEQ ID NO: 22568 - RNA, 22 nt, Homo sapiens
uguaaaccaugaugugcugcua

SEQ ID NO: 22569 - RNA, 22 nt, Homo sapiens
cgccaauauuuacgugcugcua

SEQ ID NO: 22570 - RNA, 21 nt, Homo sapiens
gccaauauuucugugcugcua

SEQ ID NO: 22571 - RNA, 23 nt, Homo sapiens
ucaguuuugcauagauuugcaca

SEQ ID NO: 22572 - RNA, 22 nt, Homo sapiens
cacucagcaccaggauauuguu

SEQ ID NO: 22573 - RNA, 22 nt, Homo sapiens
aacuaugcaaccuacuaccucu

SEQ ID NO: 22574 - RNA, 21 nt, Homo sapiens
ggaaaucccuggcaaugugau

SEQ ID NO: 22575 - RNA, 21 nt, Homo sapiens
gguaaucccuggcaaugugau

SEQ ID NO: 22576 - RNA, 22 nt, Homo sapiens
ucagaccgagacaagugcaaug

SEQ ID NO: 22577 - RNA, 22 nt, Homo sapiens
acaaaaguugccuuugugugau

SEQ ID NO: 22578 - RNA, 23 nt, Homo sapiens
aaagucucgcucucugccccuca

SEQ ID NO: 22579 - RNA, 22 nt, Homo sapiens
uucaaaacaugaauugcugcug

SEQ ID NO: 22580 - RNA, 21 nt, Homo sapiens
acaaaccacagugugcugcug

SEQ ID NO: 22581 - RNA, 22 nt, Homo sapiens
caagacacauuuggagagggac

SEQ ID NO: 22582 - RNA, 25 nt, Homo sapiens
accaacggaccuacuucccuccgcc

SEQ ID NO: 22583 - RNA, 22 nt, Homo sapiens
ugcuguuagcccuagccccgca

SEQ ID NO: 22584 - RNA, 20 nt, Homo sapiens
uccccacagacccagagccg

SEQ ID NO: 22585 - RNA, 21 nt, Homo sapiens
caucaccuuccuucuccucca

SEQ ID NO: 22586 - RNA, 22 nt, Homo sapiens
cacucuaaagggaggcacuuug

SEQ ID NO: 22587 - RNA, 21 nt, Homo sapiens
cucccccacugcagcuggcac

SEQ ID NO: 22588 - RNA, 22 nt, Homo sapiens
ucccucacacagaauuccagaa

SEQ ID NO: 22589 - RNA, 23 nt, Homo sapiens
cagcugcuuuugggauuccguug

SEQ ID NO: 22590 - RNA, 23 nt, Homo sapiens
ucaguuuugcauagauuugcaca

SEQ ID NO: 22591 - RNA, 22 nt, Homo sapiens
cacucagcaccaggauauuguu

SEQ ID NO: 22592 - RNA, 22 nt, Homo sapiens
aacuaugcaaccuacuaccucu

SEQ ID NO: 22593 - RNA, 22 nt, Homo sapiens
ucgcccucucaacccagcuuuu

SEQ ID NO: 22594 - RNA, 22 nt, Homo sapiens
uugcccucucaacccagcuuuu

SEQ ID NO: 22595 - RNA, 20 nt, Homo sapiens
acccucucaacccagcuuuu

SEQ ID NO: 22596 - RNA, 19 nt, Homo sapiens
uccucucaacccagcuuuu

SEQ ID NO: 22597 - RNA, 21 nt, Homo sapiens
ugcaaugcaacuacaaugcac

SEQ ID NO: 22598 - RNA, 23 nt, Homo sapiens
acacucuaaagagaagcgcuuug

SEQ ID NO: 22599 - RNA, 21 nt, Homo sapiens
agaaaguacuucccucuggag

SEQ ID NO: 22600 - RNA, 21 nt, Homo sapiens
agaaagugcaucccucuggag

SEQ ID NO: 22601 - RNA, 22 nt, Homo sapiens
gcaaaagaaacugugguuuuug

SEQ ID NO: 22602 - RNA, 19 nt, Homo sapiens
ucccacaggaagcagacac

SEQ ID NO: 22603 - RNA, 21 nt, Homo sapiens
cacaaccucaguguuuccagg

SEQ ID NO: 22604 - RNA, 22 nt, Homo sapiens
caaacaccauugucacacucca

SEQ ID NO: 22605 - RNA, 20 nt, Homo sapiens
ggggcagacagacgaggaag

SEQ ID NO: 22606 - RNA, 22 nt, Homo sapiens
cacgaccgacgccacgccgagu

SEQ ID NO: 22607 - RNA, 22 nt, Homo sapiens
ccaucuuuaccagacaguguua

SEQ ID NO: 22608 - RNA, 22 nt, Homo sapiens
ggagcccgcgccccgcgccgag

SEQ ID NO: 22609 - RNA, 22 nt, Homo sapiens
augggacauccuacauaugcaa

SEQ ID NO: 22610 - RNA, 21 nt, Homo sapiens
aggagacucacaaguuccugc

SEQ ID NO: 22611 - RNA, 22 nt, Homo sapiens
uauccacuacaccccgcugccu

SEQ ID NO: 22612 - RNA, 22 nt, Homo sapiens
caaacaccauugucacacucca

SEQ ID NO: 22613 - RNA, 22 nt, Homo sapiens
cacugguacaaggguugggaga

SEQ ID NO: 22614 - RNA, 21 nt, Homo sapiens
acuagacugugagcuccucga

SEQ ID NO: 22615 - RNA, 21 nt, Homo sapiens
gaccaaucgccguccccgccg

SEQ ID NO: 22616 - RNA, 20 nt, Homo sapiens
cccgccgcgucgcccugggg

SEQ ID NO: 22617 - RNA, 23 nt, Homo sapiens
cggcucugucgucgaggcgcuca

SEQ ID NO: 22618 - RNA, 22 nt, Homo sapiens
auaaggauuuuuaggggcauua

SEQ ID NO: 22619 - RNA, 19 nt, Homo sapiens
guugggaucacaggcgccc

SEQ ID NO: 22620 - RNA, 22 nt, Homo sapiens
gcggucccgcggcgccccgccu

SEQ ID NO: 22621 - RNA, 22 nt, Homo sapiens
ccucaggcacggccgggccacc

SEQ ID NO: 22622 - RNA, 22 nt, Homo sapiens
ugcuguuagcccuagccccgca

SEQ ID NO: 22623 - RNA, 24 nt, Homo sapiens
acugcaggcuccagcuuccaggcu

SEQ ID NO: 22624 - RNA, 22 nt, Homo sapiens
auagaugauaugcacaguacua

SEQ ID NO: 22625 - RNA, 23 nt, Homo sapiens
gggagugaagacacggagccaga

SEQ ID NO: 22626 - RNA, 21 nt, Homo sapiens
gaccaaucgccguccccgccg

SEQ ID NO: 22627 - RNA, 22 nt, Homo sapiens
uggcagcagcggagggggcaga

SEQ ID NO: 22628 - RNA, 22 nt, Homo sapiens
uagucaagugaagcagugggag

SEQ ID NO: 22629 - RNA, 21 nt, Homo sapiens
aucugcacugucagcacuuua

SEQ ID NO: 22630 - RNA, 23 nt, Homo sapiens
gcuuugacaauaucauugcacug

SEQ ID NO: 22631 - RNA, 20 nt, Homo sapiens
ccagcagcaccuggggcagu

SEQ ID NO: 22632 - RNA, 22 nt, Homo sapiens
aucgggaggggacugagccuga

SEQ ID NO: 22633 - RNA, 21 nt, Homo sapiens
auccuguacugagcugccccg

SEQ ID NO: 22634 - RNA, 22 nt, Homo sapiens
aggaaaccagcaaguguugacg

SEQ ID NO: 22635 - RNA, 22 nt, Homo sapiens
ugcaagccuugggugugggagg

SEQ ID NO: 22636 - RNA, 22 nt, Homo sapiens
gcggucccgcggcgccccgccu

SEQ ID NO: 22637 - RNA, 22 nt, Homo sapiens
ugcuguuagcccuagccccgca

SEQ ID NO: 22638 - RNA, 22 nt, Homo sapiens
cacauggccaaaacagagaaga

SEQ ID NO: 22639 - RNA, 20 nt, Homo sapiens
ggggggcgaggcagguguga

SEQ ID NO: 22640 - RNA, 21 nt, Homo sapiens
cugggggacggagcagaagga

SEQ ID NO: 22641 - RNA, 19 nt, Homo sapiens
ucccugauccaaaaaucca

SEQ ID NO: 22642 - RNA, 22 nt, Homo sapiens
cuguuccugcugaacugagcca

SEQ ID NO: 22643 - RNA, 22 nt, Homo sapiens
gaagaaaggcaucauauaggag

SEQ ID NO: 22644 - RNA, 22 nt, Homo sapiens
acaaccagcuaagacacugcca

SEQ ID NO: 22645 - RNA, 23 nt, Homo sapiens
gcaaucagcuaacuacacugccu

SEQ ID NO: 22646 - RNA, 22 nt, Homo sapiens
accagcuaacaauacacugcca

SEQ ID NO: 22647 - RNA, 22 nt, Homo sapiens
gccagcuaacaauacacugccu

SEQ ID NO: 22648 - RNA, 22 nt, Homo sapiens
gccagcuaacaauacacugccu

SEQ ID NO: 22649 - RNA, 18 nt, Homo sapiens
acccucugaaaggaagca

SEQ ID NO: 22650 - RNA, 22 nt, Homo sapiens
aaagugcuucuuaccuccagau

SEQ ID NO: 22651 - RNA, 23 nt, Homo sapiens
ggacauuguuucagugcccaagu

SEQ ID NO: 22652 - RNA, 19 nt, Homo sapiens
gcucuaagaaagccacacu

SEQ ID NO: 22653 - RNA, 21 nt, Homo sapiens
gaaggaagugagugcagccac

SEQ ID NO: 22654 - RNA, 23 nt, Homo sapiens
cuccagccccuccagggcuuccu

SEQ ID NO: 22655 - RNA, 20 nt, Homo sapiens
gcagcuguccgcccagacac

SEQ ID NO: 22656 - RNA, 22 nt, Homo sapiens
agcccaaaaggagaauucuuug

SEQ ID NO: 22657 - RNA, 21 nt, Homo sapiens
aacggaaccacuagugacuug

SEQ ID NO: 22658 - RNA, 22 nt, Homo sapiens
gagcccuggacuaggagucagc

SEQ ID NO: 22659 - RNA, 22 nt, Homo sapiens
agggguucaccgagcaacauuc

SEQ ID NO: 22660 - RNA, 22 nt, Homo sapiens
aggaaaccagcaaguguugacg

SEQ ID NO: 22661 - RNA, 22 nt, Homo sapiens
aagaagugcaccgcgaauguuu

SEQ ID NO: 22662 - RNA, 23 nt, Homo sapiens
uuuauugugguagauacuauuag

SEQ ID NO: 22663 - RNA, 23 nt, Homo sapiens
uuuauugugguagauacuauuag

SEQ ID NO: 22664 - RNA, 22 nt, Homo sapiens
gguuaguggaccaggucacaaa

SEQ ID NO: 22665 - RNA, 23 nt, Homo sapiens
aaucuacuuucuuugcucauccu

SEQ ID NO: 22666 - RNA, 22 nt, Homo sapiens
aaccacuuucuuugcucauccg

SEQ ID NO: 22667 - RNA, 22 nt, Homo sapiens
augcccuuuuaacauugcacug

SEQ ID NO: 22668 - RNA, 18 nt, Homo sapiens
aucacauucaccucccug

SEQ ID NO: 22669 - RNA, 22 nt, Homo sapiens
ccccucuggucaaccagucaca

SEQ ID NO: 22670 - RNA, 22 nt, Homo sapiens
ccaucuuuaccagacaguguua

SEQ ID NO: 22671 - RNA, 22 nt, Homo sapiens
cagaagugggccgggcacaggg

SEQ ID NO: 22672 - RNA, 22 nt, Homo sapiens
cacucagcggccguuuccccaa

SEQ ID NO: 22673 - RNA, 22 nt, Homo sapiens
ucacaguugccagcugagauua

SEQ ID NO: 22674 - RNA, 21 nt, Homo sapiens
ggaaaucccuggcaaugugau

SEQ ID NO: 22675 - RNA, 21 nt, Homo sapiens
gguaaucccuggcaaugugau

SEQ ID NO: 22676 - RNA, 22 nt, Homo sapiens
gcgaauauaacacggucgaucu

SEQ ID NO: 22677 - RNA, 21 nt, Homo sapiens
ccuucugacuccaaguccagu

SEQ ID NO: 22678 - RNA, 22 nt, Homo sapiens
uauggaugcaaaaugaucccaa

SEQ ID NO: 22679 - RNA, 21 nt, Homo sapiens
uggaaaccaagagugggucgc

SEQ ID NO: 22680 - RNA, 21 nt, Homo sapiens
cugaaaccaaguaugggucgc

SEQ ID NO: 22681 - RNA, 21 nt, Homo sapiens
aguucucccaacguaaaccca

SEQ ID NO: 22682 - RNA, 25 nt, Homo sapiens
aggccgccacccgcccgcgaucccu

SEQ ID NO: 22683 - RNA, 22 nt, Homo sapiens
caagacacauuuggagagggac

SEQ ID NO: 22684 - RNA, 20 nt, Homo sapiens
aggggccucagccuccuggu

SEQ ID NO: 22685 - RNA, 21 nt, Homo sapiens
caucaccuuccuucuccucca

SEQ ID NO: 22686 - RNA, 23 nt, Homo sapiens
aaccaagaccccggagaucccag

SEQ ID NO: 22687 - RNA, 23 nt, Homo sapiens
acacagcucuuccauaucuccag

SEQ ID NO: 22688 - RNA, 22 nt, Homo sapiens
cgaaggcaacacggauaaccua

SEQ ID NO: 22689 - RNA, 25 nt, Homo sapiens
agcuagucaagcgcgguuguggggg

SEQ ID NO: 22690 - RNA, 23 nt, Homo sapiens
ucaccaaaacauggaagcacuua

SEQ ID NO: 22691 - RNA, 23 nt, Homo sapiens
cuacuaaaacauggaagcacuua

SEQ ID NO: 22692 - RNA, 23 nt, Homo sapiens
ccacugaaacauggaagcacuua

SEQ ID NO: 22693 - RNA, 23 nt, Homo sapiens
acacucaaacauggaagcacuua

SEQ ID NO: 22694 - RNA, 17 nt, Homo sapiens
aagcauggaagcacuua

SEQ ID NO: 22695 - RNA, 23 nt, Homo sapiens
acgcucaaaugucgcagcacuuu

SEQ ID NO: 22696 - RNA, 23 nt, Homo sapiens
acaccccaaaaucgaagcacuuc

SEQ ID NO: 22697 - RNA, 21 nt, Homo sapiens
acaggccaucuguguuauauu

SEQ ID NO: 22698 - RNA, 22 nt, Homo sapiens
gcugccguauaugugaugucac

SEQ ID NO: 22699 - RNA, 22 nt, Homo sapiens
ccucauggaaggguuccccacu

SEQ ID NO: 22700 - RNA, 22 nt, Homo sapiens
agcacagacuugcugugauguu

SEQ ID NO: 22701 - RNA, 22 nt, Homo sapiens
gaccucagcuaugacagcacuu

SEQ ID NO: 22702 - RNA, 22 nt, Homo sapiens
acaguccaaagggaagcacuuu

SEQ ID NO: 22703 - RNA, 21 nt, Homo sapiens
cccucuaaaaggaagcacuuu

SEQ ID NO: 22704 - RNA, 22 nt, Homo sapiens
acccucuaaaaggaagcacuuu

SEQ ID NO: 22705 - RNA, 22 nt, Homo sapiens
acccaccaaagagaagcacuuu

SEQ ID NO: 22706 - RNA, 21 nt, Homo sapiens
cccucaaaaaggaagcacuuu

SEQ ID NO: 22707 - RNA, 20 nt, Homo sapiens
ugggccaccgccgagcggac

SEQ ID NO: 22708 - RNA, 22 nt, Homo sapiens
gauuccaauuuuuccacaucuu

SEQ ID NO: 22709 - RNA, 22 nt, Homo sapiens
cugcucaaacccuccaaugacu

SEQ ID NO: 22710 - RNA, 20 nt, Homo sapiens
auuucuauaucuaucuccau

SEQ ID NO: 22711 - RNA, 22 nt, Homo sapiens
uccucuuuucuuagagacucac

SEQ ID NO: 22712 - RNA, 25 nt, Homo sapiens
accaacggaccuacuucccuccgcc

SEQ ID NO: 22713 - RNA, 20 nt, Homo sapiens
gcaagacaucacaagacucu

SEQ ID NO: 22714 - RNA, 23 nt, Homo sapiens
gggagugaagacacggagccaga

SEQ ID NO: 22715 - RNA, 22 nt, Homo sapiens
ucaggaacugccuuucucucca

SEQ ID NO: 22716 - RNA, 22 nt, Homo sapiens
uucacacugcaugcucugggua

SEQ ID NO: 22717 - RNA, 22 nt, Homo sapiens
agcugaguguaggauguuuaca

SEQ ID NO: 22718 - RNA, 21 nt, Homo sapiens
aucugcacugucagcacuuua

SEQ ID NO: 22719 - RNA, 23 nt, Homo sapiens
gcuuugacaauaucauugcacug

SEQ ID NO: 22720 - RNA, 22 nt, Homo sapiens
gcgaacgcgccacggaccaccu

SEQ ID NO: 22721 - RNA, 20 nt, Homo sapiens
cuggaggaagggcccagagg

SEQ ID NO: 22722 - RNA, 22 nt, Homo sapiens
gccuaagacacaggcccagaga

SEQ ID NO: 22723 - RNA, 22 nt, Homo sapiens
uacagauggauaccgugcaauu

SEQ ID NO: 22724 - RNA, 22 nt, Homo sapiens
ugcaagccuugggugugggagg

SEQ ID NO: 22725 - RNA, 22 nt, Homo sapiens
cuccuccaacaauccuagacca

SEQ ID NO: 22726 - RNA, 25 nt, Homo sapiens
acggagcugucccaacaccaccccu

SEQ ID NO: 22727 - RNA, 20 nt, Homo sapiens
aggggccucagccuccuggu

SEQ ID NO: 22728 - RNA, 23 nt, Homo sapiens
gcacaugugcacacagccgggug

SEQ ID NO: 22729 - RNA, 19 nt, Homo sapiens
ccaccucccgaguccucac

SEQ ID NO: 22730 - RNA, 22 nt, Homo sapiens
ggcucccaagaaccucaccugu

SEQ ID NO: 22731 - RNA, 21 nt, Homo sapiens
uggggauuacacuucaacagg

SEQ ID NO: 22732 - RNA, 20 nt, Homo sapiens
cccgccgcgucgcccugggg

SEQ ID NO: 22733 - RNA, 21 nt, Homo sapiens
gcggaacuuagccacugugaa

SEQ ID NO: 22734 - RNA, 23 nt, Homo sapiens
gcgcccaauuaaugucuguugau

SEQ ID NO: 22735 - RNA, 23 nt, Homo sapiens
ccacccaaugaccuacuccaaga

SEQ ID NO: 22736 - RNA, 22 nt, Homo sapiens
uauggaugcaaaaugaucccaa

SEQ ID NO: 22737 - RNA, 21 nt, Homo sapiens
acuuuccaggauucauuaacu

SEQ ID NO: 22738 - RNA, 22 nt, Homo sapiens
guccaaaguuggggugcugguu

SEQ ID NO: 22739 - RNA, 23 nt, Homo sapiens
aaccaagaccccggagaucccag

SEQ ID NO: 22740 - RNA, 23 nt, Homo sapiens
gacguaguccuauucucugcugc

SEQ ID NO: 22741 - RNA, 22 nt, Homo sapiens
ccaguagcacggcucaguccag

SEQ ID NO: 22742 - RNA, 17 nt, Homo sapiens
caccugaauuacuugaa

SEQ ID NO: 22743 - RNA, 22 nt, Homo sapiens
cacaucucacuguagccucaaa

SEQ ID NO: 22744 - RNA, 22 nt, Homo sapiens
cacaucucacuguagccucaaa

SEQ ID NO: 22745 - RNA, 21 nt, Homo sapiens
ccgugguucuacccuguggua

SEQ ID NO: 22746 - RNA, 22 nt, Homo sapiens
agccuauccuggauuacuugaa

SEQ ID NO: 22747 - RNA, 21 nt, Homo sapiens
accuauccugaauuacuugaa

SEQ ID NO: 22748 - RNA, 22 nt, Homo sapiens
ggagagccuccacccaacccuc

SEQ ID NO: 22749 - RNA, 22 nt, Homo sapiens
agcugaguguaggauguuuaca

SEQ ID NO: 22750 - RNA, 22 nt, Homo sapiens
acaaaaguugccuuugugugau

SEQ ID NO: 22751 - RNA, 23 nt, Homo sapiens
aaagucucgcucucugccccuca

SEQ ID NO: 22752 - RNA, 21 nt, Homo sapiens
guguauaugcccauggacugc

SEQ ID NO: 22753 - RNA, 20 nt, Homo sapiens
aggggccucagccuccuggu

SEQ ID NO: 22754 - RNA, 20 nt, Homo sapiens
cccugcgccaucuccucuac

SEQ ID NO: 22755 - RNA, 22 nt, Homo sapiens
uccggggacgaacgggacgggu

SEQ ID NO: 22756 - RNA, 18 nt, Homo sapiens
uggcgccugaacagggac

SEQ ID NO: 22757 - RNA, 18 nt, Homo sapiens
aucacauucaccucccug

SEQ ID NO: 22758 - RNA, 22 nt, Homo sapiens
ucaggaacugccuuucucucca

SEQ ID NO: 22759 - RNA, 22 nt, Homo sapiens
auaaggauuuuuaggggcauua

SEQ ID NO: 22760 - RNA, 20 nt, Homo sapiens
agagaugagagaaacacccu

SEQ ID NO: 22761 - RNA, 21 nt, Homo sapiens
caucaccuuccuucuccucca

SEQ ID NO: 22762 - RNA, 22 nt, Homo sapiens
cacauggccaaaacagagaaga

SEQ ID NO: 22763 - RNA, 23 nt, Homo sapiens
aacaggugcucaaauaagacuug

SEQ ID NO: 22764 - RNA, 22 nt, Homo sapiens
cuaccauaggguaaaaccacug

SEQ ID NO: 22765 - RNA, 21 nt, Homo sapiens
ccucaaggagcuucagucuag

SEQ ID NO: 22766 - RNA, 21 nt, Homo sapiens
gaccaaucgccguccccgccg

SEQ ID NO: 22767 - RNA, 22 nt, Homo sapiens
uggcagcagcggagggggcaga

SEQ ID NO: 22768 - RNA, 20 nt, Homo sapiens
ccagcagcaccuggggcagu

SEQ ID NO: 22769 - RNA, 21 nt, Homo sapiens
auccuguacugagcugccccg

SEQ ID NO: 22770 - RNA, 22 nt, Homo sapiens
cagcauggaguccuccagguug

SEQ ID NO: 22771 - RNA, 21 nt, Homo sapiens
acaaaccacagugugcugcug

SEQ ID NO: 22772 - RNA, 21 nt, Homo sapiens
acaaaccacagugugcugcug

SEQ ID NO: 22773 - RNA, 23 nt, Homo sapiens
caugagugacgcccucuggagua

SEQ ID NO: 22774 - RNA, 22 nt, Homo sapiens
gcggucccgcggcgccccgccu

SEQ ID NO: 22775 - RNA, 22 nt, Homo sapiens
uauccacuacaccccgcugccu

SEQ ID NO: 22776 - RNA, 21 nt, Homo sapiens
ccccucccagccucccugcca

SEQ ID NO: 22777 - RNA, 21 nt, Homo sapiens
ccgugguucuacccuguggua

SEQ ID NO: 22778 - RNA, 18 nt, Homo sapiens
auucaaucuacugccuca

SEQ ID NO: 22779 - RNA, 22 nt, Homo sapiens
cuuccagucgaggauguuuaca

SEQ ID NO: 22780 - RNA, 22 nt, Homo sapiens
agcugaguguaggauguuuaca

SEQ ID NO: 22781 - RNA, 23 nt, Homo sapiens
gcugagaguguaggauguuuaca

SEQ ID NO: 22782 - RNA, 22 nt, Homo sapiens
cuuccagucggggauguuuaca

SEQ ID NO: 22783 - RNA, 22 nt, Homo sapiens
cuuccagucaaggauguuuaca

SEQ ID NO: 22784 - RNA, 20 nt, Homo sapiens
cuggaggaagggcccagagg

SEQ ID NO: 22785 - RNA, 23 nt, Homo sapiens
ucucugcaggccgugugcuuugc

SEQ ID NO: 22786 - RNA, 22 nt, Homo sapiens
gccuaagacacaggcccagaga

SEQ ID NO: 22787 - RNA, 22 nt, Homo sapiens
uacagauggauaccgugcaauu

SEQ ID NO: 22788 - RNA, 21 nt, Homo sapiens
auccuguacugagcugccccg

SEQ ID NO: 22789 - RNA, 18 nt, Homo sapiens
acccucugaaaggaagca

SEQ ID NO: 22790 - RNA, 22 nt, Homo sapiens
aaagugcuucuuaccuccagau

SEQ ID NO: 22791 - RNA, 22 nt, Homo sapiens
aguccagauucugugcccacca

SEQ ID NO: 22792 - RNA, 24 nt, Homo sapiens
acgcagagcccgaaagcccccagu

SEQ ID NO: 22793 - RNA, 21 nt, Homo sapiens
gaaggaagugagugcagccac

SEQ ID NO: 22794 - RNA, 22 nt, Homo sapiens
gcacauguucugcggcccacca

SEQ ID NO: 22795 - RNA, 21 nt, Homo sapiens
ggggagcgggggcccugccuu

SEQ ID NO: 22796 - RNA, 22 nt, Homo sapiens
cacaagaucggaucuacggguu

SEQ ID NO: 22797 - RNA, 22 nt, Homo sapiens
cgcaaggucgguucuacgggug

SEQ ID NO: 22798 - RNA, 21 nt, Homo sapiens
gcuuaaacaucuacaugaaca

SEQ ID NO: 22799 - RNA, 20 nt, Homo sapiens
gcagcuguccgcccagacac

SEQ ID NO: 22800 - RNA, 22 nt, Homo sapiens
cacuccuauaauugauccaguu

SEQ ID NO: 22801 - RNA, 17 nt, Homo sapiens
gacagccucucccccac

SEQ ID NO: 22802 - RNA, 21 nt, Homo sapiens
ucacccagaucugcggccuaa

SEQ ID NO: 22803 - RNA, 22 nt, Homo sapiens
ucaggaacugccuuucucucca

SEQ ID NO: 22804 - RNA, 22 nt, Homo sapiens
ccggcugcaacacaagacacga

SEQ ID NO: 22805 - RNA, 23 nt, Homo sapiens
gaacagguagucugaacacuggg

SEQ ID NO: 22806 - RNA, 23 nt, Homo sapiens
gaacagauagucuaaacacuggg

SEQ ID NO: 22807 - RNA, 23 nt, Homo sapiens
cuaccugcacuaugagcacuuug

SEQ ID NO: 22808 - RNA, 23 nt, Homo sapiens
gaaacccagcagacaauguagcu

SEQ ID NO: 22809 - RNA, 21 nt, Homo sapiens
uucuaggauaggcccaggggc

SEQ ID NO: 22810 - RNA, 22 nt, Homo sapiens
ucaguuuccucugcaaacaguu

SEQ ID NO: 22811 - RNA, 22 nt, Homo sapiens
aaagugcuucuuaccuccagau

SEQ ID NO: 22812 - RNA, 25 nt, Homo sapiens
acggagcugucccaacaccaccccu

SEQ ID NO: 22813 - RNA, 22 nt, Homo sapiens
cugggggcggcacaggggcuca

SEQ ID NO: 22814 - RNA, 18 nt, Homo sapiens
cccccaccaccacgcccg

SEQ ID NO: 22815 - RNA, 22 nt, Homo sapiens
aucagagcccucugagcuucag

SEQ ID NO: 22816 - RNA, 21 nt, Homo sapiens
gaccaaucgccguccccgccg

SEQ ID NO: 22817 - RNA, 21 nt, Homo sapiens
agagcucauccauaguuguca

SEQ ID NO: 22818 - RNA, 22 nt, Homo sapiens
ggcaaaauccgcaauuacuuuu

SEQ ID NO: 22819 - RNA, 23 nt, Homo sapiens
aagaaucuugucccgcagguccu

SEQ ID NO: 22820 - RNA, 19 nt, Homo sapiens
uagcauacagauacgccca

SEQ ID NO: 22821 - RNA, 24 nt, Homo sapiens
acugggcacaaacauguccagguc

SEQ ID NO: 22822 - RNA, 21 nt, Homo sapiens
gcugaggucugggccaggucu

SEQ ID NO: 22823 - RNA, 22 nt, Homo sapiens
gcggucccgcggcgccccgccu

SEQ ID NO: 22824 - RNA, 22 nt, Homo sapiens
ugcuguuagcccuagccccgca

SEQ ID NO: 22825 - RNA, 21 nt, Homo sapiens
ccccucccagccucccugcca

SEQ ID NO: 22826 - RNA, 24 nt, Homo sapiens
acugcuggucuucagucagggcca

SEQ ID NO: 22827 - RNA, 25 nt, Homo sapiens
cagcgucugccggaacccguuccca

SEQ ID NO: 22828 - RNA, 19 nt, Homo sapiens
cagcaucagcagcaucauc

SEQ ID NO: 22829 - RNA, 23 nt, Homo sapiens
gggagugaagacacggagccaga

SEQ ID NO: 22830 - RNA, 21 nt, Homo sapiens
gaccaaucgccguccccgccg

SEQ ID NO: 22831 - RNA, 22 nt, Homo sapiens
cggugagcacccggccccugcg

SEQ ID NO: 22832 - RNA, 22 nt, Homo sapiens
agcugaguguaggauguuuaca

SEQ ID NO: 22833 - RNA, 22 nt, Homo sapiens
gcggucccgcggcgccccgccu

SEQ ID NO: 22834 - RNA, 22 nt, Homo sapiens
ugcuguuagcccuagccccgca

SEQ ID NO: 22835 - RNA, 21 nt, Homo sapiens
caucaccuuccuucuccucca

SEQ ID NO: 22836 - RNA, 24 nt, Homo sapiens
cacccccagagccucagcucccca

SEQ ID NO: 22837 - RNA, 22 nt, Homo sapiens
caaacaccauugucacacucca

SEQ ID NO: 22838 - RNA, 21 nt, Homo sapiens
auguaggccuuuagaucacuu

SEQ ID NO: 22839 - RNA, 21 nt, Homo sapiens
gaccaaucgccguccccgccg

SEQ ID NO: 22840 - RNA, 22 nt, Homo sapiens
gaauucaucacggccagccucu

SEQ ID NO: 22841 - RNA, 19 nt, Homo sapiens
guugggaucacaggcgccc

SEQ ID NO: 22842 - RNA, 22 nt, Homo sapiens
aagagggagacccaggcucgga

SEQ ID NO: 22843 - RNA, 22 nt, Homo sapiens
caagacacauuuggagagggac

SEQ ID NO: 22844 - RNA, 19 nt, Homo sapiens
ucagcaguaccagccuaga

SEQ ID NO: 22845 - RNA, 19 nt, Homo sapiens
gccucagaggcagcugcuu

SEQ ID NO: 22846 - RNA, 22 nt, Homo sapiens
gcggucccgcggcgccccgccu

SEQ ID NO: 22847 - RNA, 22 nt, Homo sapiens
ugcuguuagcccuagccccgca

SEQ ID NO: 22848 - RNA, 20 nt, Homo sapiens
uacugcuuccacagcucccc

SEQ ID NO: 22849 - RNA, 23 nt, Homo sapiens
cuaccugcacuguaagcacuuuu

SEQ ID NO: 22850 - RNA, 21 nt, Homo sapiens
aucugcacugucagcacuuua

SEQ ID NO: 22851 - RNA, 18 nt, Homo sapiens
cagcagccuccuucucaa

SEQ ID NO: 22852 - RNA, 22 nt, Homo sapiens
cacgaccgacgccacgccgagu

SEQ ID NO: 22853 - RNA, 23 nt, Homo sapiens
cuaccugcacuguaagcacuuug

SEQ ID NO: 22854 - RNA, 22 nt, Homo sapiens
cagaagugggccgggcacaggg

SEQ ID NO: 22855 - RNA, 23 nt, Homo sapiens
cuaccugcacuauaagcacuuua

SEQ ID NO: 22856 - RNA, 23 nt, Homo sapiens
cuaccugcacuaugagcacuuug

SEQ ID NO: 22857 - RNA, 22 nt, Homo sapiens
ucacaguugccagcugagauua

SEQ ID NO: 22858 - RNA, 23 nt, Homo sapiens
caugagugacgcccucuggagua

SEQ ID NO: 22859 - RNA, 22 nt, Homo sapiens
acacucuaaaaggaugcacuuu

SEQ ID NO: 22860 - RNA, 22 nt, Homo sapiens
acacucuaaaaggaugcacuuu

SEQ ID NO: 22861 - RNA, 22 nt, Homo sapiens
aaccucuaaaaggaugcacuuu

SEQ ID NO: 22862 - RNA, 22 nt, Homo sapiens
aaccucuaaaaggaugcacuuu

SEQ ID NO: 22863 - RNA, 22 nt, Homo sapiens
auccucuaaaaagaugcacuuu

SEQ ID NO: 22864 - RNA, 22 nt, Homo sapiens
auccucuaaaaagaugcacuuu

SEQ ID NO: 22865 - RNA, 22 nt, Homo sapiens
cacucuaaagggaggcacuuug

SEQ ID NO: 22866 - RNA, 24 nt, Homo sapiens
acacucuaaagggaagcacuuugu

SEQ ID NO: 22867 - RNA, 22 nt, Homo sapiens
acucuaaagggaagcacuuugu

SEQ ID NO: 22868 - RNA, 23 nt, Homo sapiens
acagaaagugcuucccucaagag

SEQ ID NO: 22869 - RNA, 21 nt, Homo sapiens
cugaaaccaaguaugggucgc

SEQ ID NO: 22870 - RNA, 24 nt, Homo sapiens
cugaucaguuacacaucacuucag

SEQ ID NO: 22871 - RNA, 23 nt, Homo sapiens
acacacucacacacacacacuca

SEQ ID NO: 22872 - RNA, 19 nt, Homo sapiens
accagugcccugcacacuu

SEQ ID NO: 22873 - RNA, 23 nt, Homo sapiens
cuaccugcacgaacagcacuuug

SEQ ID NO: 22874 - RNA, 22 nt, Homo sapiens
cugggggcggcacaggggcuca

SEQ ID NO: 22875 - RNA, 22 nt, Homo sapiens
caaacaccauugucacacucca

SEQ ID NO: 22876 - RNA, 24 nt, Homo sapiens
ucacagguuaaagggucucaggga

SEQ ID NO: 22877 - RNA, 22 nt, Homo sapiens
ucacaaguuagggucucaggga

SEQ ID NO: 22878 - RNA, 23 nt, Homo sapiens
agcccuguucuacagcccugagg

SEQ ID NO: 22879 - RNA, 22 nt, Homo sapiens
gcacaaaucuccagaccaccca

SEQ ID NO: 22880 - RNA, 22 nt, Homo sapiens
cacgaccgacgccacgccgagu

SEQ ID NO: 22881 - RNA, 21 nt, Homo sapiens
gaccaaucgccguccccgccg

SEQ ID NO: 22882 - RNA, 20 nt, Homo sapiens
cccgccgcgucgcccugggg

SEQ ID NO: 22883 - RNA, 22 nt, Homo sapiens
ucagaccgagacaagugcaaug

SEQ ID NO: 22884 - RNA, 22 nt, Homo sapiens
gcgaacgcgccacggaccaccu

SEQ ID NO: 22885 - RNA, 21 nt, Homo sapiens
uucuaggauaggcccaggggc

SEQ ID NO: 22886 - RNA, 23 nt, Homo sapiens
cggcucugucgucgaggcgcuca

SEQ ID NO: 22887 - RNA, 23 nt, Homo sapiens
cugcagaacuguucccgcugcua

SEQ ID NO: 22888 - RNA, 22 nt, Homo sapiens
gugauugccacucuccugagua

SEQ ID NO: 22889 - RNA, 22 nt, Homo sapiens
aagagggagacccaggcucgga

SEQ ID NO: 22890 - RNA, 22 nt, Homo sapiens
gcggucccgcggcgccccgccu

SEQ ID NO: 22891 - RNA, 22 nt, Homo sapiens
ugcuguuagcccuagccccgca

SEQ ID NO: 22892 - RNA, 23 nt, Homo sapiens
uggcccugacacgugguacugga

SEQ ID NO: 22893 - RNA, 25 nt, Homo sapiens
gaauccugguucugucccucacuag

SEQ ID NO: 22894 - RNA, 21 nt, Homo sapiens
agaaguagaccauguguccua

SEQ ID NO: 22895 - RNA, 21 nt, Homo sapiens
gaccaaucgccguccccgccg

SEQ ID NO: 22896 - RNA, 22 nt, Homo sapiens
acugccugucugugccugcugu

SEQ ID NO: 22897 - RNA, 22 nt, Homo sapiens
accagguuccaccccagcaggc

SEQ ID NO: 22898 - RNA, 23 nt, Homo sapiens
gucagaccccgagggguccucgc

SEQ ID NO: 22899 - RNA, 22 nt, Homo sapiens
gcggucccgcggcgccccgccu

SEQ ID NO: 22900 - RNA, 23 nt, Homo sapiens
cacugugggcccucuccgcacca

SEQ ID NO: 22901 - RNA, 22 nt, Homo sapiens
ugcuguuagcccuagccccgca

SEQ ID NO: 22902 - RNA, 23 nt, Homo sapiens
ccgcuugagcuaacuccgacccg

SEQ ID NO: 22903 - RNA, 22 nt, Homo sapiens
ggcagagagucagagcgcggau

SEQ ID NO: 22904 - RNA, 23 nt, Homo sapiens
ucauagcccuguacaaugcugcu

SEQ ID NO: 22905 - RNA, 23 nt, Homo sapiens
accacaggagucugagcauuuga

SEQ ID NO: 22906 - RNA, 23 nt, Homo sapiens
ugauagcccuguacaaugcugcu

SEQ ID NO: 22907 - RNA, 24 nt, Homo sapiens
acugcaggcuccagcuuccaggcu

SEQ ID NO: 22908 - RNA, 19 nt, Homo sapiens
ucccugauccaaaaaucca

SEQ ID NO: 22909 - RNA, 22 nt, Homo sapiens
uagucaagugaagcagugggag

SEQ ID NO: 22910 - RNA, 22 nt, Homo sapiens
ucaacaucagucugauaagcua

SEQ ID NO: 22911 - RNA, 22 nt, Homo sapiens
aucgggaggggacugagccuga

SEQ ID NO: 22912 - RNA, 21 nt, Homo sapiens
acaaaccacagugugcugcug

SEQ ID NO: 22913 - RNA, 23 nt, Homo sapiens
caugagugacgcccucuggagua

SEQ ID NO: 22914 - RNA, 23 nt, Homo sapiens
caugagugacgcccucuggagua

SEQ ID NO: 22915 - RNA, 22 nt, Homo sapiens
aaagugcuucuuaccuccagau

SEQ ID NO: 22916 - RNA, 23 nt, Homo sapiens
acacucuaaagagaagcgcuuug

SEQ ID NO: 22917 - RNA, 21 nt, Homo sapiens
agaaaguacuucccucuggag

SEQ ID NO: 22918 - RNA, 21 nt, Homo sapiens
agaaagugcaucccucuggag

SEQ ID NO: 22919 - RNA, 22 nt, Homo sapiens
gcaaaagaaacugugguuuuug

SEQ ID NO: 22920 - RNA, 22 nt, Homo sapiens
cugcacuuuuaugaauaagcuc

SEQ ID NO: 22921 - RNA, 23 nt, Homo sapiens
aggagaaggcaccaugggauuua

SEQ ID NO: 22922 - RNA, 20 nt, Homo sapiens
uccccacagacccagagccg

SEQ ID NO: 22923 - RNA, 20 nt, Homo sapiens
cccugcgccaucuccucuac

SEQ ID NO: 22924 - RNA, 21 nt, Homo sapiens
ccccucccagccucccugcca

SEQ ID NO: 22925 - RNA, 22 nt, Homo sapiens
uaaaugaauucaauuuccuucu

SEQ ID NO: 22926 - RNA, 24 nt, Homo sapiens
acugcaggcuccagcuuccaggcu

SEQ ID NO: 22927 - RNA, 20 nt, Homo sapiens
aagcagaaaaaggcaaacga

SEQ ID NO: 22928 - RNA, 22 nt, Homo sapiens
ccucauggaaggguuccccacu

SEQ ID NO: 22929 - RNA, 22 nt, Homo sapiens
gcacacaauaaauguuugcuga

SEQ ID NO: 22930 - RNA, 23 nt, Homo sapiens
ccgcuugagcuaacuccgacccg

SEQ ID NO: 22931 - RNA, 20 nt, Homo sapiens
uacugcuuccacagcucccc

SEQ ID NO: 22932 - RNA, 22 nt, Homo sapiens
ggcagagagucagagcgcggau

SEQ ID NO: 22933 - RNA, 21 nt, Homo sapiens
ggggagcgggggcccugccuu

SEQ ID NO: 22934 - RNA, 20 nt, Homo sapiens
ugucuccacagggcucuuua

SEQ ID NO: 22935 - RNA, 17 nt, Homo sapiens
gggagaggaggaggcga

SEQ ID NO: 22936 - RNA, 18 nt, Homo sapiens
aucacauucaccucccug

SEQ ID NO: 22937 - RNA, 21 nt, Homo sapiens
gaccaaucgccguccccgccg

SEQ ID NO: 22938 - RNA, 22 nt, Homo sapiens
cccaacaacaugaaacuaccua

SEQ ID NO: 22939 - RNA, 22 nt, Homo sapiens
cccaacaacaggaaacuaccua

SEQ ID NO: 22940 - RNA, 23 nt, Homo sapiens
gaaacccagcagacaauguagcu

SEQ ID NO: 22941 - RNA, 22 nt, Homo sapiens
ugggguauuugacaaacugaca

SEQ ID NO: 22942 - RNA, 21 nt, Homo sapiens
ggacuauagaacuuucccccu

SEQ ID NO: 22943 - RNA, 22 nt, Homo sapiens
gcggucccgcggcgccccgccu

SEQ ID NO: 22944 - RNA, 21 nt, Homo sapiens
auaauggagaccaggccacga

SEQ ID NO: 22945 - RNA, 22 nt, Homo sapiens
agcugaguguaggauguuuaca

SEQ ID NO: 22946 - RNA, 22 nt, Homo sapiens
aaucagucucauugcuuuauaa

SEQ ID NO: 22947 - RNA, 22 nt, Homo sapiens
guagaagggaaucuugcauaag

SEQ ID NO: 22948 - RNA, 20 nt, Homo sapiens
guguguauacauuuauacau

SEQ ID NO: 22949 - RNA, 24 nt, Homo sapiens
acgcgcaggccagagacccaggca

SEQ ID NO: 22950 - RNA, 22 nt, Homo sapiens
ccucaggcacggccgggccacc

SEQ ID NO: 22951 - RNA, 18 nt, Homo sapiens
aucacauucaccucccug

SEQ ID NO: 22952 - RNA, 23 nt, Homo sapiens
gggagugaagacacggagccaga

SEQ ID NO: 22953 - RNA, 22 nt, Homo sapiens
ucaggaacugccuuucucucca

SEQ ID NO: 22954 - RNA, 23 nt, Homo sapiens
cuaucugcacuagaugcaccuua

SEQ ID NO: 22955 - RNA, 20 nt, Homo sapiens
acagcaaggagggcaggagg

SEQ ID NO: 22956 - RNA, 22 nt, Homo sapiens
ucaacaucagucugauaagcua

SEQ ID NO: 22957 - RNA, 22 nt, Homo sapiens
cuguuccugcugaacugagcca

SEQ ID NO: 22958 - RNA, 22 nt, Homo sapiens
gaauucaucacggccagccucu

SEQ ID NO: 22959 - RNA, 21 nt, Homo sapiens
acuccaaagggaagcgccuuc

SEQ ID NO: 22960 - RNA, 22 nt, Homo sapiens
cgcucuaaagggaagcgccuuc

SEQ ID NO: 22961 - RNA, 21 nt, Homo sapiens
acuuuccaggauucauuaacu

SEQ ID NO: 22962 - RNA, 22 nt, Homo sapiens
aagagggagacccaggcucgga

SEQ ID NO: 22963 - RNA, 23 nt, Homo sapiens
acccaacagccccugcaagggau

SEQ ID NO: 22964 - RNA, 21 nt, Homo sapiens
auguaggccuuuagaucacuu

SEQ ID NO: 22965 - RNA, 22 nt, Homo sapiens
ggcucccaagaaccucaccugu

SEQ ID NO: 22966 - RNA, 22 nt, Homo sapiens
gacucgaaccacugauccagca

SEQ ID NO: 22967 - RNA, 23 nt, Homo sapiens
cccaacagacauggcgguacuca

SEQ ID NO: 22968 - RNA, 22 nt, Homo sapiens
ugagccacugugccuggccuga

SEQ ID NO: 22969 - RNA, 22 nt, Homo sapiens
ucgcccucucaacccagcuuuu

SEQ ID NO: 22970 - RNA, 22 nt, Homo sapiens
uugcccucucaacccagcuuuu

SEQ ID NO: 22971 - RNA, 20 nt, Homo sapiens
acccucucaacccagcuuuu

SEQ ID NO: 22972 - RNA, 19 nt, Homo sapiens
uccucucaacccagcuuuu

SEQ ID NO: 22973 - RNA, 22 nt, Homo sapiens
guaccccuggagauucugauaa

SEQ ID NO: 22974 - RNA, 23 nt, Homo sapiens
ugcgaacucaccacggacaaccu

SEQ ID NO: 22975 - RNA, 23 nt, Homo sapiens
acccuauaagcaauauugcacua

SEQ ID NO: 22976 - RNA, 21 nt, Homo sapiens
agaggcagguuccuggaucau

SEQ ID NO: 22977 - RNA, 22 nt, Homo sapiens
agcuagugagaagucaaugccu

SEQ ID NO: 22978 - RNA, 18 nt, Homo sapiens
cagcagccuccuucucaa

SEQ ID NO: 22979 - RNA, 21 nt, Homo sapiens
cagcgaaacaggcaaacggag

SEQ ID NO: 22980 - RNA, 23 nt, Homo sapiens
cagcugcuuuugggauuccguug

SEQ ID NO: 22981 - RNA, 22 nt, Homo sapiens
accagcuaacaauacacugcca

SEQ ID NO: 22982 - RNA, 22 nt, Homo sapiens
auaaggauuuuuaggggcauua

SEQ ID NO: 22983 - RNA, 22 nt, Homo sapiens
gcaaaagaaacugugguuuuug

SEQ ID NO: 22984 - RNA, 22 nt, Homo sapiens
cucagagcagacgugguucuca

SEQ ID NO: 22985 - RNA, 21 nt, Homo sapiens
acaugguuagaucaagcacaa

SEQ ID NO: 22986 - RNA, 21 nt, Homo sapiens
caucaccuuccuucuccucca

SEQ ID NO: 22987 - RNA, 21 nt, Homo sapiens
cugaggagagaggaggugggg

SEQ ID NO: 22988 - RNA, 24 nt, Homo sapiens
acugcaggcuccagcuuccaggcu

SEQ ID NO: 22989 - RNA, 18 nt, Homo sapiens
ugguggcagaggugggau

SEQ ID NO: 22990 - RNA, 22 nt, Homo sapiens
augcccuuuuaacauugcacug

SEQ ID NO: 22991 - RNA, 21 nt, Homo sapiens
ggaaaucccuggcaaugugau

SEQ ID NO: 22992 - RNA, 21 nt, Homo sapiens
gguaaucccuggcaaugugau

SEQ ID NO: 22993 - RNA, 25 nt, Homo sapiens
acggagcugucccaacaccaccccu

SEQ ID NO: 22994 - RNA, 22 nt, Homo sapiens
ucggucccucgggccagggcag

SEQ ID NO: 22995 - RNA, 21 nt, Homo sapiens
ccccucccagccucccugcca

SEQ ID NO: 22996 - RNA, 22 nt, Homo sapiens
cuggagagacaaggggaagagg

SEQ ID NO: 22997 - RNA, 21 nt, Homo sapiens
gaccaaucgccguccccgccg

SEQ ID NO: 22998 - RNA, 19 nt, Homo sapiens
guugggaucacaggcgccc

SEQ ID NO: 22999 - RNA, 21 nt, Homo sapiens
gcugaggucugggccaggucu

SEQ ID NO: 23000 - RNA, 19 nt, Homo sapiens
gcucuaagaaagccacacu

SEQ ID NO: 23001 - RNA, 21 nt, Homo sapiens
gaaggaagugagugcagccac

SEQ ID NO: 23002 - RNA, 22 nt, Homo sapiens
gcggucccgcggcgccccgccu

SEQ ID NO: 23003 - RNA, 22 nt, Homo sapiens
ugcuguuagcccuagccccgca

SEQ ID NO: 23004 - RNA, 20 nt, Homo sapiens
cccugcgccaucuccucuac

SEQ ID NO: 23005 - RNA, 22 nt, Homo sapiens
ccacacacuuccuuacauucca

SEQ ID NO: 23006 - RNA, 21 nt, Homo sapiens
gggcaucugggacgcgcagga

SEQ ID NO: 23007 - RNA, 21 nt, Homo sapiens
gaccaaucgccguccccgccg

SEQ ID NO: 23008 - RNA, 22 nt, Homo sapiens
uggcagcagcggagggggcaga

SEQ ID NO: 23009 - RNA, 20 nt, Homo sapiens
acagcaaggagggcaggagg

SEQ ID NO: 23010 - RNA, 20 nt, Homo sapiens
ccagcagcaccuggggcagu

SEQ ID NO: 23011 - RNA, 22 nt, Homo sapiens
aaagagguuaaccagguguguu

SEQ ID NO: 23012 - RNA, 22 nt, Homo sapiens
ugaauccuugaauagguguguu

SEQ ID NO: 23013 - RNA, 21 nt, Homo sapiens
auccuguacugagcugccccg

SEQ ID NO: 23014 - RNA, 18 nt, Homo sapiens
acccucugaaaggaagca

SEQ ID NO: 23015 - RNA, 22 nt, Homo sapiens
aaagugcuucuuaccuccagau

SEQ ID NO: 23016 - RNA, 22 nt, Homo sapiens
aaagugcuucuuaccuccagau

SEQ ID NO: 23017 - RNA, 23 nt, Homo sapiens
acacucuaaagagaagcgcuuug

SEQ ID NO: 23018 - RNA, 21 nt, Homo sapiens
agaaaguacuucccucuggag

SEQ ID NO: 23019 - RNA, 21 nt, Homo sapiens
agaaagugcaucccucuggag

SEQ ID NO: 23020 - RNA, 20 nt, Homo sapiens
ugggccaccgccgagcggac

SEQ ID NO: 23021 - RNA, 25 nt, Homo sapiens
accaacggaccuacuucccuccgcc

SEQ ID NO: 23022 - RNA, 22 nt, Homo sapiens
gcggucccgcggcgccccgccu

SEQ ID NO: 23023 - RNA, 22 nt, Homo sapiens
ugcuguuagcccuagccccgca

SEQ ID NO: 23024 - RNA, 21 nt, Homo sapiens
caucaccuuccuucuccucca

SEQ ID NO: 23025 - RNA, 23 nt, Homo sapiens
ucauagcccuguacaaugcugcu

SEQ ID NO: 23026 - RNA, 23 nt, Homo sapiens
ugauagcccuguacaaugcugcu

SEQ ID NO: 23027 - RNA, 22 nt, Homo sapiens
cacaaaccauuaugugcugcua

SEQ ID NO: 23028 - RNA, 22 nt, Homo sapiens
uguaaaccaugaugugcugcua

SEQ ID NO: 23029 - RNA, 22 nt, Homo sapiens
cgccaauauuuacgugcugcua

SEQ ID NO: 23030 - RNA, 18 nt, Homo sapiens
auucaaucuacugccuca

SEQ ID NO: 23031 - RNA, 21 nt, Homo sapiens
gccaauauuucugugcugcua

SEQ ID NO: 23032 - RNA, 23 nt, Homo sapiens
cuaccugcacuauaagcacuuua

SEQ ID NO: 23033 - RNA, 22 nt, Homo sapiens
acaguucuucaacuggcagcuu

SEQ ID NO: 23034 - RNA, 23 nt, Homo sapiens
acaccaaugcccuaggggaugcg

SEQ ID NO: 23035 - RNA, 23 nt, Homo sapiens
agaggcaggcaugcgggcagaca

SEQ ID NO: 23036 - RNA, 22 nt, Homo sapiens
uucaaaacaugaauugcugcug

SEQ ID NO: 23037 - RNA, 21 nt, Homo sapiens
acaaaccacagugugcugcug

SEQ ID NO: 23038 - RNA, 22 nt, Homo sapiens
gcacacaauaaauguuugcuga

SEQ ID NO: 23039 - RNA, 19 nt, Homo sapiens
auuuugguacagcagcuca

SEQ ID NO: 23040 - RNA, 22 nt, Homo sapiens
gauuccaauuuuuccacaucuu

SEQ ID NO: 23041 - RNA, 19 nt, Homo sapiens
ucccacaggaagcagacac

SEQ ID NO: 23042 - RNA, 21 nt, Homo sapiens
guccugagagcgcugccuccu

SEQ ID NO: 23043 - RNA, 20 nt, Homo sapiens
uccccacagacccagagccg

SEQ ID NO: 23044 - RNA, 23 nt, Homo sapiens
agaaaccaugggguaugagcaga

SEQ ID NO: 23045 - RNA, 21 nt, Homo sapiens
ccccucccagccucccugcca

SEQ ID NO: 23046 - RNA, 17 nt, Homo sapiens
gggagaggaggaggcga

SEQ ID NO: 23047 - RNA, 22 nt, Homo sapiens
aggucucacuuuguugcccaga

SEQ ID NO: 23048 - RNA, 24 nt, Homo sapiens
acugcuggucuucagucagggcca

SEQ ID NO: 23049 - RNA, 23 nt, Homo sapiens
uccaucaucaaaacaaauggagu

SEQ ID NO: 23050 - RNA, 21 nt, Homo sapiens
cggggugcacgggcggagggc

SEQ ID NO: 23051 - RNA, 22 nt, Homo sapiens
ucaggaacugccuuucucucca

SEQ ID NO: 23052 - RNA, 21 nt, Homo sapiens
gaccaaucgccguccccgccg

SEQ ID NO: 23053 - RNA, 22 nt, Homo sapiens
ucagaccgagacaagugcaaug

SEQ ID NO: 23054 - RNA, 22 nt, Homo sapiens
ucagaccgagacaagugcaaug

SEQ ID NO: 23055 - RNA, 22 nt, Homo sapiens
acggaagggcagagagggccag

SEQ ID NO: 23056 - RNA, 23 nt, Homo sapiens
aaaucagaaucacaccuggggga

SEQ ID NO: 23057 - RNA, 23 nt, Homo sapiens
acccuauaagcaauauugcacua

SEQ ID NO: 23058 - RNA, 21 nt, Homo sapiens
aucagagguucagcuuacccu

SEQ ID NO: 23059 - RNA, 25 nt, Homo sapiens
aaggagcucagaagcccugcccagc

SEQ ID NO: 23060 - RNA, 24 nt, Homo sapiens
acgcagagcccgaaagcccccagu

SEQ ID NO: 23061 - RNA, 25 nt, Homo sapiens
accaacggaccuacuucccuccgcc

SEQ ID NO: 23062 - RNA, 25 nt, Homo sapiens
accaacggaccuacuucccuccgcc

SEQ ID NO: 23063 - RNA, 22 nt, Homo sapiens
gcggucccgcggcgccccgccu

SEQ ID NO: 23064 - RNA, 22 nt, Homo sapiens
ugcuguuagcccuagccccgca

SEQ ID NO: 23065 - RNA, 21 nt, Homo sapiens
caucaccuuccuucuccucca

SEQ ID NO: 23066 - RNA, 22 nt, Homo sapiens
gcugaggcuguggggcuggagu

SEQ ID NO: 23067 - RNA, 23 nt, Homo sapiens
ggaagccaucaagucgcugcagg

SEQ ID NO: 23068 - RNA, 23 nt, Homo sapiens
ggaagccaucaagucgcugcagg

SEQ ID NO: 23069 - RNA, 22 nt, Homo sapiens
caaacaccauugucacacucca

SEQ ID NO: 23070 - RNA, 22 nt, Homo sapiens
ccaucuuuaccagacaguguua

SEQ ID NO: 23071 - RNA, 23 nt, Homo sapiens
cuaucugcacuagaugcaccuua

SEQ ID NO: 23072 - RNA, 23 nt, Homo sapiens
cuaacugcacuagaugcaccuua

SEQ ID NO: 23073 - RNA, 22 nt, Homo sapiens
cccaacaacaugaaacuaccua

SEQ ID NO: 23074 - RNA, 23 nt, Homo sapiens
gaacagguagucugaacacuggg

SEQ ID NO: 23075 - RNA, 23 nt, Homo sapiens
gaacagauagucuaaacacuggg

SEQ ID NO: 23076 - RNA, 22 nt, Homo sapiens
acaucguuaccagacaguguua

SEQ ID NO: 23077 - RNA, 22 nt, Homo sapiens
cagacuccgguggaaugaagga

SEQ ID NO: 23078 - RNA, 22 nt, Homo sapiens
ucagaccgagacaagugcaaug

SEQ ID NO: 23079 - RNA, 22 nt, Homo sapiens
gaauucaucacggccagccucu

SEQ ID NO: 23080 - RNA, 21 nt, Homo sapiens
gaaggaagugagugcagccac

SEQ ID NO: 23081 - RNA, 22 nt, Homo sapiens
ugcuguuagcccuagccccgca

SEQ ID NO: 23082 - RNA, 21 nt, Homo sapiens
cucccccacugcagcuggcac

SEQ ID NO: 23083 - RNA, 21 nt, Homo sapiens
ccccucccagccucccugcca

SEQ ID NO: 23084 - RNA, 22 nt, Homo sapiens
cuagggaacacagggcugguga

SEQ ID NO: 23085 - RNA, 22 nt, Homo sapiens
gugggguggguggucaggccga

SEQ ID NO: 23086 - RNA, 23 nt, Homo sapiens
cggccugauucacaacaccagcu

SEQ ID NO: 23087 - RNA, 23 nt, Homo sapiens
gggagugaagacacggagccaga

SEQ ID NO: 23088 - RNA, 23 nt, Homo sapiens
cuaucugcacuagaugcaccuua

SEQ ID NO: 23089 - RNA, 21 nt, Homo sapiens
gaccaaucgccguccccgccg

SEQ ID NO: 23090 - RNA, 21 nt, Homo sapiens
gaccaaucgccguccccgccg

SEQ ID NO: 23091 - RNA, 22 nt, Homo sapiens
cggugagcacccggccccugcg

SEQ ID NO: 23092 - RNA, 22 nt, Homo sapiens
cagaagugggccgggcacaggg

SEQ ID NO: 23093 - RNA, 20 nt, Homo sapiens
cccgccgcgucgcccugggg

SEQ ID NO: 23094 - RNA, 21 nt, Homo sapiens
ggaaaucccuggcaaugugau

SEQ ID NO: 23095 - RNA, 21 nt, Homo sapiens
gguaaucccuggcaaugugau

SEQ ID NO: 23096 - RNA, 23 nt, Homo sapiens
aaaucagaaucacaccuggggga

SEQ ID NO: 23097 - RNA, 22 nt, Homo sapiens
aguccagauucugugcccacca

SEQ ID NO: 23098 - RNA, 19 nt, Homo sapiens
agaaaccccagcagagaca

SEQ ID NO: 23099 - RNA, 25 nt, Homo sapiens
acggagcugucccaacaccaccccu

SEQ ID NO: 23100 - RNA, 23 nt, Homo sapiens
gucagaccccgagggguccucgc

SEQ ID NO: 23101 - RNA, 22 nt, Homo sapiens
guccaaaguuggggugcugguu

SEQ ID NO: 23102 - RNA, 24 nt, Homo sapiens
acgcagagcccgaaagcccccagu

SEQ ID NO: 23103 - RNA, 22 nt, Homo sapiens
gcacauguucugcggcccacca

SEQ ID NO: 23104 - RNA, 22 nt, Homo sapiens
gcggucccgcggcgccccgccu

SEQ ID NO: 23105 - RNA, 22 nt, Homo sapiens
gcggucccgcggcgccccgccu

SEQ ID NO: 23106 - RNA, 22 nt, Homo sapiens
ugcuguuagcccuagccccgca

SEQ ID NO: 23107 - RNA, 22 nt, Homo sapiens
ucggucccucgggccagggcag

SEQ ID NO: 23108 - RNA, 17 nt, Homo sapiens
gggagaggaggaggcga

SEQ ID NO: 23109 - RNA, 21 nt, Homo sapiens
gaccaaucgccguccccgccg

SEQ ID NO: 23110 - RNA, 20 nt, Homo sapiens
acagcaaggagggcaggagg

SEQ ID NO: 23111 - RNA, 22 nt, Homo sapiens
ucagaccgagacaagugcaaug

SEQ ID NO: 23112 - RNA, 22 nt, Homo sapiens
gaauucaucacggccagccucu

SEQ ID NO: 23113 - RNA, 25 nt, Homo sapiens
accaacggaccuacuucccuccgcc

SEQ ID NO: 23114 - RNA, 22 nt, Homo sapiens
gcggucccgcggcgccccgccu

SEQ ID NO: 23115 - RNA, 22 nt, Homo sapiens
ugcuguuagcccuagccccgca

SEQ ID NO: 23116 - RNA, 22 nt, Homo sapiens
ggaggccgggacgagugcaaua

SEQ ID NO: 23117 - RNA, 20 nt, Homo sapiens
uccgccugucugaacaguga

SEQ ID NO: 23118 - RNA, 20 nt, Homo sapiens
ugucuccacagggcucuuua

SEQ ID NO: 23119 - RNA, 20 nt, Homo sapiens
aguacaucaucuauacugua

SEQ ID NO: 23120 - RNA, 21 nt, Homo sapiens
acaugguuagaucaagcacaa

SEQ ID NO: 23121 - RNA, 22 nt, Homo sapiens
ucaguuuccucugcaaacaguu

SEQ ID NO: 23122 - RNA, 21 nt, Homo sapiens
caaaaaccacaaauaccuuug

SEQ ID NO: 23123 - RNA, 21 nt, Homo sapiens
aaaggccacauccagcaccgu

SEQ ID NO: 23124 - RNA, 18 nt, Homo sapiens
cccccaccaccacgcccg

SEQ ID NO: 23125 - RNA, 23 nt, Homo sapiens
aaaaugcagauuccuggacucca

SEQ ID NO: 23126 - RNA, 23 nt, Homo sapiens
gggagugaagacacggagccaga

SEQ ID NO: 23127 - RNA, 22 nt, Homo sapiens
gauagagugcagaccagggucu

SEQ ID NO: 23128 - RNA, 23 nt, Homo sapiens
gcacaugugcacacagccgggug

SEQ ID NO: 23129 - RNA, 22 nt, Homo sapiens
ucaggaacugccuuucucucca

SEQ ID NO: 23130 - RNA, 23 nt, Homo sapiens
cccaacagacauggcgguacuca

SEQ ID NO: 23131 - RNA, 20 nt, Homo sapiens
cccgccgcgucgcccugggg

SEQ ID NO: 23132 - RNA, 22 nt, Homo sapiens
ucagccgcugucacacgcacag

SEQ ID NO: 23133 - RNA, 25 nt, Homo sapiens
acggagcugucccaacaccaccccu

SEQ ID NO: 23134 - RNA, 23 nt, Homo sapiens
acagcgcucgcaaccgcagcgau

SEQ ID NO: 23135 - RNA, 22 nt, Homo sapiens
ccucaggcacggccgggccacc

SEQ ID NO: 23136 - RNA, 23 nt, Homo sapiens
cacugugggcccucuccgcacca

SEQ ID NO: 23137 - RNA, 17 nt, Homo sapiens
uggaggccccagcgaga

SEQ ID NO: 23138 - RNA, 20 nt, Homo sapiens
uccccacagacccagagccg

SEQ ID NO: 23139 - RNA, 21 nt, Homo sapiens
aagggucaguaagcacccgcg

SEQ ID NO: 23140 - RNA, 23 nt, Homo sapiens
ccgcuugagcuaacuccgacccg

SEQ ID NO: 23141 - RNA, 20 nt, Homo sapiens
cugcgggaggacagggcuca

SEQ ID NO: 23142 - RNA, 22 nt, Homo sapiens
uccggggacgaacgggacgggu

SEQ ID NO: 23143 - RNA, 22 nt, Homo sapiens
uccggggacgaacgggacgggu

SEQ ID NO: 23144 - RNA, 19 nt, Homo sapiens
cagcaucagcagcaucauc

SEQ ID NO: 23145 - RNA, 18 nt, Homo sapiens
auucaaucuacugccuca

SEQ ID NO: 23146 - RNA, 22 nt, Homo sapiens
ugagccacugugccuggccuga

SEQ ID NO: 23147 - RNA, 21 nt, Homo sapiens
gaccaagaaauagccuuucaa

SEQ ID NO: 23148 - RNA, 22 nt, Homo sapiens
ccucauggaaggguuccccacu

SEQ ID NO: 23149 - RNA, 22 nt, Homo sapiens
aaagugcuucuuaccuccagau

SEQ ID NO: 23150 - RNA, 22 nt, Homo sapiens
caagacacauuuggagagggac

SEQ ID NO: 23151 - RNA, 21 nt, Homo sapiens
guccugagagcgcugccuccu

SEQ ID NO: 23152 - RNA, 23 nt, Homo sapiens
uguaggcuggggauaaaugaaua

SEQ ID NO: 23153 - RNA, 20 nt, Homo sapiens
uccccacagacccagagccg

SEQ ID NO: 23154 - RNA, 22 nt, Homo sapiens
ggaggccgggacgagugcaaua

SEQ ID NO: 23155 - RNA, 22 nt, Homo sapiens
ggaggccgggacgagugcaaua

SEQ ID NO: 23156 - RNA, 22 nt, Homo sapiens
caaacaccauugucacacucca

SEQ ID NO: 23157 - RNA, 24 nt, Homo sapiens
acugcaggcuccagcuuccaggcu

SEQ ID NO: 23158 - RNA, 23 nt, Homo sapiens
gggagugaagacacggagccaga

SEQ ID NO: 23159 - RNA, 22 nt, Homo sapiens
cacugguacaaggguugggaga

SEQ ID NO: 23160 - RNA, 23 nt, Homo sapiens
cccaacagacauggcgguacuca

SEQ ID NO: 23161 - RNA, 22 nt, Homo sapiens
agcugaguguaggauguuuaca

SEQ ID NO: 23162 - RNA, 22 nt, Homo sapiens
aaucagucucauugcuuuauaa

SEQ ID NO: 23163 - RNA, 19 nt, Homo sapiens
agaaaccccagcagagaca

SEQ ID NO: 23164 - RNA, 19 nt, Homo sapiens
agaaaccccagcagagaca

SEQ ID NO: 23165 - RNA, 25 nt, Homo sapiens
acggagcugucccaacaccaccccu

SEQ ID NO: 23166 - RNA, 22 nt, Homo sapiens
agcucagaacccagaggucuca

SEQ ID NO: 23167 - RNA, 20 nt, Homo sapiens
uacugcuuccacagcucccc

SEQ ID NO: 23168 - RNA, 21 nt, Homo sapiens
ggggagcgggggcccugccuu

SEQ ID NO: 23169 - RNA, 22 nt, Homo sapiens
ucucucccauuagaguugaaaa

SEQ ID NO: 23170 - RNA, 18 nt, Homo sapiens
aucacauucaccucccug

SEQ ID NO: 23171 - RNA, 23 nt, Homo sapiens
agggauuccugggaaaacuggac

SEQ ID NO: 23172 - RNA, 23 nt, Homo sapiens
gggagugaagacacggagccaga

SEQ ID NO: 23173 - RNA, 21 nt, Homo sapiens
ccucaaggagcuucagucuag

SEQ ID NO: 23174 - RNA, 22 nt, Homo sapiens
ugcaacuuaguaaugugcaaua

SEQ ID NO: 23175 - RNA, 22 nt, Homo sapiens
aaagagguuaaccagguguguu

SEQ ID NO: 23176 - RNA, 22 nt, Homo sapiens
ugaauccuugaauagguguguu

SEQ ID NO: 23177 - RNA, 22 nt, Homo sapiens
uacagauggauaccgugcaauu

SEQ ID NO: 23178 - RNA, 20 nt, Homo sapiens
uaugaacaauuucuaggaau

SEQ ID NO: 23179 - RNA, 23 nt, Homo sapiens
ccuucucagaaaggugaaauuua

SEQ ID NO: 23180 - RNA, 20 nt, Homo sapiens
guguguauacauuuauacau

SEQ ID NO: 23181 - RNA, 21 nt, Homo sapiens
caguagagauuguuucaacac

SEQ ID NO: 23182 - RNA, 22 nt, Homo sapiens
cucauccgauguacaauaauuu

SEQ ID NO: 23183 - RNA, 22 nt, Homo sapiens
cugggggcggcacaggggcuca

SEQ ID NO: 23184 - RNA, 24 nt, Homo sapiens
acugcaggcuccagcuuccaggcu

SEQ ID NO: 23185 - RNA, 17 nt, Homo sapiens
gggagaggaggaggcga

SEQ ID NO: 23186 - RNA, 22 nt, Homo sapiens
acaccuggcuccacacgcgggc

SEQ ID NO: 23187 - RNA, 22 nt, Homo sapiens
ucagaccgagacaagugcaaug

SEQ ID NO: 23188 - RNA, 22 nt, Homo sapiens
cucaauagacugugagcuccuu

SEQ ID NO: 23189 - RNA, 21 nt, Homo sapiens
ggacuauagaacuuucccccu

SEQ ID NO: 23190 - RNA, 25 nt, Homo sapiens
accaacggaccuacuucccuccgcc

SEQ ID NO: 23191 - RNA, 23 nt, Homo sapiens
cccagcuagauuguaagcuccuu

SEQ ID NO: 23192 - RNA, 22 nt, Homo sapiens
ugcuguuagcccuagccccgca

SEQ ID NO: 23193 - RNA, 21 nt, Homo sapiens
caucaccuuccuucuccucca

SEQ ID NO: 23194 - RNA, 18 nt, Homo sapiens
aucacauucaccucccug

SEQ ID NO: 23195 - RNA, 23 nt, Homo sapiens
gggagugaagacacggagccaga

SEQ ID NO: 23196 - RNA, 18 nt, Homo sapiens
auucaaucuacugccuca

SEQ ID NO: 23197 - RNA, 22 nt, Homo sapiens
gcuggguggagaagguggugaa

SEQ ID NO: 23198 - RNA, 22 nt, Homo sapiens
ugggguauuugacaaacugaca

SEQ ID NO: 23199 - RNA, 22 nt, Homo sapiens
gcacacaauaaauguuugcuga

SEQ ID NO: 23200 - RNA, 21 nt, Homo sapiens
aguucucccaacguaaaccca

SEQ ID NO: 23201 - RNA, 22 nt, Homo sapiens
caagacacauuuggagagggac

SEQ ID NO: 23202 - RNA, 21 nt, Homo sapiens
guccugagagcgcugccuccu

SEQ ID NO: 23203 - RNA, 21 nt, Homo sapiens
caucaccuuccuucuccucca

SEQ ID NO: 23204 - RNA, 21 nt, Homo sapiens
ugacugacagcuuuuugagua

SEQ ID NO: 23205 - RNA, 20 nt, Homo sapiens
ggggcagacagacgaggaag

SEQ ID NO: 23206 - RNA, 18 nt, Homo sapiens
cccccaccaccacgcccg

SEQ ID NO: 23207 - RNA, 17 nt, Homo sapiens
ggguggcagcgguggga

SEQ ID NO: 23208 - RNA, 17 nt, Homo sapiens
gggagaggaggaggcga

SEQ ID NO: 23209 - RNA, 19 nt, Homo sapiens
uaugcuaccuuugcacggu

SEQ ID NO: 23210 - RNA, 21 nt, Homo sapiens
caugcacaugcacacauacau

SEQ ID NO: 23211 - RNA, 21 nt, Homo sapiens
uucuaggauaggcccaggggc

SEQ ID NO: 23212 - RNA, 22 nt, Homo sapiens
aguccagauucugugcccacca

SEQ ID NO: 23213 - RNA, 22 nt, Homo sapiens
gcacauguucugcggcccacca

SEQ ID NO: 23214 - RNA, 23 nt, Homo sapiens
ccuagagagggugagaaccugcc

SEQ ID NO: 23215 - RNA, 21 nt, Homo sapiens
ggggagcgggggcccugccuu

SEQ ID NO: 23216 - RNA, 22 nt, Homo sapiens
uaaaugaauucaauuuccuucu

SEQ ID NO: 23217 - RNA, 24 nt, Homo sapiens
acugcuggucuucagucagggcca

SEQ ID NO: 23218 - RNA, 24 nt, Homo sapiens
acugcuggucuucagucagggcca

SEQ ID NO: 23219 - RNA, 22 nt, Homo sapiens
agaaaaugccccucaguuuuga

SEQ ID NO: 23220 - RNA, 22 nt, Homo sapiens
ccagaacugaguccacagggca

SEQ ID NO: 23221 - RNA, 22 nt, Homo sapiens
agucuucacaacagcccugugu

SEQ ID NO: 23222 - RNA, 22 nt, Homo sapiens
acaaccagcuaagacacugcca

SEQ ID NO: 23223 - RNA, 23 nt, Homo sapiens
gcaaucagcuaacuacacugccu

SEQ ID NO: 23224 - RNA, 22 nt, Homo sapiens
cacuuagcagguuguauuauau

SEQ ID NO: 23225 - RNA, 22 nt, Homo sapiens
accagcuaacaauacacugcca

SEQ ID NO: 23226 - RNA, 22 nt, Homo sapiens
gccagcuaacaauacacugccu

SEQ ID NO: 23227 - RNA, 22 nt, Homo sapiens
gcaaaaguaauugccaguuuug

SEQ ID NO: 23228 - RNA, 22 nt, Homo sapiens
ugcaaaaguagucucaguuuuu

SEQ ID NO: 23229 - RNA, 19 nt, Homo sapiens
aaaaguaauuacaguuuuu

SEQ ID NO: 23230 - RNA, 22 nt, Homo sapiens
gcaaaaguaacugcaguuuugg

SEQ ID NO: 23231 - RNA, 22 nt, Homo sapiens
aaagacguggagaaauuagaau

SEQ ID NO: 23232 - RNA, 22 nt, Homo sapiens
uggugauucacaaagaaaucca

SEQ ID NO: 23233 - RNA, 23 nt, Homo sapiens
gucacaucccucccaagacccuc

SEQ ID NO: 23234 - RNA, 22 nt, Homo sapiens
aacaacacuugaccacauccug

SEQ ID NO: 23235 - RNA, 18 nt, Homo sapiens
aucacauucaccucccug

SEQ ID NO: 23236 - RNA, 21 nt, Homo sapiens
ggcugucaauucauaggucag

SEQ ID NO: 23237 - RNA, 18 nt, Homo sapiens
augacaccucccugugaa

SEQ ID NO: 23238 - RNA, 22 nt, Homo sapiens
aaagugcuucuuaccuccagau

SEQ ID NO: 23239 - RNA, 23 nt, Homo sapiens
acacucuaaagagaagcgcuuug

SEQ ID NO: 23240 - RNA, 21 nt, Homo sapiens
agaaaguacuucccucuggag

SEQ ID NO: 23241 - RNA, 21 nt, Homo sapiens
agaaagugcaucccucuggag

SEQ ID NO: 23242 - RNA, 21 nt, Homo sapiens
caucaccuuccuucuccucca

SEQ ID NO: 23243 - RNA, 21 nt, Homo sapiens
cuggaggacggcaacagucag

SEQ ID NO: 23244 - RNA, 22 nt, Homo sapiens
cacaaguucggaucuacggguu

SEQ ID NO: 23245 - RNA, 22 nt, Homo sapiens
cacaaguucggaucuacggguu

SEQ ID NO: 23246 - RNA, 21 nt, Homo sapiens
auaauggagaccaggccacga

SEQ ID NO: 23247 - RNA, 22 nt, Homo sapiens
gugggguggguggucaggccga

SEQ ID NO: 23248 - RNA, 22 nt, Homo sapiens
cuggagagacaaggggaagagg

SEQ ID NO: 23249 - RNA, 22 nt, Homo sapiens
aucagagcccucugagcuucag

SEQ ID NO: 23250 - RNA, 19 nt, Homo sapiens
cagcaucagcagcaucauc

SEQ ID NO: 23251 - RNA, 18 nt, Homo sapiens
auucaaucuacugccuca

SEQ ID NO: 23252 - RNA, 18 nt, Homo sapiens
auucaaucuacugccuca

SEQ ID NO: 23253 - RNA, 22 nt, Homo sapiens
uucacacugcaugcucugggua

SEQ ID NO: 23254 - RNA, 20 nt, Homo sapiens
cuggaggaagggcccagagg

SEQ ID NO: 23255 - RNA, 22 nt, Homo sapiens
gccuaagacacaggcccagaga

SEQ ID NO: 23256 - RNA, 22 nt, Homo sapiens
gaauucaucacggccagccucu

SEQ ID NO: 23257 - RNA, 22 nt, Homo sapiens
ccucauggaaggguuccccacu

SEQ ID NO: 23258 - RNA, 25 nt, Homo sapiens
acggagcugucccaacaccaccccu

SEQ ID NO: 23259 - RNA, 21 nt, Homo sapiens
guccugagagcgcugccuccu

SEQ ID NO: 23260 - RNA, 21 nt, Homo sapiens
caucaccuuccuucuccucca

SEQ ID NO: 23261 - RNA, 20 nt, Homo sapiens
cccugcgccaucuccucuac

SEQ ID NO: 23262 - RNA, 20 nt, Homo sapiens
uacugcuuccacagcucccc

SEQ ID NO: 23263 - RNA, 17 nt, Homo sapiens
gggagaggaggaggcga

SEQ ID NO: 23264 - RNA, 18 nt, Homo sapiens
aucacauucaccucccug

SEQ ID NO: 23265 - RNA, 23 nt, Homo sapiens
gggagugaagacacggagccaga

SEQ ID NO: 23266 - RNA, 21 nt, Homo sapiens
gaccaaucgccguccccgccg

SEQ ID NO: 23267 - RNA, 22 nt, Homo sapiens
ucagaccgagacaagugcaaug

SEQ ID NO: 23268 - RNA, 21 nt, Homo sapiens
aucugcacugucagcacuuua

SEQ ID NO: 23269 - RNA, 23 nt, Homo sapiens
gcuuugacaauaucauugcacug

SEQ ID NO: 23270 - RNA, 22 nt, Homo sapiens
gcggucccgcggcgccccgccu

SEQ ID NO: 23271 - RNA, 22 nt, Homo sapiens
ugcuguuagcccuagccccgca

SEQ ID NO: 23272 - RNA, 21 nt, Homo sapiens
caucaccuuccuucuccucca

SEQ ID NO: 23273 - RNA, 20 nt, Homo sapiens
cugcgggaggacagggcuca

SEQ ID NO: 23274 - RNA, 22 nt, Homo sapiens
ccagaacugaguccacagggca

SEQ ID NO: 23275 - RNA, 22 nt, Homo sapiens
agcccaaaaggagaauucuuug

SEQ ID NO: 23276 - RNA, 22 nt, Homo sapiens
uggcagcagcggagggggcaga

SEQ ID NO: 23277 - RNA, 20 nt, Homo sapiens
cccgccgcgucgcccugggg

SEQ ID NO: 23278 - RNA, 20 nt, Homo sapiens
acauuacuguuaucaaaaca

SEQ ID NO: 23279 - RNA, 22 nt, Homo sapiens
agucuucacaacagcccugugu

SEQ ID NO: 23280 - RNA, 22 nt, Homo sapiens
ugggguauuugacaaacugaca

SEQ ID NO: 23281 - RNA, 20 nt, Homo sapiens
ccagcagcaccuggggcagu

SEQ ID NO: 23282 - RNA, 22 nt, Homo sapiens
aaagagguuaaccagguguguu

SEQ ID NO: 23283 - RNA, 21 nt, Homo sapiens
uucuaggauaggcccaggggc

SEQ ID NO: 23284 - RNA, 22 nt, Homo sapiens
ugaauccuugaauagguguguu

SEQ ID NO: 23285 - RNA, 21 nt, Homo sapiens
auccuguacugagcugccccg

SEQ ID NO: 23286 - RNA, 22 nt, Homo sapiens
aagaagugcaccauguuuguuu

SEQ ID NO: 23287 - RNA, 22 nt, Homo sapiens
gcaaaaguaauugagauuuuug

SEQ ID NO: 23288 - RNA, 21 nt, Homo sapiens
cugaaaccaaguaugggucgc

SEQ ID NO: 23289 - RNA, 21 nt, Homo sapiens
aguucucccaacguaaaccca

SEQ ID NO: 23290 - RNA, 20 nt, Homo sapiens
acaaugagaacccauggucu

SEQ ID NO: 23291 - RNA, 22 nt, Homo sapiens
caaacaccauugucacacucca

SEQ ID NO: 23292 - RNA, 20 nt, Homo sapiens
uccccacagacccagagccg

SEQ ID NO: 23293 - RNA, 22 nt, Homo sapiens
cuggagagacaaggggaagagg

SEQ ID NO: 23294 - RNA, 23 nt, Homo sapiens
gggagugaagacacggagccaga

SEQ ID NO: 23295 - RNA, 21 nt, Homo sapiens
gaccaaucgccguccccgccg

SEQ ID NO: 23296 - RNA, 22 nt, Homo sapiens
cagcauggaguccuccagguug

SEQ ID NO: 23297 - RNA, 21 nt, Homo sapiens
ggacuauagaacuuucccccu

SEQ ID NO: 23298 - RNA, 22 nt, Homo sapiens
gcggucccgcggcgccccgccu

SEQ ID NO: 23299 - RNA, 20 nt, Homo sapiens
cccugcgccaucuccucuac

SEQ ID NO: 23300 - RNA, 17 nt, Homo sapiens
gggagaggaggaggcga

SEQ ID NO: 23301 - RNA, 23 nt, Homo sapiens
gggagugaagacacggagccaga

SEQ ID NO: 23302 - RNA, 20 nt, Homo sapiens
acagcaaggagggcaggagg

SEQ ID NO: 23303 - RNA, 21 nt, Homo sapiens
acaugguuagaucaagcacaa

SEQ ID NO: 23304 - RNA, 21 nt, Homo sapiens
aagugucagacacgguggugg

SEQ ID NO: 23305 - RNA, 21 nt, Homo sapiens
ucaaucacagauagcaccccu

SEQ ID NO: 23306 - RNA, 23 nt, Homo sapiens
cacugugggcccucuccgcacca

SEQ ID NO: 23307 - RNA, 21 nt, Homo sapiens
aacauacaaaggguauccucu

SEQ ID NO: 23308 - RNA, 17 nt, Homo sapiens
ggguggcagcgguggga

SEQ ID NO: 23309 - RNA, 18 nt, Homo sapiens
aucacauucaccucccug

SEQ ID NO: 23310 - RNA, 22 nt, Homo sapiens
agcugaguguaggauguuuaca

SEQ ID NO: 23311 - RNA, 23 nt, Homo sapiens
acugaggggccucagaccgagcu

SEQ ID NO: 23312 - RNA, 23 nt, Homo sapiens
ccacccaaugaccuacuccaaga

SEQ ID NO: 23313 - RNA, 21 nt, Homo sapiens
ggacuauagaacuuucccccu

SEQ ID NO: 23314 - RNA, 22 nt, Homo sapiens
caaacaccauugucacacucca

SEQ ID NO: 23315 - RNA, 21 nt, Homo sapiens
gaccaaucgccguccccgccg

SEQ ID NO: 23316 - RNA, 22 nt, Homo sapiens
acaucguuaccagacaguguua

SEQ ID NO: 23317 - RNA, 22 nt, Homo sapiens
ucaucauuaccaggcaguauua

SEQ ID NO: 23318 - RNA, 23 nt, Homo sapiens
aaaucagaaucacaccuggggga

SEQ ID NO: 23319 - RNA, 22 nt, Homo sapiens
gauuccaauuuuuccacaucuu

SEQ ID NO: 23320 - RNA, 24 nt, Homo sapiens
acgcagagcccgaaagcccccagu

SEQ ID NO: 23321 - RNA, 21 nt, Homo sapiens
gaaggaagugagugcagccac

SEQ ID NO: 23322 - RNA, 22 nt, Homo sapiens
gcggucccgcggcgccccgccu

SEQ ID NO: 23323 - RNA, 22 nt, Homo sapiens
ugcuguuagcccuagccccgca

SEQ ID NO: 23324 - RNA, 23 nt, Homo sapiens
ggaagccaucaagucgcugcagg

SEQ ID NO: 23325 - RNA, 17 nt, Homo sapiens
gggagaggaggaggcga

SEQ ID NO: 23326 - RNA, 17 nt, Homo sapiens
gggagaggaggaggcga

SEQ ID NO: 23327 - RNA, 24 nt, Homo sapiens
gaagucacucccaggcagcugcaa

SEQ ID NO: 23328 - RNA, 18 nt, Homo sapiens
caccaccagagccaacgu

SEQ ID NO: 23329 - RNA, 23 nt, Homo sapiens
gggagugaagacacggagccaga

SEQ ID NO: 23330 - RNA, 22 nt, Homo sapiens
uggcagcagcggagggggcaga

SEQ ID NO: 23331 - RNA, 20 nt, Homo sapiens
acagcaaggagggcaggagg

SEQ ID NO: 23332 - RNA, 20 nt, Homo sapiens
ccagcagcaccuggggcagu

SEQ ID NO: 23333 - RNA, 23 nt, Homo sapiens
aaagucucgcucucugccccuca

SEQ ID NO: 23334 - RNA, 21 nt, Homo sapiens
auccuguacugagcugccccg

SEQ ID NO: 23335 - RNA, 22 nt, Homo sapiens
gaacuugcuaaaaaugcagaau

SEQ ID NO: 23336 - RNA, 19 nt, Homo sapiens
guugggaucacaggcgccc

SEQ ID NO: 23337 - RNA, 19 nt, Homo sapiens
gccucagaggcagcugcuu

SEQ ID NO: 23338 - RNA, 22 nt, Homo sapiens
ugcuguuagcccuagccccgca

SEQ ID NO: 23339 - RNA, 22 nt, Homo sapiens
auccuucuacaaauucacccau

SEQ ID NO: 23340 - RNA, 18 nt, Homo sapiens
aucacauucaccucccug

SEQ ID NO: 23341 - RNA, 23 nt, Homo sapiens
gggagugaagacacggagccaga

SEQ ID NO: 23342 - RNA, 22 nt, Homo sapiens
uaaccgauuucagauggugcua

SEQ ID NO: 23343 - RNA, 22 nt, Homo sapiens
gcaaaaguaauugagauuuuug

SEQ ID NO: 23344 - RNA, 20 nt, Homo sapiens
guguguauacauuuauacau

SEQ ID NO: 23345 - RNA, 21 nt, Homo sapiens
guaaugggaccuuccucuuug

SEQ ID NO: 23346 - RNA, 23 nt, Homo sapiens
acccaacagccccugcaagggau

SEQ ID NO: 23347 - RNA, 22 nt, Homo sapiens
ucaggaacugccuuucucucca

SEQ ID NO: 23348 - RNA, 21 nt, Homo sapiens
gaccaaucgccguccccgccg

SEQ ID NO: 23349 - RNA, 20 nt, Homo sapiens
acagcaaggagggcaggagg

SEQ ID NO: 23350 - RNA, 23 nt, Homo sapiens
aaaucagaaucacaccuggggga

SEQ ID NO: 23351 - RNA, 23 nt, Homo sapiens
aaagucucgcucucugccccuca

SEQ ID NO: 23352 - RNA, 22 nt, Homo sapiens
aaagugcuucuuaccuccagau

SEQ ID NO: 23353 - RNA, 24 nt, Homo sapiens
acgcagagcccgaaagcccccagu

SEQ ID NO: 23354 - RNA, 22 nt, Homo sapiens
gcggucccgcggcgccccgccu

SEQ ID NO: 23355 - RNA, 22 nt, Homo sapiens
ugcuguuagcccuagccccgca

SEQ ID NO: 23356 - RNA, 21 nt, Homo sapiens
caucaccuuccuucuccucca

SEQ ID NO: 23357 - RNA, 22 nt, Homo sapiens
cugggggcggcacaggggcuca

SEQ ID NO: 23358 - RNA, 22 nt, Homo sapiens
uaaaugaauucaauuuccuucu

SEQ ID NO: 23359 - RNA, 21 nt, Homo sapiens
ugcaggcugaucuucuucucu

SEQ ID NO: 23360 - RNA, 22 nt, Homo sapiens
aacccauggaauucaguucuca

SEQ ID NO: 23361 - RNA, 18 nt, Homo sapiens
auucaaucuacugccuca

SEQ ID NO: 23362 - RNA, 22 nt, Homo sapiens
uucacacugcaugcucugggua

SEQ ID NO: 23363 - RNA, 21 nt, Homo sapiens
gugacagagccaagcacaaau

SEQ ID NO: 23364 - RNA, 22 nt, Homo sapiens
ucacauuugccugcagagauuu

SEQ ID NO: 23365 - RNA, 22 nt, Homo sapiens
ggagagccuccacccaacccuc

SEQ ID NO: 23366 - RNA, 20 nt, Homo sapiens
cuggaggaagggcccagagg

SEQ ID NO: 23367 - RNA, 22 nt, Homo sapiens
gccuaagacacaggcccagaga

SEQ ID NO: 23368 - RNA, 23 nt, Homo sapiens
agaggcaggcaugcgggcagaca

SEQ ID NO: 23369 - RNA, 20 nt, Homo sapiens
uaugaacaauuucuaggaau

SEQ ID NO: 23370 - RNA, 22 nt, Homo sapiens
gaacuugcuaaaaaugcagaau

SEQ ID NO: 23371 - RNA, 22 nt, Homo sapiens
cucagagcagacgugguucuca

SEQ ID NO: 23372 - RNA, 22 nt, Homo sapiens
caagacacauuuggagagggac

SEQ ID NO: 23373 - RNA, 21 nt, Homo sapiens
guccugagagcgcugccuccu

SEQ ID NO: 23374 - RNA, 20 nt, Homo sapiens
cucaaagcaaacccugcaga

SEQ ID NO: 23375 - RNA, 20 nt, Homo sapiens
cucaaagcaaacccugcaga

SEQ ID NO: 23376 - RNA, 22 nt, Homo sapiens
uccggggacgaacgggacgggu

SEQ ID NO: 23377 - RNA, 24 nt, Homo sapiens
acugcaggcuccagcuuccaggcu

SEQ ID NO: 23378 - RNA, 22 nt, Homo sapiens
ccaguagcacggcucaguccag

SEQ ID NO: 23379 - RNA, 21 nt, Homo sapiens
agggcucaucuugguccugca

SEQ ID NO: 23380 - RNA, 24 nt, Homo sapiens
gaaagugcauagaauucugucugg

SEQ ID NO: 23381 - RNA, 22 nt, Homo sapiens
uagcagaagcauuuccgcacac

SEQ ID NO: 23382 - RNA, 22 nt, Homo sapiens
acugccugucugugccugcugu

SEQ ID NO: 23383 - RNA, 21 nt, Homo sapiens
acaugguuagaucaagcacaa

SEQ ID NO: 23384 - RNA, 21 nt, Homo sapiens
accuauccugaauuacuugaa

SEQ ID NO: 23385 - RNA, 22 nt, Homo sapiens
acaaccagcuaagacacugcca

SEQ ID NO: 23386 - RNA, 22 nt, Homo sapiens
auggcaguggaguuagugauug

SEQ ID NO: 23387 - RNA, 23 nt, Homo sapiens
gcaaucagcuaacuacacugccu

SEQ ID NO: 23388 - RNA, 24 nt, Homo sapiens
acucacaccuagguuccaaggauu

SEQ ID NO: 23389 - RNA, 22 nt, Homo sapiens
accagguuccaccccagcaggc

SEQ ID NO: 23390 - RNA, 21 nt, Homo sapiens
ccuucugacuccaaguccagu

SEQ ID NO: 23391 - RNA, 22 nt, Homo sapiens
agccacaaucaccuucugaucu

SEQ ID NO: 23392 - RNA, 22 nt, Homo sapiens
gccuucugacccuaaguccagu

SEQ ID NO: 23393 - RNA, 22 nt, Homo sapiens
accagcuaacaauacacugcca

SEQ ID NO: 23394 - RNA, 22 nt, Homo sapiens
gccagcuaacaauacacugccu

SEQ ID NO: 23395 - RNA, 21 nt, Homo sapiens
guguauaugcccauggacugc

SEQ ID NO: 23396 - RNA, 19 nt, Homo sapiens
aagacauuuucagacagcu

SEQ ID NO: 23397 - RNA, 23 nt, Homo sapiens
ugcgggcgggacgagcaagcaca

SEQ ID NO: 23398 - RNA, 20 nt, Homo sapiens
uccccacagacccagagccg

SEQ ID NO: 23399 - RNA, 22 nt, Homo sapiens
gcacaaaucuccagaccaccca

SEQ ID NO: 23400 - RNA, 18 nt, Homo sapiens
aucacauucaccucccug

SEQ ID NO: 23401 - RNA, 23 nt, Homo sapiens
gggagugaagacacggagccaga

SEQ ID NO: 23402 - RNA, 22 nt, Homo sapiens
ucaggaacugccuuucucucca

SEQ ID NO: 23403 - RNA, 22 nt, Homo sapiens
cagaagugggccgggcacaggg

SEQ ID NO: 23404 - RNA, 21 nt, Homo sapiens
acccaguagccagauguagcu

SEQ ID NO: 23405 - RNA, 20 nt, Homo sapiens
ugggccaccgccgagcggac

SEQ ID NO: 23406 - RNA, 25 nt, Homo sapiens
acggagcugucccaacaccaccccu

SEQ ID NO: 23407 - RNA, 21 nt, Homo sapiens
ggacuauagaacuuucccccu

SEQ ID NO: 23408 - RNA, 25 nt, Homo sapiens
accaacggaccuacuucccuccgcc

SEQ ID NO: 23409 - RNA, 21 nt, Homo sapiens
caucaccuuccuucuccucca

SEQ ID NO: 23410 - RNA, 23 nt, Homo sapiens
cacaaauucggaucuacagggua

SEQ ID NO: 23411 - RNA, 23 nt, Homo sapiens
cacaaauucgguucuacagggua

SEQ ID NO: 23412 - RNA, 21 nt, Homo sapiens
ccccucccagccucccugcca

SEQ ID NO: 23413 - RNA, 22 nt, Homo sapiens
cuggagagacaaggggaagagg

SEQ ID NO: 23414 - RNA, 20 nt, Homo sapiens
ggggcagacagacgaggaag

SEQ ID NO: 23415 - RNA, 25 nt, Homo sapiens
aagaaagagucuugcuuugucgccc

SEQ ID NO: 23416 - RNA, 22 nt, Homo sapiens
ggagcccgcgccccgcgccgag

SEQ ID NO: 23417 - RNA, 18 nt, Homo sapiens
auucaaucuacugccuca

SEQ ID NO: 23418 - RNA, 22 nt, Homo sapiens
cagaagugggccgggcacaggg

SEQ ID NO: 23419 - RNA, 22 nt, Homo sapiens
cccaacaacaggaaacuaccua

SEQ ID NO: 23420 - RNA, 23 nt, Homo sapiens
cgugagcuccuggaggacaggga

SEQ ID NO: 23421 - RNA, 22 nt, Homo sapiens
acaaccagcuaagacacugcca

SEQ ID NO: 23422 - RNA, 22 nt, Homo sapiens
auggcaguggaguuagugauug

SEQ ID NO: 23423 - RNA, 23 nt, Homo sapiens
gcaaucagcuaacuacacugccu

SEQ ID NO: 23424 - RNA, 22 nt, Homo sapiens
uacagauggauaccgugcaauu

SEQ ID NO: 23425 - RNA, 23 nt, Homo sapiens
aaagucucgcucucugccccuca

SEQ ID NO: 23426 - RNA, 23 nt, Homo sapiens
ucaacgggagugaucgugucauu

SEQ ID NO: 23427 - RNA, 22 nt, Homo sapiens
accagcuaacaauacacugcca

SEQ ID NO: 23428 - RNA, 22 nt, Homo sapiens
gccagcuaacaauacacugccu

SEQ ID NO: 23429 - RNA, 25 nt, Homo sapiens
acggagcugucccaacaccaccccu

SEQ ID NO: 23430 - RNA, 21 nt, Homo sapiens
guccugagagcgcugccuccu

SEQ ID NO: 23431 - RNA, 22 nt, Homo sapiens
gcugaggcuguggggcuggagu

SEQ ID NO: 23432 - RNA, 20 nt, Homo sapiens
cccugcgccaucuccucuac

SEQ ID NO: 23433 - RNA, 21 nt, Homo sapiens
cucccccacugcagcuggcac

SEQ ID NO: 23434 - RNA, 22 nt, Homo sapiens
ccacacacuuccuuacauucca

SEQ ID NO: 23435 - RNA, 22 nt, Homo sapiens
cagaagugggccgggcacaggg

SEQ ID NO: 23436 - RNA, 19 nt, Homo sapiens
guugggaucacaggcgccc

SEQ ID NO: 23437 - RNA, 22 nt, Homo sapiens
gauccgagcaccggggaccccc

SEQ ID NO: 23438 - RNA, 24 nt, Homo sapiens
acgcgcaggccagagacccaggca

SEQ ID NO: 23439 - RNA, 22 nt, Homo sapiens
cuggagagacaaggggaagagg

SEQ ID NO: 23440 - RNA, 17 nt, Homo sapiens
uggcgcccgaacaggga

SEQ ID NO: 23441 - RNA, 19 nt, Homo sapiens
ucccugauccaaaaaucca

SEQ ID NO: 23442 - RNA, 22 nt, Homo sapiens
augcccuuuuaacauugcacug

SEQ ID NO: 23443 - RNA, 22 nt, Homo sapiens
ccagaacugaguccacagggca

SEQ ID NO: 23444 - RNA, 22 nt, Homo sapiens
cagaaagugcuucccucuagag

SEQ ID NO: 23445 - RNA, 22 nt, Homo sapiens
uccacauggaguugcuguuaca

SEQ ID NO: 23446 - RNA, 21 nt, Homo sapiens
ggaaaucccuggcaaugugau

SEQ ID NO: 23447 - RNA, 21 nt, Homo sapiens
gguaaucccuggcaaugugau

SEQ ID NO: 23448 - RNA, 22 nt, Homo sapiens
cuuccagucgaggauguuuaca

SEQ ID NO: 23449 - RNA, 22 nt, Homo sapiens
agcugaguguaggauguuuaca

SEQ ID NO: 23450 - RNA, 23 nt, Homo sapiens
gcugagaguguaggauguuuaca

SEQ ID NO: 23451 - RNA, 22 nt, Homo sapiens
cuuccagucggggauguuuaca

SEQ ID NO: 23452 - RNA, 22 nt, Homo sapiens
cuuccagucaaggauguuuaca

SEQ ID NO: 23453 - RNA, 22 nt, Homo sapiens
gaauucaucacggccagccucu

SEQ ID NO: 23454 - RNA, 22 nt, Homo sapiens
gagguuucccguguauguuuca

SEQ ID NO: 23455 - RNA, 22 nt, Homo sapiens
gcaaaaguaauugagauuuuug

SEQ ID NO: 23456 - RNA, 23 nt, Homo sapiens
aggagaaggcaccaugggauuua

SEQ ID NO: 23457 - RNA, 20 nt, Homo sapiens
cccugcgccaucuccucuac

SEQ ID NO: 23458 - RNA, 22 nt, Homo sapiens
guaccccuggagauucugauaa

SEQ ID NO: 23459 - RNA, 22 nt, Homo sapiens
cacuuaucagguuguauuauaa

SEQ ID NO: 23460 - RNA, 22 nt, Homo sapiens
ccucaggcacggccgggccacc

SEQ ID NO: 23461 - RNA, 22 nt, Homo sapiens
cuggagagacaaggggaagagg

SEQ ID NO: 23462 - RNA, 24 nt, Homo sapiens
gaaagugcauagaauucugucugg

SEQ ID NO: 23463 - RNA, 22 nt, Homo sapiens
acugccugucugugccugcugu

SEQ ID NO: 23464 - RNA, 22 nt, Homo sapiens
cuuccagucgaggauguuuaca

SEQ ID NO: 23465 - RNA, 22 nt, Homo sapiens
agcugaguguaggauguuuaca

SEQ ID NO: 23466 - RNA, 23 nt, Homo sapiens
gcugagaguguaggauguuuaca

SEQ ID NO: 23467 - RNA, 22 nt, Homo sapiens
cuuccagucggggauguuuaca

SEQ ID NO: 23468 - RNA, 22 nt, Homo sapiens
cuuccagucaaggauguuuaca

SEQ ID NO: 23469 - RNA, 22 nt, Homo sapiens
accagguuccaccccagcaggc

SEQ ID NO: 23470 - RNA, 21 nt, Homo sapiens
agacacaccacggcacacuuc

SEQ ID NO: 23471 - RNA, 21 nt, Homo sapiens
ggacuauagaacuuucccccu

SEQ ID NO: 23472 - RNA, 19 nt, Homo sapiens
aagacauuuucagacagcu

SEQ ID NO: 23473 - RNA, 23 nt, Homo sapiens
acagcgcucgcaaccgcagcgau

SEQ ID NO: 23474 - RNA, 19 nt, Homo sapiens
accagugcccugcacacuu

SEQ ID NO: 23475 - RNA, 22 nt, Homo sapiens
ugcuguuagcccuagccccgca

SEQ ID NO: 23476 - RNA, 20 nt, Homo sapiens
cccugcgccaucuccucuac

SEQ ID NO: 23477 - RNA, 22 nt, Homo sapiens
gggagaggucucccugcgcaca

SEQ ID NO: 23478 - RNA, 22 nt, Homo sapiens
caaacaccauugucacacucca

SEQ ID NO: 23479 - RNA, 18 nt, Homo sapiens
cccccaccaccacgcccg

SEQ ID NO: 23480 - RNA, 21 nt, Homo sapiens
uuuagcauaaguaugucccaa

SEQ ID NO: 23481 - RNA, 22 nt, Homo sapiens
cggugagcacccggccccugcg

SEQ ID NO: 23482 - RNA, 21 nt, Homo sapiens
ucaaucacagauagcaccccu

SEQ ID NO: 23483 - RNA, 19 nt, Homo sapiens
gccugcugacaccgugccu

SEQ ID NO: 23484 - RNA, 24 nt, Homo sapiens
acgcgcaggccagagacccaggca

SEQ ID NO: 23485 - RNA, 22 nt, Homo sapiens
caaacaccauugucacacucca

SEQ ID NO: 23486 - RNA, 17 nt, Homo sapiens
gggagaggaggaggcga

SEQ ID NO: 23487 - RNA, 21 nt, Homo sapiens
gggcaucugggacgcgcagga

SEQ ID NO: 23488 - RNA, 21 nt, Homo sapiens
gaccaaucgccguccccgccg

SEQ ID NO: 23489 - RNA, 23 nt, Homo sapiens
cccaacagacauggcgguacuca

SEQ ID NO: 23490 - RNA, 22 nt, Homo sapiens
uggcagcagcggagggggcaga

SEQ ID NO: 23491 - RNA, 21 nt, Homo sapiens
acccaguagccagauguagcu

SEQ ID NO: 23492 - RNA, 20 nt, Homo sapiens
ccagcagcaccuggggcagu

SEQ ID NO: 23493 - RNA, 20 nt, Homo sapiens
gcaaugcaacagcaaugcac

SEQ ID NO: 23494 - RNA, 21 nt, Homo sapiens
auccuguacugagcugccccg

SEQ ID NO: 23495 - RNA, 22 nt, Homo sapiens
aacgcuccaaaagaaggcacuc

SEQ ID NO: 23496 - RNA, 22 nt, Homo sapiens
aacacucuaaaaggaggcacuu

SEQ ID NO: 23497 - RNA, 22 nt, Homo sapiens
ugacgaugacaacgaugacgua

SEQ ID NO: 23498 - RNA, 22 nt, Homo sapiens
gcggucccgcggcgccccgccu

SEQ ID NO: 23499 - RNA, 22 nt, Homo sapiens
ugcuguuagcccuagccccgca

SEQ ID NO: 23500 - RNA, 20 nt, Homo sapiens
cucaaagcaaacccugcaga

SEQ ID NO: 23501 - RNA, 22 nt, Homo sapiens
caaacaccauugucacacucca

SEQ ID NO: 23502 - RNA, 22 nt, Homo sapiens
gugggguggguggucaggccga

SEQ ID NO: 23503 - RNA, 22 nt, Homo sapiens
ucaggaacugccuuucucucca

SEQ ID NO: 23504 - RNA, 21 nt, Homo sapiens
agaauugcguuuggacaauca

SEQ ID NO: 23505 - RNA, 23 nt, Homo sapiens
aaaucagaaucacaccuggggga

SEQ ID NO: 23506 - RNA, 24 nt, Homo sapiens
acgcagagcccgaaagcccccagu

SEQ ID NO: 23507 - RNA, 24 nt, Homo sapiens
acgcgcaggccagagacccaggca

SEQ ID NO: 23508 - RNA, 26 nt, Homo sapiens
uuucagaauuugcugccaucaucauc

SEQ ID NO: 23509 - RNA, 20 nt, Homo sapiens
gcagcuguccgcccagacac

SEQ ID NO: 23510 - RNA, 21 nt, Homo sapiens
cugggggacggagcagaagga

SEQ ID NO: 23511 - RNA, 22 nt, Homo sapiens
augcccuuuuaacauugcacug

SEQ ID NO: 23512 - RNA, 22 nt, Homo sapiens
augcccuuucaucauugcacug

SEQ ID NO: 23513 - RNA, 19 nt, Homo sapiens
cagcaucagcagcaucauc

SEQ ID NO: 23514 - RNA, 24 nt, Homo sapiens
gaaagugcauagaauucugucugg

SEQ ID NO: 23515 - RNA, 23 nt, Homo sapiens
gcuuugacaauacuauugcacug

SEQ ID NO: 23516 - RNA, 23 nt, Homo sapiens
gcuuugacaauaucauugcacug

SEQ ID NO: 23517 - RNA, 21 nt, Homo sapiens
ugcaugacggccugcaagaca

SEQ ID NO: 23518 - RNA, 23 nt, Homo sapiens
acccuauaagcaauauugcacua

SEQ ID NO: 23519 - RNA, 22 nt, Homo sapiens
acgguccuacacucaaggcaug

SEQ ID NO: 23520 - RNA, 21 nt, Homo sapiens
gagcugcauccuggcuccggg

SEQ ID NO: 23521 - RNA, 21 nt, Homo sapiens
gagcugcauccuggcuccggg

SEQ ID NO: 23522 - RNA, 19 nt, Homo sapiens
cagcaucagcagcaucauc

SEQ ID NO: 23523 - RNA, 21 nt, Homo sapiens
acuagacugugagcuccucga

SEQ ID NO: 23524 - RNA, 23 nt, Homo sapiens
cccaacagacauggcgguacuca

SEQ ID NO: 23525 - RNA, 23 nt, Homo sapiens
acauuuuucguuauugcucuuga

SEQ ID NO: 23526 - RNA, 19 nt, Homo sapiens
auuuugguacagcagcuca

SEQ ID NO: 23527 - RNA, 20 nt, Homo sapiens
ugggccaccgccgagcggac

SEQ ID NO: 23528 - RNA, 23 nt, Homo sapiens
ggacauuguuucagugcccaagu

SEQ ID NO: 23529 - RNA, 23 nt, Homo sapiens
ccuagagagggugagaaccugcc

SEQ ID NO: 23530 - RNA, 22 nt, Homo sapiens
ccaguagcacggcucaguccag

SEQ ID NO: 23531 - RNA, 21 nt, Homo sapiens
ucuccagaucagggcagucca

SEQ ID NO: 23532 - RNA, 22 nt, Homo sapiens
aacccauggaauucaguucuca

SEQ ID NO: 23533 - RNA, 22 nt, Homo sapiens
cucaauagacugugagcuccuu

SEQ ID NO: 23534 - RNA, 21 nt, Homo sapiens
ccuucugacuccaaguccagu

SEQ ID NO: 23535 - RNA, 22 nt, Homo sapiens
gccuucugacccuaaguccagu

SEQ ID NO: 23536 - RNA, 21 nt, Homo sapiens
guguauaugcccauggacugc

SEQ ID NO: 23537 - RNA, 19 nt, Homo sapiens
auuuugguacagcagcuca

SEQ ID NO: 23538 - RNA, 20 nt, Homo sapiens
guuugauaaacugacacaac

SEQ ID NO: 23539 - RNA, 22 nt, Homo sapiens
ccucuaguaaauaugucagcau

SEQ ID NO: 23540 - RNA, 19 nt, Homo sapiens
gccucagaggcagcugcuu

SEQ ID NO: 23541 - RNA, 23 nt, Homo sapiens
cccagcuagauuguaagcuccuu

SEQ ID NO: 23542 - RNA, 23 nt, Homo sapiens
cccagcuagauuguaagcuccuu

SEQ ID NO: 23543 - RNA, 22 nt, Homo sapiens
cacauggccaaaacagagaaga

SEQ ID NO: 23544 - RNA, 21 nt, Homo sapiens
auaauggagaccaggccacga

SEQ ID NO: 23545 - RNA, 23 nt, Homo sapiens
aaucuacuuucuuugcucauccu

SEQ ID NO: 23546 - RNA, 22 nt, Homo sapiens
aaccacuuucuuugcucauccg

SEQ ID NO: 23547 - RNA, 23 nt, Homo sapiens
aggaacagcagcagcccgggccg

SEQ ID NO: 23548 - RNA, 23 nt, Homo sapiens
accccuaucacgauuagcauuaa

SEQ ID NO: 23549 - RNA, 23 nt, Homo sapiens
acauuuuucguuauugcucuuga

SEQ ID NO: 23550 - RNA, 23 nt, Homo sapiens
acauuuuucguuauugcucuuga

SEQ ID NO: 23551 - RNA, 22 nt, Homo sapiens
acaaccagcuaagacacugcca

SEQ ID NO: 23552 - RNA, 22 nt, Homo sapiens
aggaaaccagcaaguguugacg

SEQ ID NO: 23553 - RNA, 22 nt, Homo sapiens
gaccucagcuaugacagcacuu

SEQ ID NO: 23554 - RNA, 23 nt, Homo sapiens
gaaagugcccucaaggcugagug

SEQ ID NO: 23555 - RNA, 23 nt, Homo sapiens
ggacauuguuucagugcccaagu

SEQ ID NO: 23556 - RNA, 21 nt, Homo sapiens
gaaggaagugagugcagccac

SEQ ID NO: 23557 - RNA, 22 nt, Homo sapiens
ccucaggcacggccgggccacc

SEQ ID NO: 23558 - RNA, 21 nt, Homo sapiens
caucaccuuccuucuccucca

SEQ ID NO: 23559 - RNA, 21 nt, Homo sapiens
agggcucaucuugguccugca

SEQ ID NO: 23560 - RNA, 21 nt, Homo sapiens
gggcaucugggacgcgcagga

SEQ ID NO: 23561 - RNA, 22 nt, Homo sapiens
ucaggaacugccuuucucucca

SEQ ID NO: 23562 - RNA, 21 nt, Homo sapiens
uucuaggauaggcccaggggc

SEQ ID NO: 23563 - RNA, 19 nt, Homo sapiens
guccugaauuccgcagccu

SEQ ID NO: 23564 - RNA, 22 nt, Homo sapiens
gauccgagcaccggggaccccc

SEQ ID NO: 23565 - RNA, 23 nt, Homo sapiens
cacugugggcccucuccgcacca

SEQ ID NO: 23566 - RNA, 22 nt, Homo sapiens
gcugaggcuguggggcuggagu

SEQ ID NO: 23567 - RNA, 24 nt, Homo sapiens
cacccccagagccucagcucccca

SEQ ID NO: 23568 - RNA, 21 nt, Homo sapiens
gagcugcauccuggcuccggg

SEQ ID NO: 23569 - RNA, 18 nt, Homo sapiens
gaaaugagggccagcuga

SEQ ID NO: 23570 - RNA, 22 nt, Homo sapiens
acucaguaugccaggguaccau

SEQ ID NO: 23571 - RNA, 18 nt, Homo sapiens
cccccaccaccacgcccg

SEQ ID NO: 23572 - RNA, 17 nt, Homo sapiens
ggguggcagcgguggga

SEQ ID NO: 23573 - RNA, 21 nt, Homo sapiens
gaccaaucgccguccccgccg

SEQ ID NO: 23574 - RNA, 20 nt, Homo sapiens
cccgccgcgucgcccugggg

SEQ ID NO: 23575 - RNA, 25 nt, Homo sapiens
agcuagucaagcgcgguuguggggg

SEQ ID NO: 23576 - RNA, 21 nt, Homo sapiens
uucuaggauaggcccaggggc

SEQ ID NO: 23577 - RNA, 22 nt, Homo sapiens
aucgggaggggacugagccuga

SEQ ID NO: 23578 - RNA, 22 nt, Homo sapiens
aguccagauucugugcccacca

SEQ ID NO: 23579 - RNA, 21 nt, Homo sapiens
cccgaggagccgggcaggcuu

SEQ ID NO: 23580 - RNA, 22 nt, Homo sapiens
gcacauguucugcggcccacca

SEQ ID NO: 23581 - RNA, 25 nt, Homo sapiens
accaacggaccuacuucccuccgcc

SEQ ID NO: 23582 - RNA, 22 nt, Homo sapiens
gcggucccgcggcgccccgccu

SEQ ID NO: 23583 - RNA, 22 nt, Homo sapiens
agcucagaacccagaggucuca

SEQ ID NO: 23584 - RNA, 24 nt, Homo sapiens
cacccccagagccucagcucccca

SEQ ID NO: 23585 - RNA, 21 nt, Homo sapiens
ggggagcgggggcccugccuu

SEQ ID NO: 23586 - RNA, 18 nt, Homo sapiens
uggcgccugaacagggac

SEQ ID NO: 23587 - RNA, 18 nt, Homo sapiens
aucacauucaccucccug

SEQ ID NO: 23588 - RNA, 21 nt, Homo sapiens
gaccaaucgccguccccgccg

SEQ ID NO: 23589 - RNA, 21 nt, Homo sapiens
aggcggcaggcacaggacugg

SEQ ID NO: 23590 - RNA, 22 nt, Homo sapiens
uggcagcagcggagggggcaga

SEQ ID NO: 23591 - RNA, 22 nt, Homo sapiens
cagaagugggccgggcacaggg

SEQ ID NO: 23592 - RNA, 22 nt, Homo sapiens
cagaagugggccgggcacaggg

SEQ ID NO: 23593 - RNA, 22 nt, Homo sapiens
acugccugucugugccugcugu

SEQ ID NO: 23594 - RNA, 22 nt, Homo sapiens
agucuucacaacagcccugugu

SEQ ID NO: 23595 - RNA, 22 nt, Homo sapiens
agucuucacaacagcccugugu

SEQ ID NO: 23596 - RNA, 20 nt, Homo sapiens
ccagcagcaccuggggcagu

SEQ ID NO: 23597 - RNA, 22 nt, Homo sapiens
gagcccuggacuaggagucagc

SEQ ID NO: 23598 - RNA, 22 nt, Homo sapiens
gagcccuggacuaggagucagc

SEQ ID NO: 23599 - RNA, 22 nt, Homo sapiens
accagguuccaccccagcaggc

SEQ ID NO: 23600 - RNA, 22 nt, Homo sapiens
agagaggagagccguguaugac

SEQ ID NO: 23601 - RNA, 21 nt, Homo sapiens
auccuguacugagcugccccg

SEQ ID NO: 23602 - RNA, 22 nt, Homo sapiens
ccucuaguaaauaugucagcau

SEQ ID NO: 23603 - RNA, 22 nt, Homo sapiens
caacuccgauaugcaaugggua

SEQ ID NO: 23604 - RNA, 22 nt, Homo sapiens
gcggucccgcggcgccccgccu

SEQ ID NO: 23605 - RNA, 22 nt, Homo sapiens
ugcuguuagcccuagccccgca

SEQ ID NO: 23606 - RNA, 22 nt, Homo sapiens
gggagaggucucccugcgcaca

SEQ ID NO: 23607 - RNA, 22 nt, Homo sapiens
ugaagaagggggggaagggcgu

SEQ ID NO: 23608 - RNA, 22 nt, Homo sapiens
uaaaugaauucaauuuccuucu

SEQ ID NO: 23609 - RNA, 20 nt, Homo sapiens
agugcccccacaguuugagu

SEQ ID NO: 23610 - RNA, 21 nt, Homo sapiens
gaccaagaaauagccuuucaa

SEQ ID NO: 23611 - RNA, 22 nt, Homo sapiens
gagauuggccauguaauacuca

SEQ ID NO: 23612 - RNA, 24 nt, Homo sapiens
cacccccagagccucagcucccca

SEQ ID NO: 23613 - RNA, 21 nt, Homo sapiens
gaccaaucgccguccccgccg

SEQ ID NO: 23614 - RNA, 22 nt, Homo sapiens
cccaacaacaggaaacuaccua

SEQ ID NO: 23615 - RNA, 22 nt, Homo sapiens
uuucaguuaucaaucugucaca

SEQ ID NO: 23616 - RNA, 25 nt, Homo sapiens
acggagcugucccaacaccaccccu

SEQ ID NO: 23617 - RNA, 23 nt, Homo sapiens
acccaacagccccugcaagggau

SEQ ID NO: 23618 - RNA, 22 nt, Homo sapiens
uauccacuacaccccgcugccu

SEQ ID NO: 23619 - RNA, 20 nt, Homo sapiens
uacugcuuccacagcucccc

SEQ ID NO: 23620 - RNA, 20 nt, Homo sapiens
ggcauucaccgcgugccuua

SEQ ID NO: 23621 - RNA, 22 nt, Homo sapiens
uaaaugaauucaauuuccuucu

SEQ ID NO: 23622 - RNA, 21 nt, Homo sapiens
ggucagaacccaucauucacu

SEQ ID NO: 23623 - RNA, 22 nt, Homo sapiens
cacucagcggccguuuccccaa

SEQ ID NO: 23624 - RNA, 21 nt, Homo sapiens
acccaguagccagauguagcu

SEQ ID NO: 23625 - RNA, 17 nt, Homo sapiens
aaacauggaagcaauua

SEQ ID NO: 23626 - RNA, 21 nt, Homo sapiens
ucuacucagaagggugccuua

SEQ ID NO: 23627 - RNA, 22 nt, Homo sapiens
auaaacgacaccuccuugagaa

SEQ ID NO: 23628 - RNA, 23 nt, Homo sapiens
acagaaagugcuucccucaagag

SEQ ID NO: 23629 - RNA, 24 nt, Homo sapiens
cugaucaguuacacaucacuucag

SEQ ID NO: 23630 - RNA, 19 nt, Homo sapiens
agaaaccccagcagagaca

SEQ ID NO: 23631 - RNA, 21 nt, Homo sapiens
agacacaccacggcacacuuc

SEQ ID NO: 23632 - RNA, 22 nt, Homo sapiens
aaagagguuaaccauguauuau

SEQ ID NO: 23633 - RNA, 20 nt, Homo sapiens
cccugcgccaucuccucuac

SEQ ID NO: 23634 - RNA, 21 nt, Homo sapiens
aacauacaaaggguauccucu

SEQ ID NO: 23635 - RNA, 23 nt, Homo sapiens
gggagugaagacacggagccaga

SEQ ID NO: 23636 - RNA, 21 nt, Homo sapiens
gaccaaucgccguccccgccg

SEQ ID NO: 23637 - RNA, 22 nt, Homo sapiens
cagaagugggccgggcacaggg

SEQ ID NO: 23638 - RNA, 23 nt, Homo sapiens
cagcugcuuuugggauuccguug

SEQ ID NO: 23639 - RNA, 20 nt, Homo sapiens
cuggaggaagggcccagagg

SEQ ID NO: 23640 - RNA, 22 nt, Homo sapiens
gccuaagacacaggcccagaga

SEQ ID NO: 23641 - RNA, 22 nt, Homo sapiens
uacagauggauaccgugcaauu

SEQ ID NO: 23642 - RNA, 23 nt, Homo sapiens
aaagucucgcucucugccccuca

SEQ ID NO: 23643 - RNA, 25 nt, Homo sapiens
acggagcugucccaacaccaccccu

SEQ ID NO: 23644 - RNA, 24 nt, Homo sapiens
acgcgcaggccagagacccaggca

SEQ ID NO: 23645 - RNA, 22 nt, Homo sapiens
gcggucccgcggcgccccgccu

SEQ ID NO: 23646 - RNA, 20 nt, Homo sapiens
uccccacagacccagagccg

SEQ ID NO: 23647 - RNA, 18 nt, Homo sapiens
cccccaccaccacgcccg

SEQ ID NO: 23648 - RNA, 22 nt, Homo sapiens
agagcaagaccccgucucuaaa

SEQ ID NO: 23649 - RNA, 22 nt, Homo sapiens
augcccuuucaucauugcacug

SEQ ID NO: 23650 - RNA, 22 nt, Homo sapiens
acaaaaguugccuuugugugau

SEQ ID NO: 23651 - RNA, 23 nt, Homo sapiens
aacaggugcucaaauaagacuug

SEQ ID NO: 23652 - RNA, 22 nt, Homo sapiens
agugaauucuaccagugccaua

SEQ ID NO: 23653 - RNA, 22 nt, Homo sapiens
uaaccgauuucaaauggugcua

SEQ ID NO: 23654 - RNA, 23 nt, Homo sapiens
cuacuaaaacauggaagcacuua

SEQ ID NO: 23655 - RNA, 23 nt, Homo sapiens
acacucaaacauggaagcacuua

SEQ ID NO: 23656 - RNA, 23 nt, Homo sapiens
uguaggcuggggauaaaugaaua

SEQ ID NO: 23657 - RNA, 22 nt, Homo sapiens
caaacaccauugucacacucca

SEQ ID NO: 23658 - RNA, 22 nt, Homo sapiens
ccaucuuuaccagacaguguua

SEQ ID NO: 23659 - RNA, 22 nt, Homo sapiens
cacaaaccauuaugugcugcua

SEQ ID NO: 23660 - RNA, 22 nt, Homo sapiens
uguaaaccaugaugugcugcua

SEQ ID NO: 23661 - RNA, 22 nt, Homo sapiens
cgccaauauuuacgugcugcua

SEQ ID NO: 23662 - RNA, 20 nt, Homo sapiens
cccgccgcgucgcccugggg

SEQ ID NO: 23663 - RNA, 21 nt, Homo sapiens
gccaauauuucugugcugcua

SEQ ID NO: 23664 - RNA, 22 nt, Homo sapiens
cacucagcggccguuuccccaa

SEQ ID NO: 23665 - RNA, 21 nt, Homo sapiens
aucugcacugucagcacuuua

SEQ ID NO: 23666 - RNA, 23 nt, Homo sapiens
gcuuugacaauaucauugcacug

SEQ ID NO: 23667 - RNA, 22 nt, Homo sapiens
aaucagucucauugcuuuauaa

SEQ ID NO: 23668 - RNA, 22 nt, Homo sapiens
uucaaaacaugaauugcugcug

SEQ ID NO: 23669 - RNA, 22 nt, Homo sapiens
ccucauggaaggguuccccacu

SEQ ID NO: 23670 - RNA, 21 nt, Homo sapiens
acaaaccacagugugcugcug

SEQ ID NO: 23671 - RNA, 22 nt, Homo sapiens
acaguggucaucgagugacaca

SEQ ID NO: 23672 - RNA, 20 nt, Homo sapiens
uacugcuuccacagcucccc

SEQ ID NO: 23673 - RNA, 22 nt, Homo sapiens
aacuauacaaccuacuaccuca

SEQ ID NO: 23674 - RNA, 22 nt, Homo sapiens
aaccacacaaccuacuaccuca

SEQ ID NO: 23675 - RNA, 19 nt, Homo sapiens
agaaaccccagcagagaca

SEQ ID NO: 23676 - RNA, 23 nt, Homo sapiens
accacaggagucugagcauuuga

SEQ ID NO: 23677 - RNA, 23 nt, Homo sapiens
cuaccugcacuguaagcacuuuu

SEQ ID NO: 23678 - RNA, 22 nt, Homo sapiens
ggcucccaagaaccucaccugu

SEQ ID NO: 23679 - RNA, 21 nt, Homo sapiens
aaagagaccgguucacuguga

SEQ ID NO: 23680 - RNA, 22 nt, Homo sapiens
ccaucuuuaccagacaguguua

SEQ ID NO: 23681 - RNA, 22 nt, Homo sapiens
acaaaguucuguagugcacuga

SEQ ID NO: 23682 - RNA, 22 nt, Homo sapiens
acaaaguucugugaugcacuga

SEQ ID NO: 23683 - RNA, 21 nt, Homo sapiens
ccaaguucugucaugcacuga

SEQ ID NO: 23684 - RNA, 23 nt, Homo sapiens
gaacagguagucugaacacuggg

SEQ ID NO: 23685 - RNA, 23 nt, Homo sapiens
gaacagauagucuaaacacuggg

SEQ ID NO: 23686 - RNA, 22 nt, Homo sapiens
acaucguuaccagacaguguua

SEQ ID NO: 23687 - RNA, 22 nt, Homo sapiens
cgaauccaccacgaacaacuuc

SEQ ID NO: 23688 - RNA, 22 nt, Homo sapiens
augggacauccuacauaugcaa

SEQ ID NO: 23689 - RNA, 20 nt, Homo sapiens
guguguauacauuuauacau

SEQ ID NO: 23690 - RNA, 23 nt, Homo sapiens
aaucgcgguuuauaccaaaugaa

SEQ ID NO: 23691 - RNA, 21 nt, Homo sapiens
guuauagaucuggauuugaac

SEQ ID NO: 23692 - RNA, 24 nt, Homo sapiens
acugggcacaaacauguccagguc

SEQ ID NO: 23693 - RNA, 23 nt, Homo sapiens
ccuagagagggugagaaccugcc

SEQ ID NO: 23694 - RNA, 23 nt, Homo sapiens
agaaaccaugggguaugagcaga

SEQ ID NO: 23695 - RNA, 21 nt, Homo sapiens
cacaaccucaguguuuccagg

SEQ ID NO: 23696 - RNA, 21 nt, Homo sapiens
ccccucccagccucccugcca

SEQ ID NO: 23697 - RNA, 18 nt, Homo sapiens
auucaaucuacugccuca

SEQ ID NO: 23698 - RNA, 22 nt, Homo sapiens
cggugagcacccggccccugcg

SEQ ID NO: 23699 - RNA, 23 nt, Homo sapiens
cagcugcuuuugggauuccguug

SEQ ID NO: 23700 - RNA, 25 nt, Homo sapiens
agcuagucaagcgcgguuguggggg

SEQ ID NO: 23701 - RNA, 20 nt, Homo sapiens
uucccaugcccuauaccucu

SEQ ID NO: 23702 - RNA, 22 nt, Homo sapiens
caacaaaaucacugaugcugga

SEQ ID NO: 23703 - RNA, 23 nt, Homo sapiens
augcaaaguugcucggguaaccu

SEQ ID NO: 23704 - RNA, 21 nt, Homo sapiens
gaccaagaaauagccuuucaa

SEQ ID NO: 23705 - RNA, 22 nt, Homo sapiens
cagcauggaguccuccagguug

SEQ ID NO: 23706 - RNA, 24 nt, Homo sapiens
acugggcacaaacauguccagguc

SEQ ID NO: 23707 - RNA, 23 nt, Homo sapiens
uguaggcuggggauaaaugaaua

SEQ ID NO: 23708 - RNA, 20 nt, Homo sapiens
aggggccucagccuccuggu

SEQ ID NO: 23709 - RNA, 22 nt, Homo sapiens
caccugauaaaacugagguaua

SEQ ID NO: 23710 - RNA, 21 nt, Homo sapiens
ggggagcgggggcccugccuu

SEQ ID NO: 23711 - RNA, 23 nt, Homo sapiens
ggaagccaucaagucgcugcagg

SEQ ID NO: 23712 - RNA, 22 nt, Homo sapiens
caaacaccauugucacacucca

SEQ ID NO: 23713 - RNA, 22 nt, Homo sapiens
gugggguggguggucaggccga

SEQ ID NO: 23714 - RNA, 24 nt, Homo sapiens
acugcuggucuucagucagggcca

SEQ ID NO: 23715 - RNA, 23 nt, Homo sapiens
gggagugaagacacggagccaga

SEQ ID NO: 23716 - RNA, 23 nt, Homo sapiens
aggaacagcagcagcccgggccg

SEQ ID NO: 23717 - RNA, 21 nt, Homo sapiens
gggcaucugggacgcgcagga

SEQ ID NO: 23718 - RNA, 21 nt, Homo sapiens
gaccaaucgccguccccgccg

SEQ ID NO: 23719 - RNA, 23 nt, Homo sapiens
cccaacagacauggcgguacuca

SEQ ID NO: 23720 - RNA, 22 nt, Homo sapiens
acggaagggcagagagggccag

SEQ ID NO: 23721 - RNA, 23 nt, Homo sapiens
gggcucuuacucccucaggcacu

SEQ ID NO: 23722 - RNA, 19 nt, Homo sapiens
auuuugguacagcagcuca

SEQ ID NO: 23723 - RNA, 24 nt, Homo sapiens
acgcgcaggccagagacccaggca

SEQ ID NO: 23724 - RNA, 24 nt, Homo sapiens
acgcgcaggccagagacccaggca

SEQ ID NO: 23725 - RNA, 22 nt, Homo sapiens
gcggucccgcggcgccccgccu

SEQ ID NO: 23726 - RNA, 22 nt, Homo sapiens
ccucaggcacggccgggccacc

SEQ ID NO: 23727 - RNA, 22 nt, Homo sapiens
ugcuguuagcccuagccccgca

SEQ ID NO: 23728 - RNA, 21 nt, Homo sapiens
aagggucaguaagcacccgcg

SEQ ID NO: 23729 - RNA, 21 nt, Homo sapiens
ggggagcgggggcccugccuu

SEQ ID NO: 23730 - RNA, 23 nt, Homo sapiens
gcacaugugcacacagccgggug

SEQ ID NO: 23731 - RNA, 21 nt, Homo sapiens
acuccaaagggaagcgccuuc

SEQ ID NO: 23732 - RNA, 21 nt, Homo sapiens
gagcugcauccuggcuccggg

SEQ ID NO: 23733 - RNA, 21 nt, Homo sapiens
gagcugcauccuggcuccggg

SEQ ID NO: 23734 - RNA, 17 nt, Homo sapiens
gggagaggaggaggcga

SEQ ID NO: 23735 - RNA, 22 nt, Homo sapiens
cuguuccugcugaacugagcca

SEQ ID NO: 23736 - RNA, 22 nt, Homo sapiens
uccagcaaagggaagcgcuuuc

SEQ ID NO: 23737 - RNA, 22 nt, Homo sapiens
accucuaaaggggagcgcuuug

SEQ ID NO: 23738 - RNA, 23 nt, Homo sapiens
acacucuaaagagaagcgcuuug

SEQ ID NO: 23739 - RNA, 21 nt, Homo sapiens
gcuccaaagggaagcgcuuug

SEQ ID NO: 23740 - RNA, 21 nt, Homo sapiens
ccucuaaagagaagcgcuuuc

SEQ ID NO: 23741 - RNA, 20 nt, Homo sapiens
guguguauacauuuauacau

SEQ ID NO: 23742 - RNA, 23 nt, Homo sapiens
aguaacugguugaacaacuguaa

SEQ ID NO: 23743 - RNA, 22 nt, Homo sapiens
gggagaggucucccugcgcaca

SEQ ID NO: 23744 - RNA, 23 nt, Homo sapiens
ggaagccaucaagucgcugcagg

SEQ ID NO: 23745 - RNA, 20 nt, Homo sapiens
cucaaagcaaacccugcaga

SEQ ID NO: 23746 - RNA, 22 nt, Homo sapiens
auccuucuacaaauucacccau

SEQ ID NO: 23747 - RNA, 21 nt, Homo sapiens
agggcucaucuugguccugca

SEQ ID NO: 23748 - RNA, 22 nt, Homo sapiens
cacugguacaaggguugggaga

SEQ ID NO: 23749 - RNA, 21 nt, Homo sapiens
gaccaaucgccguccccgccg

SEQ ID NO: 23750 - RNA, 20 nt, Homo sapiens
cccgccgcgucgcccugggg

SEQ ID NO: 23751 - RNA, 21 nt, Homo sapiens
aucugcacugucagcacuuua

SEQ ID NO: 23752 - RNA, 23 nt, Homo sapiens
gcuuugacaauaucauugcacug

SEQ ID NO: 23753 - RNA, 22 nt, Homo sapiens
aguccagauucugugcccacca

SEQ ID NO: 23754 - RNA, 22 nt, Homo sapiens
gcacauguucugcggcccacca

SEQ ID NO: 23755 - RNA, 22 nt, Homo sapiens
gcggucccgcggcgccccgccu

SEQ ID NO: 23756 - RNA, 22 nt, Homo sapiens
agcucagaacccagaggucuca

SEQ ID NO: 23757 - RNA, 23 nt, Homo sapiens
ggaagccaucaagucgcugcagg

SEQ ID NO: 23758 - RNA, 23 nt, Homo sapiens
ggaagccaucaagucgcugcagg

SEQ ID NO: 23759 - RNA, 22 nt, Homo sapiens
caaacaccauugucacacucca

SEQ ID NO: 23760 - RNA, 23 nt, Homo sapiens
cugugggagggcaguggugagag

SEQ ID NO: 23761 - RNA, 17 nt, Homo sapiens
gacagccucucccccac

SEQ ID NO: 23762 - RNA, 24 nt, Homo sapiens
gaagucacucccaggcagcugcaa

SEQ ID NO: 23763 - RNA, 18 nt, Homo sapiens
aucacauucaccucccug

SEQ ID NO: 23764 - RNA, 23 nt, Homo sapiens
gggagugaagacacggagccaga

SEQ ID NO: 23765 - RNA, 22 nt, Homo sapiens
cagacuccgguggaaugaagga

SEQ ID NO: 23766 - RNA, 22 nt, Homo sapiens
ucagaccgagacaagugcaaug

SEQ ID NO: 23767 - RNA, 23 nt, Homo sapiens
aaaucagaaucacaccuggggga

SEQ ID NO: 23768 - RNA, 23 nt, Homo sapiens
aaagucucgcucucugccccuca

SEQ ID NO: 23769 - RNA, 22 nt, Homo sapiens
aucgggaggggacugagccuga

SEQ ID NO: 23770 - RNA, 22 nt, Homo sapiens
gaauucaucacggccagccucu

SEQ ID NO: 23771 - RNA, 19 nt, Homo sapiens
auuuugguacagcagcuca

SEQ ID NO: 23772 - RNA, 23 nt, Homo sapiens
ccaccuggcaagaacaggcguuc

SEQ ID NO: 23773 - RNA, 25 nt, Homo sapiens
accaacggaccuacuucccuccgcc

SEQ ID NO: 23774 - RNA, 24 nt, Homo sapiens
acgcgcaggccagagacccaggca

SEQ ID NO: 23775 - RNA, 22 nt, Homo sapiens
cugggggcggcacaggggcuca

SEQ ID NO: 23776 - RNA, 22 nt, Homo sapiens
caaacaccauugucacacucca

SEQ ID NO: 23777 - RNA, 22 nt, Homo sapiens
uccggggacgaacgggacgggu

SEQ ID NO: 23778 - RNA, 21 nt, Homo sapiens
gaccaaucgccguccccgccg

SEQ ID NO: 23779 - RNA, 22 nt, Homo sapiens
aagagggagacccaggcucgga

SEQ ID NO: 23780 - RNA, 23 nt, Homo sapiens
cacugugggcccucuccgcacca

SEQ ID NO: 23781 - RNA, 22 nt, Homo sapiens
ugcuguuagcccuagccccgca

SEQ ID NO: 23782 - RNA, 21 nt, Homo sapiens
aagggucaguaagcacccgcg

SEQ ID NO: 23783 - RNA, 22 nt, Homo sapiens
ggcagagagucagagcgcggau

SEQ ID NO: 23784 - RNA, 20 nt, Homo sapiens
ggggcagacagacgaggaag

SEQ ID NO: 23785 - RNA, 18 nt, Homo sapiens
ugguggcagaggugggau

SEQ ID NO: 23786 - RNA, 22 nt, Homo sapiens
auccuucuacaaauucacccau

SEQ ID NO: 23787 - RNA, 22 nt, Homo sapiens
ccccucuggucaaccagucaca

SEQ ID NO: 23788 - RNA, 22 nt, Homo sapiens
ccagaacugaguccacagggca

SEQ ID NO: 23789 - RNA, 20 nt, Homo sapiens
acagcaaggagggcaggagg

SEQ ID NO: 23790 - RNA, 23 nt, Homo sapiens
cgugagcuccuggaggacaggga

SEQ ID NO: 23791 - RNA, 23 nt, Homo sapiens
aaagucucgcucucugccccuca

SEQ ID NO: 23792 - RNA, 18 nt, Homo sapiens
acccucugaaaggaagca

SEQ ID NO: 23793 - RNA, 22 nt, Homo sapiens
aaagugcuucuuaccuccagau

SEQ ID NO: 23794 - RNA, 22 nt, Homo sapiens
ugcaagccuugggugugggagg

SEQ ID NO: 23795 - RNA, 21 nt, Homo sapiens
aagggucaguaagcacccgcg

SEQ ID NO: 23796 - RNA, 22 nt, Homo sapiens
cuggagagacaaggggaagagg

SEQ ID NO: 23797 - RNA, 23 nt, Homo sapiens
aaucuacuuucuuugcucauccu

SEQ ID NO: 23798 - RNA, 22 nt, Homo sapiens
aaccacuuucuuugcucauccg

SEQ ID NO: 23799 - RNA, 17 nt, Homo sapiens
gacagccucucccccac

SEQ ID NO: 23800 - RNA, 22 nt, Homo sapiens
aucagagcccucugagcuucag

SEQ ID NO: 23801 - RNA, 17 nt, Homo sapiens
gggagaggaggaggcga

SEQ ID NO: 23802 - RNA, 22 nt, Homo sapiens
acuccaacagggccgcgucucc

SEQ ID NO: 23803 - RNA, 25 nt, Homo sapiens
agcuagucaagcgcgguuguggggg

SEQ ID NO: 23804 - RNA, 20 nt, Homo sapiens
uacugcuuccacagcucccc

SEQ ID NO: 23805 - RNA, 22 nt, Homo sapiens
cacucuaaagggaggcacuuug

SEQ ID NO: 23806 - RNA, 24 nt, Homo sapiens
cacccccagagccucagcucccca

SEQ ID NO: 23807 - RNA, 21 nt, Homo sapiens
auaauggagaccaggccacga

SEQ ID NO: 23808 - RNA, 21 nt, Homo sapiens
ccccucccagccucccugcca

SEQ ID NO: 23809 - RNA, 17 nt, Homo sapiens
gggagaggaggaggcga

SEQ ID NO: 23810 - RNA, 22 nt, Homo sapiens
aggucucacuuuguugcccaga

SEQ ID NO: 23811 - RNA, 23 nt, Homo sapiens
aggaacagcagcagcccgggccg

SEQ ID NO: 23812 - RNA, 22 nt, Homo sapiens
cggugagcacccggccccugcg

SEQ ID NO: 23813 - RNA, 21 nt, Homo sapiens
aagugucagacacgguggugg

SEQ ID NO: 23814 - RNA, 25 nt, Homo sapiens
aaggagcucagaagcccugcccagc

SEQ ID NO: 23815 - RNA, 22 nt, Homo sapiens
aagagggagacccaggcucgga

SEQ ID NO: 23816 - RNA, 21 nt, Homo sapiens
gcuccaaccucagcagacugu

SEQ ID NO: 23817 - RNA, 22 nt, Homo sapiens
ccucaggcacggccgggccacc

SEQ ID NO: 23818 - RNA, 21 nt, Homo sapiens
gaccaaucgccguccccgccg

SEQ ID NO: 23819 - RNA, 22 nt, Homo sapiens
ucagaccgagacaagugcaaug

SEQ ID NO: 23820 - RNA, 23 nt, Homo sapiens
aaaucagaaucacaccuggggga

SEQ ID NO: 23821 - RNA, 19 nt, Homo sapiens
guccugaauuccgcagccu

SEQ ID NO: 23822 - RNA, 24 nt, Homo sapiens
acgcagagcccgaaagcccccagu

SEQ ID NO: 23823 - RNA, 22 nt, Homo sapiens
gcggucccgcggcgccccgccu

SEQ ID NO: 23824 - RNA, 22 nt, Homo sapiens
ugcuguuagcccuagccccgca

SEQ ID NO: 23825 - RNA, 20 nt, Homo sapiens
uccccacagacccagagccg

SEQ ID NO: 23826 - RNA, 22 nt, Homo sapiens
aacagcacaaacuacuaccuca

SEQ ID NO: 23827 - RNA, 22 nt, Homo sapiens
aacagcacaaacuacuaccuca

SEQ ID NO: 23828 - RNA, 23 nt, Homo sapiens
ggaagccaucaagucgcugcagg

SEQ ID NO: 23829 - RNA, 20 nt, Homo sapiens
cucaaagcaaacccugcaga

SEQ ID NO: 23830 - RNA, 19 nt, Homo sapiens
ucccugauccaaaaaucca

SEQ ID NO: 23831 - RNA, 18 nt, Homo sapiens
aucacauucaccucccug

SEQ ID NO: 23832 - RNA, 23 nt, Homo sapiens
gggagugaagacacggagccaga

SEQ ID NO: 23833 - RNA, 22 nt, Homo sapiens
uggcagcagcggagggggcaga

SEQ ID NO: 23834 - RNA, 20 nt, Homo sapiens
acagcaaggagggcaggagg

SEQ ID NO: 23835 - RNA, 20 nt, Homo sapiens
ccagcagcaccuggggcagu

SEQ ID NO: 23836 - RNA, 22 nt, Homo sapiens
uacagauggauaccgugcaauu

SEQ ID NO: 23837 - RNA, 22 nt, Homo sapiens
gaauucaucacggccagccucu

SEQ ID NO: 23838 - RNA, 21 nt, Homo sapiens
auccuguacugagcugccccg

SEQ ID NO: 23839 - RNA, 25 nt, Homo sapiens
acggagcugucccaacaccaccccu

SEQ ID NO: 23840 - RNA, 23 nt, Homo sapiens
cacugugggcccucuccgcacca

SEQ ID NO: 23841 - RNA, 22 nt, Homo sapiens
ugcuguuagcccuagccccgca

SEQ ID NO: 23842 - RNA, 21 nt, Homo sapiens
caucaccuuccuucuccucca

SEQ ID NO: 23843 - RNA, 24 nt, Homo sapiens
cacccccagagccucagcucccca

SEQ ID NO: 23844 - RNA, 22 nt, Homo sapiens
ccacacacuuccuuacauucca

SEQ ID NO: 23845 - RNA, 18 nt, Homo sapiens
aucacauucaccucccug

SEQ ID NO: 23846 - RNA, 22 nt, Homo sapiens
cuaccauaggguaaaaccacug

SEQ ID NO: 23847 - RNA, 23 nt, Homo sapiens
gggagugaagacacggagccaga

SEQ ID NO: 23848 - RNA, 23 nt, Homo sapiens
acauuuuucguuauugcucuuga

SEQ ID NO: 23849 - RNA, 21 nt, Homo sapiens
acaaaccacagugugcugcug

SEQ ID NO: 23850 - RNA, 22 nt, Homo sapiens
gcaaaaguaauugccaguuuug

SEQ ID NO: 23851 - RNA, 22 nt, Homo sapiens
ugcaaaaguagucucaguuuuu

SEQ ID NO: 23852 - RNA, 19 nt, Homo sapiens
aaaaguaauuacaguuuuu

SEQ ID NO: 23853 - RNA, 21 nt, Homo sapiens
aguucucccaacguaaaccca

SEQ ID NO: 23854 - RNA, 22 nt, Homo sapiens
caagacacauuuggagagggac

SEQ ID NO: 23855 - RNA, 23 nt, Homo sapiens
ggaagccaucaagucgcugcagg

SEQ ID NO: 23856 - RNA, 20 nt, Homo sapiens
gcagcuguccgcccagacac

SEQ ID NO: 23857 - RNA, 21 nt, Homo sapiens
ucuccagaucagggcagucca

SEQ ID NO: 23858 - RNA, 24 nt, Homo sapiens
gaaagugcauagaauucugucugg

SEQ ID NO: 23859 - RNA, 23 nt, Homo sapiens
gggagugaagacacggagccaga

SEQ ID NO: 23860 - RNA, 23 nt, Homo sapiens
cuaccugcacuguaagcacuuug

SEQ ID NO: 23861 - RNA, 21 nt, Homo sapiens
gaccaaucgccguccccgccg

SEQ ID NO: 23862 - RNA, 22 nt, Homo sapiens
cagaagugggccgggcacaggg

SEQ ID NO: 23863 - RNA, 19 nt, Homo sapiens
uaugcuaccuuugcacggu

SEQ ID NO: 23864 - RNA, 21 nt, Homo sapiens
accuauccugaauuacuugaa

SEQ ID NO: 23865 - RNA, 22 nt, Homo sapiens
acaaccagcuaagacacugcca

SEQ ID NO: 23866 - RNA, 23 nt, Homo sapiens
gcaaucagcuaacuacacugccu

SEQ ID NO: 23867 - RNA, 22 nt, Homo sapiens
accagcuaacaauacacugcca

SEQ ID NO: 23868 - RNA, 22 nt, Homo sapiens
gccagcuaacaauacacugccu

SEQ ID NO: 23869 - RNA, 22 nt, Homo sapiens
caugauugccacgucugcagua

SEQ ID NO: 23870 - RNA, 21 nt, Homo sapiens
ugauugccacugucugcagua

SEQ ID NO: 23871 - RNA, 22 nt, Homo sapiens
gccaccuucaaaugggaagucu

SEQ ID NO: 23872 - RNA, 19 nt, Homo sapiens
aagacauuuucagacagcu

SEQ ID NO: 23873 - RNA, 22 nt, Homo sapiens
gcggucccgcggcgccccgccu

SEQ ID NO: 23874 - RNA, 22 nt, Homo sapiens
ugcuguuagcccuagccccgca

SEQ ID NO: 23875 - RNA, 22 nt, Homo sapiens
cacucuaaagggaggcacuuug

SEQ ID NO: 23876 - RNA, 22 nt, Homo sapiens
caaacaccauugucacacucca

SEQ ID NO: 23877 - RNA, 20 nt, Homo sapiens
gcagcuguccgcccagacac

SEQ ID NO: 23878 - RNA, 17 nt, Homo sapiens
gggagaggaggaggcga

SEQ ID NO: 23879 - RNA, 18 nt, Homo sapiens
aucacauucaccucccug

SEQ ID NO: 23880 - RNA, 18 nt, Homo sapiens
aucacauucaccucccug

SEQ ID NO: 23881 - RNA, 24 nt, Homo sapiens
gaaagugcauagaauucugucugg

SEQ ID NO: 23882 - RNA, 23 nt, Homo sapiens
gggagugaagacacggagccaga

SEQ ID NO: 23883 - RNA, 22 nt, Homo sapiens
agcccaaaaggagaauucuuug

SEQ ID NO: 23884 - RNA, 21 nt, Homo sapiens
gaccaaucgccguccccgccg

SEQ ID NO: 23885 - RNA, 22 nt, Homo sapiens
ucgcccucucaacccagcuuuu

SEQ ID NO: 23886 - RNA, 22 nt, Homo sapiens
uugcccucucaacccagcuuuu

SEQ ID NO: 23887 - RNA, 20 nt, Homo sapiens
acccucucaacccagcuuuu

SEQ ID NO: 23888 - RNA, 19 nt, Homo sapiens
uccucucaacccagcuuuu

SEQ ID NO: 23889 - RNA, 23 nt, Homo sapiens
aaagucucgcucucugccccuca

SEQ ID NO: 23890 - RNA, 23 nt, Homo sapiens
caugagugacgcccucuggagua

SEQ ID NO: 23891 - RNA, 22 nt, Homo sapiens
aaagugcuucuuaccuccagau

SEQ ID NO: 23892 - RNA, 23 nt, Homo sapiens
acacucuaaagagaagcgcuuug

SEQ ID NO: 23893 - RNA, 21 nt, Homo sapiens
agaaaguacuucccucuggag

SEQ ID NO: 23894 - RNA, 21 nt, Homo sapiens
agaaagugcaucccucuggag

SEQ ID NO: 23895 - RNA, 21 nt, Homo sapiens
cucacucagauggccaacuca

SEQ ID NO: 23896 - RNA, 23 nt, Homo sapiens
ccaccuggcaagaacaggcguuc

SEQ ID NO: 23897 - RNA, 19 nt, Homo sapiens
aagacauuuucagacagcu

SEQ ID NO: 23898 - RNA, 22 nt, Homo sapiens
gcggucccgcggcgccccgccu

SEQ ID NO: 23899 - RNA, 22 nt, Homo sapiens
ugcuguuagcccuagccccgca

SEQ ID NO: 23900 - RNA, 21 nt, Homo sapiens
caucaccuuccuucuccucca

SEQ ID NO: 23901 - RNA, 20 nt, Homo sapiens
cccugcgccaucuccucuac

SEQ ID NO: 23902 - RNA, 22 nt, Homo sapiens
cacaaaccauuaugugcugcua

SEQ ID NO: 23903 - RNA, 22 nt, Homo sapiens
uguaaaccaugaugugcugcua

SEQ ID NO: 23904 - RNA, 22 nt, Homo sapiens
cgccaauauuuacgugcugcua

SEQ ID NO: 23905 - RNA, 18 nt, Homo sapiens
auucaaucuacugccuca

SEQ ID NO: 23906 - RNA, 22 nt, Homo sapiens
cggugagcacccggccccugcg

SEQ ID NO: 23907 - RNA, 21 nt, Homo sapiens
gccaauauuucugugcugcua

SEQ ID NO: 23908 - RNA, 22 nt, Homo sapiens
aaucagucucauugcuuuauaa

SEQ ID NO: 23909 - RNA, 22 nt, Homo sapiens
acaaccagcuaagacacugcca

SEQ ID NO: 23910 - RNA, 22 nt, Homo sapiens
uucaaaacaugaauugcugcug

SEQ ID NO: 23911 - RNA, 21 nt, Homo sapiens
acaaaccacagugugcugcug

SEQ ID NO: 23912 - RNA, 20 nt, Homo sapiens
uacugcuuccacagcucccc

SEQ ID NO: 23913 - RNA, 21 nt, Homo sapiens
ggggagcgggggcccugccuu

SEQ ID NO: 23914 - RNA, 22 nt, Homo sapiens
augcccuuuuaacauugcacug

SEQ ID NO: 23915 - RNA, 22 nt, Homo sapiens
cccaacaacaugaaacuaccua

SEQ ID NO: 23916 - RNA, 22 nt, Homo sapiens
cccaacaacaggaaacuaccua

SEQ ID NO: 23917 - RNA, 22 nt, Homo sapiens
acaucguuaccagacaguguua

SEQ ID NO: 23918 - RNA, 22 nt, Homo sapiens
ucaucauuaccaggcaguauua

SEQ ID NO: 23919 - RNA, 21 nt, Homo sapiens
ggaaaucccuggcaaugugau

SEQ ID NO: 23920 - RNA, 21 nt, Homo sapiens
gguaaucccuggcaaugugau

SEQ ID NO: 23921 - RNA, 23 nt, Homo sapiens
acacuuacuggacaccuacuagg

SEQ ID NO: 23922 - RNA, 22 nt, Homo sapiens
cacuuaucagguuguauuauaa

SEQ ID NO: 23923 - RNA, 22 nt, Homo sapiens
cacuuagcagguuguauuauau

SEQ ID NO: 23924 - RNA, 21 nt, Homo sapiens
ucgacugccacucuuacuaga

SEQ ID NO: 23925 - RNA, 23 nt, Homo sapiens
acaaggaugaaucuuuguuacug

SEQ ID NO: 23926 - RNA, 22 nt, Homo sapiens
aacaacacuugaccacauccug

SEQ ID NO: 23927 - RNA, 22 nt, Homo sapiens
acaacuguaacuagacgguuuu

SEQ ID NO: 23928 - RNA, 22 nt, Homo sapiens
ucaacaucagucugauaagcua

SEQ ID NO: 23929 - RNA, 24 nt, Homo sapiens
acucacaccuagguuccaaggauu

SEQ ID NO: 23930 - RNA, 21 nt, Homo sapiens
acguggauuuuccucuaugau

SEQ ID NO: 23931 - RNA, 22 nt, Homo sapiens
aacauggauuuuccucuaugau

SEQ ID NO: 23932 - RNA, 20 nt, Homo sapiens
gaaagggcuucccuuugcag

SEQ ID NO: 23933 - RNA, 20 nt, Homo sapiens
gaaagggcuucccuuugcag

SEQ ID NO: 23934 - RNA, 22 nt, Homo sapiens
aaagacguggagaaauuagaau

SEQ ID NO: 23935 - RNA, 21 nt, Homo sapiens
cagguaccaauauuuuaucua

SEQ ID NO: 23936 - RNA, 21 nt, Homo sapiens
acuagcuuauacauaaaauua

SEQ ID NO: 23937 - RNA, 22 nt, Homo sapiens
cugcacuuuuaugaauaagcuc

SEQ ID NO: 23938 - RNA, 23 nt, Homo sapiens
ggacauuguuucagugcccaagu

SEQ ID NO: 23939 - RNA, 17 nt, Homo sapiens
gggagaggaggaggcga

SEQ ID NO: 23940 - RNA, 22 nt, Homo sapiens
ggagcccgcgccccgcgccgag

SEQ ID NO: 23941 - RNA, 22 nt, Homo sapiens
uagcagaagcauuuccgcacac

SEQ ID NO: 23942 - RNA, 18 nt, Homo sapiens
auucaaucuacugccuca

SEQ ID NO: 23943 - RNA, 21 nt, Homo sapiens
acaggauugagggggggcccu

SEQ ID NO: 23944 - RNA, 21 nt, Homo sapiens
aggagacucacaaguuccugc

SEQ ID NO: 23945 - RNA, 21 nt, Homo sapiens
ggggagcgggggcccugccuu

SEQ ID NO: 23946 - RNA, 21 nt, Homo sapiens
gagcugcauccuggcuccggg

SEQ ID NO: 23947 - RNA, 21 nt, Homo sapiens
auaauggagaccaggccacga

SEQ ID NO: 23948 - RNA, 22 nt, Homo sapiens
cugggggcggcacaggggcuca

SEQ ID NO: 23949 - RNA, 22 nt, Homo sapiens
caaacaccauugucacacucca

SEQ ID NO: 23950 - RNA, 18 nt, Homo sapiens
cccccaccaccacgcccg

SEQ ID NO: 23951 - RNA, 21 nt, Homo sapiens
gaccaaucgccguccccgccg

SEQ ID NO: 23952 - RNA, 22 nt, Homo sapiens
cggugagcacccggccccugcg

SEQ ID NO: 23953 - RNA, 22 nt, Homo sapiens
aacacucuaaagggaugcacga

SEQ ID NO: 23954 - RNA, 21 nt, Homo sapiens
guucuaacccauuguggccaa

SEQ ID NO: 23955 - RNA, 21 nt, Homo sapiens
ggacuauagaacuuucccccu

SEQ ID NO: 23956 - RNA, 22 nt, Homo sapiens
gcggucccgcggcgccccgccu

SEQ ID NO: 23957 - RNA, 22 nt, Homo sapiens
ugcuguuagcccuagccccgca

SEQ ID NO: 23958 - RNA, 20 nt, Homo sapiens
uacugcuuccacagcucccc

SEQ ID NO: 23959 - RNA, 22 nt, Homo sapiens
uaaaugaauucaauuuccuucu

SEQ ID NO: 23960 - RNA, 17 nt, Homo sapiens
uggcgcccgaacaggga

SEQ ID NO: 23961 - RNA, 19 nt, Homo sapiens
ucccugauccaaaaaucca

SEQ ID NO: 23962 - RNA, 22 nt, Homo sapiens
uccacauggaguugcuguuaca

SEQ ID NO: 23963 - RNA, 22 nt, Homo sapiens
cagacuccgguggaaugaagga

SEQ ID NO: 23964 - RNA, 22 nt, Homo sapiens
ugggguauuugacaaacugaca

SEQ ID NO: 23965 - RNA, 22 nt, Homo sapiens
uaaccgauuucagauggugcua

SEQ ID NO: 23966 - RNA, 22 nt, Homo sapiens
cuuccagucgaggauguuuaca

SEQ ID NO: 23967 - RNA, 22 nt, Homo sapiens
cuuccagucggggauguuuaca

SEQ ID NO: 23968 - RNA, 22 nt, Homo sapiens
cuuccagucaaggauguuuaca

SEQ ID NO: 23969 - RNA, 23 nt, Homo sapiens
ccuucucagaaaggugaaauuua

SEQ ID NO: 23970 - RNA, 22 nt, Homo sapiens
acacaccaaggauaauuucucc

SEQ ID NO: 23971 - RNA, 21 nt, Homo sapiens
cagguaccaauauuuuaucua

SEQ ID NO: 23972 - RNA, 22 nt, Homo sapiens
ggagauggagccagggcccuaa

SEQ ID NO: 23973 - RNA, 22 nt, Homo sapiens
cacugguacaaggguugggaga

SEQ ID NO: 23974 - RNA, 23 nt, Homo sapiens
cuaacugcacuagaugcaccuua

SEQ ID NO: 23975 - RNA, 22 nt, Homo sapiens
accuaauauaucaaacauauca

SEQ ID NO: 23976 - RNA, 21 nt, Homo sapiens
aacccaauaucaaacauauca

SEQ ID NO: 23977 - RNA, 22 nt, Homo sapiens
uuaacagcuaagcacccuaauc

SEQ ID NO: 23978 - RNA, 22 nt, Homo sapiens
cgggacguccagacucaacucu

SEQ ID NO: 23979 - RNA, 22 nt, Homo sapiens
acggaagggcagagagggccag

SEQ ID NO: 23980 - RNA, 22 nt, Homo sapiens
ccucaggcacggccgggccacc

SEQ ID NO: 23981 - RNA, 25 nt, Homo sapiens
gaauccugguucugucccucacuag

SEQ ID NO: 23982 - RNA, 22 nt, Homo sapiens
acucaguaugccaggguaccau

SEQ ID NO: 23983 - RNA, 22 nt, Homo sapiens
ggagauggagccagggcccuaa

SEQ ID NO: 23984 - RNA, 22 nt, Homo sapiens
ggagauggagccagggcccuaa

SEQ ID NO: 23985 - RNA, 21 nt, Homo sapiens
ccgugguucuacccuguggua

SEQ ID NO: 23986 - RNA, 20 nt, Homo sapiens
cccgccgcgucgcccugggg

SEQ ID NO: 23987 - RNA, 21 nt, Homo sapiens
aacggaaccacuagugacuug

SEQ ID NO: 23988 - RNA, 24 nt, Homo sapiens
ugggagaaccucccugcuucugcu

SEQ ID NO: 23989 - RNA, 22 nt, Homo sapiens
agcugaguguaggauguuuaca

SEQ ID NO: 23990 - RNA, 22 nt, Homo sapiens
acggaagggcagagagggccag

SEQ ID NO: 23991 - RNA, 21 nt, Homo sapiens
uucuaggauaggcccaggggc

SEQ ID NO: 23992 - RNA, 22 nt, Homo sapiens
ccuggccgugugguuagugauu

SEQ ID NO: 23993 - RNA, 22 nt, Homo sapiens
auaaacgacaccuccuugagaa

SEQ ID NO: 23994 - RNA, 22 nt, Homo sapiens
gaacuugcuaaaaaugcagaau

SEQ ID NO: 23995 - RNA, 22 nt, Homo sapiens
ccucaggcacggccgggccacc

SEQ ID NO: 23996 - RNA, 21 nt, Homo sapiens
aggagacucacaaguuccugc

SEQ ID NO: 23997 - RNA, 22 nt, Homo sapiens
caaacaccauugucacacucca

SEQ ID NO: 23998 - RNA, 17 nt, Homo sapiens
gacagccucucccccac

SEQ ID NO: 23999 - RNA, 21 nt, Homo sapiens
cggggugcacgggcggagggc

SEQ ID NO: 24000 - RNA, 23 nt, Homo sapiens
gggagugaagacacggagccaga

SEQ ID NO: 24001 - RNA, 22 nt, Homo sapiens
agcccaaaaggagaauucuuug

SEQ ID NO: 24002 - RNA, 21 nt, Homo sapiens
gaccaaucgccguccccgccg

SEQ ID NO: 24003 - RNA, 21 nt, Homo sapiens
gaccaaucgccguccccgccg

SEQ ID NO: 24004 - RNA, 22 nt, Homo sapiens
uagucaagugaagcagugggag

SEQ ID NO: 24005 - RNA, 22 nt, Homo sapiens
ucagaccgagacaagugcaaug

SEQ ID NO: 24006 - RNA, 21 nt, Homo sapiens
acaggauugagggggggcccu

SEQ ID NO: 24007 - RNA, 22 nt, Homo sapiens
agcugaguguaggauguuuaca

SEQ ID NO: 24008 - RNA, 23 nt, Homo sapiens
aaagucucgcucucugccccuca

SEQ ID NO: 24009 - RNA, 22 nt, Homo sapiens
ugcaagccuugggugugggagg

SEQ ID NO: 24010 - RNA, 22 nt, Homo sapiens
aguccagauucugugcccacca

SEQ ID NO: 24011 - RNA, 25 nt, Homo sapiens
acggagcugucccaacaccaccccu

SEQ ID NO: 24012 - RNA, 25 nt, Homo sapiens
acggagcugucccaacaccaccccu

SEQ ID NO: 24013 - RNA, 22 nt, Homo sapiens
gcacauguucugcggcccacca

SEQ ID NO: 24014 - RNA, 22 nt, Homo sapiens
gcggucccgcggcgccccgccu

SEQ ID NO: 24015 - RNA, 22 nt, Homo sapiens
gcggucccgcggcgccccgccu

SEQ ID NO: 24016 - RNA, 20 nt, Homo sapiens
uacugcuuccacagcucccc

SEQ ID NO: 24017 - RNA, 20 nt, Homo sapiens
uacugcuuccacagcucccc

SEQ ID NO: 24018 - RNA, 23 nt, Homo sapiens
gcacaugugcacacagccgggug

SEQ ID NO: 24019 - RNA, 22 nt, Homo sapiens
auccuucuacaaauucacccau

SEQ ID NO: 24020 - RNA, 22 nt, Homo sapiens
aggucucacuuuguugcccaga

SEQ ID NO: 24021 - RNA, 22 nt, Homo sapiens
ucaggaacugccuuucucucca

SEQ ID NO: 24022 - RNA, 24 nt, Homo sapiens
acucacaccuagguuccaaggauu

SEQ ID NO: 24023 - RNA, 22 nt, Homo sapiens
acgguccuacacucaaggcaug

SEQ ID NO: 24024 - RNA, 25 nt, Homo sapiens
aaggagcucagaagcccugcccagc

SEQ ID NO: 24025 - RNA, 23 nt, Homo sapiens
cacugugggcccucuccgcacca

SEQ ID NO: 24026 - RNA, 22 nt, Homo sapiens
cgaccauggcuguagacuguua

SEQ ID NO: 24027 - RNA, 25 nt, Homo sapiens
agcuagucaagcgcgguuguggggg

SEQ ID NO: 24028 - RNA, 21 nt, Homo sapiens
ggccgugacuggagacuguua

SEQ ID NO: 24029 - RNA, 22 nt, Homo sapiens
cuuccagucgaggauguuuaca

SEQ ID NO: 24030 - RNA, 22 nt, Homo sapiens
cuuccagucggggauguuuaca

SEQ ID NO: 24031 - RNA, 22 nt, Homo sapiens
cuuccagucaaggauguuuaca

SEQ ID NO: 24032 - RNA, 22 nt, Homo sapiens
ucaguuuccucugcaaacaguu

SEQ ID NO: 24033 - RNA, 21 nt, Homo sapiens
aaacaucacugcaagucuuaa

SEQ ID NO: 24034 - RNA, 22 nt, Homo sapiens
cucagagcagacgugguucuca

SEQ ID NO: 24035 - RNA, 21 nt, Homo sapiens
cuggaggacggcaacagucag

SEQ ID NO: 24036 - RNA, 22 nt, Homo sapiens
cuagggaacacagggcugguga

SEQ ID NO: 24037 - RNA, 22 nt, Homo sapiens
cuggagagacaaggggaagagg

SEQ ID NO: 24038 - RNA, 23 nt, Homo sapiens
cggccugauucacaacaccagcu

SEQ ID NO: 24039 - RNA, 22 nt, Homo sapiens
ucaggaacugccuuucucucca

SEQ ID NO: 24040 - RNA, 21 nt, Homo sapiens
gaccaaucgccguccccgccg

SEQ ID NO: 24041 - RNA, 21 nt, Homo sapiens
ggaaaucccuggcaaugugau

SEQ ID NO: 24042 - RNA, 21 nt, Homo sapiens
gguaaucccuggcaaugugau

SEQ ID NO: 24043 - RNA, 19 nt, Homo sapiens
gccugcugacaccgugccu

SEQ ID NO: 24044 - RNA, 22 nt, Homo sapiens
gcggucccgcggcgccccgccu

SEQ ID NO: 24045 - RNA, 23 nt, Homo sapiens
cccagcuagauuguaagcuccuu

SEQ ID NO: 24046 - RNA, 20 nt, Homo sapiens
cccugcgccaucuccucuac

SEQ ID NO: 24047 - RNA, 23 nt, Homo sapiens
gucacaucccucccaagacccuc

SEQ ID NO: 24048 - RNA, 20 nt, Homo sapiens
uacugcuuccacagcucccc

SEQ ID NO: 24049 - RNA, 22 nt, Homo sapiens
aacccauggaauucaguucuca

SEQ ID NO: 24050 - RNA, 24 nt, Homo sapiens
agugugaguucuaccauugccaaa

SEQ ID NO: 24051 - RNA, 18 nt, Homo sapiens
auucaaucuacugccuca

SEQ ID NO: 24052 - RNA, 22 nt, Homo sapiens
agcccaaaaggagaauucuuug

SEQ ID NO: 24053 - RNA, 20 nt, Homo sapiens
acagcaaggagggcaggagg

SEQ ID NO: 24054 - RNA, 21 nt, Homo sapiens
gagcuacagugcuucaucuca

SEQ ID NO: 24055 - RNA, 21 nt, Homo sapiens
cguacgcuauacggucuacua

SEQ ID NO: 24056 - RNA, 22 nt, Homo sapiens
acaaaaguugccuuugugugau

SEQ ID NO: 24057 - RNA, 22 nt, Homo sapiens
uuucaguuaucaaucugucaca

SEQ ID NO: 24058 - RNA, 21 nt, Homo sapiens
ggacuauagaacuuucccccu

SEQ ID NO: 24059 - RNA, 21 nt, Homo sapiens
ggggagcgggggcccugccuu

SEQ ID NO: 24060 - RNA, 21 nt, Homo sapiens
ccccucccagccucccugcca

SEQ ID NO: 24061 - RNA, 18 nt, Homo sapiens
aucacauucaccucccug

SEQ ID NO: 24062 - RNA, 23 nt, Homo sapiens
gggagugaagacacggagccaga

SEQ ID NO: 24063 - RNA, 22 nt, Homo sapiens
ucaggaacugccuuucucucca

SEQ ID NO: 24064 - RNA, 22 nt, Homo sapiens
cggugagcacccggccccugcg

SEQ ID NO: 24065 - RNA, 22 nt, Homo sapiens
uggcagcagcggagggggcaga

SEQ ID NO: 24066 - RNA, 20 nt, Homo sapiens
cccgccgcgucgcccugggg

SEQ ID NO: 24067 - RNA, 22 nt, Homo sapiens
ucagaccgagacaagugcaaug

SEQ ID NO: 24068 - RNA, 20 nt, Homo sapiens
ccagcagcaccuggggcagu

SEQ ID NO: 24069 - RNA, 21 nt, Homo sapiens
auccuguacugagcugccccg

SEQ ID NO: 24070 - RNA, 21 nt, Homo sapiens
cucacucagauggccaacuca

SEQ ID NO: 24071 - RNA, 24 nt, Homo sapiens
acgcagagcccgaaagcccccagu

SEQ ID NO: 24072 - RNA, 21 nt, Homo sapiens
caucaccuuccuucuccucca

SEQ ID NO: 24073 - RNA, 22 nt, Homo sapiens
ucggucccucgggccagggcag

SEQ ID NO: 24074 - RNA, 21 nt, Homo sapiens
ggggagcgggggcccugccuu

SEQ ID NO: 24075 - RNA, 21 nt, Homo sapiens
aaagaucaaccauguauuauu

SEQ ID NO: 24076 - RNA, 22 nt, Homo sapiens
acaccgaggagcccaucaugau

SEQ ID NO: 24077 - RNA, 22 nt, Homo sapiens
guagaagggaaucuugcauaag

SEQ ID NO: 24078 - RNA, 22 nt, Homo sapiens
gagauuggccauguaauacuca

SEQ ID NO: 24079 - RNA, 22 nt, Homo sapiens
gauuccaauuuuuccacaucuu

SEQ ID NO: 24080 - RNA, 23 nt, Homo sapiens
gagcaaggcucuugucuguaagu

SEQ ID NO: 24081 - RNA, 22 nt, Homo sapiens
auggcaguggaguuagugauug

SEQ ID NO: 24082 - RNA, 22 nt, Homo sapiens
ccuggccgugugguuagugauu

SEQ ID NO: 24083 - RNA, 22 nt, Homo sapiens
uccggggacgaacgggacgggu

SEQ ID NO: 24084 - RNA, 18 nt, Homo sapiens
caccaccagagccaacgu

SEQ ID NO: 24085 - RNA, 23 nt, Homo sapiens
aggaacagcagcagcccgggccg

SEQ ID NO: 24086 - RNA, 21 nt, Homo sapiens
gaccaaucgccguccccgccg

SEQ ID NO: 24087 - RNA, 22 nt, Homo sapiens
cggugagcacccggccccugcg

SEQ ID NO: 24088 - RNA, 21 nt, Homo sapiens
ucaaucacagauagcaccccu

SEQ ID NO: 24089 - RNA, 23 nt, Homo sapiens
acccucuauagggaagcgcguuc

SEQ ID NO: 24090 - RNA, 21 nt, Homo sapiens
acuggcugagucaggacuagc

SEQ ID NO: 24091 - RNA, 19 nt, Homo sapiens
ucagcaguaccagccuaga

SEQ ID NO: 24092 - RNA, 22 nt, Homo sapiens
gcggucccgcggcgccccgccu

SEQ ID NO: 24093 - RNA, 22 nt, Homo sapiens
ggaggccgggacgagugcaaua

SEQ ID NO: 24094 - RNA, 17 nt, Homo sapiens
gggagaggaggaggcga

SEQ ID NO: 24095 - RNA, 24 nt, Homo sapiens
agugugaguucuaccauugccaaa

SEQ ID NO: 24096 - RNA, 18 nt, Homo sapiens
auucaaucuacugccuca

SEQ ID NO: 24097 - RNA, 21 nt, Homo sapiens
gaccaaucgccguccccgccg

SEQ ID NO: 24098 - RNA, 22 nt, Homo sapiens
ucagaccgagacaagugcaaug

SEQ ID NO: 24099 - RNA, 19 nt, Homo sapiens
guugggaucacaggcgccc

SEQ ID NO: 24100 - RNA, 21 nt, Homo sapiens
guccugagagcgcugccuccu

SEQ ID NO: 24101 - RNA, 25 nt, Homo sapiens
accaacggaccuacuucccuccgcc

SEQ ID NO: 24102 - RNA, 22 nt, Homo sapiens
gcggucccgcggcgccccgccu

SEQ ID NO: 24103 - RNA, 21 nt, Homo sapiens
gguggagcccugagaaccgga

SEQ ID NO: 24104 - RNA, 21 nt, Homo sapiens
aagggucaguaagcacccgcg

SEQ ID NO: 24105 - RNA, 20 nt, Homo sapiens
uacugcuuccacagcucccc

SEQ ID NO: 24106 - RNA, 26 nt, Homo sapiens
uuucagaauuugcugccaucaucauc

SEQ ID NO: 24107 - RNA, 21 nt, Homo sapiens
ugcaggcugaucuucuucucu

SEQ ID NO: 24108 - RNA, 17 nt, Homo sapiens
gggagaggaggaggcga

SEQ ID NO: 24109 - RNA, 22 nt, Homo sapiens
ucccucacacagaauuccagaa

SEQ ID NO: 24110 - RNA, 22 nt, Homo sapiens
agaaaaugccccucaguuuuga

SEQ ID NO: 24111 - RNA, 22 nt, Homo sapiens
cuaccauaggguaaaaccacug

SEQ ID NO: 24112 - RNA, 22 nt, Homo sapiens
ccaucuuuaccagacaguguua

SEQ ID NO: 24113 - RNA, 21 nt, Homo sapiens
uucuaggauaggcccaggggc

SEQ ID NO: 24114 - RNA, 22 nt, Homo sapiens
gcaaaaguaauugccaguuuug

SEQ ID NO: 24115 - RNA, 22 nt, Homo sapiens
ugcaaaaguagucucaguuuuu

SEQ ID NO: 24116 - RNA, 19 nt, Homo sapiens
aaaaguaauuacaguuuuu

SEQ ID NO: 24117 - RNA, 22 nt, Homo sapiens
gcaaaaguaacugcaguuuugg

SEQ ID NO: 24118 - RNA, 21 nt, Homo sapiens
gcuccaaccucagcagacugu

SEQ ID NO: 24119 - RNA, 22 nt, Homo sapiens
acuccaacagggccgcgucucc

SEQ ID NO: 24120 - RNA, 21 nt, Homo sapiens
aucugcacugucagcacuuua

SEQ ID NO: 24121 - RNA, 21 nt, Homo sapiens
cugaggagagaggaggugggg

SEQ ID NO: 24122 - RNA, 22 nt, Homo sapiens
cuggagagacaaggggaagagg

SEQ ID NO: 24123 - RNA, 18 nt, Homo sapiens
ugguggcagaggugggau

SEQ ID NO: 24124 - RNA, 20 nt, Homo sapiens
acagcaaggagggcaggagg

SEQ ID NO: 24125 - RNA, 22 nt, Homo sapiens
cucaauagacugugagcuccuu

SEQ ID NO: 24126 - RNA, 22 nt, Homo sapiens
auaaggauuuuuaggggcauua

SEQ ID NO: 24127 - RNA, 22 nt, Homo sapiens
ccucaggcacggccgggccacc

SEQ ID NO: 24128 - RNA, 23 nt, Homo sapiens
cccagcuagauuguaagcuccuu

SEQ ID NO: 24129 - RNA, 21 nt, Homo sapiens
caucaccuuccuucuccucca

SEQ ID NO: 24130 - RNA, 22 nt, Homo sapiens
agaggcaggguaguguaaugga

SEQ ID NO: 24131 - RNA, 22 nt, Homo sapiens
cugcgauuccucccucuacugu

SEQ ID NO: 24132 - RNA, 22 nt, Homo sapiens
caaacaccauugucacacucca

SEQ ID NO: 24133 - RNA, 22 nt, Homo sapiens
gccagcuaacaauacacugccu

SEQ ID NO: 24134 - RNA, 20 nt, Homo sapiens
cuggaggaagggcccagagg

SEQ ID NO: 24135 - RNA, 22 nt, Homo sapiens
gccuaagacacaggcccagaga

SEQ ID NO: 24136 - RNA, 23 nt, Homo sapiens
uguaggcuggggauaaaugaaua

SEQ ID NO: 24137 - RNA, 21 nt, Homo sapiens
acuccaaagggaagcgccuuc

SEQ ID NO: 24138 - RNA, 19 nt, Homo sapiens
ccugcuccaaaaauccauu

SEQ ID NO: 24139 - RNA, 19 nt, Homo sapiens
aagccaaagccuuauccau

SEQ ID NO: 24140 - RNA, 21 nt, Homo sapiens
aaagagaccgguucacuguga

SEQ ID NO: 24141 - RNA, 22 nt, Homo sapiens
gaaaagccagggucuguauaga

SEQ ID NO: 24142 - RNA, 19 nt, Homo sapiens
ucccugauccaaaaaucca

SEQ ID NO: 24143 - RNA, 22 nt, Homo sapiens
augcccuuuuaacauugcacug

SEQ ID NO: 24144 - RNA, 22 nt, Homo sapiens
augcccuuucaucauugcacug

SEQ ID NO: 24145 - RNA, 23 nt, Homo sapiens
ucaguuuugcauagauuugcaca

SEQ ID NO: 24146 - RNA, 23 nt, Homo sapiens
ucaguuuugcauggauuugcaca

SEQ ID NO: 24147 - RNA, 21 nt, Homo sapiens
gcggaacuuagccacugugaa

SEQ ID NO: 24148 - RNA, 21 nt, Homo sapiens
gcagaacuuagccacugugaa

SEQ ID NO: 24149 - RNA, 23 nt, Homo sapiens
gcuuugacaauacuauugcacug

SEQ ID NO: 24150 - RNA, 23 nt, Homo sapiens
gcuuugacaauaucauugcacug

SEQ ID NO: 24151 - RNA, 23 nt, Homo sapiens
acacuuacuggacaccuacuagg

SEQ ID NO: 24152 - RNA, 21 nt, Homo sapiens
aaagaucaaccauguauuauu

SEQ ID NO: 24153 - RNA, 23 nt, Homo sapiens
acccuauaagcaauauugcacua

SEQ ID NO: 24154 - RNA, 21 nt, Homo sapiens
uucacuccaaaaggugcaaaa

SEQ ID NO: 24155 - RNA, 22 nt, Homo sapiens
gcaaaaguaauugagauuuuug

SEQ ID NO: 24156 - RNA, 23 nt, Homo sapiens
agacaaggcccacccgugcaaac

SEQ ID NO: 24157 - RNA, 23 nt, Homo sapiens
uguaggcuggggauaaaugaaua

SEQ ID NO: 24158 - RNA, 22 nt, Homo sapiens
ucaggaacugccuuucucucca

SEQ ID NO: 24159 - RNA, 22 nt, Homo sapiens
ccuaaugauucaucauucucaa

SEQ ID NO: 24160 - RNA, 22 nt, Homo sapiens
gcaaaaguaauugccaguuuug

SEQ ID NO: 24161 - RNA, 22 nt, Homo sapiens
ugcaaaaguagucucaguuuuu

SEQ ID NO: 24162 - RNA, 19 nt, Homo sapiens
aaaaguaauuacaguuuuu

SEQ ID NO: 24163 - RNA, 21 nt, Homo sapiens
aggcggcaggcacaggacugg

SEQ ID NO: 24164 - RNA, 22 nt, Homo sapiens
uauccacuacaccccgcugccu

SEQ ID NO: 24165 - RNA, 21 nt, Homo sapiens
caugcacaugcacacauacau

SEQ ID NO: 24166 - RNA, 22 nt, Homo sapiens
guagaagggaaucuugcauaag

SEQ ID NO: 24167 - RNA, 21 nt, Homo sapiens
ucuacucacagaagugucaau

SEQ ID NO: 24168 - RNA, 22 nt, Homo sapiens
acaucaucgcauauugacacaa

SEQ ID NO: 24169 - RNA, 23 nt, Homo sapiens
aaagucucgcucucugccccuca

SEQ ID NO: 24170 - RNA, 23 nt, Homo sapiens
caugagugacgcccucuggagua

SEQ ID NO: 24171 - RNA, 22 nt, Homo sapiens
guacaaaaguaauuacaguuuu

SEQ ID NO: 24172 - RNA, 22 nt, Homo sapiens
accuucccugguacagaauacu

SEQ ID NO: 24173 - RNA, 22 nt, Homo sapiens
aacccauggaauucaguucuca

SEQ ID NO: 24174 - RNA, 22 nt, Homo sapiens
agccuauggaauucaguucuca

SEQ ID NO: 24175 - RNA, 22 nt, Homo sapiens
aaaguaacugcaguuuuugcua

SEQ ID NO: 24176 - RNA, 17 nt, Homo sapiens
caccugaauuacuugaa

SEQ ID NO: 24177 - RNA, 24 nt, Homo sapiens
gaaagugcauagaauucugucugg

SEQ ID NO: 24178 - RNA, 22 nt, Homo sapiens
agcccaaaaggagaauucuuug

SEQ ID NO: 24179 - RNA, 22 nt, Homo sapiens
agccuauccuggauuacuugaa

SEQ ID NO: 24180 - RNA, 21 nt, Homo sapiens
accuauccugaauuacuugaa

SEQ ID NO: 24181 - RNA, 22 nt, Homo sapiens
uccacauggaguugcuguuaca

SEQ ID NO: 24182 - RNA, 22 nt, Homo sapiens
uaaaugaauucaauuuccuucu

SEQ ID NO: 24183 - RNA, 21 nt, Homo sapiens
uagcacccagauagcaaggau

SEQ ID NO: 24184 - RNA, 22 nt, Homo sapiens
caaacaccauugucacacucca

SEQ ID NO: 24185 - RNA, 22 nt, Homo sapiens
caaacaccauugucacacucca

SEQ ID NO: 24186 - RNA, 23 nt, Homo sapiens
gggagugaagacacggagccaga

SEQ ID NO: 24187 - RNA, 20 nt, Homo sapiens
cccgccgcgucgcccugggg

SEQ ID NO: 24188 - RNA, 22 nt, Homo sapiens
ucaacaucagucugauaagcua

SEQ ID NO: 24189 - RNA, 21 nt, Homo sapiens
uucuaggauaggcccaggggc

SEQ ID NO: 24190 - RNA, 23 nt, Homo sapiens
aaaucagaaucacaccuggggga

SEQ ID NO: 24191 - RNA, 23 nt, Homo sapiens
gucagaccccgagggguccucgc

SEQ ID NO: 24192 - RNA, 24 nt, Homo sapiens
acgcagagcccgaaagcccccagu

SEQ ID NO: 24193 - RNA, 24 nt, Homo sapiens
acgcgcaggccagagacccaggca

SEQ ID NO: 24194 - RNA, 21 nt, Homo sapiens
ccccucccagccucccugcca

SEQ ID NO: 24195 - RNA, 17 nt, Homo sapiens
gggagaggaggaggcga

SEQ ID NO: 24196 - RNA, 21 nt, Homo sapiens
gaccaaucgccguccccgccg

SEQ ID NO: 24197 - RNA, 22 nt, Homo sapiens
uggcagcagcggagggggcaga

SEQ ID NO: 24198 - RNA, 22 nt, Homo sapiens
ucagaccgagacaagugcaaug

SEQ ID NO: 24199 - RNA, 20 nt, Homo sapiens
ccagcagcaccuggggcagu

SEQ ID NO: 24200 - RNA, 21 nt, Homo sapiens
auccuguacugagcugccccg

SEQ ID NO: 24201 - RNA, 25 nt, Homo sapiens
accaacggaccuacuucccuccgcc

SEQ ID NO: 24202 - RNA, 22 nt, Homo sapiens
gcggucccgcggcgccccgccu

SEQ ID NO: 24203 - RNA, 22 nt, Homo sapiens
ugcuguuagcccuagccccgca

SEQ ID NO: 24204 - RNA, 22 nt, Homo sapiens
uauccacuacaccccgcugccu

SEQ ID NO: 24205 - RNA, 22 nt, Homo sapiens
ggcagagagucagagcgcggau

SEQ ID NO: 24206 - RNA, 20 nt, Homo sapiens
cuggggaaaaggguggcacg

SEQ ID NO: 24207 - RNA, 20 nt, Homo sapiens
cuggggaaaaggguggcacg

SEQ ID NO: 24208 - RNA, 23 nt, Homo sapiens
acucaccgacagcguugaauguu

SEQ ID NO: 24209 - RNA, 22 nt, Homo sapiens
ucaggaacugccuuucucucca

SEQ ID NO: 24210 - RNA, 22 nt, Homo sapiens
cccaacaacaugaaacuaccua

SEQ ID NO: 24211 - RNA, 23 nt, Homo sapiens
cuaccugcacuaugagcacuuug

SEQ ID NO: 24212 - RNA, 22 nt, Homo sapiens
ucaccauugcuaaagugcaauu

SEQ ID NO: 24213 - RNA, 20 nt, Homo sapiens
acccaccuggagauccaugg

SEQ ID NO: 24214 - RNA, 22 nt, Homo sapiens
aggaaaccagcaaguguugacg

SEQ ID NO: 24215 - RNA, 21 nt, Homo sapiens
aaaacaaaaucucaccguuuu

SEQ ID NO: 24216 - RNA, 22 nt, Homo sapiens
gcaaagguaauugcuguuuucg

SEQ ID NO: 24217 - RNA, 21 nt, Homo sapiens
guucuaacccauuguggccaa

SEQ ID NO: 24218 - RNA, 23 nt, Homo sapiens
gggccgcagcugucgcccguguc

SEQ ID NO: 24219 - RNA, 21 nt, Homo sapiens
gcuccaaccucagcagacugu

SEQ ID NO: 24220 - RNA, 19 nt, Homo sapiens
ucccacaggaagcagacac

SEQ ID NO: 24221 - RNA, 22 nt, Homo sapiens
ugcuguuagcccuagccccgca

SEQ ID NO: 24222 - RNA, 21 nt, Homo sapiens
cuacgcagaaaggacacagug

SEQ ID NO: 24223 - RNA, 27 nt, Homo sapiens
uuuagcacagugcuuauacaagaaggu

SEQ ID NO: 24224 - RNA, 18 nt, Homo sapiens
cagcagccuccuucucaa

SEQ ID NO: 24225 - RNA, 20 nt, Homo sapiens
uaugaacaauuucuaggaau

SEQ ID NO: 24226 - RNA, 18 nt, Homo sapiens
acccucugaaaggaagca

SEQ ID NO: 24227 - RNA, 22 nt, Homo sapiens
aaagugcuucuuaccuccagau

SEQ ID NO: 24228 - RNA, 22 nt, Homo sapiens
ccuggcacacaguagaccuuca

SEQ ID NO: 24229 - RNA, 23 nt, Homo sapiens
gagcaaggcucuugucuguaagu

SEQ ID NO: 24230 - RNA, 21 nt, Homo sapiens
agcuaugccagcaucuugccu

SEQ ID NO: 24231 - RNA, 22 nt, Homo sapiens
gcacacaauaaauguuugcuga

SEQ ID NO: 24232 - RNA, 24 nt, Homo sapiens
gaaagugcauagaauucugucugg

SEQ ID NO: 24233 - RNA, 22 nt, Homo sapiens
ccaucuuuaccagacaguguua

SEQ ID NO: 24234 - RNA, 24 nt, Homo sapiens
agugugaguucuaccauugccaaa

SEQ ID NO: 24235 - RNA, 22 nt, Homo sapiens
acaucguuaccagacaguguua

SEQ ID NO: 24236 - RNA, 22 nt, Homo sapiens
acaguucuucaacuggcagcuu

SEQ ID NO: 24237 - RNA, 23 nt, Homo sapiens
ucaacgggagugaucgugucauu

SEQ ID NO: 24238 - RNA, 22 nt, Homo sapiens
aucgggaggggacugagccuga

SEQ ID NO: 24239 - RNA, 19 nt, Homo sapiens
auuuugguacagcagcuca

SEQ ID NO: 24240 - RNA, 19 nt, Homo sapiens
aagacauuuucagacagcu

SEQ ID NO: 24241 - RNA, 19 nt, Homo sapiens
ucccacaggaagcagacac

SEQ ID NO: 24242 - RNA, 21 nt, Homo sapiens
caucaccuuccuucuccucca

SEQ ID NO: 24243 - RNA, 22 nt, Homo sapiens
ucaaugacucagguaaguugca

SEQ ID NO: 24244 - RNA, 22 nt, Homo sapiens
ggcagagagucagagcgcggau

SEQ ID NO: 24245 - RNA, 18 nt, Homo sapiens
ugguggcagaggugggau

SEQ ID NO: 24246 - RNA, 22 nt, Homo sapiens
aacaacacuugaccacauccug

SEQ ID NO: 24247 - RNA, 17 nt, Homo sapiens
gggagaggaggaggcga

SEQ ID NO: 24248 - RNA, 18 nt, Homo sapiens
aucacauucaccucccug

SEQ ID NO: 24249 - RNA, 21 nt, Homo sapiens
gaccaaucgccguccccgccg

SEQ ID NO: 24250 - RNA, 22 nt, Homo sapiens
ugagccacugugccuggccuga

SEQ ID NO: 24251 - RNA, 22 nt, Homo sapiens
ugcaagccuugggugugggagg

SEQ ID NO: 24252 - RNA, 24 nt, Homo sapiens
acgcgcaggccagagacccaggca

SEQ ID NO: 24253 - RNA, 22 nt, Homo sapiens
gcggucccgcggcgccccgccu

SEQ ID NO: 24254 - RNA, 22 nt, Homo sapiens
ugcuguuagcccuagccccgca

SEQ ID NO: 24255 - RNA, 20 nt, Homo sapiens
uacugcuuccacagcucccc

SEQ ID NO: 24256 - RNA, 21 nt, Homo sapiens
guuauagaucuggauuugaac

SEQ ID NO: 24257 - RNA, 21 nt, Homo sapiens
aaagagaccgguucacuguga

SEQ ID NO: 24258 - RNA, 23 nt, Homo sapiens
ccacccaaugaccuacuccaaga

SEQ ID NO: 24259 - RNA, 24 nt, Homo sapiens
cugaucaguuacacaucacuucag

SEQ ID NO: 24260 - RNA, 22 nt, Homo sapiens
agcgggacuuugagggccaguu

SEQ ID NO: 24261 - RNA, 22 nt, Homo sapiens
cgaauccaccacgaacaacuuc

SEQ ID NO: 24262 - RNA, 20 nt, Homo sapiens
ugucuccacagggcucuuua

SEQ ID NO: 24263 - RNA, 22 nt, Homo sapiens
aggaaaccagcaaguguugacg

SEQ ID NO: 24264 - RNA, 22 nt, Homo sapiens
gguuaguggaccaggucacaaa

SEQ ID NO: 24265 - RNA, 21 nt, Homo sapiens
caucaccuuccuucuccucca

SEQ ID NO: 24266 - RNA, 21 nt, Homo sapiens
auaauggagaccaggccacga

SEQ ID NO: 24267 - RNA, 22 nt, Homo sapiens
cugggggcggcacaggggcuca

SEQ ID NO: 24268 - RNA, 20 nt, Homo sapiens
aagcagaaaaaggcaaacga

SEQ ID NO: 24269 - RNA, 22 nt, Homo sapiens
acaaaguucugugaugcacuga

SEQ ID NO: 24270 - RNA, 22 nt, Homo sapiens
cacaaaccauuaugugcugcua

SEQ ID NO: 24271 - RNA, 22 nt, Homo sapiens
uguaaaccaugaugugcugcua

SEQ ID NO: 24272 - RNA, 22 nt, Homo sapiens
cgccaauauuuacgugcugcua

SEQ ID NO: 24273 - RNA, 21 nt, Homo sapiens
gaccaaucgccguccccgccg

SEQ ID NO: 24274 - RNA, 21 nt, Homo sapiens
gccaauauuucugugcugcua

SEQ ID NO: 24275 - RNA, 22 nt, Homo sapiens
acugccugucugugccugcugu

SEQ ID NO: 24276 - RNA, 22 nt, Homo sapiens
accagguuccaccccagcaggc

SEQ ID NO: 24277 - RNA, 22 nt, Homo sapiens
uucaaaacaugaauugcugcug

SEQ ID NO: 24278 - RNA, 22 nt, Homo sapiens
auauuaggaacacaucgcaaaa

SEQ ID NO: 24279 - RNA, 21 nt, Homo sapiens
acaaaccacagugugcugcug

SEQ ID NO: 24280 - RNA, 22 nt, Homo sapiens
aaagugcuucuuaccuccagau

SEQ ID NO: 24281 - RNA, 22 nt, Homo sapiens
gaacuugcuaaaaaugcagaau

SEQ ID NO: 24282 - RNA, 19 nt, Homo sapiens
guugggaucacaggcgccc

SEQ ID NO: 24283 - RNA, 21 nt, Homo sapiens
ucccagcacacauuuagcuca

SEQ ID NO: 24284 - RNA, 22 nt, Homo sapiens
aagagggagacccaggcucgga

SEQ ID NO: 24285 - RNA, 22 nt, Homo sapiens
gcggucccgcggcgccccgccu

SEQ ID NO: 24286 - RNA, 22 nt, Homo sapiens
ugcuguuagcccuagccccgca

SEQ ID NO: 24287 - RNA, 22 nt, Homo sapiens
cucagagcagacgugguucuca

SEQ ID NO: 24288 - RNA, 22 nt, Homo sapiens
agagcaagaccccgucucuaaa

SEQ ID NO: 24289 - RNA, 22 nt, Homo sapiens
uagucaagugaagcagugggag

SEQ ID NO: 24290 - RNA, 22 nt, Homo sapiens
ucagaccgagacaagugcaaug

SEQ ID NO: 24291 - RNA, 22 nt, Homo sapiens
ugcaagccuugggugugggagg

SEQ ID NO: 24292 - RNA, 22 nt, Homo sapiens
acaucaucgcauauugacacaa

SEQ ID NO: 24293 - RNA, 22 nt, Homo sapiens
acaguggucaucgagugacaca

SEQ ID NO: 24294 - RNA, 21 nt, Homo sapiens
gagcuacagugcuucaucuca

SEQ ID NO: 24295 - RNA, 21 nt, Homo sapiens
cguacgcuauacggucuacua

SEQ ID NO: 24296 - RNA, 21 nt, Homo sapiens
uagcacccagauagcaaggau

SEQ ID NO: 24297 - RNA, 22 nt, Homo sapiens
ucaacaucagucugauaagcua

SEQ ID NO: 24298 - RNA, 22 nt, Homo sapiens
cugcacuuuuaugaauaagcuc

SEQ ID NO: 24299 - RNA, 23 nt, Homo sapiens
gggagugaagacacggagccaga

SEQ ID NO: 24300 - RNA, 22 nt, Homo sapiens
agcccaaaaggagaauucuuug

SEQ ID NO: 24301 - RNA, 23 nt, Homo sapiens
cccaacagacauggcgguacuca

SEQ ID NO: 24302 - RNA, 22 nt, Homo sapiens
agcgggacuuugagggccaguu

SEQ ID NO: 24303 - RNA, 23 nt, Homo sapiens
cuaccugcacuauaagcacuuua

SEQ ID NO: 24304 - RNA, 23 nt, Homo sapiens
uccaaucaguuccugaugcagua

SEQ ID NO: 24305 - RNA, 23 nt, Homo sapiens
gaaagugcccucaaggcugagug

SEQ ID NO: 24306 - RNA, 24 nt, Homo sapiens
cagaaagugcuuucuuuuggagaa

SEQ ID NO: 24307 - RNA, 22 nt, Homo sapiens
aacacucuaaaaggaggcacuu

SEQ ID NO: 24308 - RNA, 23 nt, Homo sapiens
ucacauaggaauaaaaagccaua

SEQ ID NO: 24309 - RNA, 21 nt, Homo sapiens
acaugguuagaucaagcacaa

SEQ ID NO: 24310 - RNA, 22 nt, Homo sapiens
gccaccuucaaaugggaagucu

SEQ ID NO: 24311 - RNA, 27 nt, Homo sapiens
uuuagcacagugcuuauacaagaaggu

SEQ ID NO: 24312 - RNA, 22 nt, Homo sapiens
gaggcucagaauggcucaggag

SEQ ID NO: 24313 - RNA, 21 nt, Homo sapiens
aagugucagacacgguggugg

SEQ ID NO: 24314 - RNA, 23 nt, Homo sapiens
cgugagcuccuggaggacaggga

SEQ ID NO: 24315 - RNA, 21 nt, Homo sapiens
cggcucggguggcggcgacgg

SEQ ID NO: 24316 - RNA, 22 nt, Homo sapiens
caaacaccauugucacacucca

SEQ ID NO: 24317 - RNA, 20 nt, Homo sapiens
cccgccgcgucgcccugggg

SEQ ID NO: 24318 - RNA, 22 nt, Homo sapiens
uagucaagugaagcagugggag

SEQ ID NO: 24319 - RNA, 22 nt, Homo sapiens
gauagagugcagaccagggucu

SEQ ID NO: 24320 - RNA, 24 nt, Homo sapiens
cacccccagagccucagcucccca

SEQ ID NO: 24321 - RNA, 17 nt, Homo sapiens
uggcgcccgaacaggga

SEQ ID NO: 24322 - RNA, 22 nt, Homo sapiens
agagagagucugcccuuguaua

SEQ ID NO: 24323 - RNA, 22 nt, Homo sapiens
acagagagcuugcccuuguaua

SEQ ID NO: 24324 - RNA, 22 nt, Homo sapiens
cuaccugagcuagcauacaagu

SEQ ID NO: 24325 - RNA, 21 nt, Homo sapiens
cggggugcacgggcggagggc

SEQ ID NO: 24326 - RNA, 21 nt, Homo sapiens
uucuaggauaggcccaggggc

SEQ ID NO: 24327 - RNA, 21 nt, Homo sapiens
ggacuauagaacuuucccccu

SEQ ID NO: 24328 - RNA, 22 nt, Homo sapiens
ucggucccucgggccagggcag

SEQ ID NO: 24329 - RNA, 22 nt, Homo sapiens
cccaacaacaggaaacuaccua

SEQ ID NO: 24330 - RNA, 22 nt, Homo sapiens
cggugagcacccggccccugcg

SEQ ID NO: 24331 - RNA, 23 nt, Homo sapiens
aaaucagaaucacaccuggggga

SEQ ID NO: 24332 - RNA, 24 nt, Homo sapiens
acgcagagcccgaaagcccccagu

SEQ ID NO: 24333 - RNA, 24 nt, Homo sapiens
cagaaagugcuuucuuuuggagaa

SEQ ID NO: 24334 - RNA, 22 nt, Homo sapiens
aacacucuaaaaggaggcacuu

SEQ ID NO: 24335 - RNA, 22 nt, Homo sapiens
aaaauacauauauaucuacgua

SEQ ID NO: 24336 - RNA, 22 nt, Homo sapiens
ucucucccauuagaguugaaaa

SEQ ID NO: 24337 - RNA, 21 nt, Homo sapiens
ccgugguucuacccuguggua

SEQ ID NO: 24338 - RNA, 22 nt, Homo sapiens
uguaaaccaugaugugcugcua

SEQ ID NO: 24339 - RNA, 20 nt, Homo sapiens
acauuacuguuaucaaaaca

SEQ ID NO: 24340 - RNA, 22 nt, Homo sapiens
uucaaaacaugaauugcugcug

SEQ ID NO: 24341 - RNA, 22 nt, Homo sapiens
uucaaaacaugaauugcugcug

SEQ ID NO: 24342 - RNA, 21 nt, Homo sapiens
acaaaccacagugugcugcug

SEQ ID NO: 24343 - RNA, 21 nt, Homo sapiens
agacacaccacggcacacuuc

SEQ ID NO: 24344 - RNA, 22 nt, Homo sapiens
gcaaaaguaauugcagugugug

SEQ ID NO: 24345 - RNA, 22 nt, Homo sapiens
acacaccaaggauaauuucucc

SEQ ID NO: 24346 - RNA, 20 nt, Homo sapiens
cugcgggaggacagggcuca

SEQ ID NO: 24347 - RNA, 22 nt, Homo sapiens
aacccauggaauucaguucuca

SEQ ID NO: 24348 - RNA, 21 nt, Homo sapiens
cggggugcacgggcggagggc

SEQ ID NO: 24349 - RNA, 22 nt, Homo sapiens
acaaaguucuguagugcacuga

SEQ ID NO: 24350 - RNA, 22 nt, Homo sapiens
acaaaguucugugaugcacuga

SEQ ID NO: 24351 - RNA, 23 nt, Homo sapiens
gggagugaagacacggagccaga

SEQ ID NO: 24352 - RNA, 21 nt, Homo sapiens
ccaaguucugucaugcacuga

SEQ ID NO: 24353 - RNA, 22 nt, Homo sapiens
uagucaagugaagcagugggag

SEQ ID NO: 24354 - RNA, 22 nt, Homo sapiens
agcugaguguaggauguuuaca

SEQ ID NO: 24355 - RNA, 23 nt, Homo sapiens
aaagucucgcucucugccccuca

SEQ ID NO: 24356 - RNA, 22 nt, Homo sapiens
ugcaagccuugggugugggagg

SEQ ID NO: 24357 - RNA, 20 nt, Homo sapiens
ugggccaccgccgagcggac

SEQ ID NO: 24358 - RNA, 21 nt, Homo sapiens
cccgaggagccgggcaggcuu

SEQ ID NO: 24359 - RNA, 25 nt, Homo sapiens
accaacggaccuacuucccuccgcc

SEQ ID NO: 24360 - RNA, 22 nt, Homo sapiens
ugcuguuagcccuagccccgca

SEQ ID NO: 24361 - RNA, 22 nt, Homo sapiens
cucagagcagacgugguucuca

SEQ ID NO: 24362 - RNA, 21 nt, Homo sapiens
gaccaaucgccguccccgccg

SEQ ID NO: 24363 - RNA, 22 nt, Homo sapiens
gcggucccgcggcgccccgccu

SEQ ID NO: 24364 - RNA, 21 nt, Homo sapiens
cccgaggagccgggcaggcuu

SEQ ID NO: 24365 - RNA, 22 nt, Homo sapiens
uaaaugaauucaauuuccuucu

SEQ ID NO: 24366 - RNA, 22 nt, Homo sapiens
ucccucacacagaauuccagaa

SEQ ID NO: 24367 - RNA, 22 nt, Homo sapiens
augcuuuuugggguaagggcuu

SEQ ID NO: 24368 - RNA, 21 nt, Homo sapiens
gcuccaaccucagcagacugu

SEQ ID NO: 24369 - RNA, 23 nt, Homo sapiens
cuaccugcacuguaagcacuuuu

SEQ ID NO: 24370 - RNA, 22 nt, Homo sapiens
agaggcaggguaguguaaugga

SEQ ID NO: 24371 - RNA, 22 nt, Homo sapiens
aacacucuaaagggaugcacga

SEQ ID NO: 24372 - RNA, 22 nt, Homo sapiens
gcacacaauaaauguuugcuga

SEQ ID NO: 24373 - RNA, 25 nt, Homo sapiens
aagaaagagucuugcuuugucgccc

SEQ ID NO: 24374 - RNA, 21 nt, Homo sapiens
uuccacgaccuaauccuaacu

SEQ ID NO: 24375 - RNA, 22 nt, Homo sapiens
gcuggguggagaagguggugaa

SEQ ID NO: 24376 - RNA, 22 nt, Homo sapiens
gagcccuggacuaggagucagc

SEQ ID NO: 24377 - RNA, 22 nt, Homo sapiens
gcaaaaguaauugccaguuuug

SEQ ID NO: 24378 - RNA, 22 nt, Homo sapiens
ugcaaaaguagucucaguuuuu

SEQ ID NO: 24379 - RNA, 19 nt, Homo sapiens
aaaaguaauuacaguuuuu

SEQ ID NO: 24380 - RNA, 20 nt, Homo sapiens
cccugcgccaucuccucuac

SEQ ID NO: 24381 - RNA, 24 nt, Homo sapiens
acucacaccuagguuccaaggauu

SEQ ID NO: 24382 - RNA, 23 nt, Homo sapiens
acacagcucuuccauaucuccag

SEQ ID NO: 24383 - RNA, 20 nt, Homo sapiens
auuucuauaucuaucuccau

SEQ ID NO: 24384 - RNA, 21 nt, Homo sapiens
accuauccugaauuacuugaa

SEQ ID NO: 24385 - RNA, 22 nt, Homo sapiens
aaagagguuaaccauguauuau

SEQ ID NO: 24386 - RNA, 21 nt, Homo sapiens
aaaagcuaagucaucauauau

SEQ ID NO: 24387 - RNA, 22 nt, Homo sapiens
cucggggcagcucaguacagga

SEQ ID NO: 24388 - RNA, 21 nt, Homo sapiens
ugacugacagcuuuuugagua

SEQ ID NO: 24389 - RNA, 21 nt, Homo sapiens
aaagaucaaccauguauuauu

SEQ ID NO: 24390 - RNA, 23 nt, Homo sapiens
caugcucagacaaccauggugca

SEQ ID NO: 24391 - RNA, 21 nt, Homo sapiens
ccgugguucuacccuguggua

SEQ ID NO: 24392 - RNA, 21 nt, Homo sapiens
gugacucaucaccuauggaaa

SEQ ID NO: 24393 - RNA, 22 nt, Homo sapiens
agagagagucugcccuuguaua

SEQ ID NO: 24394 - RNA, 22 nt, Homo sapiens
acagagagcuugcccuuguaua

SEQ ID NO: 24395 - RNA, 22 nt, Homo sapiens
cuaccugagcuagcauacaagu

SEQ ID NO: 24396 - RNA, 22 nt, Homo sapiens
uccaggagcucacaaucuagug

SEQ ID NO: 24397 - RNA, 23 nt, Homo sapiens
uuuauugugguagauacuauuag

SEQ ID NO: 24398 - RNA, 21 nt, Homo sapiens
ugacugcagagcaaaagacac

SEQ ID NO: 24399 - RNA, 22 nt, Homo sapiens
ucggucccucgggccagggcag

SEQ ID NO: 24400 - RNA, 21 nt, Homo sapiens
acaaugguuguccgauauuaa

SEQ ID NO: 24401 - RNA, 22 nt, Homo sapiens
ggagagccuccacccaacccuc

SEQ ID NO: 24402 - RNA, 21 nt, Homo sapiens
uucaguuaucacaguacugua

SEQ ID NO: 24403 - RNA, 20 nt, Homo sapiens
cugcgggaggacagggcuca

SEQ ID NO: 24404 - RNA, 21 nt, Homo sapiens
acugaucuagagaacacaaga

SEQ ID NO: 24405 - RNA, 22 nt, Homo sapiens
agccacaaucaccuucugaucu

SEQ ID NO: 24406 - RNA, 22 nt, Homo sapiens
cucagucccaggcaaaccauaa

SEQ ID NO: 24407 - RNA, 20 nt, Homo sapiens
acaaugagaacccauggucu

SEQ ID NO: 24408 - RNA, 22 nt, Homo sapiens
caaacaccauugucacacucca

SEQ ID NO: 24409 - RNA, 22 nt, Homo sapiens
aagaagugcaccgcgaauguuu

SEQ ID NO: 24410 - RNA, 20 nt, Homo sapiens
aggggccucagccuccuggu

SEQ ID NO: 24411 - RNA, 20 nt, Homo sapiens
gcagaagcauuuccacacac

SEQ ID NO: 24412 - RNA, 22 nt, Homo sapiens
cuagggaacacagggcugguga

SEQ ID NO: 24413 - RNA, 23 nt, Homo sapiens
cggccugauucacaacaccagcu

SEQ ID NO: 24414 - RNA, 19 nt, Homo sapiens
gccucagaggcagcugcuu

SEQ ID NO: 24415 - RNA, 21 nt, Homo sapiens
ucuccagaucagggcagucca

SEQ ID NO: 24416 - RNA, 21 nt, Homo sapiens
guaaugggaccuuccucuuug

SEQ ID NO: 24417 - RNA, 22 nt, Homo sapiens
gaggcucagaauggcucaggag

SEQ ID NO: 24418 - RNA, 22 nt, Homo sapiens
cucggggcagcucaguacagga

SEQ ID NO: 24419 - RNA, 17 nt, Homo sapiens
gacagccucucccccac

SEQ ID NO: 24420 - RNA, 20 nt, Homo sapiens
cuggggaaaaggguggcacg

SEQ ID NO: 24421 - RNA, 24 nt, Homo sapiens
agugugaguucuaccauugccaaa

SEQ ID NO: 24422 - RNA, 22 nt, Homo sapiens
cucagagcagacgugguucuca

SEQ ID NO: 24423 - RNA, 20 nt, Homo sapiens
cucaaagcaaacccugcaga

SEQ ID NO: 24424 - RNA, 22 nt, Homo sapiens
ccccucuggucaaccagucaca

SEQ ID NO: 24425 - RNA, 22 nt, Homo sapiens
guccaaaguuggggugcugguu

SEQ ID NO: 24426 - RNA, 21 nt, Homo sapiens
ccucaaggagcuucagucuag

SEQ ID NO: 24427 - RNA, 22 nt, Homo sapiens
auaaaugacaccuccuugugaa

SEQ ID NO: 24428 - RNA, 22 nt, Homo sapiens
ccaucuuuaccagacaguguua

SEQ ID NO: 24429 - RNA, 22 nt, Homo sapiens
acaucguuaccagacaguguua

SEQ ID NO: 24430 - RNA, 21 nt, Homo sapiens
acguggauuuuccucuaugau

SEQ ID NO: 24431 - RNA, 22 nt, Homo sapiens
aacauggauuuuccucuaugau

SEQ ID NO: 24432 - RNA, 20 nt, Homo sapiens
acagcaaggagggcaggagg

SEQ ID NO: 24433 - RNA, 22 nt, Homo sapiens
ucaacaucagucugauaagcua

SEQ ID NO: 24434 - RNA, 22 nt, Homo sapiens
gcgaacgcgccacggaccaccu

SEQ ID NO: 24435 - RNA, 23 nt, Homo sapiens
cccaacagacauggcgguacuca

SEQ ID NO: 24436 - RNA, 22 nt, Homo sapiens
ucaucucgcccgcaaagaccca

SEQ ID NO: 24437 - RNA, 23 nt, Homo sapiens
acccuauaagcaauauugcacua

SEQ ID NO: 24438 - RNA, 22 nt, Homo sapiens
auggcaguggaguuagugauug

SEQ ID NO: 24439 - RNA, 22 nt, Homo sapiens
cucauccgauguacaauaauuu

SEQ ID NO: 24440 - RNA, 22 nt, Homo sapiens
ccagaacugaguccacagggca

SEQ ID NO: 24441 - RNA, 22 nt, Homo sapiens
agucuucacaacagcccugugu

SEQ ID NO: 24442 - RNA, 22 nt, Homo sapiens
acacaccaaggauaauuucucc

SEQ ID NO: 24443 - RNA, 26 nt, Homo sapiens
uuucagaauuugcugccaucaucauc

SEQ ID NO: 24444 - RNA, 22 nt, Homo sapiens
cacaaguucggaucuacggguu

SEQ ID NO: 24445 - RNA, 21 nt, Homo sapiens
aucugcacugucagcacuuua

SEQ ID NO: 24446 - RNA, 21 nt, Homo sapiens
cugaggagagaggaggugggg

SEQ ID NO: 24447 - RNA, 17 nt, Homo sapiens
gggagaggaggaggcga

SEQ ID NO: 24448 - RNA, 23 nt, Homo sapiens
gggagugaagacacggagccaga

SEQ ID NO: 24449 - RNA, 21 nt, Homo sapiens
gaccaaucgccguccccgccg

SEQ ID NO: 24450 - RNA, 21 nt, Homo sapiens
gaccaaucgccguccccgccg

SEQ ID NO: 24451 - RNA, 22 nt, Homo sapiens
ucagaccgagacaagugcaaug

SEQ ID NO: 24452 - RNA, 22 nt, Homo sapiens
agcugaguguaggauguuuaca

SEQ ID NO: 24453 - RNA, 21 nt, Homo sapiens
gaccaagaaauagccuuucaa

SEQ ID NO: 24454 - RNA, 22 nt, Homo sapiens
auaaacgacaccuccuugagaa

SEQ ID NO: 24455 - RNA, 23 nt, Homo sapiens
ucucgugacaugaugauccccga

SEQ ID NO: 24456 - RNA, 22 nt, Homo sapiens
gauccgagcaccggggaccccc

SEQ ID NO: 24457 - RNA, 25 nt, Homo sapiens
accaacggaccuacuucccuccgcc

SEQ ID NO: 24458 - RNA, 22 nt, Homo sapiens
gcggucccgcggcgccccgccu

SEQ ID NO: 24459 - RNA, 22 nt, Homo sapiens
gcggucccgcggcgccccgccu

SEQ ID NO: 24460 - RNA, 22 nt, Homo sapiens
ugcuguuagcccuagccccgca

SEQ ID NO: 24461 - RNA, 22 nt, Homo sapiens
ugcuguuagcccuagccccgca

SEQ ID NO: 24462 - RNA, 20 nt, Homo sapiens
uacugcuuccacagcucccc

SEQ ID NO: 24463 - RNA, 22 nt, Homo sapiens
acuucaaggaucuuaaacuuug

SEQ ID NO: 24464 - RNA, 22 nt, Homo sapiens
cuggagagacaaggggaagagg

SEQ ID NO: 24465 - RNA, 21 nt, Homo sapiens
uuccacgaccuaauccuaacu

SEQ ID NO: 24466 - RNA, 22 nt, Homo sapiens
aacccauggaauucaguucuca

SEQ ID NO: 24467 - RNA, 22 nt, Homo sapiens
agccuauggaauucaguucuca

SEQ ID NO: 24468 - RNA, 23 nt, Homo sapiens
ucaguuuugcauagauuugcaca

SEQ ID NO: 24469 - RNA, 23 nt, Homo sapiens
ucaguuuugcauggauuugcaca

SEQ ID NO: 24470 - RNA, 21 nt, Homo sapiens
uucacuccaaaaggugcaaaa

SEQ ID NO: 24471 - RNA, 23 nt, Homo sapiens
agacaaggcccacccgugcaaac

SEQ ID NO: 24472 - RNA, 23 nt, Homo sapiens
aggagaaggcaccaugggauuua

SEQ ID NO: 24473 - RNA, 24 nt, Homo sapiens
acgcgcaggccagagacccaggca

SEQ ID NO: 24474 - RNA, 21 nt, Homo sapiens
cugcugggccacaacguggga

SEQ ID NO: 24475 - RNA, 21 nt, Homo sapiens
acaugguuagaucaagcacaa

SEQ ID NO: 24476 - RNA, 17 nt, Homo sapiens
gacagccucucccccac

SEQ ID NO: 24477 - RNA, 21 nt, Homo sapiens
guuauagaucuggauuugaac

SEQ ID NO: 24478 - RNA, 23 nt, Homo sapiens
cacaaauucggaucuacagggua

SEQ ID NO: 24479 - RNA, 23 nt, Homo sapiens
cacaaauucgguucuacagggua

SEQ ID NO: 24480 - RNA, 22 nt, Homo sapiens
agucuucacaacagcccugugu

SEQ ID NO: 24481 - RNA, 22 nt, Homo sapiens
acaaaauccacaauuacuuuug

SEQ ID NO: 24482 - RNA, 21 nt, Homo sapiens
agagguugacuguauaauauu

SEQ ID NO: 24483 - RNA, 22 nt, Homo sapiens
aaaguaacugcaguuuuugcua

SEQ ID NO: 24484 - RNA, 21 nt, Homo sapiens
ucccagcacacauuuagcuca

SEQ ID NO: 24485 - RNA, 22 nt, Homo sapiens
ucaguuuccucugcaaacaguu

SEQ ID NO: 24486 - RNA, 21 nt, Homo sapiens
gccaauauuucugugcugcua

SEQ ID NO: 24487 - RNA, 22 nt, Homo sapiens
acaucguuaccagacaguguua

SEQ ID NO: 24488 - RNA, 22 nt, Homo sapiens
ucaucauuaccaggcaguauua

SEQ ID NO: 24489 - RNA, 23 nt, Homo sapiens
cccaacagacauggcgguacuca

SEQ ID NO: 24490 - RNA, 21 nt, Homo sapiens
ugcaaacccugcaugugggag

SEQ ID NO: 24491 - RNA, 21 nt, Homo sapiens
accuauccugaauuacuugaa

SEQ ID NO: 24492 - RNA, 22 nt, Homo sapiens
uaaccgauuucagauggugcua

SEQ ID NO: 24493 - RNA, 23 nt, Homo sapiens
aacacugauuucaaauggugcua

SEQ ID NO: 24494 - RNA, 22 nt, Homo sapiens
uaaccgauuucaaauggugcua

SEQ ID NO: 24495 - RNA, 21 nt, Homo sapiens
ucuacucacagaagugucaau

SEQ ID NO: 24496 - RNA, 18 nt, Homo sapiens
acccucugaaaggaagca

SEQ ID NO: 24497 - RNA, 22 nt, Homo sapiens
aaagugcuucuuaccuccagau

SEQ ID NO: 24498 - RNA, 22 nt, Homo sapiens
gaacuugcuaaaaaugcagaau

SEQ ID NO: 24499 - RNA, 22 nt, Homo sapiens
cucagagcagacgugguucuca

SEQ ID NO: 24500 - RNA, 20 nt, Homo sapiens
acaaugagaacccauggucu

SEQ ID NO: 24501 - RNA, 22 nt, Homo sapiens
acaucaucgcauauugacacaa

SEQ ID NO: 24502 - RNA, 23 nt, Homo sapiens
acagcgcucgcaaccgcagcgau

SEQ ID NO: 24503 - RNA, 17 nt, Homo sapiens
uggaggccccagcgaga

SEQ ID NO: 24504 - RNA, 20 nt, Homo sapiens
uccccacagacccagagccg

SEQ ID NO: 24505 - RNA, 22 nt, Homo sapiens
aaucagucucauugcuuuauaa

SEQ ID NO: 24506 - RNA, 22 nt, Homo sapiens
aacagcacaaacuacuaccuca

SEQ ID NO: 24507 - RNA, 18 nt, Homo sapiens
aucacauucaccucccug

SEQ ID NO: 24508 - RNA, 23 nt, Homo sapiens
gggagugaagacacggagccaga

SEQ ID NO: 24509 - RNA, 21 nt, Homo sapiens
gaccaaucgccguccccgccg

SEQ ID NO: 24510 - RNA, 20 nt, Homo sapiens
cuggaggaagggcccagagg

SEQ ID NO: 24511 - RNA, 22 nt, Homo sapiens
gccuaagacacaggcccagaga

SEQ ID NO: 24512 - RNA, 21 nt, Homo sapiens
uagcacccagauagcaaggau

SEQ ID NO: 24513 - RNA, 22 nt, Homo sapiens
gcggucccgcggcgccccgccu

SEQ ID NO: 24514 - RNA, 22 nt, Homo sapiens
ugcuguuagcccuagccccgca

SEQ ID NO: 24515 - RNA, 22 nt, Homo sapiens
gggagaggucucccugcgcaca

SEQ ID NO: 24516 - RNA, 25 nt, Homo sapiens
agcuagucaagcgcgguuguggggg

SEQ ID NO: 24517 - RNA, 23 nt, Homo sapiens
acacacucacacacacacacuca

SEQ ID NO: 24518 - RNA, 21 nt, Homo sapiens
uggggauuacacuucaacagg

SEQ ID NO: 24519 - RNA, 22 nt, Homo sapiens
ucaggaacugccuuucucucca

SEQ ID NO: 24520 - RNA, 22 nt, Homo sapiens
uaaccgauuucagauggugcua

SEQ ID NO: 24521 - RNA, 22 nt, Homo sapiens
cuuccagucgaggauguuuaca

SEQ ID NO: 24522 - RNA, 22 nt, Homo sapiens
cuuccagucggggauguuuaca

SEQ ID NO: 24523 - RNA, 22 nt, Homo sapiens
cuuccagucaaggauguuuaca

SEQ ID NO: 24524 - RNA, 23 nt, Homo sapiens
cggcucugucgucgaggcgcuca

SEQ ID NO: 24525 - RNA, 23 nt, Homo sapiens
gcgcccaauuaaugucuguugau

SEQ ID NO: 24526 - RNA, 22 nt, Homo sapiens
aaagugcuucuuaccuccagau

SEQ ID NO: 24527 - RNA, 21 nt, Homo sapiens
acuccaaagggaagcgccuuc

SEQ ID NO: 24528 - RNA, 22 nt, Homo sapiens
cgcucuaaagggaagcgccuuc

SEQ ID NO: 24529 - RNA, 21 nt, Homo sapiens
caguagagauuguuucaacac

SEQ ID NO: 24530 - RNA, 21 nt, Homo sapiens
caucaccuuccuucuccucca

SEQ ID NO: 24531 - RNA, 27 nt, Homo sapiens
ugcccacucucaccaucaccuacagug

SEQ ID NO: 24532 - RNA, 23 nt, Homo sapiens
ucacauaggaaugaaaagccaua

SEQ ID NO: 24533 - RNA, 22 nt, Homo sapiens
cuggagacacgugcacuguaga

SEQ ID NO: 24534 - RNA, 22 nt, Homo sapiens
ucaggaacugccuuucucucca

SEQ ID NO: 24535 - RNA, 19 nt, Homo sapiens
auuuugguacagcagcuca

SEQ ID NO: 24536 - RNA, 22 nt, Homo sapiens
cucagagcagacgugguucuca

SEQ ID NO: 24537 - RNA, 25 nt, Homo sapiens
acggagcugucccaacaccaccccu

SEQ ID NO: 24538 - RNA, 22 nt, Homo sapiens
ugcuguuagcccuagccccgca

SEQ ID NO: 24539 - RNA, 20 nt, Homo sapiens
uccccacagacccagagccg

SEQ ID NO: 24540 - RNA, 23 nt, Homo sapiens
ccgcuugagcuaacuccgacccg

SEQ ID NO: 24541 - RNA, 20 nt, Homo sapiens
uacugcuuccacagcucccc

SEQ ID NO: 24542 - RNA, 23 nt, Homo sapiens
cuaccugcacuguaagcacuuug

SEQ ID NO: 24543 - RNA, 21 nt, Homo sapiens
aagugucagacacgguggugg

SEQ ID NO: 24544 - RNA, 22 nt, Homo sapiens
caugauugccacgucugcagua

SEQ ID NO: 24545 - RNA, 21 nt, Homo sapiens
ugauugccacugucugcagua

SEQ ID NO: 24546 - RNA, 18 nt, Homo sapiens
cccccaccaccacgcccg

SEQ ID NO: 24547 - RNA, 21 nt, Homo sapiens
agggcucaucuugguccugca

SEQ ID NO: 24548 - RNA, 21 nt, Homo sapiens
ucuccagaucagggcagucca

SEQ ID NO: 24549 - RNA, 23 nt, Homo sapiens
aaaaugcagauuccuggacucca

SEQ ID NO: 24550 - RNA, 25 nt, Homo sapiens
cagcgucugccggaacccguuccca

SEQ ID NO: 24551 - RNA, 21 nt, Homo sapiens
gggcaucugggacgcgcagga

SEQ ID NO: 24552 - RNA, 21 nt, Homo sapiens
aggcggcaggcacaggacugg

SEQ ID NO: 24553 - RNA, 22 nt, Homo sapiens
uggcagcagcggagggggcaga

SEQ ID NO: 24554 - RNA, 22 nt, Homo sapiens
cacucagcggccguuuccccaa

SEQ ID NO: 24555 - RNA, 20 nt, Homo sapiens
cuggaggaagggcccagagg

SEQ ID NO: 24556 - RNA, 22 nt, Homo sapiens
gccuaagacacaggcccagaga

SEQ ID NO: 24557 - RNA, 22 nt, Homo sapiens
auggcaguggaguuagugauug

SEQ ID NO: 24558 - RNA, 21 nt, Homo sapiens
auccuguacugagcugccccg

SEQ ID NO: 24559 - RNA, 23 nt, Homo sapiens
acacacucacacacacacacuca

SEQ ID NO: 24560 - RNA, 23 nt, Homo sapiens
gucagaccccgagggguccucgc

SEQ ID NO: 24561 - RNA, 24 nt, Homo sapiens
acugggcacaaacauguccagguc

SEQ ID NO: 24562 - RNA, 19 nt, Homo sapiens
accagugcccugcacacuu

SEQ ID NO: 24563 - RNA, 22 nt, Homo sapiens
gggagaggucucccugcgcaca

SEQ ID NO: 24564 - RNA, 22 nt, Homo sapiens
acuucaaggaucuuaaacuuug

SEQ ID NO: 24565 - RNA, 22 nt, Homo sapiens
acugggacuuuguaggccaguu

SEQ ID NO: 24566 - RNA, 22 nt, Homo sapiens
agcgggacuuugagggccaguu

SEQ ID NO: 24567 - RNA, 25 nt, Homo sapiens
accaacggaccuacuucccuccgcc

SEQ ID NO: 24568 - RNA, 24 nt, Homo sapiens
cacccccagagccucagcucccca

SEQ ID NO: 24569 - RNA, 23 nt, Homo sapiens
agcagcauuguacagggcuauga

SEQ ID NO: 24570 - RNA, 21 nt, Homo sapiens
cucccccacugcagcuggcac

SEQ ID NO: 24571 - RNA, 21 nt, Homo sapiens
ccccucccagccucccugcca

SEQ ID NO: 24572 - RNA, 21 nt, Homo sapiens
cugaggagagaggaggugggg

SEQ ID NO: 24573 - RNA, 18 nt, Homo sapiens
cccccaccaccacgcccg

SEQ ID NO: 24574 - RNA, 23 nt, Homo sapiens
gaaacccagcagacaauguagcu

SEQ ID NO: 24575 - RNA, 21 nt, Homo sapiens
acuccaaagggaagcgccuuc

SEQ ID NO: 24576 - RNA, 22 nt, Homo sapiens
cgcucuaaagggaagcgccuuc

SEQ ID NO: 24577 - RNA, 22 nt, Homo sapiens
aguccagauucugugcccacca

SEQ ID NO: 24578 - RNA, 19 nt, Homo sapiens
guugggaucacaggcgccc

SEQ ID NO: 24579 - RNA, 19 nt, Homo sapiens
guugggaucacaggcgccc

SEQ ID NO: 24580 - RNA, 25 nt, Homo sapiens
acggagcugucccaacaccaccccu

SEQ ID NO: 24581 - RNA, 21 nt, Homo sapiens
gcugaggucugggccaggucu

SEQ ID NO: 24582 - RNA, 22 nt, Homo sapiens
gcacauguucugcggcccacca

SEQ ID NO: 24583 - RNA, 20 nt, Homo sapiens
uacugcuuccacagcucccc

SEQ ID NO: 24584 - RNA, 17 nt, Homo sapiens
ggguggcagcgguggga

SEQ ID NO: 24585 - RNA, 21 nt, Homo sapiens
cggggugcacgggcggagggc

SEQ ID NO: 24586 - RNA, 23 nt, Homo sapiens
gggagugaagacacggagccaga

SEQ ID NO: 24587 - RNA, 23 nt, Homo sapiens
gggagugaagacacggagccaga

SEQ ID NO: 24588 - RNA, 23 nt, Homo sapiens
aggaacagcagcagcccgggccg

SEQ ID NO: 24589 - RNA, 21 nt, Homo sapiens
gaccaaucgccguccccgccg

SEQ ID NO: 24590 - RNA, 22 nt, Homo sapiens
ucagaccgagacaagugcaaug

SEQ ID NO: 24591 - RNA, 22 nt, Homo sapiens
aggaaaccagcaaguguugacg

SEQ ID NO: 24592 - RNA, 25 nt, Homo sapiens
acggagcugucccaacaccaccccu

SEQ ID NO: 24593 - RNA, 25 nt, Homo sapiens
accaacggaccuacuucccuccgcc

SEQ ID NO: 24594 - RNA, 22 nt, Homo sapiens
gcggucccgcggcgccccgccu

SEQ ID NO: 24595 - RNA, 20 nt, Homo sapiens
uacugcuuccacagcucccc

SEQ ID NO: 24596 - RNA, 24 nt, Homo sapiens
cacccccagagccucagcucccca

SEQ ID NO: 24597 - RNA, 22 nt, Homo sapiens
caagacacauuuggagagggac

SEQ ID NO: 24598 - RNA, 22 nt, Homo sapiens
caaacaccauugucacacucca

SEQ ID NO: 24599 - RNA, 23 nt, Homo sapiens
gaaagugcccucaaggcugagug

SEQ ID NO: 24600 - RNA, 20 nt, Homo sapiens
aggggccucagccuccuggu

SEQ ID NO: 24601 - RNA, 22 nt, Homo sapiens
cacucuaaagggaggcacuuug

SEQ ID NO: 24602 - RNA, 24 nt, Homo sapiens
cacccccagagccucagcucccca

SEQ ID NO: 24603 - RNA, 22 nt, Homo sapiens
uggcagcagcggagggggcaga

SEQ ID NO: 24604 - RNA, 22 nt, Homo sapiens
ucagaccgagacaagugcaaug

SEQ ID NO: 24605 - RNA, 20 nt, Homo sapiens
ccagcagcaccuggggcagu

SEQ ID NO: 24606 - RNA, 21 nt, Homo sapiens
auccuguacugagcugccccg

SEQ ID NO: 24607 - RNA, 22 nt, Homo sapiens
ucccucacacagaauuccagaa

SEQ ID NO: 24608 - RNA, 22 nt, Homo sapiens
augcuuuuugggguaagggcuu

SEQ ID NO: 24609 - RNA, 23 nt, Homo sapiens
uccaucaucaaaacaaauggagu

SEQ ID NO: 24610 - RNA, 22 nt, Homo sapiens
cacugguacaaggguugggaga

SEQ ID NO: 24611 - RNA, 22 nt, Homo sapiens
accuaauauaucaaacauauca

SEQ ID NO: 24612 - RNA, 23 nt, Homo sapiens
cagcugcuuuugggauuccguug

SEQ ID NO: 24613 - RNA, 22 nt, Homo sapiens
cacucagcggccguuuccccaa

SEQ ID NO: 24614 - RNA, 23 nt, Homo sapiens
gaaacccagcagacaauguagcu

SEQ ID NO: 24615 - RNA, 20 nt, Homo sapiens
cuggaggaagggcccagagg

SEQ ID NO: 24616 - RNA, 22 nt, Homo sapiens
gccuaagacacaggcccagaga

SEQ ID NO: 24617 - RNA, 20 nt, Homo sapiens
gcaaugcaacagcaaugcac

SEQ ID NO: 24618 - RNA, 23 nt, Homo sapiens
acgggugcgauuucugugugaga

SEQ ID NO: 24619 - RNA, 23 nt, Homo sapiens
aaaucagaaucacaccuggggga

SEQ ID NO: 24620 - RNA, 22 nt, Homo sapiens
acaaaaguugccuuugugugau

SEQ ID NO: 24621 - RNA, 22 nt, Homo sapiens
gaauucaucacggccagccucu

SEQ ID NO: 24622 - RNA, 22 nt, Homo sapiens
ccucauggaaggguuccccacu

SEQ ID NO: 24623 - RNA, 22 nt, Homo sapiens
aacgcuccaaaagaaggcacuc

SEQ ID NO: 24624 - RNA, 22 nt, Homo sapiens
aacacucuaaaaggaggcacuu

SEQ ID NO: 24625 - RNA, 23 nt, Homo sapiens
gggcucuuacucccucaggcacu

SEQ ID NO: 24626 - RNA, 25 nt, Homo sapiens
acggagcugucccaacaccaccccu

SEQ ID NO: 24627 - RNA, 21 nt, Homo sapiens
gcuccaaccucagcagacugu

SEQ ID NO: 24628 - RNA, 24 nt, Homo sapiens
acgcagagcccgaaagcccccagu

SEQ ID NO: 24629 - RNA, 20 nt, Homo sapiens
uacugcuuccacagcucccc

SEQ ID NO: 24630 - RNA, 21 nt, Homo sapiens
cucccccacugcagcuggcac

SEQ ID NO: 24631 - RNA, 22 nt, Homo sapiens
acaaaguucugugaugcacuga

SEQ ID NO: 24632 - RNA, 22 nt, Homo sapiens
ucaggaacugccuuucucucca

SEQ ID NO: 24633 - RNA, 22 nt, Homo sapiens
ucacauuugccugcagagauuu

SEQ ID NO: 24634 - RNA, 22 nt, Homo sapiens
cacucagcaccaggauauuguu

SEQ ID NO: 24635 - RNA, 22 nt, Homo sapiens
uacagauggauaccgugcaauu

SEQ ID NO: 24636 - RNA, 22 nt, Homo sapiens
acaccgaggagcccaucaugau

SEQ ID NO: 24637 - RNA, 22 nt, Homo sapiens
cgauguaguccaaaggcacaua

SEQ ID NO: 24638 - RNA, 22 nt, Homo sapiens
gcaaagguaauugcuguuuucg

SEQ ID NO: 24639 - RNA, 25 nt, Homo sapiens
acggagcugucccaacaccaccccu

SEQ ID NO: 24640 - RNA, 24 nt, Homo sapiens
acgcgcaggccagagacccaggca

SEQ ID NO: 24641 - RNA, 23 nt, Homo sapiens
cccagcuagauuguaagcuccuu

SEQ ID NO: 24642 - RNA, 21 nt, Homo sapiens
caucaccuuccuucuccucca

SEQ ID NO: 24643 - RNA, 24 nt, Homo sapiens
ugggagaaccucccugcuucugcu

SEQ ID NO: 24644 - RNA, 22 nt, Homo sapiens
caaacaccauugucacacucca

SEQ ID NO: 24645 - RNA, 21 nt, Homo sapiens
agcgccuuuggcagcuagagu

SEQ ID NO: 24646 - RNA, 24 nt, Homo sapiens
acugcaggcuccagcuuccaggcu

SEQ ID NO: 24647 - RNA, 22 nt, Homo sapiens
cacgaccgacgccacgccgagu

SEQ ID NO: 24648 - RNA, 23 nt, Homo sapiens
aggaacagcagcagcccgggccg

SEQ ID NO: 24649 - RNA, 23 nt, Homo sapiens
aggaacagcagcagcccgggccg

SEQ ID NO: 24650 - RNA, 21 nt, Homo sapiens
gaccaaucgccguccccgccg

SEQ ID NO: 24651 - RNA, 21 nt, Homo sapiens
gaccaaucgccguccccgccg

SEQ ID NO: 24652 - RNA, 24 nt, Homo sapiens
acgcagagcccgaaagcccccagu

SEQ ID NO: 24653 - RNA, 22 nt, Homo sapiens
gcggucccgcggcgccccgccu

SEQ ID NO: 24654 - RNA, 22 nt, Homo sapiens
gcggucccgcggcgccccgccu

SEQ ID NO: 24655 - RNA, 22 nt, Homo sapiens
ugcuguuagcccuagccccgca

SEQ ID NO: 24656 - RNA, 22 nt, Homo sapiens
ugcuguuagcccuagccccgca

SEQ ID NO: 24657 - RNA, 23 nt, Homo sapiens
ggaagccaucaagucgcugcagg

SEQ ID NO: 24658 - RNA, 23 nt, Homo sapiens
ggaagccaucaagucgcugcagg

SEQ ID NO: 24659 - RNA, 22 nt, Homo sapiens
cugggggcggcacaggggcuca

SEQ ID NO: 24660 - RNA, 22 nt, Homo sapiens
uccggggacgaacgggacgggu

SEQ ID NO: 24661 - RNA, 23 nt, Homo sapiens
gggagugaagacacggagccaga

SEQ ID NO: 24662 - RNA, 22 nt, Homo sapiens
acccuuaucaguucuccgucca

SEQ ID NO: 24663 - RNA, 22 nt, Homo sapiens
uggcagcagcggagggggcaga

SEQ ID NO: 24664 - RNA, 20 nt, Homo sapiens
ccagcagcaccuggggcagu

SEQ ID NO: 24665 - RNA, 23 nt, Homo sapiens
aaagucucgcucucugccccuca

SEQ ID NO: 24666 - RNA, 21 nt, Homo sapiens
auccuguacugagcugccccg

SEQ ID NO: 24667 - RNA, 21 nt, Homo sapiens
cacaacccuaguggcgccauu

SEQ ID NO: 24668 - RNA, 21 nt, Homo sapiens
caucaccuuccuucuccucca

SEQ ID NO: 24669 - RNA, 22 nt, Homo sapiens
uauccacuacaccccgcugccu

SEQ ID NO: 24670 - RNA, 22 nt, Homo sapiens
ggaggccgggacgagugcaaua

SEQ ID NO: 24671 - RNA, 22 nt, Homo sapiens
cugggggcggcacaggggcuca

SEQ ID NO: 24672 - RNA, 22 nt, Homo sapiens
gccagcuaacaauacacugccu

SEQ ID NO: 24673 - RNA, 21 nt, Homo sapiens
aucagagguucagcuuacccu

SEQ ID NO: 24674 - RNA, 22 nt, Homo sapiens
ucccucacacagaauuccagaa

SEQ ID NO: 24675 - RNA, 21 nt, Homo sapiens
agcuaugccagcaucuugccu

SEQ ID NO: 24676 - RNA, 21 nt, Homo sapiens
aggagacucacaaguuccugc

SEQ ID NO: 24677 - RNA, 23 nt, Homo sapiens
acggcuaguggaccaggugaagu

SEQ ID NO: 24678 - RNA, 23 nt, Homo sapiens
ucacauaggaauaaaaagccaua

SEQ ID NO: 24679 - RNA, 23 nt, Homo sapiens
ucacauaggaaugaaaagccaua

SEQ ID NO: 24680 - RNA, 21 nt, Homo sapiens
cucccccacugcagcuggcac

SEQ ID NO: 24681 - RNA, 20 nt, Homo sapiens
ggggggcgaggcagguguga

SEQ ID NO: 24682 - RNA, 18 nt, Homo sapiens
ggagaggagggcacugga

SEQ ID NO: 24683 - RNA, 21 nt, Homo sapiens
gaccaaucgccguccccgccg

SEQ ID NO: 24684 - RNA, 20 nt, Homo sapiens
cccgccgcgucgcccugggg

SEQ ID NO: 24685 - RNA, 22 nt, Homo sapiens
ucagaccgagacaagugcaaug

SEQ ID NO: 24686 - RNA, 21 nt, Homo sapiens
ucaaucacagauagcaccccu

SEQ ID NO: 24687 - RNA, 21 nt, Homo sapiens
acuccaaagggaagcgccuuc

SEQ ID NO: 24688 - RNA, 22 nt, Homo sapiens
cgcucuaaagggaagcgccuuc

SEQ ID NO: 24689 - RNA, 19 nt, Homo sapiens
guugggaucacaggcgccc

SEQ ID NO: 24690 - RNA, 19 nt, Homo sapiens
gcucuaagaaagccacacu

SEQ ID NO: 24691 - RNA, 22 nt, Homo sapiens
gcggucccgcggcgccccgccu

SEQ ID NO: 24692 - RNA, 23 nt, Homo sapiens
cacugugggcccucuccgcacca

SEQ ID NO: 24693 - RNA, 21 nt, Homo sapiens
caucaccuuccuucuccucca

SEQ ID NO: 24694 - RNA, 20 nt, Homo sapiens
uacugcuuccacagcucccc

SEQ ID NO: 24695 - RNA, 22 nt, Homo sapiens
caaacaccauugucacacucca

SEQ ID NO: 24696 - RNA, 22 nt, Homo sapiens
cagcugguugaaggggaccaaa

SEQ ID NO: 24697 - RNA, 22 nt, Homo sapiens
uagcugguugaaggggaccaaa

SEQ ID NO: 24698 - RNA, 21 nt, Homo sapiens
gaccaagaaauagccuuucaa

SEQ ID NO: 24699 - RNA, 19 nt, Homo sapiens
guccugaauuccgcagccu

SEQ ID NO: 24700 - RNA, 21 nt, Homo sapiens
gcuuaaacaucuacaugaaca

SEQ ID NO: 24701 - RNA, 22 nt, Homo sapiens
cacaucucacuguagccucaaa

SEQ ID NO: 24702 - RNA, 22 nt, Homo sapiens
cacaaaccauuaugugcugcua

SEQ ID NO: 24703 - RNA, 22 nt, Homo sapiens
uguaaaccaugaugugcugcua

SEQ ID NO: 24704 - RNA, 22 nt, Homo sapiens
cgccaauauuuacgugcugcua

SEQ ID NO: 24705 - RNA, 21 nt, Homo sapiens
gccaauauuucugugcugcua

SEQ ID NO: 24706 - RNA, 17 nt, Homo sapiens
aaacauggaagcaauua

SEQ ID NO: 24707 - RNA, 22 nt, Homo sapiens
uucaaaacaugaauugcugcug

SEQ ID NO: 24708 - RNA, 21 nt, Homo sapiens
acaaaccacagugugcugcug

SEQ ID NO: 24709 - RNA, 20 nt, Homo sapiens
acaaugagaacccauggucu

SEQ ID NO: 24710 - RNA, 22 nt, Homo sapiens
caaacaccauugucacacucca

SEQ ID NO: 24711 - RNA, 22 nt, Homo sapiens
ggcagagagucagagcgcggau

SEQ ID NO: 24712 - RNA, 22 nt, Homo sapiens
cuggagagacaaggggaagagg

SEQ ID NO: 24713 - RNA, 24 nt, Homo sapiens
ucacagguuaaagggucucaggga

SEQ ID NO: 24714 - RNA, 22 nt, Homo sapiens
ucacaaguuagggucucaggga

SEQ ID NO: 24715 - RNA, 23 nt, Homo sapiens
agcccuguucuacagcccugagg

SEQ ID NO: 24716 - RNA, 22 nt, Homo sapiens
cacaaaccauuaugugcugcua

SEQ ID NO: 24717 - RNA, 22 nt, Homo sapiens
uguaaaccaugaugugcugcua

SEQ ID NO: 24718 - RNA, 22 nt, Homo sapiens
cgccaauauuuacgugcugcua

SEQ ID NO: 24719 - RNA, 21 nt, Homo sapiens
gccaauauuucugugcugcua

SEQ ID NO: 24720 - RNA, 22 nt, Homo sapiens
ggagagccuccacccaacccuc

SEQ ID NO: 24721 - RNA, 20 nt, Homo sapiens
cuggaggaagggcccagagg

SEQ ID NO: 24722 - RNA, 22 nt, Homo sapiens
gccuaagacacaggcccagaga

SEQ ID NO: 24723 - RNA, 22 nt, Homo sapiens
ucaccauugcuaaagugcaauu

SEQ ID NO: 24724 - RNA, 22 nt, Homo sapiens
uucaaaacaugaauugcugcug

SEQ ID NO: 24725 - RNA, 21 nt, Homo sapiens
acaaaccacagugugcugcug

SEQ ID NO: 24726 - RNA, 23 nt, Homo sapiens
cugcagaacuguucccgcugcua

SEQ ID NO: 24727 - RNA, 22 nt, Homo sapiens
gugauugccacucuccugagua

SEQ ID NO: 24728 - RNA, 22 nt, Homo sapiens
auaaacgacaccuccuugagaa

SEQ ID NO: 24729 - RNA, 23 nt, Homo sapiens
acagcgcucgcaaccgcagcgau

SEQ ID NO: 24730 - RNA, 20 nt, Homo sapiens
uacugcuuccacagcucccc

SEQ ID NO: 24731 - RNA, 22 nt, Homo sapiens
cacucuaaagggaggcacuuug

SEQ ID NO: 24732 - RNA, 20 nt, Homo sapiens
gcaaaugguacagcuacuuu

SEQ ID NO: 24733 - RNA, 21 nt, Homo sapiens
gagcugcauccuggcuccggg

SEQ ID NO: 24734 - RNA, 21 nt, Homo sapiens
gagcugcauccuggcuccggg

SEQ ID NO: 24735 - RNA, 17 nt, Homo sapiens
gggagaggaggaggcga

SEQ ID NO: 24736 - RNA, 18 nt, Homo sapiens
aucacauucaccucccug

SEQ ID NO: 24737 - RNA, 21 nt, Homo sapiens
cggggugcacgggcggagggc

SEQ ID NO: 24738 - RNA, 23 nt, Homo sapiens
gggagugaagacacggagccaga

SEQ ID NO: 24739 - RNA, 19 nt, Homo sapiens
guugggaucacaggcgccc

SEQ ID NO: 24740 - RNA, 19 nt, Homo sapiens
guccugaauuccgcagccu

SEQ ID NO: 24741 - RNA, 22 nt, Homo sapiens
caagacacauuuggagagggac

SEQ ID NO: 24742 - RNA, 23 nt, Homo sapiens
guagugggccgagccgagugaca

SEQ ID NO: 24743 - RNA, 22 nt, Homo sapiens
gcugaggcuguggggcuggagu

SEQ ID NO: 24744 - RNA, 22 nt, Homo sapiens
ggagcccgcgccccgcgccgag

SEQ ID NO: 24745 - RNA, 22 nt, Homo sapiens
acaccuggcuccacacgcgggc

SEQ ID NO: 24746 - RNA, 23 nt, Homo sapiens
gggagugaagacacggagccaga

SEQ ID NO: 24747 - RNA, 23 nt, Homo sapiens
aggaacagcagcagcccgggccg

SEQ ID NO: 24748 - RNA, 23 nt, Homo sapiens
aggaacagcagcagcccgggccg

SEQ ID NO: 24749 - RNA, 22 nt, Homo sapiens
agcugaguguaggauguuuaca

SEQ ID NO: 24750 - RNA, 23 nt, Homo sapiens
ccacccaaugaccuacuccaaga

SEQ ID NO: 24751 - RNA, 21 nt, Homo sapiens
ccccucccagccucccugcca

SEQ ID NO: 24752 - RNA, 18 nt, Homo sapiens
ugguggcagaggugggau

SEQ ID NO: 24753 - RNA, 22 nt, Homo sapiens
agcugaguguaggauguuuaca

SEQ ID NO: 24754 - RNA, 22 nt, Homo sapiens
ugcaagccuugggugugggagg

SEQ ID NO: 24755 - RNA, 21 nt, Homo sapiens
gagcugcauccuggcuccggg

SEQ ID NO: 24756 - RNA, 22 nt, Homo sapiens
agacaacaaugccaaccucaca

SEQ ID NO: 24757 - RNA, 22 nt, Homo sapiens
ccccucuggucaaccagucaca

SEQ ID NO: 24758 - RNA, 19 nt, Homo sapiens
guccugaauuccgcagccu

SEQ ID NO: 24759 - RNA, 21 nt, Homo sapiens
gaaggaagugagugcagccac

SEQ ID NO: 24760 - RNA, 21 nt, Homo sapiens
gaccaaucgccguccccgccg

SEQ ID NO: 24761 - RNA, 23 nt, Homo sapiens
aaagucucgcucucugccccuca

SEQ ID NO: 24762 - RNA, 19 nt, Homo sapiens
guccugaauuccgcagccu

SEQ ID NO: 24763 - RNA, 22 nt, Homo sapiens
gcggucccgcggcgccccgccu

SEQ ID NO: 24764 - RNA, 22 nt, Homo sapiens
ugcuguuagcccuagccccgca

SEQ ID NO: 24765 - RNA, 21 nt, Homo sapiens
gagcugcauccuggcuccggg

SEQ ID NO: 24766 - RNA, 21 nt, Homo sapiens
gggcaucugggacgcgcagga

SEQ ID NO: 24767 - RNA, 22 nt, Homo sapiens
aagagggagacccaggcucgga

SEQ ID NO: 24768 - RNA, 22 nt, Homo sapiens
uauccacuacaccccgcugccu

SEQ ID NO: 24769 - RNA, 21 nt, Homo sapiens
acaaaccacagugugcugcug

SEQ ID NO: 24770 - RNA, 22 nt, Homo sapiens
cacucuaaagggaggcacuuug

SEQ ID NO: 24771 - RNA, 22 nt, Homo sapiens
caaacaccauugucacacucca

SEQ ID NO: 24772 - RNA, 22 nt, Homo sapiens
cuggagagacaaggggaagagg

SEQ ID NO: 24773 - RNA, 22 nt, Homo sapiens
ccaucuuuaccagacaguguua

SEQ ID NO: 24774 - RNA, 22 nt, Homo sapiens
acugggacuuuguaggccaguu

SEQ ID NO: 24775 - RNA, 22 nt, Homo sapiens
agcgggacuuugagggccaguu

SEQ ID NO: 24776 - RNA, 22 nt, Homo sapiens
ucagaccgagacaagugcaaug

SEQ ID NO: 24777 - RNA, 23 nt, Homo sapiens
ucaacgggagugaucgugucauu

SEQ ID NO: 24778 - RNA, 22 nt, Homo sapiens
uauggaugcaaaaugaucccaa

SEQ ID NO: 24779 - RNA, 22 nt, Homo sapiens
caagacacauuuggagagggac

SEQ ID NO: 24780 - RNA, 23 nt, Homo sapiens
aaccaagaccccggagaucccag

SEQ ID NO: 24781 - RNA, 22 nt, Homo sapiens
agagcaagaccccgucucuaaa

SEQ ID NO: 24782 - RNA, 22 nt, Homo sapiens
acuggguucaccuuuaagggca

SEQ ID NO: 24783 - RNA, 20 nt, Homo sapiens
uacugcuuccacagcucccc

SEQ ID NO: 24784 - RNA, 23 nt, Homo sapiens
gacguaguccuauucucugcugc

SEQ ID NO: 24785 - RNA, 25 nt, Homo sapiens
acggagcugucccaacaccaccccu

SEQ ID NO: 24786 - RNA, 21 nt, Homo sapiens
cucccccacugcagcuggcac

SEQ ID NO: 24787 - RNA, 18 nt, Homo sapiens
gaaaugagggccagcuga

SEQ ID NO: 24788 - RNA, 22 nt, Homo sapiens
cugggggcggcacaggggcuca

SEQ ID NO: 24789 - RNA, 18 nt, Homo sapiens
ugguggcagaggugggau

SEQ ID NO: 24790 - RNA, 17 nt, Homo sapiens
ggguggcagcgguggga

SEQ ID NO: 24791 - RNA, 23 nt, Homo sapiens
gggagugaagacacggagccaga

SEQ ID NO: 24792 - RNA, 22 nt, Homo sapiens
ucaggaacugccuuucucucca

SEQ ID NO: 24793 - RNA, 21 nt, Homo sapiens
aucugcacugucagcacuuua

SEQ ID NO: 24794 - RNA, 23 nt, Homo sapiens
gcuuugacaauaucauugcacug

SEQ ID NO: 24795 - RNA, 22 nt, Homo sapiens
ugcaagccuugggugugggagg

SEQ ID NO: 24796 - RNA, 20 nt, Homo sapiens
uccccacagacccagagccg

SEQ ID NO: 24797 - RNA, 20 nt, Homo sapiens
uacugcuuccacagcucccc

SEQ ID NO: 24798 - RNA, 21 nt, Homo sapiens
ugacugacagcuuuuugagua

SEQ ID NO: 24799 - RNA, 23 nt, Homo sapiens
gacguaguccuauucucugcugc

SEQ ID NO: 24800 - RNA, 23 nt, Homo sapiens
cccaacagacauggcgguacuca

SEQ ID NO: 24801 - RNA, 27 nt, Homo sapiens
uuuagcacagugcuuauacaagaaggu

SEQ ID NO: 24802 - RNA, 24 nt, Homo sapiens
acugcaggcuccagcuuccaggcu

SEQ ID NO: 24803 - RNA, 23 nt, Homo sapiens
uccaucaucaaaacaaauggagu

SEQ ID NO: 24804 - RNA, 21 nt, Homo sapiens
cggggugcacgggcggagggc

SEQ ID NO: 24805 - RNA, 23 nt, Homo sapiens
gggagugaagacacggagccaga

SEQ ID NO: 24806 - RNA, 22 nt, Homo sapiens
ugagccacugugccuggccuga

SEQ ID NO: 24807 - RNA, 21 nt, Homo sapiens
agaggucgaccguguaaugug

SEQ ID NO: 24808 - RNA, 22 nt, Homo sapiens
acggaagggcagagagggccag

SEQ ID NO: 24809 - RNA, 22 nt, Homo sapiens
aagauguggaccauauuacaua

SEQ ID NO: 24810 - RNA, 24 nt, Homo sapiens
acugcuggucuucagucagggcca

SEQ ID NO: 24811 - RNA, 22 nt, Homo sapiens
acggaagggcagagagggccag

SEQ ID NO: 24812 - RNA, 20 nt, Homo sapiens
gcaaugcaacagcaaugcac

SEQ ID NO: 24813 - RNA, 22 nt, Homo sapiens
aacgcuccaaaagaaggcacuc

SEQ ID NO: 24814 - RNA, 22 nt, Homo sapiens
aacacucuaaaaggaggcacuu

SEQ ID NO: 24815 - RNA, 21 nt, Homo sapiens
agggcucaucuugguccugca

SEQ ID NO: 24816 - RNA, 18 nt, Homo sapiens
aucacauucaccucccug

SEQ ID NO: 24817 - RNA, 22 nt, Homo sapiens
ccucauggaaggguuccccacu

SEQ ID NO: 24818 - RNA, 25 nt, Homo sapiens
acggagcugucccaacaccaccccu

SEQ ID NO: 24819 - RNA, 24 nt, Homo sapiens
acgcgcaggccagagacccaggca

SEQ ID NO: 24820 - RNA, 21 nt, Homo sapiens
caucaccuuccuucuccucca

SEQ ID NO: 24821 - RNA, 20 nt, Homo sapiens
uacugcuuccacagcucccc

SEQ ID NO: 24822 - RNA, 22 nt, Homo sapiens
cacaagaucggaucuacggguu

SEQ ID NO: 24823 - RNA, 22 nt, Homo sapiens
cgcaaggucgguucuacgggug

SEQ ID NO: 24824 - RNA, 21 nt, Homo sapiens
agggcucaucuugguccugca

SEQ ID NO: 24825 - RNA, 22 nt, Homo sapiens
cacaaaccauuaugugcugcua

SEQ ID NO: 24826 - RNA, 22 nt, Homo sapiens
uguaaaccaugaugugcugcua

SEQ ID NO: 24827 - RNA, 22 nt, Homo sapiens
cgccaauauuuacgugcugcua

SEQ ID NO: 24828 - RNA, 21 nt, Homo sapiens
gccaauauuucugugcugcua

SEQ ID NO: 24829 - RNA, 22 nt, Homo sapiens
uucaaaacaugaauugcugcug

SEQ ID NO: 24830 - RNA, 21 nt, Homo sapiens
acaaaccacagugugcugcug

SEQ ID NO: 24831 - RNA, 23 nt, Homo sapiens
cccagcuagauuguaagcuccuu

SEQ ID NO: 24832 - RNA, 25 nt, Homo sapiens
accaacggaccuacuucccuccgcc

SEQ ID NO: 24833 - RNA, 23 nt, Homo sapiens
acauuuuucguuauugcucuuga

SEQ ID NO: 24834 - RNA, 23 nt, Homo sapiens
gggagugaagacacggagccaga

SEQ ID NO: 24835 - RNA, 22 nt, Homo sapiens
gugauugccacucuccugagua

SEQ ID NO: 24836 - RNA, 20 nt, Homo sapiens
ggcauucaccgcgugccuua

SEQ ID NO: 24837 - RNA, 22 nt, Homo sapiens
cagaaagugcuucccucuagag

SEQ ID NO: 24838 - RNA, 21 nt, Homo sapiens
cacucugaagggaagcgcuuu

SEQ ID NO: 24839 - RNA, 21 nt, Homo sapiens
ccucuaaagagaagcgcuuuc

SEQ ID NO: 24840 - RNA, 22 nt, Homo sapiens
acacucuaaaaggaugcacuuu

SEQ ID NO: 24841 - RNA, 22 nt, Homo sapiens
cagaaagcgcuucccucuagag

SEQ ID NO: 24842 - RNA, 22 nt, Homo sapiens
cagaaagcgcuucccucuagag

SEQ ID NO: 24843 - RNA, 22 nt, Homo sapiens
cagaaagugcuucccucuagag

SEQ ID NO: 24844 - RNA, 22 nt, Homo sapiens
acacucuaaagggaaccauuuu

SEQ ID NO: 24845 - RNA, 23 nt, Homo sapiens
acccucuauagggaagcgcguuc

SEQ ID NO: 24846 - RNA, 22 nt, Homo sapiens
cagaaagugcuucccucuagag

SEQ ID NO: 24847 - RNA, 22 nt, Homo sapiens
cuguuccugcugaacugagcca

SEQ ID NO: 24848 - RNA, 24 nt, Homo sapiens
ucacagguuaaagggucucaggga

SEQ ID NO: 24849 - RNA, 22 nt, Homo sapiens
ucacaaguuagggucucaggga

SEQ ID NO: 24850 - RNA, 23 nt, Homo sapiens
agcccuguucuacagcccugagg

SEQ ID NO: 24851 - RNA, 22 nt, Homo sapiens
gaaccuaucuccccucuggacc

SEQ ID NO: 24852 - RNA, 21 nt, Homo sapiens
agaaaguacuucccucuggag

SEQ ID NO: 24853 - RNA, 21 nt, Homo sapiens
agaaagugcaucccucuggag

SEQ ID NO: 24854 - RNA, 22 nt, Homo sapiens
cugggggcggcacaggggcuca

SEQ ID NO: 24855 - RNA, 22 nt, Homo sapiens
ggagauggagccagggcccuaa

SEQ ID NO: 24856 - RNA, 21 nt, Homo sapiens
aguagugcuuucuacuuuaug

SEQ ID NO: 24857 - RNA, 22 nt, Homo sapiens
ucaggaacugccuuucucucca

SEQ ID NO: 24858 - RNA, 21 nt, Homo sapiens
gaccaaucgccguccccgccg

SEQ ID NO: 24859 - RNA, 21 nt, Homo sapiens
acaggauugagggggggcccu

SEQ ID NO: 24860 - RNA, 22 nt, Homo sapiens
aaucagucucauugcuuuauaa

SEQ ID NO: 24861 - RNA, 23 nt, Homo sapiens
aaaucagaaucacaccuggggga

SEQ ID NO: 24862 - RNA, 21 nt, Homo sapiens
gugacucaucaccuauggaaa

SEQ ID NO: 24863 - RNA, 24 nt, Homo sapiens
acgcagagcccgaaagcccccagu

SEQ ID NO: 24864 - RNA, 22 nt, Homo sapiens
gcggucccgcggcgccccgccu

SEQ ID NO: 24865 - RNA, 23 nt, Homo sapiens
cuccagccccuccagggcuuccu

SEQ ID NO: 24866 - RNA, 22 nt, Homo sapiens
uccggggacgaacgggacgggu

SEQ ID NO: 24867 - RNA, 23 nt, Homo sapiens
gggagugaagacacggagccaga

SEQ ID NO: 24868 - RNA, 23 nt, Homo sapiens
gggagugaagacacggagccaga

SEQ ID NO: 24869 - RNA, 21 nt, Homo sapiens
gggcaucugggacgcgcagga

SEQ ID NO: 24870 - RNA, 21 nt, Homo sapiens
gaccaaucgccguccccgccg

SEQ ID NO: 24871 - RNA, 21 nt, Homo sapiens
acaggauugagggggggcccu

SEQ ID NO: 24872 - RNA, 21 nt, Homo sapiens
acaggauugagggggggcccu

SEQ ID NO: 24873 - RNA, 23 nt, Homo sapiens
aaaucagaaucacaccuggggga

SEQ ID NO: 24874 - RNA, 25 nt, Homo sapiens
acggagcugucccaacaccaccccu

SEQ ID NO: 24875 - RNA, 24 nt, Homo sapiens
acgcagagcccgaaagcccccagu

SEQ ID NO: 24876 - RNA, 22 nt, Homo sapiens
gcggucccgcggcgccccgccu

SEQ ID NO: 24877 - RNA, 22 nt, Homo sapiens
ugcuguuagcccuagccccgca

SEQ ID NO: 24878 - RNA, 20 nt, Homo sapiens
uacugcuuccacagcucccc

SEQ ID NO: 24879 - RNA, 22 nt, Homo sapiens
ggaggccgggacgagugcaaua

SEQ ID NO: 24880 - RNA, 23 nt, Homo sapiens
cacaaauucggaucuacagggua

SEQ ID NO: 24881 - RNA, 23 nt, Homo sapiens
cacaaauucgguucuacagggua

SEQ ID NO: 24882 - RNA, 20 nt, Homo sapiens
ggggggcgaggcagguguga

SEQ ID NO: 24883 - RNA, 24 nt, Homo sapiens
ucacagguuaaagggucucaggga

SEQ ID NO: 24884 - RNA, 22 nt, Homo sapiens
ucacaaguuagggucucaggga

SEQ ID NO: 24885 - RNA, 23 nt, Homo sapiens
agcccuguucuacagcccugagg

SEQ ID NO: 24886 - RNA, 22 nt, Homo sapiens
uagucaagugaagcagugggag

SEQ ID NO: 24887 - RNA, 23 nt, Homo sapiens
cgugagcuccuggaggacaggga

SEQ ID NO: 24888 - RNA, 22 nt, Homo sapiens
uauggaugcaaaaugaucccaa

SEQ ID NO: 24889 - RNA, 22 nt, Homo sapiens
cucggggcagcucaguacagga

SEQ ID NO: 24890 - RNA, 21 nt, Homo sapiens
uagcacccagauagcaaggau

SEQ ID NO: 24891 - RNA, 22 nt, Homo sapiens
gauagagugcagaccagggucu

SEQ ID NO: 24892 - RNA, 22 nt, Homo sapiens
gugauugccacucuccugagua

SEQ ID NO: 24893 - RNA, 22 nt, Homo sapiens
aaagugcuucuuaccuccagau

SEQ ID NO: 24894 - RNA, 23 nt, Homo sapiens
acacucuaaagagaagcgcuuug

SEQ ID NO: 24895 - RNA, 21 nt, Homo sapiens
agaaaguacuucccucuggag

SEQ ID NO: 24896 - RNA, 21 nt, Homo sapiens
agaaagugcaucccucuggag

SEQ ID NO: 24897 - RNA, 23 nt, Homo sapiens
aaccaagaccccggagaucccag

SEQ ID NO: 24898 - RNA, 18 nt, Homo sapiens
gaaaugagggccagcuga

SEQ ID NO: 24899 - RNA, 22 nt, Homo sapiens
caaacaccauugucacacucca

SEQ ID NO: 24900 - RNA, 21 nt, Homo sapiens
cugggggacggagcagaagga

SEQ ID NO: 24901 - RNA, 24 nt, Homo sapiens
ucacagguuaaagggucucaggga

SEQ ID NO: 24902 - RNA, 22 nt, Homo sapiens
ucacaaguuagggucucaggga

SEQ ID NO: 24903 - RNA, 23 nt, Homo sapiens
agcccuguucuacagcccugagg

SEQ ID NO: 24904 - RNA, 20 nt, Homo sapiens
acagcaaggagggcaggagg

SEQ ID NO: 24905 - RNA, 22 nt, Homo sapiens
cacucagcggccguuuccccaa

SEQ ID NO: 24906 - RNA, 21 nt, Homo sapiens
gugacagagccaagcacaaau

SEQ ID NO: 24907 - RNA, 23 nt, Homo sapiens
gaaacccagcagacaauguagcu

SEQ ID NO: 24908 - RNA, 22 nt, Homo sapiens
ucagaccgagacaagugcaaug

SEQ ID NO: 24909 - RNA, 24 nt, Homo sapiens
ugggagaaccucccugcuucugcu

SEQ ID NO: 24910 - RNA, 22 nt, Homo sapiens
accagcuaacaauacacugcca

SEQ ID NO: 24911 - RNA, 22 nt, Homo sapiens
gagauuggccauguaauacuca

SEQ ID NO: 24912 - RNA, 23 nt, Homo sapiens
gaaagugcccucaaggcugagug

SEQ ID NO: 24913 - RNA, 22 nt, Homo sapiens
gaacuugcuaaaaaugcagaau

SEQ ID NO: 24914 - RNA, 23 nt, Homo sapiens
acaacaaaaucacuagucuucca

SEQ ID NO: 24915 - RNA, 22 nt, Homo sapiens
ucggucccucgggccagggcag

SEQ ID NO: 24916 - RNA, 21 nt, Homo sapiens
cugaggagagaggaggugggg

SEQ ID NO: 24917 - RNA, 19 nt, Homo sapiens
ccaccucccgaguccucac

SEQ ID NO: 24918 - RNA, 20 nt, Homo sapiens
ggggcagacagacgaggaag

SEQ ID NO: 24919 - RNA, 21 nt, Homo sapiens
gagcuacagugcuucaucuca

SEQ ID NO: 24920 - RNA, 20 nt, Homo sapiens
cuggaggaagggcccagagg

SEQ ID NO: 24921 - RNA, 22 nt, Homo sapiens
gccuaagacacaggcccagaga

SEQ ID NO: 24922 - RNA, 23 nt, Homo sapiens
acgggugcgauuucugugugaga

SEQ ID NO: 24923 - RNA, 22 nt, Homo sapiens
ccucauggaaggguuccccacu

SEQ ID NO: 24924 - RNA, 21 nt, Homo sapiens
uugucuaaccagucaccuguu

SEQ ID NO: 24925 - RNA, 21 nt, Homo sapiens
cucacucagauggccaacuca

SEQ ID NO: 24926 - RNA, 22 nt, Homo sapiens
gauccgagcaccggggaccccc

SEQ ID NO: 24927 - RNA, 21 nt, Homo sapiens
caucaccuuccuucuccucca

SEQ ID NO: 24928 - RNA, 20 nt, Homo sapiens
uacugcuuccacagcucccc

SEQ ID NO: 24929 - RNA, 22 nt, Homo sapiens
cacauggccaaaacagagaaga

SEQ ID NO: 24930 - RNA, 21 nt, Homo sapiens
caucaccuuccuucuccucca

SEQ ID NO: 24931 - RNA, 21 nt, Homo sapiens
ucccagcacacauuuagcuca

SEQ ID NO: 24932 - RNA, 18 nt, Homo sapiens
aucacauucaccucccug

SEQ ID NO: 24933 - RNA, 23 nt, Homo sapiens
gggagugaagacacggagccaga

SEQ ID NO: 24934 - RNA, 22 nt, Homo sapiens
cgaaggcaacacggauaaccua

SEQ ID NO: 24935 - RNA, 21 nt, Homo sapiens
ugcaaacccugcaugugggag

SEQ ID NO: 24936 - RNA, 22 nt, Homo sapiens
aggcauaggaugacaaagggaa

SEQ ID NO: 24937 - RNA, 22 nt, Homo sapiens
ucagccgcugucacacgcacag

SEQ ID NO: 24938 - RNA, 22 nt, Homo sapiens
aggcgaaggaugacaaagggaa

SEQ ID NO: 24939 - RNA, 22 nt, Homo sapiens
acggaagggcagagagggccag

SEQ ID NO: 24940 - RNA, 22 nt, Homo sapiens
cgauguaguccaaaggcacaua

SEQ ID NO: 24941 - RNA, 23 nt, Homo sapiens
ggacauuguuucagugcccaagu

SEQ ID NO: 24942 - RNA, 21 nt, Homo sapiens
guccugagagcgcugccuccu

SEQ ID NO: 24943 - RNA, 23 nt, Homo sapiens
ccuagagagggugagaaccugcc

SEQ ID NO: 24944 - RNA, 23 nt, Homo sapiens
cccagcuagauuguaagcuccuu

SEQ ID NO: 24945 - RNA, 18 nt, Homo sapiens
ugguggcagaggugggau

SEQ ID NO: 24946 - RNA, 22 nt, Homo sapiens
ugcaagccuugggugugggagg

SEQ ID NO: 24947 - RNA, 20 nt, Homo sapiens
ggcauucaccgcgugccuua

SEQ ID NO: 24948 - RNA, 21 nt, Homo sapiens
ucuacucagaagggugccuua

SEQ ID NO: 24949 - RNA, 24 nt, Homo sapiens
gaaagugcauagaauucugucugg

SEQ ID NO: 24950 - RNA, 20 nt, Homo sapiens
cccugcgccaucuccucuac

SEQ ID NO: 24951 - RNA, 26 nt, Homo sapiens
aaccaucucauacaaaccaacuacuu

SEQ ID NO: 24952 - RNA, 21 nt, Homo sapiens
acaggauugagggggggcccu

SEQ ID NO: 24953 - RNA, 23 nt, Homo sapiens
acugaggggccucagaccgagcu

SEQ ID NO: 24954 - RNA, 22 nt, Homo sapiens
auaaacgacaccuccuugagaa

SEQ ID NO: 24955 - RNA, 23 nt, Homo sapiens
acagaaagugcuucccucaagag

SEQ ID NO: 24956 - RNA, 22 nt, Homo sapiens
ccuaaugauucaucauucucaa

SEQ ID NO: 24957 - RNA, 23 nt, Homo sapiens
ggacauuguuucagugcccaagu

SEQ ID NO: 24958 - RNA, 21 nt, Homo sapiens
acuccaaagggaagcgccuuc

SEQ ID NO: 24959 - RNA, 22 nt, Homo sapiens
uaaccaaugugcagacuacugu

SEQ ID NO: 24960 - RNA, 22 nt, Homo sapiens
uaaccaaugugcagacuacugu

SEQ ID NO: 24961 - RNA, 17 nt, Homo sapiens
gggagaggaggaggcga

SEQ ID NO: 24962 - RNA, 22 nt, Homo sapiens
cucaauagacugugagcuccuu

SEQ ID NO: 24963 - RNA, 22 nt, Homo sapiens
cugcacuuuuaugaauaagcuc

SEQ ID NO: 24964 - RNA, 23 nt, Homo sapiens
cccagcuagauuguaagcuccuu

SEQ ID NO: 24965 - RNA, 21 nt, Homo sapiens
ggcugucaauucauaggucag

SEQ ID NO: 24966 - RNA, 23 nt, Homo sapiens
uguaggcuggggauaaaugaaua

SEQ ID NO: 24967 - RNA, 22 nt, Homo sapiens
aggaaaccagcaaguguugacg

SEQ ID NO: 24968 - RNA, 25 nt, Homo sapiens
acggagcugucccaacaccaccccu

SEQ ID NO: 24969 - RNA, 23 nt, Homo sapiens
gggagugaagacacggagccaga

SEQ ID NO: 24970 - RNA, 21 nt, Homo sapiens
gaccaaucgccguccccgccg

SEQ ID NO: 24971 - RNA, 23 nt, Homo sapiens
caugagugacgcccucuggagua

SEQ ID NO: 24972 - RNA, 22 nt, Homo sapiens
gcggucccgcggcgccccgccu

SEQ ID NO: 24973 - RNA, 24 nt, Homo sapiens
cacccccagagccucagcucccca

SEQ ID NO: 24974 - RNA, 22 nt, Homo sapiens
acaaaaguugccuuugugugau

SEQ ID NO: 24975 - RNA, 23 nt, Homo sapiens
gaaagugcccucaaggcugagug

SEQ ID NO: 24976 - RNA, 24 nt, Homo sapiens
acugggcacaaacauguccagguc

SEQ ID NO: 24977 - RNA, 23 nt, Homo sapiens
acgggugcgauuucugugugaga

SEQ ID NO: 24978 - RNA, 20 nt, Homo sapiens
aggggccucagccuccuggu

SEQ ID NO: 24979 - RNA, 22 nt, Homo sapiens
ucccucacacagaauuccagaa

SEQ ID NO: 24980 - RNA, 22 nt, Homo sapiens
augcuuuuugggguaagggcuu

SEQ ID NO: 24981 - RNA, 18 nt, Homo sapiens
auucaaucuacugccuca

SEQ ID NO: 24982 - RNA, 21 nt, Homo sapiens
guccugagagcgcugccuccu

SEQ ID NO: 24983 - RNA, 21 nt, Homo sapiens
ggggagcgggggcccugccuu

SEQ ID NO: 24984 - RNA, 23 nt, Homo sapiens
acaccaaugcccuaggggaugcg

SEQ ID NO: 24985 - RNA, 21 nt, Homo sapiens
ugcaaugcaacuacaaugcac

SEQ ID NO: 24986 - RNA, 22 nt, Homo sapiens
uagucaagugaagcagugggag

SEQ ID NO: 24987 - RNA, 20 nt, Homo sapiens
gcagaagcauuuccacacac

SEQ ID NO: 24988 - RNA, 20 nt, Homo sapiens
agugcccccacaguuugagu

SEQ ID NO: 24989 - RNA, 21 nt, Homo sapiens
gagcugcauccuggcuccggg

SEQ ID NO: 24990 - RNA, 22 nt, Homo sapiens
ucaggaacugccuuucucucca

SEQ ID NO: 24991 - RNA, 22 nt, Homo sapiens
uucacacugcaugcucugggua

SEQ ID NO: 24992 - RNA, 23 nt, Homo sapiens
cagcugcuuuugggauuccguug

SEQ ID NO: 24993 - RNA, 21 nt, Homo sapiens
aagugucagacacgguggugg

SEQ ID NO: 24994 - RNA, 23 nt, Homo sapiens
aaaucagaaucacaccuggggga

SEQ ID NO: 24995 - RNA, 19 nt, Homo sapiens
guccugaauuccgcagccu

SEQ ID NO: 24996 - RNA, 21 nt, Homo sapiens
ucccagcacacauuuagcuca

SEQ ID NO: 24997 - RNA, 24 nt, Homo sapiens
acgcagagcccgaaagcccccagu

SEQ ID NO: 24998 - RNA, 21 nt, Homo sapiens
gaaggaagugagugcagccac

SEQ ID NO: 24999 - RNA, 23 nt, Homo sapiens
guagugggccgagccgagugaca

SEQ ID NO: 25000 - RNA, 23 nt, Homo sapiens
ccgcuugagcuaacuccgacccg

SEQ ID NO: 25001 - RNA, 22 nt, Homo sapiens
caaacaccauugucacacucca

SEQ ID NO: 25002 - RNA, 27 nt, Homo sapiens
uuuagcacagugcuuauacaagaaggu

SEQ ID NO: 25003 - RNA, 23 nt, Homo sapiens
gggagugaagacacggagccaga

SEQ ID NO: 25004 - RNA, 22 nt, Homo sapiens
cagacuccgguggaaugaagga

SEQ ID NO: 25005 - RNA, 21 nt, Homo sapiens
ccuucugacuccaaguccagu

SEQ ID NO: 25006 - RNA, 22 nt, Homo sapiens
aggaaaccagcaaguguugacg

SEQ ID NO: 25007 - RNA, 19 nt, Homo sapiens
agaaaccccagcagagaca

SEQ ID NO: 25008 - RNA, 23 nt, Homo sapiens
gcacaugugcacacagccgggug

SEQ ID NO: 25009 - RNA, 18 nt, Homo sapiens
caccaccagagccaacgu

SEQ ID NO: 25010 - RNA, 23 nt, Homo sapiens
gggagugaagacacggagccaga

SEQ ID NO: 25011 - RNA, 21 nt, Homo sapiens
acuagacugugagcuccucga

SEQ ID NO: 25012 - RNA, 22 nt, Homo sapiens
ucaggaacugccuuucucucca

SEQ ID NO: 25013 - RNA, 21 nt, Homo sapiens
gaccaaucgccguccccgccg

SEQ ID NO: 25014 - RNA, 22 nt, Homo sapiens
cagaagugggccgggcacaggg

SEQ ID NO: 25015 - RNA, 22 nt, Homo sapiens
acaguucuucaacuggcagcuu

SEQ ID NO: 25016 - RNA, 19 nt, Homo sapiens
auuuugguacagcagcuca

SEQ ID NO: 25017 - RNA, 19 nt, Homo sapiens
guugggaucacaggcgccc

SEQ ID NO: 25018 - RNA, 22 nt, Homo sapiens
gcggucccgcggcgccccgccu

SEQ ID NO: 25019 - RNA, 23 nt, Homo sapiens
ccgcuugagcuaacuccgacccg

SEQ ID NO: 25020 - RNA, 20 nt, Homo sapiens
uacugcuuccacagcucccc

SEQ ID NO: 25021 - RNA, 22 nt, Homo sapiens
caaacaccauugucacacucca

SEQ ID NO: 25022 - RNA, 21 nt, Homo sapiens
ggucagaacccaucauucacu

SEQ ID NO: 25023 - RNA, 24 nt, Homo sapiens
ucacagguuaaagggucucaggga

SEQ ID NO: 25024 - RNA, 22 nt, Homo sapiens
ucacaaguuagggucucaggga

SEQ ID NO: 25025 - RNA, 23 nt, Homo sapiens
agcccuguucuacagcccugagg

SEQ ID NO: 25026 - RNA, 24 nt, Homo sapiens
acugcuggucuucagucagggcca

SEQ ID NO: 25027 - RNA, 22 nt, Homo sapiens
cacaucucacuguagccucaaa

SEQ ID NO: 25028 - RNA, 22 nt, Homo sapiens
ucaggaacugccuuucucucca

SEQ ID NO: 25029 - RNA, 22 nt, Homo sapiens
agcccaaaaggagaauucuuug

SEQ ID NO: 25030 - RNA, 21 nt, Homo sapiens
gaccaaucgccguccccgccg

SEQ ID NO: 25031 - RNA, 22 nt, Homo sapiens
gaauucaucacggccagccucu

SEQ ID NO: 25032 - RNA, 24 nt, Homo sapiens
acacucuaaagggaagcacuuugu

SEQ ID NO: 25033 - RNA, 22 nt, Homo sapiens
acucuaaagggaagcacuuugu

SEQ ID NO: 25034 - RNA, 22 nt, Homo sapiens
cuccuccaacaauccuagacca

SEQ ID NO: 25035 - RNA, 22 nt, Homo sapiens
guccaaaguuggggugcugguu

SEQ ID NO: 25036 - RNA, 22 nt, Homo sapiens
gcggucccgcggcgccccgccu

SEQ ID NO: 25037 - RNA, 22 nt, Homo sapiens
ugcuguuagcccuagccccgca

SEQ ID NO: 25038 - RNA, 22 nt, Homo sapiens
gaauucaucacggccagccucu

SEQ ID NO: 25039 - RNA, 19 nt, Homo sapiens
guccugaauuccgcagccu

SEQ ID NO: 25040 - RNA, 23 nt, Homo sapiens
acacagcucuuccauaucuccag

SEQ ID NO: 25041 - RNA, 17 nt, Homo sapiens
agaaagaagcaauauga

SEQ ID NO: 25042 - RNA, 22 nt, Homo sapiens
ucagccgcugucacacgcacag

SEQ ID NO: 25043 - RNA, 22 nt, Homo sapiens
cacucagcggccguuuccccaa

SEQ ID NO: 25044 - RNA, 22 nt, Homo sapiens
ucacaguugccagcugagauua

SEQ ID NO: 25045 - RNA, 23 nt, Homo sapiens
acauuuuucguuauugcucuuga

SEQ ID NO: 25046 - RNA, 22 nt, Homo sapiens
gcaaagguaauugcuguuuucg

SEQ ID NO: 25047 - RNA, 21 nt, Homo sapiens
cagguaccaauauuuuaucua

SEQ ID NO: 25048 - RNA, 23 nt, Homo sapiens
aaucgcgguuuauaccaaaugaa

SEQ ID NO: 25049 - RNA, 20 nt, Homo sapiens
auuucuauaucuaucuccau

SEQ ID NO: 25050 - RNA, 21 nt, Homo sapiens
cuggaggacggcaacagucag

SEQ ID NO: 25051 - RNA, 22 nt, Homo sapiens
cagaagugggccgggcacaggg

SEQ ID NO: 25052 - RNA, 22 nt, Homo sapiens
cacaaaccauuaugugcugcua

SEQ ID NO: 25053 - RNA, 22 nt, Homo sapiens
uguaaaccaugaugugcugcua

SEQ ID NO: 25054 - RNA, 22 nt, Homo sapiens
cgccaauauuuacgugcugcua

SEQ ID NO: 25055 - RNA, 21 nt, Homo sapiens
gccaauauuucugugcugcua

SEQ ID NO: 25056 - RNA, 22 nt, Homo sapiens
acugccugucugugccugcugu

SEQ ID NO: 25057 - RNA, 22 nt, Homo sapiens
uucaaaacaugaauugcugcug

SEQ ID NO: 25058 - RNA, 21 nt, Homo sapiens
acaaaccacagugugcugcug

SEQ ID NO: 25059 - RNA, 22 nt, Homo sapiens
gagcccuggacuaggagucagc

SEQ ID NO: 25060 - RNA, 21 nt, Homo sapiens
acuagacugugagcuccucga

SEQ ID NO: 25061 - RNA, 21 nt, Homo sapiens
gaccaaucgccguccccgccg

SEQ ID NO: 25062 - RNA, 22 nt, Homo sapiens
uggcagcagcggagggggcaga

SEQ ID NO: 25063 - RNA, 25 nt, Homo sapiens
agcuagucaagcgcgguuguggggg

SEQ ID NO: 25064 - RNA, 21 nt, Homo sapiens
acaggauugagggggggcccu

SEQ ID NO: 25065 - RNA, 20 nt, Homo sapiens
ccagcagcaccuggggcagu

SEQ ID NO: 25066 - RNA, 21 nt, Homo sapiens
auccuguacugagcugccccg

SEQ ID NO: 25067 - RNA, 19 nt, Homo sapiens
gccugcugacaccgugccu

SEQ ID NO: 25068 - RNA, 22 nt, Homo sapiens
uauccacuacaccccgcugccu

SEQ ID NO: 25069 - RNA, 21 nt, Homo sapiens
cuagggaagaacagugagcaa

SEQ ID NO: 25070 - RNA, 18 nt, Homo sapiens
cccccaccaccacgcccg

SEQ ID NO: 25071 - RNA, 17 nt, Homo sapiens
gggagaggaggaggcga

SEQ ID NO: 25072 - RNA, 21 nt, Homo sapiens
cggggugcacgggcggagggc

SEQ ID NO: 25073 - RNA, 23 nt, Homo sapiens
gggagugaagacacggagccaga

SEQ ID NO: 25074 - RNA, 23 nt, Homo sapiens
cugcagaacuguucccgcugcua

SEQ ID NO: 25075 - RNA, 23 nt, Homo sapiens
agaaaccaugggguaugagcaga

SEQ ID NO: 25076 - RNA, 22 nt, Homo sapiens
ugcucaauaaauacccguugaa

SEQ ID NO: 25077 - RNA, 22 nt, Homo sapiens
augcccuuucaucauugcacug

SEQ ID NO: 25078 - RNA, 23 nt, Homo sapiens
agggauuccugggaaaacuggac

SEQ ID NO: 25079 - RNA, 22 nt, Homo sapiens
agcccaaaaggagaauucuuug

SEQ ID NO: 25080 - RNA, 23 nt, Homo sapiens
cuaacugcacuagaugcaccuua

SEQ ID NO: 25081 - RNA, 22 nt, Homo sapiens
uuaacagcuaagcacccuaauc

SEQ ID NO: 25082 - RNA, 22 nt, Homo sapiens
auaaggauuuuuaggggcauua

SEQ ID NO: 25083 - RNA, 22 nt, Homo sapiens
gacaaaacccgcaaauacuuuu

SEQ ID NO: 25084 - RNA, 23 nt, Homo sapiens
uguaggcuggggauaaaugaaua

SEQ ID NO: 25085 - RNA, 22 nt, Homo sapiens
cacauggccaaaacagagaaga

SEQ ID NO: 25086 - RNA, 22 nt, Homo sapiens
caaacaccauugucacacucca

SEQ ID NO: 25087 - RNA, 21 nt, Homo sapiens
ccgugguucuacccuguggua

SEQ ID NO: 25088 - RNA, 21 nt, Homo sapiens
gaccaaucgccguccccgccg

SEQ ID NO: 25089 - RNA, 21 nt, Homo sapiens
cacucugaagggaagcgcuuu

SEQ ID NO: 25090 - RNA, 23 nt, Homo sapiens
acagcgcucgcaaccgcagcgau

SEQ ID NO: 25091 - RNA, 22 nt, Homo sapiens
gcggucccgcggcgccccgccu

SEQ ID NO: 25092 - RNA, 17 nt, Homo sapiens
uggaggccccagcgaga

SEQ ID NO: 25093 - RNA, 22 nt, Homo sapiens
ugcuguuagcccuagccccgca

SEQ ID NO: 25094 - RNA, 22 nt, Homo sapiens
uauccacuacaccccgcugccu

SEQ ID NO: 25095 - RNA, 24 nt, Homo sapiens
cacccccagagccucagcucccca

SEQ ID NO: 25096 - RNA, 21 nt, Homo sapiens
aucugcacugucagcacuuua

SEQ ID NO: 25097 - RNA, 21 nt, Homo sapiens
cggcucggguggcggcgacgg

SEQ ID NO: 25098 - RNA, 20 nt, Homo sapiens
cucaaagcaaacccugcaga

SEQ ID NO: 25099 - RNA, 20 nt, Homo sapiens
cucaaagcaaacccugcaga

SEQ ID NO: 25100 - RNA, 22 nt, Homo sapiens
cgcauuauuacucacgguacga

SEQ ID NO: 25101 - RNA, 22 nt, Homo sapiens
acucaguaugccaggguaccau

SEQ ID NO: 25102 - RNA, 24 nt, Homo sapiens
acugcuggucuucagucagggcca

SEQ ID NO: 25103 - RNA, 21 nt, Homo sapiens
gagcuacagugcuucaucuca

SEQ ID NO: 25104 - RNA, 22 nt, Homo sapiens
acaaaguucuguagugcacuga

SEQ ID NO: 25105 - RNA, 22 nt, Homo sapiens
acaaaguucugugaugcacuga

SEQ ID NO: 25106 - RNA, 21 nt, Homo sapiens
ccaaguucugucaugcacuga

SEQ ID NO: 25107 - RNA, 21 nt, Homo sapiens
gggcaucugggacgcgcagga

SEQ ID NO: 25108 - RNA, 22 nt, Homo sapiens
cggugagcacccggccccugcg

SEQ ID NO: 25109 - RNA, 20 nt, Homo sapiens
acagcaaggagggcaggagg

SEQ ID NO: 25110 - RNA, 23 nt, Homo sapiens
cggcucugucgucgaggcgcuca

SEQ ID NO: 25111 - RNA, 22 nt, Homo sapiens
aaucagucucauugcuuuauaa

SEQ ID NO: 25112 - RNA, 22 nt, Homo sapiens
uauccacuacaccccgcugccu

SEQ ID NO: 25113 - RNA, 22 nt, Homo sapiens
gggagaggucucccugcgcaca

SEQ ID NO: 25114 - RNA, 21 nt, Homo sapiens
cugaggagagaggaggugggg

SEQ ID NO: 25115 - RNA, 21 nt, Homo sapiens
cugaggagagaggaggugggg

SEQ ID NO: 25116 - RNA, 20 nt, Homo sapiens
cugcgggaggacagggcuca

SEQ ID NO: 25117 - RNA, 22 nt, Homo sapiens
cagaaagugcuucccucuagag

SEQ ID NO: 25118 - RNA, 22 nt, Homo sapiens
uccacauggaguugcuguuaca

SEQ ID NO: 25119 - RNA, 22 nt, Homo sapiens
uagucaagugaagcagugggag

SEQ ID NO: 25120 - RNA, 22 nt, Homo sapiens
auggcaguggaguuagugauug

SEQ ID NO: 25121 - RNA, 22 nt, Homo sapiens
gaccucagcuaugacagcacuu

SEQ ID NO: 25122 - RNA, 22 nt, Homo sapiens
ugcaagccuugggugugggagg

SEQ ID NO: 25123 - RNA, 22 nt, Homo sapiens
aguccagauucugugcccacca

SEQ ID NO: 25124 - RNA, 21 nt, Homo sapiens
agagcucauccauaguuguca

SEQ ID NO: 25125 - RNA, 22 nt, Homo sapiens
gcacauguucugcggcccacca

SEQ ID NO: 25126 - RNA, 21 nt, Homo sapiens
ugacugacagcuuuuugagua

SEQ ID NO: 25127 - RNA, 20 nt, Homo sapiens
uacugcuuccacagcucccc

SEQ ID NO: 25128 - RNA, 18 nt, Homo sapiens
auucaaucuacugccuca

SEQ ID NO: 25129 - RNA, 23 nt, Homo sapiens
accacaggagucugagcauuuga

SEQ ID NO: 25130 - RNA, 24 nt, Homo sapiens
ucacagguuaaagggucucaggga

SEQ ID NO: 25131 - RNA, 22 nt, Homo sapiens
ucacaaguuagggucucaggga

SEQ ID NO: 25132 - RNA, 23 nt, Homo sapiens
agcccuguucuacagcccugagg

SEQ ID NO: 25133 - RNA, 23 nt, Homo sapiens
gggagugaagacacggagccaga

SEQ ID NO: 25134 - RNA, 21 nt, Homo sapiens
uucuaggauaggcccaggggc

SEQ ID NO: 25135 - RNA, 22 nt, Homo sapiens
auaaggauuuuuaggggcauua

SEQ ID NO: 25136 - RNA, 22 nt, Homo sapiens
gccagcuaacaauacacugccu

SEQ ID NO: 25137 - RNA, 22 nt, Homo sapiens
gugauugccacucuccugagua

SEQ ID NO: 25138 - RNA, 22 nt, Homo sapiens
ccccccacugggccguacccac

SEQ ID NO: 25139 - RNA, 22 nt, Homo sapiens
augcccuuuuaacauugcacug

SEQ ID NO: 25140 - RNA, 22 nt, Homo sapiens
augcccuuucaucauugcacug

SEQ ID NO: 25141 - RNA, 23 nt, Homo sapiens
gggagugaagacacggagccaga

SEQ ID NO: 25142 - RNA, 22 nt, Homo sapiens
agcccaaaaggagaauucuuug

SEQ ID NO: 25143 - RNA, 22 nt, Homo sapiens
uggcagcagcggagggggcaga

SEQ ID NO: 25144 - RNA, 23 nt, Homo sapiens
gaacagguagucugaacacuggg

SEQ ID NO: 25145 - RNA, 23 nt, Homo sapiens
gaacagauagucuaaacacuggg

SEQ ID NO: 25146 - RNA, 23 nt, Homo sapiens
ucaguuuugcauagauuugcaca

SEQ ID NO: 25147 - RNA, 23 nt, Homo sapiens
ucaguuuugcauggauuugcaca

SEQ ID NO: 25148 - RNA, 23 nt, Homo sapiens
gcuuugacaauacuauugcacug

SEQ ID NO: 25149 - RNA, 23 nt, Homo sapiens
gcuuugacaauaucauugcacug

SEQ ID NO: 25150 - RNA, 22 nt, Homo sapiens
agcugaguguaggauguuuaca

SEQ ID NO: 25151 - RNA, 20 nt, Homo sapiens
ccagcagcaccuggggcagu

SEQ ID NO: 25152 - RNA, 23 nt, Homo sapiens
acgggugcgauuucugugugaga

SEQ ID NO: 25153 - RNA, 23 nt, Homo sapiens
aaagucucgcucucugccccuca

SEQ ID NO: 25154 - RNA, 22 nt, Homo sapiens
auauuaggaacacaucgcaaaa

SEQ ID NO: 25155 - RNA, 23 nt, Homo sapiens
acccuauaagcaauauugcacua

SEQ ID NO: 25156 - RNA, 21 nt, Homo sapiens
auccuguacugagcugccccg

SEQ ID NO: 25157 - RNA, 21 nt, Homo sapiens
acaaaccacagugugcugcug

SEQ ID NO: 25158 - RNA, 21 nt, Homo sapiens
uucacuccaaaaggugcaaaa

SEQ ID NO: 25159 - RNA, 20 nt, Homo sapiens
gaaagggcuucccuuugcag

SEQ ID NO: 25160 - RNA, 22 nt, Homo sapiens
acacucuaaaaggaugcacuuu

SEQ ID NO: 25161 - RNA, 22 nt, Homo sapiens
aaccucuaaaaggaugcacuuu

SEQ ID NO: 25162 - RNA, 22 nt, Homo sapiens
auccucuaaaaagaugcacuuu

SEQ ID NO: 25163 - RNA, 20 nt, Homo sapiens
gaaagggcuucccuuugcag

SEQ ID NO: 25164 - RNA, 22 nt, Homo sapiens
ugcaagccuugggugugggagg

SEQ ID NO: 25165 - RNA, 22 nt, Homo sapiens
gcaaaagaaacugugguuuuug

SEQ ID NO: 25166 - RNA, 21 nt, Homo sapiens
cugaaaccaaguaugggucgc

SEQ ID NO: 25167 - RNA, 23 nt, Homo sapiens
agacaaggcccacccgugcaaac

SEQ ID NO: 25168 - RNA, 23 nt, Homo sapiens
acacacucacacacacacacuca

SEQ ID NO: 25169 - RNA, 22 nt, Homo sapiens
gcaaaaguaauugcagugugug

SEQ ID NO: 25170 - RNA, 22 nt, Homo sapiens
ugaauuacuuuguaaaccacca

SEQ ID NO: 25171 - RNA, 22 nt, Homo sapiens
cacucuaaagggaggcacuuug

SEQ ID NO: 25172 - RNA, 23 nt, Homo sapiens
gggagugaagacacggagccaga

SEQ ID NO: 25173 - RNA, 18 nt, Homo sapiens
ggagaggagggcacugga

SEQ ID NO: 25174 - RNA, 20 nt, Homo sapiens
gcaaugcaacagcaaugcac

SEQ ID NO: 25175 - RNA, 22 nt, Homo sapiens
aacgcuccaaaagaaggcacuc

SEQ ID NO: 25176 - RNA, 22 nt, Homo sapiens
aacacucuaaaaggaggcacuu

SEQ ID NO: 25177 - RNA, 23 nt, Homo sapiens
gggcucuuacucccucaggcacu

SEQ ID NO: 25178 - RNA, 23 nt, Homo sapiens
ggaagccaucaagucgcugcagg

SEQ ID NO: 25179 - RNA, 23 nt, Homo sapiens
ggaagccaucaagucgcugcagg

SEQ ID NO: 25180 - RNA, 22 nt, Homo sapiens
ucaacaucagucugauaagcua

SEQ ID NO: 25181 - RNA, 21 nt, Homo sapiens
uucuaggauaggcccaggggc

SEQ ID NO: 25182 - RNA, 21 nt, Homo sapiens
auccuguacugagcugccccg

SEQ ID NO: 25183 - RNA, 23 nt, Homo sapiens
gggcucuuacucccucaggcacu

SEQ ID NO: 25184 - RNA, 22 nt, Homo sapiens
caagacacauuuggagagggac

SEQ ID NO: 25185 - RNA, 22 nt, Homo sapiens
caacuccgauaugcaaugggua

SEQ ID NO: 25186 - RNA, 18 nt, Homo sapiens
cccccaccaccacgcccg

SEQ ID NO: 25187 - RNA, 22 nt, Homo sapiens
ccaucuuuaccagacaguguua

SEQ ID NO: 25188 - RNA, 21 nt, Homo sapiens
gaccaaucgccguccccgccg

SEQ ID NO: 25189 - RNA, 22 nt, Homo sapiens
gcggucccgcggcgccccgccu

SEQ ID NO: 25190 - RNA, 22 nt, Homo sapiens
ucaguggcucagguucguugca

SEQ ID NO: 25191 - RNA, 18 nt, Homo sapiens
gaaaugagggccagcuga

SEQ ID NO: 25192 - RNA, 23 nt, Homo sapiens
gggagugaagacacggagccaga

SEQ ID NO: 25193 - RNA, 20 nt, Homo sapiens
cccgccgcgucgcccugggg

SEQ ID NO: 25194 - RNA, 23 nt, Homo sapiens
gaaacccagcagacaauguagcu

SEQ ID NO: 25195 - RNA, 23 nt, Homo sapiens
ucaacgggagugaucgugucauu

SEQ ID NO: 25196 - RNA, 22 nt, Homo sapiens
aguccagauucugugcccacca

SEQ ID NO: 25197 - RNA, 21 nt, Homo sapiens
guaaugggaccuuccucuuug

SEQ ID NO: 25198 - RNA, 22 nt, Homo sapiens
gcacauguucugcggcccacca

SEQ ID NO: 25199 - RNA, 25 nt, Homo sapiens
acggagcugucccaacaccaccccu

SEQ ID NO: 25200 - RNA, 21 nt, Homo sapiens
cugaggagagaggaggugggg

SEQ ID NO: 25201 - RNA, 22 nt, Homo sapiens
gugggguggguggucaggccga

SEQ ID NO: 25202 - RNA, 17 nt, Homo sapiens
gggagaggaggaggcga

SEQ ID NO: 25203 - RNA, 23 nt, Homo sapiens
gggagugaagacacggagccaga

SEQ ID NO: 25204 - RNA, 21 nt, Homo sapiens
gaccaaucgccguccccgccg

SEQ ID NO: 25205 - RNA, 22 nt, Homo sapiens
cuuccagucgaggauguuuaca

SEQ ID NO: 25206 - RNA, 22 nt, Homo sapiens
agcugaguguaggauguuuaca

SEQ ID NO: 25207 - RNA, 23 nt, Homo sapiens
gcugagaguguaggauguuuaca

SEQ ID NO: 25208 - RNA, 22 nt, Homo sapiens
cuuccagucggggauguuuaca

SEQ ID NO: 25209 - RNA, 22 nt, Homo sapiens
cuuccagucaaggauguuuaca

SEQ ID NO: 25210 - RNA, 18 nt, Homo sapiens
acccucugaaaggaagca

SEQ ID NO: 25211 - RNA, 22 nt, Homo sapiens
aaagugcuucuuaccuccagau

SEQ ID NO: 25212 - RNA, 24 nt, Homo sapiens
acugggcacaaacauguccagguc

SEQ ID NO: 25213 - RNA, 25 nt, Homo sapiens
aggccgccacccgcccgcgaucccu

SEQ ID NO: 25214 - RNA, 22 nt, Homo sapiens
gcggucccgcggcgccccgccu

SEQ ID NO: 25215 - RNA, 23 nt, Homo sapiens
cuccagccccuccagggcuuccu

SEQ ID NO: 25216 - RNA, 22 nt, Homo sapiens
ugcuguuagcccuagccccgca

SEQ ID NO: 25217 - RNA, 20 nt, Homo sapiens
uacugcuuccacagcucccc

SEQ ID NO: 25218 - RNA, 20 nt, Homo sapiens
uacugcuuccacagcucccc

SEQ ID NO: 25219 - RNA, 22 nt, Homo sapiens
uagucaagugaagcagugggag

SEQ ID NO: 25220 - RNA, 22 nt, Homo sapiens
ucgcccucucaacccagcuuuu

SEQ ID NO: 25221 - RNA, 22 nt, Homo sapiens
uugcccucucaacccagcuuuu

SEQ ID NO: 25222 - RNA, 20 nt, Homo sapiens
acccucucaacccagcuuuu

SEQ ID NO: 25223 - RNA, 19 nt, Homo sapiens
uccucucaacccagcuuuu

SEQ ID NO: 25224 - RNA, 22 nt, Homo sapiens
ucacgcgagccgaacgaacaaa

SEQ ID NO: 25225 - RNA, 22 nt, Homo sapiens
aagaagugcaccauguuuguuu

SEQ ID NO: 25226 - RNA, 23 nt, Homo sapiens
gaaaaacgcccccuggcuugaaa

SEQ ID NO: 25227 - RNA, 22 nt, Homo sapiens
aaagugcuucuuaccuccagau

SEQ ID NO: 25228 - RNA, 22 nt, Homo sapiens
aaagugcuucuuaccuccagau

SEQ ID NO: 25229 - RNA, 19 nt, Homo sapiens
aagacauuuucagacagcu

SEQ ID NO: 25230 - RNA, 21 nt, Homo sapiens
cuagggaagaacagugagcaa

SEQ ID NO: 25231 - RNA, 21 nt, Homo sapiens
aguagugcuuucuacuuuaug

SEQ ID NO: 25232 - RNA, 23 nt, Homo sapiens
accccuaucacgauuagcauuaa

SEQ ID NO: 25233 - RNA, 22 nt, Homo sapiens
cuuccagucgaggauguuuaca

SEQ ID NO: 25234 - RNA, 22 nt, Homo sapiens
agcugaguguaggauguuuaca

SEQ ID NO: 25235 - RNA, 23 nt, Homo sapiens
gcugagaguguaggauguuuaca

SEQ ID NO: 25236 - RNA, 22 nt, Homo sapiens
cuuccagucggggauguuuaca

SEQ ID NO: 25237 - RNA, 22 nt, Homo sapiens
cuuccagucaaggauguuuaca

SEQ ID NO: 25238 - RNA, 25 nt, Homo sapiens
aagaaagagucuugcuuugucgccc

SEQ ID NO: 25239 - RNA, 22 nt, Homo sapiens
ccagaacugaguccacagggca

SEQ ID NO: 25240 - RNA, 21 nt, Homo sapiens
gaccaaucgccguccccgccg

SEQ ID NO: 25241 - RNA, 21 nt, Homo sapiens
gaccaaucgccguccccgccg

SEQ ID NO: 25242 - RNA, 22 nt, Homo sapiens
ucagaccgagacaagugcaaug

SEQ ID NO: 25243 - RNA, 22 nt, Homo sapiens
aggaaaccagcaaguguugacg

SEQ ID NO: 25244 - RNA, 22 nt, Homo sapiens
gauccgagcaccggggaccccc

SEQ ID NO: 25245 - RNA, 22 nt, Homo sapiens
gcggucccgcggcgccccgccu

SEQ ID NO: 25246 - RNA, 22 nt, Homo sapiens
gcggucccgcggcgccccgccu

SEQ ID NO: 25247 - RNA, 22 nt, Homo sapiens
ugcuguuagcccuagccccgca

SEQ ID NO: 25248 - RNA, 22 nt, Homo sapiens
aaccauacaaccuacuaccuca

SEQ ID NO: 25249 - RNA, 23 nt, Homo sapiens
guaaauagagguuuaauuaacac

SEQ ID NO: 25250 - RNA, 18 nt, Homo sapiens
acccucugaaaggaagca

SEQ ID NO: 25251 - RNA, 22 nt, Homo sapiens
aaagugcuucuuaccuccagau

SEQ ID NO: 25252 - RNA, 21 nt, Homo sapiens
cugcugggccacaacguggga

SEQ ID NO: 25253 - RNA, 22 nt, Homo sapiens
ggaggccgggacgagugcaaua

SEQ ID NO: 25254 - RNA, 22 nt, Homo sapiens
ggagcccgcgccccgcgccgag

SEQ ID NO: 25255 - RNA, 20 nt, Homo sapiens
uucccaugcccuauaccucu

SEQ ID NO: 25256 - RNA, 23 nt, Homo sapiens
acgggugcgauuucugugugaga

SEQ ID NO: 25257 - RNA, 21 nt, Homo sapiens
ggucagaacccaucauucacu

SEQ ID NO: 25258 - RNA, 22 nt, Homo sapiens
augcccuuucaucauugcacug

SEQ ID NO: 25259 - RNA, 23 nt, Homo sapiens
agggauuccugggaaaacuggac

SEQ ID NO: 25260 - RNA, 23 nt, Homo sapiens
accccuaucacgauuagcauuaa

SEQ ID NO: 25261 - RNA, 23 nt, Homo sapiens
acucaccgacagcguugaauguu

SEQ ID NO: 25262 - RNA, 23 nt, Homo sapiens
acccaccgacagcaaugaauguu

SEQ ID NO: 25263 - RNA, 22 nt, Homo sapiens
acucaccgacagguugaauguu

SEQ ID NO: 25264 - RNA, 23 nt, Homo sapiens
acccaccgacaacaaugaauguu

SEQ ID NO: 25265 - RNA, 22 nt, Homo sapiens
acugccugucugugccugcugu

SEQ ID NO: 25266 - RNA, 22 nt, Homo sapiens
auggcaguggaguuagugauug

SEQ ID NO: 25267 - RNA, 22 nt, Homo sapiens
accagguuccaccccagcaggc

SEQ ID NO: 25268 - RNA, 21 nt, Homo sapiens
guaaugggaccuuccucuuug

SEQ ID NO: 25269 - RNA, 22 nt, Homo sapiens
ucggucccucgggccagggcag

SEQ ID NO: 25270 - RNA, 20 nt, Homo sapiens
cccugcgccaucuccucuac

SEQ ID NO: 25271 - RNA, 22 nt, Homo sapiens
auacauacuucuuuacauucca

SEQ ID NO: 25272 - RNA, 23 nt, Homo sapiens
accacaggagucugagcauuuga

SEQ ID NO: 25273 - RNA, 21 nt, Homo sapiens
cugaggagagaggaggugggg

SEQ ID NO: 25274 - RNA, 18 nt, Homo sapiens
ugguggcagaggugggau

SEQ ID NO: 25275 - RNA, 22 nt, Homo sapiens
gcacaaaucuccagaccaccca

SEQ ID NO: 25276 - RNA, 22 nt, Homo sapiens
augcccuuuuaacauugcacug

SEQ ID NO: 25277 - RNA, 22 nt, Homo sapiens
aacccauggaauucaguucuca

SEQ ID NO: 25278 - RNA, 22 nt, Homo sapiens
agccuauggaauucaguucuca

SEQ ID NO: 25279 - RNA, 23 nt, Homo sapiens
gggagugaagacacggagccaga

SEQ ID NO: 25280 - RNA, 22 nt, Homo sapiens
ccacacacuuccuuacauucca

SEQ ID NO: 25281 - RNA, 21 nt, Homo sapiens
aagugucagacacgguggugg

SEQ ID NO: 25282 - RNA, 21 nt, Homo sapiens
ggaaaucccuggcaaugugau

SEQ ID NO: 25283 - RNA, 21 nt, Homo sapiens
gguaaucccuggcaaugugau

SEQ ID NO: 25284 - RNA, 22 nt, Homo sapiens
cucaauagacugugagcuccuu

SEQ ID NO: 25285 - RNA, 22 nt, Homo sapiens
agccacaaucaccuucugaucu

SEQ ID NO: 25286 - RNA, 22 nt, Homo sapiens
agcugaguguaggauguuuaca

SEQ ID NO: 25287 - RNA, 22 nt, Homo sapiens
aucgggaggggacugagccuga

SEQ ID NO: 25288 - RNA, 21 nt, Homo sapiens
acaaaccacagugugcugcug

SEQ ID NO: 25289 - RNA, 20 nt, Homo sapiens
gaaagggcuucccuuugcag

SEQ ID NO: 25290 - RNA, 20 nt, Homo sapiens
gaaagggcuucccuuugcag

SEQ ID NO: 25291 - RNA, 22 nt, Homo sapiens
ugcaagccuugggugugggagg

SEQ ID NO: 25292 - RNA, 20 nt, Homo sapiens
ggcaaagaaggaacauuccu

SEQ ID NO: 25293 - RNA, 20 nt, Homo sapiens
aggggccucagccuccuggu

SEQ ID NO: 25294 - RNA, 23 nt, Homo sapiens
cccagcuagauuguaagcuccuu

SEQ ID NO: 25295 - RNA, 21 nt, Homo sapiens
caucaccuuccuucuccucca

SEQ ID NO: 25296 - RNA, 22 nt, Homo sapiens
ugaauuacuuuguaaaccacca

SEQ ID NO: 25297 - RNA, 22 nt, Homo sapiens
ucaggaacugccuuucucucca

SEQ ID NO: 25298 - RNA, 22 nt, Homo sapiens
cacgaccgacgccacgccgagu

SEQ ID NO: 25299 - RNA, 21 nt, Homo sapiens
gaccaaucgccguccccgccg

SEQ ID NO: 25300 - RNA, 22 nt, Homo sapiens
ucagaccgagacaagugcaaug

SEQ ID NO: 25301 - RNA, 21 nt, Homo sapiens
acaggauugagggggggcccu

SEQ ID NO: 25302 - RNA, 21 nt, Homo sapiens
acaggauugagggggggcccu

SEQ ID NO: 25303 - RNA, 22 nt, Homo sapiens
acaaaaguugccuuugugugau

SEQ ID NO: 25304 - RNA, 22 nt, Homo sapiens
gcggucccgcggcgccccgccu

SEQ ID NO: 25305 - RNA, 22 nt, Homo sapiens
ugcuguuagcccuagccccgca

SEQ ID NO: 25306 - RNA, 22 nt, Homo sapiens
cacaagaucggaucuacggguu

SEQ ID NO: 25307 - RNA, 22 nt, Homo sapiens
cgcaaggucgguucuacgggug

SEQ ID NO: 25308 - RNA, 22 nt, Homo sapiens
gugggguggguggucaggccga

SEQ ID NO: 25309 - RNA, 17 nt, Homo sapiens
gacagccucucccccac

SEQ ID NO: 25310 - RNA, 25 nt, Homo sapiens
cagcgucugccggaacccguuccca

SEQ ID NO: 25311 - RNA, 22 nt, Homo sapiens
ggagcccgcgccccgcgccgag

SEQ ID NO: 25312 - RNA, 23 nt, Homo sapiens
gggagugaagacacggagccaga

SEQ ID NO: 25313 - RNA, 21 nt, Homo sapiens
gggcaucugggacgcgcagga

SEQ ID NO: 25314 - RNA, 21 nt, Homo sapiens
gaccaaucgccguccccgccg

SEQ ID NO: 25315 - RNA, 22 nt, Homo sapiens
ucagaccgagacaagugcaaug

SEQ ID NO: 25316 - RNA, 23 nt, Homo sapiens
aaaucagaaucacaccuggggga

SEQ ID NO: 25317 - RNA, 23 nt, Homo sapiens
aaagucucgcucucugccccuca

SEQ ID NO: 25318 - RNA, 19 nt, Homo sapiens
auuuugguacagcagcuca

SEQ ID NO: 25319 - RNA, 19 nt, Homo sapiens
gccugcugacaccgugccu

SEQ ID NO: 25320 - RNA, 24 nt, Homo sapiens
acgcagagcccgaaagcccccagu

SEQ ID NO: 25321 - RNA, 24 nt, Homo sapiens
acgcgcaggccagagacccaggca

SEQ ID NO: 25322 - RNA, 22 nt, Homo sapiens
gcggucccgcggcgccccgccu

SEQ ID NO: 25323 - RNA, 23 nt, Homo sapiens
ccgcuugagcuaacuccgacccg

SEQ ID NO: 25324 - RNA, 20 nt, Homo sapiens
uacugcuuccacagcucccc

SEQ ID NO: 25325 - RNA, 25 nt, Homo sapiens
aggccgccacccgcccgcgaucccu

SEQ ID NO: 25326 - RNA, 23 nt, Homo sapiens
gucacaucccucccaagacccuc

SEQ ID NO: 25327 - RNA, 21 nt, Homo sapiens
cucccccacugcagcuggcac

SEQ ID NO: 25328 - RNA, 18 nt, Homo sapiens
cagcagccuccuucucaa

SEQ ID NO: 25329 - RNA, 22 nt, Homo sapiens
ccaucuuuaccagacaguguua

SEQ ID NO: 25330 - RNA, 22 nt, Homo sapiens
acaucguuaccagacaguguua

SEQ ID NO: 25331 - RNA, 20 nt, Homo sapiens
aggggccucagccuccuggu

SEQ ID NO: 25332 - RNA, 22 nt, Homo sapiens
cugggggcggcacaggggcuca

SEQ ID NO: 25333 - RNA, 22 nt, Homo sapiens
augcccuuucaucauugcacug

SEQ ID NO: 25334 - RNA, 18 nt, Homo sapiens
aucacauucaccucccug

SEQ ID NO: 25335 - RNA, 22 nt, Homo sapiens
ccucauggaaggguuccccacu

SEQ ID NO: 25336 - RNA, 21 nt, Homo sapiens
guaaugggaccuuccucuuug

SEQ ID NO: 25337 - RNA, 21 nt, Homo sapiens
agacacaccacggcacacuuc

SEQ ID NO: 25338 - RNA, 20 nt, Homo sapiens
uacugcuuccacagcucccc

SEQ ID NO: 25339 - RNA, 22 nt, Homo sapiens
uaaaugaauucaauuuccuucu

SEQ ID NO: 25340 - RNA, 21 nt, Homo sapiens
ggcugucaauucauaggucag

SEQ ID NO: 25341 - RNA, 21 nt, Homo sapiens
gucugucaauucauaggucau

SEQ ID NO: 25342 - RNA, 22 nt, Homo sapiens
gagcccuggacuaggagucagc

SEQ ID NO: 25343 - RNA, 21 nt, Homo sapiens
guaaugggaccuuccucuuug

SEQ ID NO: 25344 - RNA, 21 nt, Homo sapiens
cggcucggguggcggcgacgg

SEQ ID NO: 25345 - RNA, 18 nt, Homo sapiens
cccccaccaccacgcccg

SEQ ID NO: 25346 - RNA, 17 nt, Homo sapiens
gggagaggaggaggcga

SEQ ID NO: 25347 - RNA, 23 nt, Homo sapiens
uccauaaaguaggaaacacuaca

SEQ ID NO: 25348 - RNA, 20 nt, Homo sapiens
gcagaagcauuuccacacac

SEQ ID NO: 25349 - RNA, 20 nt, Homo sapiens
acagcaaggagggcaggagg

SEQ ID NO: 25350 - RNA, 23 nt, Homo sapiens
cuaccugcacuaugagcacuuug

SEQ ID NO: 25351 - RNA, 18 nt, Homo sapiens
acccucugaaaggaagca

SEQ ID NO: 25352 - RNA, 22 nt, Homo sapiens
aaagugcuucuuaccuccagau

SEQ ID NO: 25353 - RNA, 23 nt, Homo sapiens
acccucuauagggaagcgcguuc

SEQ ID NO: 25354 - RNA, 21 nt, Homo sapiens
cccgaggagccgggcaggcuu

SEQ ID NO: 25355 - RNA, 22 nt, Homo sapiens
gcaaaaguaauugcagugugug

SEQ ID NO: 25356 - RNA, 21 nt, Homo sapiens
ggggagcgggggcccugccuu

SEQ ID NO: 25357 - RNA, 23 nt, Homo sapiens
uguaggcuggggauaaaugaaua

SEQ ID NO: 25358 - RNA, 21 nt, Homo sapiens
gaaggaagugagugcagccac

SEQ ID NO: 25359 - RNA, 23 nt, Homo sapiens
aggaacagcagcagcccgggccg

SEQ ID NO: 25360 - RNA, 23 nt, Homo sapiens
aggaacagcagcagcccgggccg

SEQ ID NO: 25361 - RNA, 21 nt, Homo sapiens
acaggauugagggggggcccu

SEQ ID NO: 25362 - RNA, 22 nt, Homo sapiens
aggaaaccagcaaguguugacg

SEQ ID NO: 25363 - RNA, 20 nt, Homo sapiens
aggggccucagccuccuggu

SEQ ID NO: 25364 - RNA, 22 nt, Homo sapiens
ugcuguuagcccuagccccgca

SEQ ID NO: 25365 - RNA, 22 nt, Homo sapiens
ucggucccucgggccagggcag

SEQ ID NO: 25366 - RNA, 22 nt, Homo sapiens
cuagggaacacagggcugguga

SEQ ID NO: 25367 - RNA, 22 nt, Homo sapiens
ugaagaagggggggaagggcgu

SEQ ID NO: 25368 - RNA, 22 nt, Homo sapiens
ugaagaagggggggaagggcgu

SEQ ID NO: 25369 - RNA, 23 nt, Homo sapiens
cggccugauucacaacaccagcu

SEQ ID NO: 25370 - RNA, 21 nt, Homo sapiens
gaccaaucgccguccccgccg

SEQ ID NO: 25371 - RNA, 20 nt, Homo sapiens
acauuacuguuaucaaaaca

SEQ ID NO: 25372 - RNA, 20 nt, Homo sapiens
cuggaggaagggcccagagg

SEQ ID NO: 25373 - RNA, 22 nt, Homo sapiens
gccuaagacacaggcccagaga

SEQ ID NO: 25374 - RNA, 21 nt, Homo sapiens
uucuaggauaggcccaggggc

SEQ ID NO: 25375 - RNA, 22 nt, Homo sapiens
aucgggaggggacugagccuga

SEQ ID NO: 25376 - RNA, 22 nt, Homo sapiens
gcggucccgcggcgccccgccu

SEQ ID NO: 25377 - RNA, 20 nt, Homo sapiens
uccccacagacccagagccg

SEQ ID NO: 25378 - RNA, 20 nt, Homo sapiens
uacugcuuccacagcucccc

SEQ ID NO: 25379 - RNA, 24 nt, Homo sapiens
acugggcacaaacauguccagguc

SEQ ID NO: 25380 - RNA, 21 nt, Homo sapiens
ccccucccagccucccugcca

SEQ ID NO: 25381 - RNA, 22 nt, Homo sapiens
ccaguagcacggcucaguccag

SEQ ID NO: 25382 - RNA, 22 nt, Homo sapiens
gaaccuaucuccccucuggacc

SEQ ID NO: 25383 - RNA, 22 nt, Homo sapiens
cucaauagacugugagcuccuu

SEQ ID NO: 25384 - RNA, 21 nt, Homo sapiens
ccuucugacuccaaguccagu

SEQ ID NO: 25385 - RNA, 22 nt, Homo sapiens
gccuucugacccuaaguccagu

SEQ ID NO: 25386 - RNA, 21 nt, Homo sapiens
guguauaugcccauggacugc

SEQ ID NO: 25387 - RNA, 20 nt, Homo sapiens
acccaccuggagauccaugg

SEQ ID NO: 25388 - RNA, 18 nt, Homo sapiens
augacaccucccugugaa

SEQ ID NO: 25389 - RNA, 23 nt, Homo sapiens
acacucuaaagagaagcgcuuug

SEQ ID NO: 25390 - RNA, 21 nt, Homo sapiens
agaaaguacuucccucuggag

SEQ ID NO: 25391 - RNA, 21 nt, Homo sapiens
agaaagugcaucccucuggag

SEQ ID NO: 25392 - RNA, 22 nt, Homo sapiens
gcaaagguaauugcuguuuucg

SEQ ID NO: 25393 - RNA, 21 nt, Homo sapiens
gaaggaagugagugcagccac

SEQ ID NO: 25394 - RNA, 23 nt, Homo sapiens
cccagcuagauuguaagcuccuu

SEQ ID NO: 25395 - RNA, 21 nt, Homo sapiens
ggggagcgggggcccugccuu

SEQ ID NO: 25396 - RNA, 22 nt, Homo sapiens
gcacaaaucuccagaccaccca

SEQ ID NO: 25397 - RNA, 18 nt, Homo sapiens
aucacauucaccucccug

SEQ ID NO: 25398 - RNA, 22 nt, Homo sapiens
ucaggaacugccuuucucucca

SEQ ID NO: 25399 - RNA, 23 nt, Homo sapiens
cuaucugcacuagaugcaccuua

SEQ ID NO: 25400 - RNA, 22 nt, Homo sapiens
cagaagugggccgggcacaggg

SEQ ID NO: 25401 - RNA, 20 nt, Homo sapiens
cccgccgcgucgcccugggg

SEQ ID NO: 25402 - RNA, 23 nt, Homo sapiens
gaacagguagucugaacacuggg

SEQ ID NO: 25403 - RNA, 23 nt, Homo sapiens
gaacagauagucuaaacacuggg

SEQ ID NO: 25404 - RNA, 21 nt, Homo sapiens
uucuaggauaggcccaggggc

SEQ ID NO: 25405 - RNA, 22 nt, Homo sapiens
uacagauggauaccgugcaauu

SEQ ID NO: 25406 - RNA, 22 nt, Homo sapiens
gaauucaucacggccagccucu

SEQ ID NO: 25407 - RNA, 22 nt, Homo sapiens
ccucauggaaggguuccccacu

SEQ ID NO: 25408 - RNA, 19 nt, Homo sapiens
gcuccuguccaacuggcuc

SEQ ID NO: 25409 - RNA, 25 nt, Homo sapiens
acggagcugucccaacaccaccccu

SEQ ID NO: 25410 - RNA, 22 nt, Homo sapiens
caagacacauuuggagagggac

SEQ ID NO: 25411 - RNA, 24 nt, Homo sapiens
acgcgcaggccagagacccaggca

SEQ ID NO: 25412 - RNA, 23 nt, Homo sapiens
cuccagccccuccagggcuuccu

SEQ ID NO: 25413 - RNA, 21 nt, Homo sapiens
caucaccuuccuucuccucca

SEQ ID NO: 25414 - RNA, 22 nt, Homo sapiens
ucggucccucgggccagggcag

SEQ ID NO: 25415 - RNA, 22 nt, Homo sapiens
ucuacccagaaaggagccagug

SEQ ID NO: 25416 - RNA, 20 nt, Homo sapiens
uacugcuuccacagcucccc

SEQ ID NO: 25417 - RNA, 21 nt, Homo sapiens
ggggagcgggggcccugccuu

SEQ ID NO: 25418 - RNA, 22 nt, Homo sapiens
aacuauacaaccuacuaccuca

SEQ ID NO: 25419 - RNA, 22 nt, Homo sapiens
aaccacacaaccuacuaccuca

SEQ ID NO: 25420 - RNA, 19 nt, Homo sapiens
agaaaccccagcagagaca

SEQ ID NO: 25421 - RNA, 21 nt, Homo sapiens
aaaagcuaagucaucauauau

SEQ ID NO: 25422 - RNA, 18 nt, Homo sapiens
aucacauucaccucccug

SEQ ID NO: 25423 - RNA, 21 nt, Homo sapiens
ccgugguucuacccuguggua

SEQ ID NO: 25424 - RNA, 23 nt, Homo sapiens
gggagugaagacacggagccaga

SEQ ID NO: 25425 - RNA, 22 nt, Homo sapiens
ucaacaucagucugauaagcua

SEQ ID NO: 25426 - RNA, 22 nt, Homo sapiens
ggagagccuccacccaacccuc

SEQ ID NO: 25427 - RNA, 21 nt, Homo sapiens
caugcacaugcacacauacau

SEQ ID NO: 25428 - RNA, 24 nt, Homo sapiens
ugggagaaccucccugcuucugcu

SEQ ID NO: 25429 - RNA, 22 nt, Homo sapiens
gaacuugcuaaaaaugcagaau

SEQ ID NO: 25430 - RNA, 20 nt, Homo sapiens
guguguauacauuuauacau

SEQ ID NO: 25431 - RNA, 23 nt, Homo sapiens
acacacucacacacacacacuca

SEQ ID NO: 25432 - RNA, 22 nt, Homo sapiens
acaguggucaucgagugacaca

SEQ ID NO: 25433 - RNA, 22 nt, Homo sapiens
gcaaaaguaauugcagugugug

SEQ ID NO: 25434 - RNA, 22 nt, Homo sapiens
caagacacauuuggagagggac

SEQ ID NO: 25435 - RNA, 22 nt, Homo sapiens
cugggggcggcacaggggcuca

SEQ ID NO: 25436 - RNA, 17 nt, Homo sapiens
gacagccucucccccac

SEQ ID NO: 25437 - RNA, 21 nt, Homo sapiens
gaccaaucgccguccccgccg

SEQ ID NO: 25438 - RNA, 20 nt, Homo sapiens
cccgccgcgucgcccugggg

SEQ ID NO: 25439 - RNA, 23 nt, Homo sapiens
cagcugcuuuugggauuccguug

SEQ ID NO: 25440 - RNA, 23 nt, Homo sapiens
aaaucagaaucacaccuggggga

SEQ ID NO: 25441 - RNA, 22 nt, Homo sapiens
aguccagauucugugcccacca

SEQ ID NO: 25442 - RNA, 25 nt, Homo sapiens
acggagcugucccaacaccaccccu

SEQ ID NO: 25443 - RNA, 24 nt, Homo sapiens
acgcagagcccgaaagcccccagu

SEQ ID NO: 25444 - RNA, 22 nt, Homo sapiens
gcacauguucugcggcccacca

SEQ ID NO: 25445 - RNA, 22 nt, Homo sapiens
gcggucccgcggcgccccgccu

SEQ ID NO: 25446 - RNA, 22 nt, Homo sapiens
ugcuguuagcccuagccccgca

SEQ ID NO: 25447 - RNA, 24 nt, Homo sapiens
cacccccagagccucagcucccca

SEQ ID NO: 25448 - RNA, 22 nt, Homo sapiens
cuagggaacacagggcugguga

SEQ ID NO: 25449 - RNA, 23 nt, Homo sapiens
cggccugauucacaacaccagcu

SEQ ID NO: 25450 - RNA, 22 nt, Homo sapiens
ucagaccgagacaagugcaaug

SEQ ID NO: 25451 - RNA, 23 nt, Homo sapiens
acauuuuucguuauugcucuuga

SEQ ID NO: 25452 - RNA, 23 nt, Homo sapiens
cggcucugucgucgaggcgcuca

SEQ ID NO: 25453 - RNA, 22 nt, Homo sapiens
aucgggaggggacugagccuga

SEQ ID NO: 25454 - RNA, 23 nt, Homo sapiens
gcacaugugcacacagccgggug

SEQ ID NO: 25455 - RNA, 22 nt, Homo sapiens
uacaucuggacagccgaaugaa

SEQ ID NO: 25456 - RNA, 23 nt, Homo sapiens
accccuaucacgauuagcauuaa

SEQ ID NO: 25457 - RNA, 22 nt, Homo sapiens
acugggacuuuguaggccaguu

SEQ ID NO: 25458 - RNA, 22 nt, Homo sapiens
agcgggacuuugagggccaguu

SEQ ID NO: 25459 - RNA, 23 nt, Homo sapiens
cugugggagggcaguggugagag

SEQ ID NO: 25460 - RNA, 22 nt, Homo sapiens
ggagauggagccagggcccuaa

SEQ ID NO: 25461 - RNA, 22 nt, Homo sapiens
cacgaccgacgccacgccgagu

SEQ ID NO: 25462 - RNA, 18 nt, Homo sapiens
aucacauucaccucccug

SEQ ID NO: 25463 - RNA, 23 nt, Homo sapiens
gggagugaagacacggagccaga

SEQ ID NO: 25464 - RNA, 23 nt, Homo sapiens
aaagucucgcucucugccccuca

SEQ ID NO: 25465 - RNA, 19 nt, Homo sapiens
gccucagaggcagcugcuu

SEQ ID NO: 25466 - RNA, 24 nt, Homo sapiens
acgcgcaggccagagacccaggca

SEQ ID NO: 25467 - RNA, 22 nt, Homo sapiens
ugcuguuagcccuagccccgca

SEQ ID NO: 25468 - RNA, 20 nt, Homo sapiens
uacugcuuccacagcucccc

SEQ ID NO: 25469 - RNA, 22 nt, Homo sapiens
gggagaggucucccugcgcaca

SEQ ID NO: 25470 - RNA, 22 nt, Homo sapiens
cacaagaucggaucuacggguu

SEQ ID NO: 25471 - RNA, 22 nt, Homo sapiens
cgcaaggucgguucuacgggug

SEQ ID NO: 25472 - RNA, 20 nt, Homo sapiens
cucaaagcaaacccugcaga

SEQ ID NO: 25473 - RNA, 17 nt, Homo sapiens
gggagaggaggaggcga

SEQ ID NO: 25474 - RNA, 22 nt, Homo sapiens
gcacaaaucuccagaccaccca

SEQ ID NO: 25475 - RNA, 18 nt, Homo sapiens
aucacauucaccucccug

SEQ ID NO: 25476 - RNA, 21 nt, Homo sapiens
gaccaaucgccguccccgccg

SEQ ID NO: 25477 - RNA, 22 nt, Homo sapiens
gcgaacgcgccacggaccaccu

SEQ ID NO: 25478 - RNA, 23 nt, Homo sapiens
cggcucugucgucgaggcgcuca

SEQ ID NO: 25479 - RNA, 20 nt, Homo sapiens
ugggccaccgccgagcggac

SEQ ID NO: 25480 - RNA, 25 nt, Homo sapiens
accaacggaccuacuucccuccgcc

SEQ ID NO: 25481 - RNA, 22 nt, Homo sapiens
gcggucccgcggcgccccgccu

SEQ ID NO: 25482 - RNA, 22 nt, Homo sapiens
ugcuguuagcccuagccccgca

SEQ ID NO: 25483 - RNA, 21 nt, Homo sapiens
caucaccuuccuucuccucca

SEQ ID NO: 25484 - RNA, 21 nt, Homo sapiens
aagggucaguaagcacccgcg

SEQ ID NO: 25485 - RNA, 22 nt, Homo sapiens
ggcagagagucagagcgcggau

SEQ ID NO: 25486 - RNA, 23 nt, Homo sapiens
gcacaugugcacacagccgggug

SEQ ID NO: 25487 - RNA, 20 nt, Homo sapiens
ugucuccacagggcucuuua

SEQ ID NO: 25488 - RNA, 22 nt, Homo sapiens
augcccuuucaucauugcacug

SEQ ID NO: 25489 - RNA, 23 nt, Homo sapiens
gggagugaagacacggagccaga

SEQ ID NO: 25490 - RNA, 22 nt, Homo sapiens
cacaaaccauuaugugcugcua

SEQ ID NO: 25491 - RNA, 22 nt, Homo sapiens
uguaaaccaugaugugcugcua

SEQ ID NO: 25492 - RNA, 22 nt, Homo sapiens
cgccaauauuuacgugcugcua

SEQ ID NO: 25493 - RNA, 23 nt, Homo sapiens
cccaacagacauggcgguacuca

SEQ ID NO: 25494 - RNA, 21 nt, Homo sapiens
gccaauauuucugugcugcua

SEQ ID NO: 25495 - RNA, 22 nt, Homo sapiens
cuguuccugcugaacugagcca

SEQ ID NO: 25496 - RNA, 22 nt, Homo sapiens
cucaauagacugugagcuccuu

SEQ ID NO: 25497 - RNA, 22 nt, Homo sapiens
uucaaaacaugaauugcugcug

SEQ ID NO: 25498 - RNA, 22 nt, Homo sapiens
gaauucaucacggccagccucu

SEQ ID NO: 25499 - RNA, 21 nt, Homo sapiens
acaaaccacagugugcugcug

SEQ ID NO: 25500 - RNA, 23 nt, Homo sapiens
cugcagaacuguucccgcugcua

SEQ ID NO: 25501 - RNA, 23 nt, Homo sapiens
gucagaccccgagggguccucgc

SEQ ID NO: 25502 - RNA, 20 nt, Homo sapiens
aggggccucagccuccuggu

SEQ ID NO: 25503 - RNA, 23 nt, Homo sapiens
cccagcuagauuguaagcuccuu

SEQ ID NO: 25504 - RNA, 21 nt, Homo sapiens
caucaccuuccuucuccucca

SEQ ID NO: 25505 - RNA, 22 nt, Homo sapiens
gcugaggcuguggggcuggagu

SEQ ID NO: 25506 - RNA, 22 nt, Homo sapiens
gggagaggucucccugcgcaca

SEQ ID NO: 25507 - RNA, 21 nt, Homo sapiens
ucuccagaucagggcagucca

SEQ ID NO: 25508 - RNA, 21 nt, Homo sapiens
gaccaaucgccguccccgccg

SEQ ID NO: 25509 - RNA, 22 nt, Homo sapiens
gaauucaucacggccagccucu

SEQ ID NO: 25510 - RNA, 22 nt, Homo sapiens
gauagagugcagaccagggucu

SEQ ID NO: 25511 - RNA, 20 nt, Homo sapiens
ugggccaccgccgagcggac

SEQ ID NO: 25512 - RNA, 22 nt, Homo sapiens
aagagggagacccaggcucgga

SEQ ID NO: 25513 - RNA, 22 nt, Homo sapiens
gcggucccgcggcgccccgccu

SEQ ID NO: 25514 - RNA, 22 nt, Homo sapiens
ugcuguuagcccuagccccgca

SEQ ID NO: 25515 - RNA, 20 nt, Homo sapiens
gcagcuguccgcccagacac

SEQ ID NO: 25516 - RNA, 22 nt, Homo sapiens
cgcauuauuacucacgguacga

SEQ ID NO: 25517 - RNA, 23 nt, Homo sapiens
agggauuccugggaaaacuggac

SEQ ID NO: 25518 - RNA, 21 nt, Homo sapiens
caugcacaugcacacauacau

SEQ ID NO: 25519 - RNA, 22 nt, Homo sapiens
ccucuaguaaauaugucagcau

SEQ ID NO: 25520 - RNA, 22 nt, Homo sapiens
cucauccgauguacaauaauuu

SEQ ID NO: 25521 - RNA, 22 nt, Homo sapiens
cugggggcggcacaggggcuca

SEQ ID NO: 25522 - RNA, 17 nt, Homo sapiens
gacagccucucccccac

SEQ ID NO: 25523 - RNA, 22 nt, Homo sapiens
cacgaccgacgccacgccgagu

SEQ ID NO: 25524 - RNA, 18 nt, Homo sapiens
aucacauucaccucccug

SEQ ID NO: 25525 - RNA, 22 nt, Homo sapiens
ggagcccgcgccccgcgccgag

SEQ ID NO: 25526 - RNA, 23 nt, Homo sapiens
gggagugaagacacggagccaga

SEQ ID NO: 25527 - RNA, 23 nt, Homo sapiens
cuaucugcacuagaugcaccuua

SEQ ID NO: 25528 - RNA, 21 nt, Homo sapiens
gaccaaucgccguccccgccg

SEQ ID NO: 25529 - RNA, 22 nt, Homo sapiens
acaguucuucaacuggcagcuu

SEQ ID NO: 25530 - RNA, 22 nt, Homo sapiens
aucgggaggggacugagccuga

SEQ ID NO: 25531 - RNA, 21 nt, Homo sapiens
cccgaggagccgggcaggcuu

SEQ ID NO: 25532 - RNA, 25 nt, Homo sapiens
acggagcugucccaacaccaccccu

SEQ ID NO: 25533 - RNA, 22 nt, Homo sapiens
caagacacauuuggagagggac

SEQ ID NO: 25534 - RNA, 22 nt, Homo sapiens
gcggucccgcggcgccccgccu

SEQ ID NO: 25535 - RNA, 22 nt, Homo sapiens
ugcuguuagcccuagccccgca

SEQ ID NO: 25536 - RNA, 21 nt, Homo sapiens
caucaccuuccuucuccucca

SEQ ID NO: 25537 - RNA, 22 nt, Homo sapiens
gcugaggcuguggggcuggagu

SEQ ID NO: 25538 - RNA, 20 nt, Homo sapiens
uacugcuuccacagcucccc

SEQ ID NO: 25539 - RNA, 21 nt, Homo sapiens
agagcucauccauaguuguca

SEQ ID NO: 25540 - RNA, 22 nt, Homo sapiens
uaaaugaauucaauuuccuucu

SEQ ID NO: 25541 - RNA, 18 nt, Homo sapiens
aucacauucaccucccug

SEQ ID NO: 25542 - RNA, 21 nt, Homo sapiens
gggcaucugggacgcgcagga

SEQ ID NO: 25543 - RNA, 22 nt, Homo sapiens
cccaacaacaggaaacuaccua

SEQ ID NO: 25544 - RNA, 22 nt, Homo sapiens
ugggguauuugacaaacugaca

SEQ ID NO: 25545 - RNA, 21 nt, Homo sapiens
gagcuacagugcuucaucuca

SEQ ID NO: 25546 - RNA, 21 nt, Homo sapiens
cguacgcuauacggucuacua

SEQ ID NO: 25547 - RNA, 22 nt, Homo sapiens
gagcccuggacuaggagucagc

SEQ ID NO: 25548 - RNA, 21 nt, Homo sapiens
ccuucugacuccaaguccagu

SEQ ID NO: 25549 - RNA, 22 nt, Homo sapiens
gggagaggucucccugcgcaca

SEQ ID NO: 25550 - RNA, 21 nt, Homo sapiens
aagugucagacacgguggugg

SEQ ID NO: 25551 - RNA, 22 nt, Homo sapiens
augcccuuucaucauugcacug

SEQ ID NO: 25552 - RNA, 21 nt, Homo sapiens
guaaugggaccuuccucuuug

SEQ ID NO: 25553 - RNA, 22 nt, Homo sapiens
aacuauacaaccuacuaccuca

SEQ ID NO: 25554 - RNA, 22 nt, Homo sapiens
aaccacacaaccuacuaccuca

SEQ ID NO: 25555 - RNA, 22 nt, Homo sapiens
aaccauacaaccuacuaccuca

SEQ ID NO: 25556 - RNA, 22 nt, Homo sapiens
aacuaugcaaccuacuaccucu

SEQ ID NO: 25557 - RNA, 22 nt, Homo sapiens
aacuauacaaccuccuaccuca

SEQ ID NO: 25558 - RNA, 22 nt, Homo sapiens
aacuauacaaucuacuaccuca

SEQ ID NO: 25559 - RNA, 22 nt, Homo sapiens
aacuguacaaacuacuaccuca

SEQ ID NO: 25560 - RNA, 22 nt, Homo sapiens
aacagcacaaacuacuaccuca

SEQ ID NO: 25561 - RNA, 22 nt, Homo sapiens
aacagcacaaacuacuaccuca

SEQ ID NO: 25562 - RNA, 21 nt, Homo sapiens
cugaggagagaggaggugggg

SEQ ID NO: 25563 - RNA, 22 nt, Homo sapiens
cgcauuauuacucacgguacga

SEQ ID NO: 25564 - RNA, 18 nt, Homo sapiens
ugguggcagaggugggau

SEQ ID NO: 25565 - RNA, 17 nt, Homo sapiens
gggagaggaggaggcga

SEQ ID NO: 25566 - RNA, 21 nt, Homo sapiens
agggcucaucuugguccugca

SEQ ID NO: 25567 - RNA, 22 nt, Homo sapiens
ucucucccauuagaguugaaaa

SEQ ID NO: 25568 - RNA, 23 nt, Homo sapiens
gggagugaagacacggagccaga

SEQ ID NO: 25569 - RNA, 21 nt, Homo sapiens
gggcaucugggacgcgcagga

SEQ ID NO: 25570 - RNA, 22 nt, Homo sapiens
agcugaguguaggauguuuaca

SEQ ID NO: 25571 - RNA, 21 nt, Homo sapiens
aagacgggaggagaggaguga

SEQ ID NO: 25572 - RNA, 21 nt, Homo sapiens
cacucugaagggaagcgcuuu

SEQ ID NO: 25573 - RNA, 22 nt, Homo sapiens
ugcaagccuugggugugggagg

SEQ ID NO: 25574 - RNA, 25 nt, Homo sapiens
acggagcugucccaacaccaccccu

SEQ ID NO: 25575 - RNA, 22 nt, Homo sapiens
ggcagagagucagagcgcggau

SEQ ID NO: 25576 - RNA, 22 nt, Homo sapiens
aacaauacaacuuacuaccuca

SEQ ID NO: 25577 - RNA, 22 nt, Homo sapiens
agcgggacuuugagggccaguu

SEQ ID NO: 25578 - RNA, 22 nt, Homo sapiens
ugggguauuugacaaacugaca

SEQ ID NO: 25579 - RNA, 22 nt, Homo sapiens
ucgcccucucaacccagcuuuu

SEQ ID NO: 25580 - RNA, 22 nt, Homo sapiens
uugcccucucaacccagcuuuu

SEQ ID NO: 25581 - RNA, 20 nt, Homo sapiens
acccucucaacccagcuuuu

SEQ ID NO: 25582 - RNA, 19 nt, Homo sapiens
uccucucaacccagcuuuu

SEQ ID NO: 25583 - RNA, 22 nt, Homo sapiens
accuucccugguacagaauacu

SEQ ID NO: 25584 - RNA, 23 nt, Homo sapiens
ucacauaggaaugaaaagccaua

SEQ ID NO: 25585 - RNA, 22 nt, Homo sapiens
aaagagguuaaccagguguguu

SEQ ID NO: 25586 - RNA, 22 nt, Homo sapiens
ugaauccuugaauagguguguu

SEQ ID NO: 25587 - RNA, 21 nt, Homo sapiens
cucacucagauggccaacuca

SEQ ID NO: 25588 - RNA, 21 nt, Homo sapiens
gaccaaucgccguccccgccg

SEQ ID NO: 25589 - RNA, 22 nt, Homo sapiens
gcggucccgcggcgccccgccu

SEQ ID NO: 25590 - RNA, 21 nt, Homo sapiens
gggcaucugggacgcgcagga

SEQ ID NO: 25591 - RNA, 21 nt, Homo sapiens
gaccaaucgccguccccgccg

SEQ ID NO: 25592 - RNA, 23 nt, Homo sapiens
cccaacagacauggcgguacuca

SEQ ID NO: 25593 - RNA, 22 nt, Homo sapiens
ucagaccgagacaagugcaaug

SEQ ID NO: 25594 - RNA, 23 nt, Homo sapiens
aaaucagaaucacaccuggggga

SEQ ID NO: 25595 - RNA, 23 nt, Homo sapiens
aaagucucgcucucugccccuca

SEQ ID NO: 25596 - RNA, 23 nt, Homo sapiens
aagaaucuugucccgcagguccu

SEQ ID NO: 25597 - RNA, 19 nt, Homo sapiens
auuuugguacagcagcuca

SEQ ID NO: 25598 - RNA, 24 nt, Homo sapiens
acgcagagcccgaaagcccccagu

SEQ ID NO: 25599 - RNA, 19 nt, Homo sapiens
gccucagaggcagcugcuu

SEQ ID NO: 25600 - RNA, 22 nt, Homo sapiens
gcggucccgcggcgccccgccu

SEQ ID NO: 25601 - RNA, 22 nt, Homo sapiens
ugcuguuagcccuagccccgca

SEQ ID NO: 25602 - RNA, 21 nt, Homo sapiens
caucaccuuccuucuccucca

SEQ ID NO: 25603 - RNA, 22 nt, Homo sapiens
cugggggcggcacaggggcuca

SEQ ID NO: 25604 - RNA, 22 nt, Homo sapiens
caaacaccauugucacacucca

SEQ ID NO: 25605 - RNA, 18 nt, Homo sapiens
ugguggcagaggugggau

SEQ ID NO: 25606 - RNA, 22 nt, Homo sapiens
uucacacugcaugcucugggua

SEQ ID NO: 25607 - RNA, 22 nt, Homo sapiens
ucaucucgcccgcaaagaccca

SEQ ID NO: 25608 - RNA, 22 nt, Homo sapiens
cccaacaacaugaaacuaccua

SEQ ID NO: 25609 - RNA, 22 nt, Homo sapiens
ucaccauugcuaaagugcaauu

SEQ ID NO: 25610 - RNA, 23 nt, Homo sapiens
aaagucucgcucucugccccuca

SEQ ID NO: 25611 - RNA, 21 nt, Homo sapiens
gaccaagaaauagccuuucaa

SEQ ID NO: 25612 - RNA, 22 nt, Homo sapiens
agcacagacuugcugugauguu

SEQ ID NO: 25613 - RNA, 24 nt, Homo sapiens
cagaaagugcuuucuuuuggagaa

SEQ ID NO: 25614 - RNA, 22 nt, Homo sapiens
aacacucuaaaaggaggcacuu

SEQ ID NO: 25615 - RNA, 22 nt, Homo sapiens
ugcaagccuugggugugggagg

SEQ ID NO: 25616 - RNA, 21 nt, Homo sapiens
acugaucuagagaacacaaga

SEQ ID NO: 25617 - RNA, 22 nt, Homo sapiens
ugcuguuagcccuagccccgca

SEQ ID NO: 25618 - RNA, 22 nt, Homo sapiens
acugccugucugugccugcugu

SEQ ID NO: 25619 - RNA, 22 nt, Homo sapiens
cuguuccugcugaacugagcca

SEQ ID NO: 25620 - RNA, 22 nt, Homo sapiens
acaaccagcuaagacacugcca

SEQ ID NO: 25621 - RNA, 22 nt, Homo sapiens
auggcaguggaguuagugauug

SEQ ID NO: 25622 - RNA, 23 nt, Homo sapiens
gcaaucagcuaacuacacugccu

SEQ ID NO: 25623 - RNA, 23 nt, Homo sapiens
aaaucagaaucacaccuggggga

SEQ ID NO: 25624 - RNA, 22 nt, Homo sapiens
accagguuccaccccagcaggc

SEQ ID NO: 25625 - RNA, 22 nt, Homo sapiens
accagcuaacaauacacugcca

SEQ ID NO: 25626 - RNA, 22 nt, Homo sapiens
gccagcuaacaauacacugccu

SEQ ID NO: 25627 - RNA, 22 nt, Homo sapiens
aucgggaggggacugagccuga

SEQ ID NO: 25628 - RNA, 21 nt, Homo sapiens
cccgaggagccgggcaggcuu

SEQ ID NO: 25629 - RNA, 24 nt, Homo sapiens
acgcagagcccgaaagcccccagu

SEQ ID NO: 25630 - RNA, 24 nt, Homo sapiens
acgcgcaggccagagacccaggca

SEQ ID NO: 25631 - RNA, 20 nt, Homo sapiens
uacugcuuccacagcucccc

SEQ ID NO: 25632 - RNA, 22 nt, Homo sapiens
acacacccacgcgagccggaaa

SEQ ID NO: 25633 - RNA, 22 nt, Homo sapiens
cuagggaacacagggcugguga

SEQ ID NO: 25634 - RNA, 23 nt, Homo sapiens
cggccugauucacaacaccagcu

SEQ ID NO: 25635 - RNA, 23 nt, Homo sapiens
gggagugaagacacggagccaga

SEQ ID NO: 25636 - RNA, 21 nt, Homo sapiens
gaccaaucgccguccccgccg

SEQ ID NO: 25637 - RNA, 23 nt, Homo sapiens
cccaacagacauggcgguacuca

SEQ ID NO: 25638 - RNA, 22 nt, Homo sapiens
uggcagcagcggagggggcaga

SEQ ID NO: 25639 - RNA, 23 nt, Homo sapiens
gaaacccagcagacaauguagcu

SEQ ID NO: 25640 - RNA, 20 nt, Homo sapiens
ccagcagcaccuggggcagu

SEQ ID NO: 25641 - RNA, 21 nt, Homo sapiens
uucuaggauaggcccaggggc

SEQ ID NO: 25642 - RNA, 23 nt, Homo sapiens
aaagucucgcucucugccccuca

SEQ ID NO: 25643 - RNA, 21 nt, Homo sapiens
auccuguacugagcugccccg

SEQ ID NO: 25644 - RNA, 19 nt, Homo sapiens
guccugaauuccgcagccu

SEQ ID NO: 25645 - RNA, 22 nt, Homo sapiens
gcggucccgcggcgccccgccu

SEQ ID NO: 25646 - RNA, 23 nt, Homo sapiens
gagcaaggcucuugucuguaagu

SEQ ID NO: 25647 - RNA, 22 nt, Homo sapiens
caaacaccauugucacacucca

SEQ ID NO: 25648 - RNA, 17 nt, Homo sapiens
uggcgcccgaacaggga

SEQ ID NO: 25649 - RNA, 18 nt, Homo sapiens
auucaaucuacugccuca

SEQ ID NO: 25650 - RNA, 23 nt, Homo sapiens
cuacuaaaacauggaagcacuua

SEQ ID NO: 25651 - RNA, 23 nt, Homo sapiens
acacucaaacauggaagcacuua

SEQ ID NO: 25652 - RNA, 21 nt, Homo sapiens
caucaccuuccuucuccucca

SEQ ID NO: 25653 - RNA, 21 nt, Homo sapiens
ggggagcgggggcccugccuu

SEQ ID NO: 25654 - RNA, 22 nt, Homo sapiens
ugagugcuugcuaggugccaag

SEQ ID NO: 25655 - RNA, 22 nt, Homo sapiens
ucaguuuccucugcaaacaguu

SEQ ID NO: 25656 - RNA, 21 nt, Homo sapiens
uagcacccagauagcaaggau

SEQ ID NO: 25657 - RNA, 19 nt, Homo sapiens
agaaaccccagcagagaca

SEQ ID NO: 25658 - RNA, 21 nt, Homo sapiens
ggacuauagaacuuucccccu

SEQ ID NO: 25659 - RNA, 23 nt, Homo sapiens
agcaaaaaugugcuagugccaaa

SEQ ID NO: 25660 - RNA, 27 nt, Homo sapiens
uuuagcacagugcuuauacaagaaggu

SEQ ID NO: 25661 - RNA, 22 nt, Homo sapiens
ugaagaagggggggaagggcgu

SEQ ID NO: 25662 - RNA, 24 nt, Homo sapiens
acugcaggcuccagcuuccaggcu

SEQ ID NO: 25663 - RNA, 18 nt, Homo sapiens
ccacugaaccacccaugc

SEQ ID NO: 25664 - RNA, 22 nt, Homo sapiens
acaccuggcuccacacgcgggc

SEQ ID NO: 25665 - RNA, 21 nt, Homo sapiens
gaccaaucgccguccccgccg

SEQ ID NO: 25666 - RNA, 23 nt, Homo sapiens
cagcugcuuuugggauuccguug

SEQ ID NO: 25667 - RNA, 21 nt, Homo sapiens
agcuaugccagcaucuugccu

SEQ ID NO: 25668 - RNA, 22 nt, Homo sapiens
cagcauggaguccuccagguug

SEQ ID NO: 25669 - RNA, 22 nt, Homo sapiens
uuucaguuaucaaucugucaca

SEQ ID NO: 25670 - RNA, 22 nt, Homo sapiens
gcggucccgcggcgccccgccu

SEQ ID NO: 25671 - RNA, 21 nt, Homo sapiens
cugaggagagaggaggugggg

SEQ ID NO: 25672 - RNA, 22 nt, Homo sapiens
uccacauggaguugcuguuaca

SEQ ID NO: 25673 - RNA, 22 nt, Homo sapiens
ccucauggaaggguuccccacu

SEQ ID NO: 25674 - RNA, 22 nt, Homo sapiens
caaacaccauugucacacucca

SEQ ID NO: 25675 - RNA, 24 nt, Homo sapiens
acugcaggcuccagcuuccaggcu

SEQ ID NO: 25676 - RNA, 21 nt, Homo sapiens
ccgugguucuacccuguggua

SEQ ID NO: 25677 - RNA, 22 nt, Homo sapiens
cacugguacaaggguugggaga

SEQ ID NO: 25678 - RNA, 22 nt, Homo sapiens
agcccaaaaggagaauucuuug

SEQ ID NO: 25679 - RNA, 23 nt, Homo sapiens
cuaucugcacuagaugcaccuua

SEQ ID NO: 25680 - RNA, 20 nt, Homo sapiens
cccgccgcgucgcccugggg

SEQ ID NO: 25681 - RNA, 20 nt, Homo sapiens
uucccaugcccuauaccucu

SEQ ID NO: 25682 - RNA, 22 nt, Homo sapiens
acaguucuucaacuggcagcuu

SEQ ID NO: 25683 - RNA, 22 nt, Homo sapiens
ggagagccuccacccaacccuc

SEQ ID NO: 25684 - RNA, 21 nt, Homo sapiens
acaggauugagggggggcccu

SEQ ID NO: 25685 - RNA, 22 nt, Homo sapiens
agcugaguguaggauguuuaca

SEQ ID NO: 25686 - RNA, 22 nt, Homo sapiens
ucgcccucucaacccagcuuuu

SEQ ID NO: 25687 - RNA, 22 nt, Homo sapiens
uugcccucucaacccagcuuuu

SEQ ID NO: 25688 - RNA, 20 nt, Homo sapiens
acccucucaacccagcuuuu

SEQ ID NO: 25689 - RNA, 19 nt, Homo sapiens
uccucucaacccagcuuuu

SEQ ID NO: 25690 - RNA, 23 nt, Homo sapiens
ccacccaaugaccuacuccaaga

SEQ ID NO: 25691 - RNA, 22 nt, Homo sapiens
aucgggaggggacugagccuga

SEQ ID NO: 25692 - RNA, 22 nt, Homo sapiens
acaaaagcaacugagguucuug

SEQ ID NO: 25693 - RNA, 19 nt, Homo sapiens
auuuugguacagcagcuca

SEQ ID NO: 25694 - RNA, 21 nt, Homo sapiens
acuuuccaggauucauuaacu

SEQ ID NO: 25695 - RNA, 22 nt, Homo sapiens
caccugauaaaacugagguaua

SEQ ID NO: 25696 - RNA, 20 nt, Homo sapiens
uacugcuuccacagcucccc

SEQ ID NO: 25697 - RNA, 24 nt, Homo sapiens
cacccccagagccucagcucccca

SEQ ID NO: 25698 - RNA, 22 nt, Homo sapiens
gaggcucagaauggcucaggag

SEQ ID NO: 25699 - RNA, 23 nt, Homo sapiens
gggagugaagacacggagccaga

SEQ ID NO: 25700 - RNA, 22 nt, Homo sapiens
uagucaagugaagcagugggag

SEQ ID NO: 25701 - RNA, 22 nt, Homo sapiens
cuguuccugcugaacugagcca

SEQ ID NO: 25702 - RNA, 20 nt, Homo sapiens
gcaaugcaacagcaaugcac

SEQ ID NO: 25703 - RNA, 23 nt, Homo sapiens
acugaggggccucagaccgagcu

SEQ ID NO: 25704 - RNA, 22 nt, Homo sapiens
aacgcuccaaaagaaggcacuc

SEQ ID NO: 25705 - RNA, 22 nt, Homo sapiens
aacacucuaaaaggaggcacuu

SEQ ID NO: 25706 - RNA, 23 nt, Homo sapiens
gggcucuuacucccucaggcacu

SEQ ID NO: 25707 - RNA, 22 nt, Homo sapiens
aagagggagacccaggcucgga

SEQ ID NO: 25708 - RNA, 21 nt, Homo sapiens
cugcugggccacaacguggga

SEQ ID NO: 25709 - RNA, 21 nt, Homo sapiens
aggagacucacaaguuccugc

SEQ ID NO: 25710 - RNA, 22 nt, Homo sapiens
uccggggacgaacgggacgggu

SEQ ID NO: 25711 - RNA, 18 nt, Homo sapiens
aucacauucaccucccug

SEQ ID NO: 25712 - RNA, 20 nt, Homo sapiens
cuggaggaagggcccagagg

SEQ ID NO: 25713 - RNA, 22 nt, Homo sapiens
gccuaagacacaggcccagaga

SEQ ID NO: 25714 - RNA, 22 nt, Homo sapiens
gaacuugcuaaaaaugcagaau

SEQ ID NO: 25715 - RNA, 22 nt, Homo sapiens
guacaaaaguaauuacaguuuu

SEQ ID NO: 25716 - RNA, 22 nt, Homo sapiens
ggaggccgggacgagugcaaua

SEQ ID NO: 25717 - RNA, 22 nt, Homo sapiens
acacacccacgcgagccggaaa

SEQ ID NO: 25718 - RNA, 22 nt, Homo sapiens
ugaagaagggggggaagggcgu

SEQ ID NO: 25719 - RNA, 22 nt, Homo sapiens
agccaagcucagacggauccga

SEQ ID NO: 25720 - RNA, 21 nt, Homo sapiens
ugcaaacccugcaugugggag

SEQ ID NO: 25721 - RNA, 21 nt, Homo sapiens
gaccaaucgccguccccgccg

SEQ ID NO: 25722 - RNA, 23 nt, Homo sapiens
cggcucugucgucgaggcgcuca

SEQ ID NO: 25723 - RNA, 22 nt, Homo sapiens
auaaggauuuuuaggggcauua

SEQ ID NO: 25724 - RNA, 23 nt, Homo sapiens
ucaacgggagugaucgugucauu

SEQ ID NO: 25725 - RNA, 22 nt, Homo sapiens
uauggaugcaaaaugaucccaa

SEQ ID NO: 25726 - RNA, 21 nt, Homo sapiens
acugaucuagagaacacaaga

SEQ ID NO: 25727 - RNA, 22 nt, Homo sapiens
gcggucccgcggcgccccgccu

SEQ ID NO: 25728 - RNA, 23 nt, Homo sapiens
cuccagccccuccagggcuuccu

SEQ ID NO: 25729 - RNA, 22 nt, Homo sapiens
ugcuguuagcccuagccccgca

SEQ ID NO: 25730 - RNA, 23 nt, Homo sapiens
aaccaagaccccggagaucccag

SEQ ID NO: 25731 - RNA, 22 nt, Homo sapiens
ggagauggagccagggcccuaa

SEQ ID NO: 25732 - RNA, 25 nt, Homo sapiens
acggagcugucccaacaccaccccu

SEQ ID NO: 25733 - RNA, 23 nt, Homo sapiens
ggaagccaucaagucgcugcagg

SEQ ID NO: 25734 - RNA, 18 nt, Homo sapiens
gaaaugagggccagcuga

SEQ ID NO: 25735 - RNA, 23 nt, Homo sapiens
cugugggagggcaguggugagag

SEQ ID NO: 25736 - RNA, 22 nt, Homo sapiens
ggcucccaagaaccucaccugu

SEQ ID NO: 25737 - RNA, 20 nt, Homo sapiens
ugucuccacagggcucuuua

SEQ ID NO: 25738 - RNA, 21 nt, Homo sapiens
ucuccagaucagggcagucca

SEQ ID NO: 25739 - RNA, 24 nt, Homo sapiens
gaagucacucccaggcagcugcaa

SEQ ID NO: 25740 - RNA, 22 nt, Homo sapiens
uagcagaagcauuuccgcacac

SEQ ID NO: 25741 - RNA, 23 nt, Homo sapiens
cuaccugcacuguaagcacuuug

SEQ ID NO: 25742 - RNA, 22 nt, Homo sapiens
ucagaccgagacaagugcaaug

SEQ ID NO: 25743 - RNA, 22 nt, Homo sapiens
caugauugccacgucugcagua

SEQ ID NO: 25744 - RNA, 21 nt, Homo sapiens
ugauugccacugucugcagua

SEQ ID NO: 25745 - RNA, 21 nt, Homo sapiens
gcugaggucugggccaggucu

SEQ ID NO: 25746 - RNA, 19 nt, Homo sapiens
ccaccucccgaguccucac

SEQ ID NO: 25747 - RNA, 22 nt, Homo sapiens
ccagaacugaguccacagggca

SEQ ID NO: 25748 - RNA, 21 nt, Homo sapiens
cggggugcacgggcggagggc

SEQ ID NO: 25749 - RNA, 21 nt, Homo sapiens
cggggugcacgggcggagggc

SEQ ID NO: 25750 - RNA, 23 nt, Homo sapiens
cuaucugcacuagaugcaccuua

SEQ ID NO: 25751 - RNA, 20 nt, Homo sapiens
acagcaaggagggcaggagg

SEQ ID NO: 25752 - RNA, 22 nt, Homo sapiens
ucagaccgagacaagugcaaug

SEQ ID NO: 25753 - RNA, 22 nt, Homo sapiens
gaccucagcuaugacagcacuu

SEQ ID NO: 25754 - RNA, 20 nt, Homo sapiens
agagaugagagaaacacccu

SEQ ID NO: 25755 - RNA, 25 nt, Homo sapiens
accaacggaccuacuucccuccgcc

SEQ ID NO: 25756 - RNA, 25 nt, Homo sapiens
accaacggaccuacuucccuccgcc

SEQ ID NO: 25757 - RNA, 22 nt, Homo sapiens
ucggucccucgggccagggcag

SEQ ID NO: 25758 - RNA, 21 nt, Homo sapiens
cggcucggguggcggcgacgg

SEQ ID NO: 25759 - RNA, 21 nt, Homo sapiens
ccccucccagccucccugcca

SEQ ID NO: 25760 - RNA, 18 nt, Homo sapiens
aucacauucaccucccug

SEQ ID NO: 25761 - RNA, 23 nt, Homo sapiens
gggagugaagacacggagccaga

SEQ ID NO: 25762 - RNA, 21 nt, Homo sapiens
gaccaaucgccguccccgccg

SEQ ID NO: 25763 - RNA, 22 nt, Homo sapiens
cggugagcacccggccccugcg

SEQ ID NO: 25764 - RNA, 23 nt, Homo sapiens
acaccaaugcccuaggggaugcg

SEQ ID NO: 25765 - RNA, 22 nt, Homo sapiens
ccucauggaaggguuccccacu

SEQ ID NO: 25766 - RNA, 22 nt, Homo sapiens
gcggucccgcggcgccccgccu

SEQ ID NO: 25767 - RNA, 22 nt, Homo sapiens
ugcuguuagcccuagccccgca

SEQ ID NO: 25768 - RNA, 24 nt, Homo sapiens
cacccccagagccucagcucccca

SEQ ID NO: 25769 - RNA, 22 nt, Homo sapiens
cuggagagacaaggggaagagg

SEQ ID NO: 25770 - RNA, 22 nt, Homo sapiens
cacaaaccauuaugugcugcua

SEQ ID NO: 25771 - RNA, 18 nt, Homo sapiens
auucaaucuacugccuca

SEQ ID NO: 25772 - RNA, 22 nt, Homo sapiens
uauggaugcaaaaugaucccaa

SEQ ID NO: 25773 - RNA, 21 nt, Homo sapiens
gugacucaucaccuauggaaa

SEQ ID NO: 25774 - RNA, 23 nt, Homo sapiens
aaccaagaccccggagaucccag

SEQ ID NO: 25775 - RNA, 20 nt, Homo sapiens
cccugcgccaucuccucuac

SEQ ID NO: 25776 - RNA, 20 nt, Homo sapiens
cccugcgccaucuccucuac

SEQ ID NO: 25777 - RNA, 21 nt, Homo sapiens
ggggagcgggggcccugccuu

SEQ ID NO: 25778 - RNA, 21 nt, Homo sapiens
agaaguagaccauguguccua

SEQ ID NO: 25779 - RNA, 22 nt, Homo sapiens
auccuucuacaaauucacccau

SEQ ID NO: 25780 - RNA, 21 nt, Homo sapiens
agggcucaucuugguccugca

SEQ ID NO: 25781 - RNA, 22 nt, Homo sapiens
ucaggaacugccuuucucucca

SEQ ID NO: 25782 - RNA, 22 nt, Homo sapiens
acugccugucugugccugcugu

SEQ ID NO: 25783 - RNA, 20 nt, Homo sapiens
cuggaggaagggcccagagg

SEQ ID NO: 25784 - RNA, 22 nt, Homo sapiens
gccuaagacacaggcccagaga

SEQ ID NO: 25785 - RNA, 22 nt, Homo sapiens
accagguuccaccccagcaggc

SEQ ID NO: 25786 - RNA, 23 nt, Homo sapiens
acggcuaguggaccaggugaagu

SEQ ID NO: 25787 - RNA, 25 nt, Homo sapiens
acggagcugucccaacaccaccccu

SEQ ID NO: 25788 - RNA, 22 nt, Homo sapiens
gauccgagcaccggggaccccc

SEQ ID NO: 25789 - RNA, 20 nt, Homo sapiens
uccccacagacccagagccg

SEQ ID NO: 25790 - RNA, 21 nt, Homo sapiens
cacaaccucaguguuuccagg

SEQ ID NO: 25791 - RNA, 20 nt, Homo sapiens
uacugcuuccacagcucccc

SEQ ID NO: 25792 - RNA, 22 nt, Homo sapiens
gggagaggucucccugcgcaca

SEQ ID NO: 25793 - RNA, 22 nt, Homo sapiens
uagcagaagcauuuccgcacac

SEQ ID NO: 25794 - RNA, 22 nt, Homo sapiens
acccuuaucaguucuccgucca

SEQ ID NO: 25795 - RNA, 21 nt, Homo sapiens
gaccaaucgccguccccgccg

SEQ ID NO: 25796 - RNA, 22 nt, Homo sapiens
ugagccacugugccuggccuga

SEQ ID NO: 25797 - RNA, 21 nt, Homo sapiens
uagaaaggcuaggaccaaacc

SEQ ID NO: 25798 - RNA, 22 nt, Homo sapiens
ucaacaucagucugauaagcua

SEQ ID NO: 25799 - RNA, 21 nt, Homo sapiens
gcggaacuuagccacugugaa

SEQ ID NO: 25800 - RNA, 23 nt, Homo sapiens
cuacuaaaacauggaagcacuua

SEQ ID NO: 25801 - RNA, 23 nt, Homo sapiens
acacucaaacauggaagcacuua

SEQ ID NO: 25802 - RNA, 23 nt, Homo sapiens
acggcuaguggaccaggugaagu

SEQ ID NO: 25803 - RNA, 22 nt, Homo sapiens
aagaagugcaccauguuuguuu

SEQ ID NO: 25804 - RNA, 21 nt, Homo sapiens
cacucugaagggaagcgcuuu

SEQ ID NO: 25805 - RNA, 22 nt, Homo sapiens
uuucaguuaucaaucugucaca

SEQ ID NO: 25806 - RNA, 22 nt, Homo sapiens
gcggucccgcggcgccccgccu

SEQ ID NO: 25807 - RNA, 23 nt, Homo sapiens
guagugggccgagccgagugaca

SEQ ID NO: 25808 - RNA, 22 nt, Homo sapiens
ugcuguuagcccuagccccgca

SEQ ID NO: 25809 - RNA, 22 nt, Homo sapiens
ggaggccgggacgagugcaaua

SEQ ID NO: 25810 - RNA, 22 nt, Homo sapiens
cacgaccgacgccacgccgagu

SEQ ID NO: 25811 - RNA, 23 nt, Homo sapiens
aggaacagcagcagcccgggccg

SEQ ID NO: 25812 - RNA, 23 nt, Homo sapiens
aggaacagcagcagcccgggccg

SEQ ID NO: 25813 - RNA, 22 nt, Homo sapiens
ggaggccgggacgagugcaaua

SEQ ID NO: 25814 - RNA, 22 nt, Homo sapiens
gggagaggucucccugcgcaca

SEQ ID NO: 25815 - RNA, 22 nt, Homo sapiens
gaauucaucacggccagccucu

SEQ ID NO: 25816 - RNA, 24 nt, Homo sapiens
acugcaggcuccagcuuccaggcu

SEQ ID NO: 25817 - RNA, 21 nt, Homo sapiens
gagcuacagugcuucaucuca

SEQ ID NO: 25818 - RNA, 22 nt, Homo sapiens
cagaagugggccgggcacaggg

SEQ ID NO: 25819 - RNA, 22 nt, Homo sapiens
ucgcccucucaacccagcuuuu

SEQ ID NO: 25820 - RNA, 22 nt, Homo sapiens
uugcccucucaacccagcuuuu

SEQ ID NO: 25821 - RNA, 20 nt, Homo sapiens
acccucucaacccagcuuuu

SEQ ID NO: 25822 - RNA, 19 nt, Homo sapiens
uccucucaacccagcuuuu

SEQ ID NO: 25823 - RNA, 23 nt, Homo sapiens
ccacccaaugaccuacuccaaga

SEQ ID NO: 25824 - RNA, 24 nt, Homo sapiens
cagaaagugcuuucuuuuggagaa

SEQ ID NO: 25825 - RNA, 22 nt, Homo sapiens
aacacucuaaaaggaggcacuu

SEQ ID NO: 25826 - RNA, 25 nt, Homo sapiens
acggagcugucccaacaccaccccu

SEQ ID NO: 25827 - RNA, 20 nt, Homo sapiens
uacugcuuccacagcucccc

SEQ ID NO: 25828 - RNA, 17 nt, Homo sapiens
gggagaggaggaggcga

SEQ ID NO: 25829 - RNA, 21 nt, Homo sapiens
gggcaucugggacgcgcagga

SEQ ID NO: 25830 - RNA, 23 nt, Homo sapiens
ccacccaaugaccuacuccaaga

SEQ ID NO: 25831 - RNA, 23 nt, Homo sapiens
acccucuauagggaagcgcguuc

SEQ ID NO: 25832 - RNA, 19 nt, Homo sapiens
guugggaucacaggcgccc

SEQ ID NO: 25833 - RNA, 20 nt, Homo sapiens
agagaugagagaaacacccu

SEQ ID NO: 25834 - RNA, 21 nt, Homo sapiens
cacaacccuaguggcgccauu

SEQ ID NO: 25835 - RNA, 21 nt, Homo sapiens
caacugaugccuuuccaagua

SEQ ID NO: 25836 - RNA, 17 nt, Homo sapiens
gggagaggaggaggcga

SEQ ID NO: 25837 - RNA, 18 nt, Homo sapiens
aucacauucaccucccug

SEQ ID NO: 25838 - RNA, 18 nt, Homo sapiens
aucacauucaccucccug

SEQ ID NO: 25839 - RNA, 22 nt, Homo sapiens
cagaagugggccgggcacaggg

SEQ ID NO: 25840 - RNA, 22 nt, Homo sapiens
agccacaaucaccuucugaucu

SEQ ID NO: 25841 - RNA, 21 nt, Homo sapiens
aguucucccaacguaaaccca

SEQ ID NO: 25842 - RNA, 21 nt, Homo sapiens
caucaccuuccuucuccucca

SEQ ID NO: 25843 - RNA, 21 nt, Homo sapiens
cugaggagagaggaggugggg

SEQ ID NO: 25844 - RNA, 20 nt, Homo sapiens
cugcgggaggacagggcuca

SEQ ID NO: 25845 - RNA, 24 nt, Homo sapiens
ucacagguuaaagggucucaggga

SEQ ID NO: 25846 - RNA, 22 nt, Homo sapiens
ucacaaguuagggucucaggga

SEQ ID NO: 25847 - RNA, 18 nt, Homo sapiens
ugguggcagaggugggau

SEQ ID NO: 25848 - RNA, 23 nt, Homo sapiens
agcccuguucuacagcccugagg

SEQ ID NO: 25849 - RNA, 23 nt, Homo sapiens
gggagugaagacacggagccaga

SEQ ID NO: 25850 - RNA, 18 nt, Homo sapiens
auucaaucuacugccuca

SEQ ID NO: 25851 - RNA, 23 nt, Homo sapiens
cuaucugcacuagaugcaccuua

SEQ ID NO: 25852 - RNA, 23 nt, Homo sapiens
cuaacugcacuagaugcaccuua

SEQ ID NO: 25853 - RNA, 22 nt, Homo sapiens
uggcagcagcggagggggcaga

SEQ ID NO: 25854 - RNA, 22 nt, Homo sapiens
cuguuccugcugaacugagcca

SEQ ID NO: 25855 - RNA, 22 nt, Homo sapiens
agcugaguguaggauguuuaca

SEQ ID NO: 25856 - RNA, 20 nt, Homo sapiens
ccagcagcaccuggggcagu

SEQ ID NO: 25857 - RNA, 21 nt, Homo sapiens
auccuguacugagcugccccg

SEQ ID NO: 25858 - RNA, 22 nt, Homo sapiens
ugcaagccuugggugugggagg

SEQ ID NO: 25859 - RNA, 23 nt, Homo sapiens
gggcucuuacucccucaggcacu

SEQ ID NO: 25860 - RNA, 22 nt, Homo sapiens
caagacacauuuggagagggac

SEQ ID NO: 25861 - RNA, 23 nt, Homo sapiens
cccagcuagauuguaagcuccuu

SEQ ID NO: 25862 - RNA, 20 nt, Homo sapiens
uacugcuuccacagcucccc

SEQ ID NO: 25863 - RNA, 21 nt, Homo sapiens
ggggagcgggggcccugccuu

SEQ ID NO: 25864 - RNA, 21 nt, Homo sapiens
ccccucccagccucccugcca

SEQ ID NO: 25865 - RNA, 18 nt, Homo sapiens
ugguggcagaggugggau

SEQ ID NO: 25866 - RNA, 22 nt, Homo sapiens
ccaguagcacggcucaguccag

SEQ ID NO: 25867 - RNA, 17 nt, Homo sapiens
ggguggcagcgguggga

SEQ ID NO: 25868 - RNA, 21 nt, Homo sapiens
ucuccagaucagggcagucca

SEQ ID NO: 25869 - RNA, 23 nt, Homo sapiens
gggagugaagacacggagccaga

SEQ ID NO: 25870 - RNA, 22 nt, Homo sapiens
agcugaguguaggauguuuaca

SEQ ID NO: 25871 - RNA, 22 nt, Homo sapiens
auggcaguggaguuagugauug

SEQ ID NO: 25872 - RNA, 21 nt, Homo sapiens
guguauaugcccauggacugc

SEQ ID NO: 25873 - RNA, 23 nt, Homo sapiens
caugagugacgcccucuggagua

SEQ ID NO: 25874 - RNA, 22 nt, Homo sapiens
ugcaagccuugggugugggagg

SEQ ID NO: 25875 - RNA, 22 nt, Homo sapiens
caagacacauuuggagagggac

SEQ ID NO: 25876 - RNA, 21 nt, Homo sapiens
ggggagcgggggcccugccuu

SEQ ID NO: 25877 - RNA, 22 nt, Homo sapiens
acugccugucugugccugcugu

SEQ ID NO: 25878 - RNA, 22 nt, Homo sapiens
accagguuccaccccagcaggc

SEQ ID NO: 25879 - RNA, 22 nt, Homo sapiens
gggagaggucucccugcgcaca

SEQ ID NO: 25880 - RNA, 23 nt, Homo sapiens
acaccaaugcccuaggggaugcg

SEQ ID NO: 25881 - RNA, 23 nt, Homo sapiens
uguaggcuggggauaaaugaaua

SEQ ID NO: 25882 - RNA, 22 nt, Homo sapiens
cuagggaacacagggcugguga

SEQ ID NO: 25883 - RNA, 23 nt, Homo sapiens
cugugggagggcaguggugagag

SEQ ID NO: 25884 - RNA, 17 nt, Homo sapiens
gggagaggaggaggcga

SEQ ID NO: 25885 - RNA, 22 nt, Homo sapiens
ucccucacacagaauuccagaa

SEQ ID NO: 25886 - RNA, 22 nt, Homo sapiens
augcuuuuugggguaagggcuu

SEQ ID NO: 25887 - RNA, 23 nt, Homo sapiens
cggccugauucacaacaccagcu

SEQ ID NO: 25888 - RNA, 23 nt, Homo sapiens
aaaucagaaucacaccuggggga

SEQ ID NO: 25889 - RNA, 22 nt, Homo sapiens
auauuaggaacacaucgcaaaa

SEQ ID NO: 25890 - RNA, 21 nt, Homo sapiens
cugaaaccaaguaugggucgc

SEQ ID NO: 25891 - RNA, 19 nt, Homo sapiens
guugggaucacaggcgccc

SEQ ID NO: 25892 - RNA, 24 nt, Homo sapiens
acgcagagcccgaaagcccccagu

SEQ ID NO: 25893 - RNA, 23 nt, Homo sapiens
caugcucagacaaccauggugca

SEQ ID NO: 25894 - RNA, 21 nt, Homo sapiens
ccccucccagccucccugcca

SEQ ID NO: 25895 - RNA, 22 nt, Homo sapiens
cuggagagacaaggggaagagg

SEQ ID NO: 25896 - RNA, 22 nt, Homo sapiens
aacaacacuugaccacauccug

SEQ ID NO: 25897 - RNA, 25 nt, Homo sapiens
aagaaagagucuugcuuugucgccc

SEQ ID NO: 25898 - RNA, 20 nt, Homo sapiens
ugucuccacagggcucuuua

SEQ ID NO: 25899 - RNA, 22 nt, Homo sapiens
augcccuuucaucauugcacug

SEQ ID NO: 25900 - RNA, 23 nt, Homo sapiens
gggagugaagacacggagccaga

SEQ ID NO: 25901 - RNA, 20 nt, Homo sapiens
cuggaggaagggcccagagg

SEQ ID NO: 25902 - RNA, 22 nt, Homo sapiens
gccuaagacacaggcccagaga

SEQ ID NO: 25903 - RNA, 22 nt, Homo sapiens
gcugccguauaugugaugucac

SEQ ID NO: 25904 - RNA, 22 nt, Homo sapiens
uuucaguuaucaaucugucaca

SEQ ID NO: 25905 - RNA, 21 nt, Homo sapiens
cugaaaccaaguaugggucgc

SEQ ID NO: 25906 - RNA, 20 nt, Homo sapiens
uccccacagacccagagccg

SEQ ID NO: 25907 - RNA, 21 nt, Homo sapiens
aggagacucacaaguuccugc

SEQ ID NO: 25908 - RNA, 21 nt, Homo sapiens
cuagggaagaacagugagcaa

SEQ ID NO: 25909 - RNA, 18 nt, Homo sapiens
ugguggcagaggugggau

SEQ ID NO: 25910 - RNA, 24 nt, Homo sapiens
acugcuggucuucagucagggcca

SEQ ID NO: 25911 - RNA, 22 nt, Homo sapiens
cggugagcacccggccccugcg

SEQ ID NO: 25912 - RNA, 22 nt, Homo sapiens
acugggacuuuguaggccaguu

SEQ ID NO: 25913 - RNA, 22 nt, Homo sapiens
agcgggacuuugagggccaguu

SEQ ID NO: 25914 - RNA, 22 nt, Homo sapiens
uccacauggaguugcuguuaca

SEQ ID NO: 25915 - RNA, 22 nt, Homo sapiens
acggaagggcagagagggccag

SEQ ID NO: 25916 - RNA, 21 nt, Homo sapiens
uucuaggauaggcccaggggc

SEQ ID NO: 25917 - RNA, 21 nt, Homo sapiens
auccuguacugagcugccccg

SEQ ID NO: 25918 - RNA, 22 nt, Homo sapiens
aggaaaccagcaaguguugacg

SEQ ID NO: 25919 - RNA, 25 nt, Homo sapiens
acggagcugucccaacaccaccccu

SEQ ID NO: 25920 - RNA, 23 nt, Homo sapiens
agaaaccaugggguaugagcaga

SEQ ID NO: 25921 - RNA, 20 nt, Homo sapiens
cucaaagcaaacccugcaga

SEQ ID NO: 25922 - RNA, 22 nt, Homo sapiens
cggugagcacccggccccugcg

SEQ ID NO: 25923 - RNA, 22 nt, Homo sapiens
uggcagcagcggagggggcaga

SEQ ID NO: 25924 - RNA, 20 nt, Homo sapiens
ccagcagcaccuggggcagu

SEQ ID NO: 25925 - RNA, 21 nt, Homo sapiens
auccuguacugagcugccccg

SEQ ID NO: 25926 - RNA, 19 nt, Homo sapiens
agaaaccccagcagagaca

SEQ ID NO: 25927 - RNA, 19 nt, Homo sapiens
guccugaauuccgcagccu

SEQ ID NO: 25928 - RNA, 22 nt, Homo sapiens
gggagaggucucccugcgcaca

SEQ ID NO: 25929 - RNA, 22 nt, Homo sapiens
gggagaggucucccugcgcaca

SEQ ID NO: 25930 - RNA, 23 nt, Homo sapiens
cuaccugcacuguaagcacuuuu

SEQ ID NO: 25931 - RNA, 21 nt, Homo sapiens
aucugcacugucagcacuuua

SEQ ID NO: 25932 - RNA, 18 nt, Homo sapiens
gaaaugagggccagcuga

SEQ ID NO: 25933 - RNA, 24 nt, Homo sapiens
gaagucacucccaggcagcugcaa

SEQ ID NO: 25934 - RNA, 24 nt, Homo sapiens
gaagucacucccaggcagcugcaa

SEQ ID NO: 25935 - RNA, 23 nt, Homo sapiens
cuaccugcacuguaagcacuuug

SEQ ID NO: 25936 - RNA, 22 nt, Homo sapiens
agcccaaaaggagaauucuuug

SEQ ID NO: 25937 - RNA, 22 nt, Homo sapiens
cccaacaacaugaaacuaccua

SEQ ID NO: 25938 - RNA, 23 nt, Homo sapiens
cuaccugcacuauaagcacuuua

SEQ ID NO: 25939 - RNA, 23 nt, Homo sapiens
cuaccugcacuaugagcacuuug

SEQ ID NO: 25940 - RNA, 22 nt, Homo sapiens
acugccugucugugccugcugu

SEQ ID NO: 25941 - RNA, 23 nt, Homo sapiens
acaccaaugcccuaggggaugcg

SEQ ID NO: 25942 - RNA, 22 nt, Homo sapiens
ucaccauugcuaaagugcaauu

SEQ ID NO: 25943 - RNA, 22 nt, Homo sapiens
accagguuccaccccagcaggc

SEQ ID NO: 25944 - RNA, 22 nt, Homo sapiens
acacucuaaaaggaugcacuuu

SEQ ID NO: 25945 - RNA, 22 nt, Homo sapiens
aaccucuaaaaggaugcacuuu

SEQ ID NO: 25946 - RNA, 22 nt, Homo sapiens
auccucuaaaaagaugcacuuu

SEQ ID NO: 25947 - RNA, 22 nt, Homo sapiens
cacucuaaagggaggcacuuug

SEQ ID NO: 25948 - RNA, 23 nt, Homo sapiens
acagaaagugcuucccucaagag

SEQ ID NO: 25949 - RNA, 22 nt, Homo sapiens
guccaaaguuggggugcugguu

SEQ ID NO: 25950 - RNA, 22 nt, Homo sapiens
ugcuguuagcccuagccccgca

SEQ ID NO: 25951 - RNA, 20 nt, Homo sapiens
uccccacagacccagagccg

SEQ ID NO: 25952 - RNA, 23 nt, Homo sapiens
cuaccugcacgaacagcacuuug

SEQ ID NO: 25953 - RNA, 18 nt, Homo sapiens
cccccaccaccacgcccg

SEQ ID NO: 25954 - RNA, 20 nt, Homo sapiens
gcagaagcauuuccacacac

SEQ ID NO: 25955 - RNA, 20 nt, Homo sapiens
cccgccgcgucgcccugggg

SEQ ID NO: 25956 - RNA, 22 nt, Homo sapiens
agcugaguguaggauguuuaca

SEQ ID NO: 25957 - RNA, 21 nt, Homo sapiens
uucuaggauaggcccaggggc

SEQ ID NO: 25958 - RNA, 22 nt, Homo sapiens
gagcccuggacuaggagucagc

SEQ ID NO: 25959 - RNA, 21 nt, Homo sapiens
gcuccaaccucagcagacugu

SEQ ID NO: 25960 - RNA, 23 nt, Homo sapiens
gacguaguccuauucucugcugc

SEQ ID NO: 25961 - RNA, 22 nt, Homo sapiens
caaacaccauugucacacucca

SEQ ID NO: 25962 - RNA, 22 nt, Homo sapiens
gugggguggguggucaggccga

SEQ ID NO: 25963 - RNA, 22 nt, Homo sapiens
acaccuggcuccacacgcgggc

SEQ ID NO: 25964 - RNA, 22 nt, Homo sapiens
aggcauaggaugacaaagggaa

SEQ ID NO: 25965 - RNA, 22 nt, Homo sapiens
aggcgaaggaugacaaagggaa

SEQ ID NO: 25966 - RNA, 21 nt, Homo sapiens
gugacagagccaagcacaaau

SEQ ID NO: 25967 - RNA, 23 nt, Homo sapiens
gggccgcagcugucgcccguguc

SEQ ID NO: 25968 - RNA, 24 nt, Homo sapiens
acgcgcaggccagagacccaggca

SEQ ID NO: 25969 - RNA, 22 nt, Homo sapiens
ugcuguuagcccuagccccgca

SEQ ID NO: 25970 - RNA, 23 nt, Homo sapiens
gcacaugugcacacagccgggug

SEQ ID NO: 25971 - RNA, 22 nt, Homo sapiens
cuggagagacaaggggaagagg

SEQ ID NO: 25972 - RNA, 17 nt, Homo sapiens
gggagaggaggaggcga

SEQ ID NO: 25973 - RNA, 22 nt, Homo sapiens
agaaagcgcuuuccuuuguaga

SEQ ID NO: 25974 - RNA, 23 nt, Homo sapiens
aaaaugcagauuccuggacucca

SEQ ID NO: 25975 - RNA, 22 nt, Homo sapiens
ccccucuggucaaccagucaca

SEQ ID NO: 25976 - RNA, 22 nt, Homo sapiens
cagaagugggccgggcacaggg

SEQ ID NO: 25977 - RNA, 21 nt, Homo sapiens
acaugguuagaucaagcacaa

SEQ ID NO: 25978 - RNA, 23 nt, Homo sapiens
cuacuaaaacauggaagcacuua

SEQ ID NO: 25979 - RNA, 23 nt, Homo sapiens
acacucaaacauggaagcacuua

SEQ ID NO: 25980 - RNA, 21 nt, Homo sapiens
ccuucugacuccaaguccagu

SEQ ID NO: 25981 - RNA, 22 nt, Homo sapiens
gccuucugacccuaaguccagu

SEQ ID NO: 25982 - RNA, 22 nt, Homo sapiens
auaaaugacaccuccuugugaa

SEQ ID NO: 25983 - RNA, 20 nt, Homo sapiens
gaaagggcuucccuuuguag

SEQ ID NO: 25984 - RNA, 22 nt, Homo sapiens
gagaaagugcuucccuuuguag

SEQ ID NO: 25985 - RNA, 23 nt, Homo sapiens
ugcgggcgggacgagcaagcaca

SEQ ID NO: 25986 - RNA, 22 nt, Homo sapiens
gguuaguggaccaggucacaaa

SEQ ID NO: 25987 - RNA, 21 nt, Homo sapiens
caucaccuuccuucuccucca

SEQ ID NO: 25988 - RNA, 22 nt, Homo sapiens
gcugaggcuguggggcuggagu

SEQ ID NO: 25989 - RNA, 17 nt, Homo sapiens
gacagccucucccccac

SEQ ID NO: 25990 - RNA, 21 nt, Homo sapiens
gaccaaucgccguccccgccg

SEQ ID NO: 25991 - RNA, 22 nt, Homo sapiens
cuuccagucgaggauguuuaca

SEQ ID NO: 25992 - RNA, 22 nt, Homo sapiens
cuuccagucggggauguuuaca

SEQ ID NO: 25993 - RNA, 22 nt, Homo sapiens
cuuccagucaaggauguuuaca

SEQ ID NO: 25994 - RNA, 22 nt, Homo sapiens
gcggucccgcggcgccccgccu

SEQ ID NO: 25995 - RNA, 22 nt, Homo sapiens
ugcuguuagcccuagccccgca

SEQ ID NO: 25996 - RNA, 20 nt, Homo sapiens
cuggggaaaaggguggcacg

SEQ ID NO: 25997 - RNA, 22 nt, Homo sapiens
cuggagagacaaggggaagagg

SEQ ID NO: 25998 - RNA, 22 nt, Homo sapiens
cacgaccgacgccacgccgagu

SEQ ID NO: 25999 - RNA, 21 nt, Homo sapiens
gaccaaucgccguccccgccg

SEQ ID NO: 26000 - RNA, 20 nt, Homo sapiens
cccgccgcgucgcccugggg

SEQ ID NO: 26001 - RNA, 20 nt, Homo sapiens
acagcaaggagggcaggagg

SEQ ID NO: 26002 - RNA, 22 nt, Homo sapiens
ucagaccgagacaagugcaaug

SEQ ID NO: 26003 - RNA, 21 nt, Homo sapiens
uucuaggauaggcccaggggc

SEQ ID NO: 26004 - RNA, 22 nt, Homo sapiens
aggaaaccagcaaguguugacg

SEQ ID NO: 26005 - RNA, 20 nt, Homo sapiens
ggcauucaccgcgugccuua

SEQ ID NO: 26006 - RNA, 20 nt, Homo sapiens
ggcauucaccgcgugccuua

SEQ ID NO: 26007 - RNA, 22 nt, Homo sapiens
cagaaagugcuucccucuagag

SEQ ID NO: 26008 - RNA, 22 nt, Homo sapiens
cagaaagugcuucccucuagag

SEQ ID NO: 26009 - RNA, 21 nt, Homo sapiens
cacucugaagggaagcgcuuu

SEQ ID NO: 26010 - RNA, 21 nt, Homo sapiens
cacucugaagggaagcgcuuu

SEQ ID NO: 26011 - RNA, 21 nt, Homo sapiens
ccucuaaagagaagcgcuuuc

SEQ ID NO: 26012 - RNA, 21 nt, Homo sapiens
ccucuaaagagaagcgcuuuc

SEQ ID NO: 26013 - RNA, 22 nt, Homo sapiens
acacucuaaaaggaugcacuuu

SEQ ID NO: 26014 - RNA, 22 nt, Homo sapiens
acacucuaaaaggaugcacuuu

SEQ ID NO: 26015 - RNA, 22 nt, Homo sapiens
cagaaagcgcuucccucuagag

SEQ ID NO: 26016 - RNA, 22 nt, Homo sapiens
cagaaagcgcuucccucuagag

SEQ ID NO: 26017 - RNA, 22 nt, Homo sapiens
cagaaagcgcuucccucuagag

SEQ ID NO: 26018 - RNA, 22 nt, Homo sapiens
cagaaagcgcuucccucuagag

SEQ ID NO: 26019 - RNA, 22 nt, Homo sapiens
cagaaagugcuucccucuagag

SEQ ID NO: 26020 - RNA, 22 nt, Homo sapiens
cagaaagugcuucccucuagag

SEQ ID NO: 26021 - RNA, 22 nt, Homo sapiens
acacucuaaagggaaccauuuu

SEQ ID NO: 26022 - RNA, 22 nt, Homo sapiens
acacucuaaagggaaccauuuu

SEQ ID NO: 26023 - RNA, 23 nt, Homo sapiens
acccucuauagggaagcgcguuc

SEQ ID NO: 26024 - RNA, 23 nt, Homo sapiens
acccucuauagggaagcgcguuc

SEQ ID NO: 26025 - RNA, 22 nt, Homo sapiens
cagaaagugcuucccucuagag

SEQ ID NO: 26026 - RNA, 22 nt, Homo sapiens
cagaaagugcuucccucuagag

SEQ ID NO: 26027 - RNA, 21 nt, Homo sapiens
ggacuauagaacuuucccccu

SEQ ID NO: 26028 - RNA, 19 nt, Homo sapiens
gcucuaagaaagccacacu

SEQ ID NO: 26029 - RNA, 22 nt, Homo sapiens
gcggucccgcggcgccccgccu

SEQ ID NO: 26030 - RNA, 20 nt, Homo sapiens
cccugcgccaucuccucuac

SEQ ID NO: 26031 - RNA, 22 nt, Homo sapiens
caaacaccauugucacacucca

SEQ ID NO: 26032 - RNA, 18 nt, Homo sapiens
cccccaccaccacgcccg

SEQ ID NO: 26033 - RNA, 21 nt, Homo sapiens
gaccaaucgccguccccgccg

SEQ ID NO: 26034 - RNA, 21 nt, Homo sapiens
ccuucugacuccaaguccagu

SEQ ID NO: 26035 - RNA, 22 nt, Homo sapiens
gcggucccgcggcgccccgccu

SEQ ID NO: 26036 - RNA, 22 nt, Homo sapiens
ugcuguuagcccuagccccgca

SEQ ID NO: 26037 - RNA, 23 nt, Homo sapiens
accacaggagucugagcauuuga

SEQ ID NO: 26038 - RNA, 23 nt, Homo sapiens
ggaagccaucaagucgcugcagg

SEQ ID NO: 26039 - RNA, 20 nt, Homo sapiens
cucaaagcaaacccugcaga

SEQ ID NO: 26040 - RNA, 24 nt, Homo sapiens
gaagucacucccaggcagcugcaa

SEQ ID NO: 26041 - RNA, 22 nt, Homo sapiens
uccacauggaguugcuguuaca

SEQ ID NO: 26042 - RNA, 22 nt, Homo sapiens
cgaauccaccacgaacaacuuc

SEQ ID NO: 26043 - RNA, 23 nt, Homo sapiens
gggcucuuacucccucaggcacu

SEQ ID NO: 26044 - RNA, 23 nt, Homo sapiens
gucagaccccgagggguccucgc

SEQ ID NO: 26045 - RNA, 22 nt, Homo sapiens
gugggguggguggucaggccga

SEQ ID NO: 26046 - RNA, 22 nt, Homo sapiens
auccuucuacaaauucacccau

SEQ ID NO: 26047 - RNA, 21 nt, Homo sapiens
gaccaaucgccguccccgccg

SEQ ID NO: 26048 - RNA, 22 nt, Homo sapiens
ucagaccgagacaagugcaaug

SEQ ID NO: 26049 - RNA, 22 nt, Homo sapiens
gcggucccgcggcgccccgccu

SEQ ID NO: 26050 - RNA, 22 nt, Homo sapiens
ugcuguuagcccuagccccgca

SEQ ID NO: 26051 - RNA, 21 nt, Homo sapiens
caucaccuuccuucuccucca

SEQ ID NO: 26052 - RNA, 21 nt, Homo sapiens
gagcugcauccuggcuccggg

SEQ ID NO: 26053 - RNA, 21 nt, Homo sapiens
cugaggagagaggaggugggg

SEQ ID NO: 26054 - RNA, 22 nt, Homo sapiens
agacaacaaugccaaccucaca

SEQ ID NO: 26055 - RNA, 23 nt, Homo sapiens
gggagugaagacacggagccaga

SEQ ID NO: 26056 - RNA, 23 nt, Homo sapiens
aggaacagcagcagcccgggccg

SEQ ID NO: 26057 - RNA, 21 nt, Homo sapiens
uucuaggauaggcccaggggc

SEQ ID NO: 26058 - RNA, 22 nt, Homo sapiens
uacagauggauaccgugcaauu

SEQ ID NO: 26059 - RNA, 23 nt, Homo sapiens
aaagucucgcucucugccccuca

SEQ ID NO: 26060 - RNA, 22 nt, Homo sapiens
aguccagauucugugcccacca

SEQ ID NO: 26061 - RNA, 21 nt, Homo sapiens
aucagagguucagcuuacccu

SEQ ID NO: 26062 - RNA, 22 nt, Homo sapiens
gauccgagcaccggggaccccc

SEQ ID NO: 26063 - RNA, 22 nt, Homo sapiens
gcacauguucugcggcccacca

SEQ ID NO: 26064 - RNA, 21 nt, Homo sapiens
aaagagaccgguucacuguga

SEQ ID NO: 26065 - RNA, 24 nt, Homo sapiens
gaagucacucccaggcagcugcaa

SEQ ID NO: 26066 - RNA, 21 nt, Homo sapiens
gggcaucugggacgcgcagga

SEQ ID NO: 26067 - RNA, 23 nt, Homo sapiens
cccaacagacauggcgguacuca

SEQ ID NO: 26068 - RNA, 25 nt, Homo sapiens
agcuagucaagcgcgguuguggggg

SEQ ID NO: 26069 - RNA, 22 nt, Homo sapiens
cuguuccugcugaacugagcca

SEQ ID NO: 26070 - RNA, 21 nt, Homo sapiens
cccgaggagccgggcaggcuu

SEQ ID NO: 26071 - RNA, 19 nt, Homo sapiens
guccugaauuccgcagccu

SEQ ID NO: 26072 - RNA, 22 nt, Homo sapiens
ugcuguuagcccuagccccgca

SEQ ID NO: 26073 - RNA, 23 nt, Homo sapiens
aacaggugcucaaauaagacuug

SEQ ID NO: 26074 - RNA, 23 nt, Homo sapiens
cacugugggcccucuccgcacca

SEQ ID NO: 26075 - RNA, 23 nt, Homo sapiens
gucacaucccucccaagacccuc

SEQ ID NO: 26076 - RNA, 21 nt, Homo sapiens
auguaggccuuuagaucacuu

SEQ ID NO: 26077 - RNA, 21 nt, Homo sapiens
cggggugcacgggcggagggc

SEQ ID NO: 26078 - RNA, 23 nt, Homo sapiens
gggagugaagacacggagccaga

SEQ ID NO: 26079 - RNA, 21 nt, Homo sapiens
cccuccaccaugcaagggaug

SEQ ID NO: 26080 - RNA, 23 nt, Homo sapiens
cuaucugcacuagaugcaccuua

SEQ ID NO: 26081 - RNA, 20 nt, Homo sapiens
cccgccgcgucgcccugggg

SEQ ID NO: 26082 - RNA, 22 nt, Homo sapiens
ucaucucgcccgcaaagaccca

SEQ ID NO: 26083 - RNA, 21 nt, Homo sapiens
acaugguuagaucaagcacaa

SEQ ID NO: 26084 - RNA, 22 nt, Homo sapiens
ucagaccgagacaagugcaaug

SEQ ID NO: 26085 - RNA, 22 nt, Homo sapiens
aaucagucucauugcuuuauaa

SEQ ID NO: 26086 - RNA, 22 nt, Homo sapiens
aaucagucucauugcuuuauaa

SEQ ID NO: 26087 - RNA, 22 nt, Homo sapiens
acuucaaggaucuuaaacuuug

SEQ ID NO: 26088 - RNA, 23 nt, Homo sapiens
aggagaaggcaccaugggauuua

SEQ ID NO: 26089 - RNA, 25 nt, Homo sapiens
accaacggaccuacuucccuccgcc

SEQ ID NO: 26090 - RNA, 20 nt, Homo sapiens
uccccacagacccagagccg

SEQ ID NO: 26091 - RNA, 22 nt, Homo sapiens
ucggucccucgggccagggcag

SEQ ID NO: 26092 - RNA, 22 nt, Homo sapiens
uggugauucacaaagaaaucca

SEQ ID NO: 26093 - RNA, 24 nt, Homo sapiens
acugcaggcuccagcuuccaggcu

SEQ ID NO: 26094 - RNA, 22 nt, Homo sapiens
gccaccuucaaaugggaagucu

SEQ ID NO: 26095 - RNA, 21 nt, Homo sapiens
ccccucccagccucccugcca

SEQ ID NO: 26096 - RNA, 22 nt, Homo sapiens
acaccuggcuccacacgcgggc

SEQ ID NO: 26097 - RNA, 23 nt, Homo sapiens
cuaucugcacuagaugcaccuua

SEQ ID NO: 26098 - RNA, 22 nt, Homo sapiens
aggcauaggaugacaaagggaa

SEQ ID NO: 26099 - RNA, 22 nt, Homo sapiens
aggcgaaggaugacaaagggaa

SEQ ID NO: 26100 - RNA, 17 nt, Homo sapiens
aaacauggaagcaauua

SEQ ID NO: 26101 - RNA, 22 nt, Homo sapiens
auaaacgacaccuccuugagaa

SEQ ID NO: 26102 - RNA, 22 nt, Homo sapiens
ugcuguuagcccuagccccgca

SEQ ID NO: 26103 - RNA, 22 nt, Homo sapiens
ucggucccucgggccagggcag

SEQ ID NO: 26104 - RNA, 24 nt, Homo sapiens
gaaagugcauagaauucugucugg

SEQ ID NO: 26105 - RNA, 18 nt, Homo sapiens
auucaaucuacugccuca

SEQ ID NO: 26106 - RNA, 22 nt, Homo sapiens
ucaggaacugccuuucucucca

SEQ ID NO: 26107 - RNA, 22 nt, Homo sapiens
ccggcugcaacacaagacacga

SEQ ID NO: 26108 - RNA, 21 nt, Homo sapiens
gaccaaucgccguccccgccg

SEQ ID NO: 26109 - RNA, 22 nt, Homo sapiens
ucagaccgagacaagugcaaug

SEQ ID NO: 26110 - RNA, 24 nt, Homo sapiens
ugggagaaccucccugcuucugcu

SEQ ID NO: 26111 - RNA, 23 nt, Homo sapiens
agaggcaggcaugcgggcagaca

SEQ ID NO: 26112 - RNA, 21 nt, Homo sapiens
gcuccaaccucagcagacugu

SEQ ID NO: 26113 - RNA, 21 nt, Homo sapiens
ggacuauagaacuuucccccu

SEQ ID NO: 26114 - RNA, 19 nt, Homo sapiens
ucccacaggaagcagacac

SEQ ID NO: 26115 - RNA, 22 nt, Homo sapiens
caagacacauuuggagagggac

SEQ ID NO: 26116 - RNA, 25 nt, Homo sapiens
accaacggaccuacuucccuccgcc

SEQ ID NO: 26117 - RNA, 22 nt, Homo sapiens
gcggucccgcggcgccccgccu

SEQ ID NO: 26118 - RNA, 21 nt, Homo sapiens
ugacugacagcuuuuugagua

SEQ ID NO: 26119 - RNA, 24 nt, Homo sapiens
cacccccagagccucagcucccca

SEQ ID NO: 26120 - RNA, 22 nt, Homo sapiens
gaggcucagaauggcucaggag

SEQ ID NO: 26121 - RNA, 22 nt, Homo sapiens
cuagggaacacagggcugguga

SEQ ID NO: 26122 - RNA, 23 nt, Homo sapiens
cggccugauucacaacaccagcu

SEQ ID NO: 26123 - RNA, 22 nt, Homo sapiens
ucaucucgcccgcaaagaccca

SEQ ID NO: 26124 - RNA, 22 nt, Homo sapiens
agcgggacuuugagggccaguu

SEQ ID NO: 26125 - RNA, 22 nt, Homo sapiens
uaaccgauuucagauggugcua

SEQ ID NO: 26126 - RNA, 23 nt, Homo sapiens
aacacugauuucaaauggugcua

SEQ ID NO: 26127 - RNA, 22 nt, Homo sapiens
uaaccgauuucaaauggugcua

SEQ ID NO: 26128 - RNA, 23 nt, Homo sapiens
acauuuuucguuauugcucuuga

SEQ ID NO: 26129 - RNA, 23 nt, Homo sapiens
acaccccaaaaucgaagcacuuc

SEQ ID NO: 26130 - RNA, 22 nt, Homo sapiens
cacuuaucagguuguauuauaa

SEQ ID NO: 26131 - RNA, 22 nt, Homo sapiens
gagauuggccauguaauacuca

SEQ ID NO: 26132 - RNA, 23 nt, Homo sapiens
ucucacccagguagcaaggauua

SEQ ID NO: 26133 - RNA, 22 nt, Homo sapiens
ucucacccagggacaaaggauu

SEQ ID NO: 26134 - RNA, 22 nt, Homo sapiens
gugauugccacucuccugagua

SEQ ID NO: 26135 - RNA, 22 nt, Homo sapiens
aguccagauucugugcccacca

SEQ ID NO: 26136 - RNA, 22 nt, Homo sapiens
cugcucaaacccuccaaugacu

SEQ ID NO: 26137 - RNA, 22 nt, Homo sapiens
uccucuuuucuuagagacucac

SEQ ID NO: 26138 - RNA, 21 nt, Homo sapiens
ugacugacagcuuuuugagua

SEQ ID NO: 26139 - RNA, 22 nt, Homo sapiens
cacaaguucggaucuacggguu

SEQ ID NO: 26140 - RNA, 18 nt, Homo sapiens
acccucugaaaggaagca

SEQ ID NO: 26141 - RNA, 22 nt, Homo sapiens
aaagugcuucuuaccuccagau

SEQ ID NO: 26142 - RNA, 19 nt, Homo sapiens
ucccugauccaaaaaucca

SEQ ID NO: 26143 - RNA, 22 nt, Homo sapiens
agcccaaaaggagaauucuuug

SEQ ID NO: 26144 - RNA, 22 nt, Homo sapiens
gcaaaaguaauugagauuuuug

SEQ ID NO: 26145 - RNA, 21 nt, Homo sapiens
gugacucaucaccuauggaaa

SEQ ID NO: 26146 - RNA, 22 nt, Homo sapiens
ucaaugacucagguaaguugca

SEQ ID NO: 26147 - RNA, 23 nt, Homo sapiens
ggaagccaucaagucgcugcagg

SEQ ID NO: 26148 - RNA, 18 nt, Homo sapiens
uggcgccugaacagggac

SEQ ID NO: 26149 - RNA, 18 nt, Homo sapiens
aucacauucaccucccug

SEQ ID NO: 26150 - RNA, 23 nt, Homo sapiens
gggagugaagacacggagccaga

SEQ ID NO: 26151 - RNA, 23 nt, Homo sapiens
cuaccugcacuguaagcacuuug

SEQ ID NO: 26152 - RNA, 22 nt, Homo sapiens
cagaagugggccgggcacaggg

SEQ ID NO: 26153 - RNA, 20 nt, Homo sapiens
acagcaaggagggcaggagg

SEQ ID NO: 26154 - RNA, 22 nt, Homo sapiens
acugccugucugugccugcugu

SEQ ID NO: 26155 - RNA, 22 nt, Homo sapiens
agucuucacaacagcccugugu

SEQ ID NO: 26156 - RNA, 23 nt, Homo sapiens
ucucugcaggccgugugcuuugc

SEQ ID NO: 26157 - RNA, 22 nt, Homo sapiens
accagguuccaccccagcaggc

SEQ ID NO: 26158 - RNA, 22 nt, Homo sapiens
gcugccguauaugugaugucac

SEQ ID NO: 26159 - RNA, 20 nt, Homo sapiens
gaaagggcuucccuuugcag

SEQ ID NO: 26160 - RNA, 20 nt, Homo sapiens
gaaagggcuucccuuugcag

SEQ ID NO: 26161 - RNA, 19 nt, Homo sapiens
gccucagaggcagcugcuu

SEQ ID NO: 26162 - RNA, 21 nt, Homo sapiens
gaaggaagugagugcagccac

SEQ ID NO: 26163 - RNA, 23 nt, Homo sapiens
acaacaaaaucacuagucuucca

SEQ ID NO: 26164 - RNA, 21 nt, Homo sapiens
caucaccuuccuucuccucca

SEQ ID NO: 26165 - RNA, 23 nt, Homo sapiens
agaaaccaugggguaugagcaga

SEQ ID NO: 26166 - RNA, 21 nt, Homo sapiens
cuggaggacggcaacagucag

SEQ ID NO: 26167 - RNA, 22 nt, Homo sapiens
gugauugccacucuccugagua

SEQ ID NO: 26168 - RNA, 21 nt, Homo sapiens
agcgccuuuggcagcuagagu

SEQ ID NO: 26169 - RNA, 22 nt, Homo sapiens
aacccauggaauucaguucuca

SEQ ID NO: 26170 - RNA, 22 nt, Homo sapiens
agccuauggaauucaguucuca

SEQ ID NO: 26171 - RNA, 22 nt, Homo sapiens
aucgggaggggacugagccuga

SEQ ID NO: 26172 - RNA, 22 nt, Homo sapiens
gagguuucccguguauguuuca

SEQ ID NO: 26173 - RNA, 21 nt, Homo sapiens
cccgaggagccgggcaggcuu

SEQ ID NO: 26174 - RNA, 21 nt, Homo sapiens
aguucucccaacguaaaccca

SEQ ID NO: 26175 - RNA, 20 nt, Homo sapiens
aggggccucagccuccuggu

SEQ ID NO: 26176 - RNA, 26 nt, Homo sapiens
uuucagaauuugcugccaucaucauc

SEQ ID NO: 26177 - RNA, 22 nt, Homo sapiens
caaacaccauugucacacucca

SEQ ID NO: 26178 - RNA, 22 nt, Homo sapiens
ugagugcuugcuaggugccaag

SEQ ID NO: 26179 - RNA, 22 nt, Homo sapiens
auagaugauaugcacaguacua

SEQ ID NO: 26180 - RNA, 22 nt, Homo sapiens
aggucucacuuuguugcccaga

SEQ ID NO: 26181 - RNA, 21 nt, Homo sapiens
agcuaugccagcaucuugccu

SEQ ID NO: 26182 - RNA, 22 nt, Homo sapiens
aagaagugcaccauguuuguuu

SEQ ID NO: 26183 - RNA, 25 nt, Homo sapiens
aaggagcucagaagcccugcccagc

SEQ ID NO: 26184 - RNA, 23 nt, Homo sapiens
uggcccugacacgugguacugga

SEQ ID NO: 26185 - RNA, 23 nt, Homo sapiens
agcaaaaaugugcuagugccaaa

SEQ ID NO: 26186 - RNA, 20 nt, Homo sapiens
aggggccucagccuccuggu

SEQ ID NO: 26187 - RNA, 18 nt, Homo sapiens
aucacauucaccucccug

SEQ ID NO: 26188 - RNA, 22 nt, Homo sapiens
uacagauggauaccgugcaauu

SEQ ID NO: 26189 - RNA, 25 nt, Homo sapiens
acggagcugucccaacaccaccccu

SEQ ID NO: 26190 - RNA, 22 nt, Homo sapiens
gguucaguuguucaaccaguua

SEQ ID NO: 26191 - RNA, 21 nt, Homo sapiens
ccgugguucuacccuguggua

SEQ ID NO: 26192 - RNA, 22 nt, Homo sapiens
agcccaaaaggagaauucuuug

SEQ ID NO: 26193 - RNA, 22 nt, Homo sapiens
cugcgauuccucccucuacugu

SEQ ID NO: 26194 - RNA, 22 nt, Homo sapiens
uccacauggaguugcuguuaca

SEQ ID NO: 26195 - RNA, 25 nt, Homo sapiens
aggccgccacccgcccgcgaucccu

SEQ ID NO: 26196 - RNA, 17 nt, Homo sapiens
gggagaggaggaggcga

SEQ ID NO: 26197 - RNA, 22 nt, Homo sapiens
cacugguacaaggguugggaga

SEQ ID NO: 26198 - RNA, 22 nt, Homo sapiens
cacucagcggccguuuccccaa

SEQ ID NO: 26199 - RNA, 21 nt, Homo sapiens
ccccucccagccucccugcca

SEQ ID NO: 26200 - RNA, 20 nt, Homo sapiens
aggggccucagccuccuggu

SEQ ID NO: 26201 - RNA, 22 nt, Homo sapiens
aggucucacuuuguugcccaga

SEQ ID NO: 26202 - RNA, 23 nt, Homo sapiens
gggagugaagacacggagccaga

SEQ ID NO: 26203 - RNA, 25 nt, Homo sapiens
aaggagcucagaagcccugcccagc

SEQ ID NO: 26204 - RNA, 23 nt, Homo sapiens
cacaaauucggaucuacagggua

SEQ ID NO: 26205 - RNA, 23 nt, Homo sapiens
cacaaauucgguucuacagggua

SEQ ID NO: 26206 - RNA, 22 nt, Homo sapiens
cuagggaacacagggcugguga

SEQ ID NO: 26207 - RNA, 21 nt, Homo sapiens
aaagagaccgguucacuguga

SEQ ID NO: 26208 - RNA, 23 nt, Homo sapiens
cggccugauucacaacaccagcu

SEQ ID NO: 26209 - RNA, 22 nt, Homo sapiens
uccagcaaagggaagcgcuuuc

SEQ ID NO: 26210 - RNA, 22 nt, Homo sapiens
accucuaaaggggagcgcuuug

SEQ ID NO: 26211 - RNA, 23 nt, Homo sapiens
acacucuaaagagaagcgcuuug

SEQ ID NO: 26212 - RNA, 21 nt, Homo sapiens
gcuccaaagggaagcgcuuug

SEQ ID NO: 26213 - RNA, 21 nt, Homo sapiens
ccucuaaagagaagcgcuuuc

SEQ ID NO: 26214 - RNA, 21 nt, Homo sapiens
ggggagcgggggcccugccuu

SEQ ID NO: 26215 - RNA, 23 nt, Homo sapiens
ucauacagcuagauaaccaaaga

SEQ ID NO: 26216 - RNA, 23 nt, Homo sapiens
cacugugggcccucuccgcacca

SEQ ID NO: 26217 - RNA, 22 nt, Homo sapiens
aaaguaacugcaguuuuugcua

SEQ ID NO: 26218 - RNA, 18 nt, Homo sapiens
aucacauucaccucccug

SEQ ID NO: 26219 - RNA, 22 nt, Homo sapiens
acuccaacagggccgcgucucc

SEQ ID NO: 26220 - RNA, 23 nt, Homo sapiens
gggagugaagacacggagccaga

SEQ ID NO: 26221 - RNA, 21 nt, Homo sapiens
gggcaucugggacgcgcagga

SEQ ID NO: 26222 - RNA, 22 nt, Homo sapiens
cacaaaccauuaugugcugcua

SEQ ID NO: 26223 - RNA, 22 nt, Homo sapiens
uguaaaccaugaugugcugcua

SEQ ID NO: 26224 - RNA, 22 nt, Homo sapiens
cgccaauauuuacgugcugcua

SEQ ID NO: 26225 - RNA, 22 nt, Homo sapiens
cagaagugggccgggcacaggg

SEQ ID NO: 26226 - RNA, 22 nt, Homo sapiens
ucaacaucagucugauaagcua

SEQ ID NO: 26227 - RNA, 21 nt, Homo sapiens
acaaaccacagugugcugcug

SEQ ID NO: 26228 - RNA, 22 nt, Homo sapiens
auccuucuacaaauucacccau

SEQ ID NO: 26229 - RNA, 18 nt, Homo sapiens
uggcgccugaacagggac

SEQ ID NO: 26230 - RNA, 17 nt, Homo sapiens
uggcgcccgaacaggga

SEQ ID NO: 26231 - RNA, 21 nt, Homo sapiens
gaccaaucgccguccccgccg

SEQ ID NO: 26232 - RNA, 22 nt, Homo sapiens
agcgggacuuugagggccaguu

SEQ ID NO: 26233 - RNA, 22 nt, Homo sapiens
agcugaguguaggauguuuaca

SEQ ID NO: 26234 - RNA, 22 nt, Homo sapiens
ucaccauugcuaaagugcaauu

SEQ ID NO: 26235 - RNA, 22 nt, Homo sapiens
gaauucaucacggccagccucu

SEQ ID NO: 26236 - RNA, 22 nt, Homo sapiens
gcugccguauaugugaugucac

SEQ ID NO: 26237 - RNA, 22 nt, Homo sapiens
agcacagacuugcugugauguu

SEQ ID NO: 26238 - RNA, 23 nt, Homo sapiens
ucucacccagguagcaaggauua

SEQ ID NO: 26239 - RNA, 22 nt, Homo sapiens
aguccagauucugugcccacca

SEQ ID NO: 26240 - RNA, 22 nt, Homo sapiens
gcggucccgcggcgccccgccu

SEQ ID NO: 26241 - RNA, 21 nt, Homo sapiens
caucaccuuccuucuccucca

SEQ ID NO: 26242 - RNA, 22 nt, Homo sapiens
cacucuaaagggaggcacuuug

SEQ ID NO: 26243 - RNA, 20 nt, Homo sapiens
gcagaagcauuuccacacac

SEQ ID NO: 26244 - RNA, 19 nt, Homo sapiens
agaaaccccagcagagaca

SEQ ID NO: 26245 - RNA, 17 nt, Homo sapiens
ggguggcagcgguggga

SEQ ID NO: 26246 - RNA, 22 nt, Homo sapiens
cagacuccgguggaaugaagga

SEQ ID NO: 26247 - RNA, 23 nt, Homo sapiens
cuccagccccuccagggcuuccu

SEQ ID NO: 26248 - RNA, 22 nt, Homo sapiens
agcccaaaaggagaauucuuug

SEQ ID NO: 26249 - RNA, 21 nt, Homo sapiens
cucccccacugcagcuggcac

SEQ ID NO: 26250 - RNA, 22 nt, Homo sapiens
cugggggcggcacaggggcuca

SEQ ID NO: 26251 - RNA, 22 nt, Homo sapiens
agagcaagaccccgucucuaaa

SEQ ID NO: 26252 - RNA, 23 nt, Homo sapiens
cagcugcuuuugggauuccguug

SEQ ID NO: 26253 - RNA, 22 nt, Homo sapiens
uacagauggauaccgugcaauu

SEQ ID NO: 26254 - RNA, 21 nt, Homo sapiens
acuccaaagggaagcgccuuc

SEQ ID NO: 26255 - RNA, 22 nt, Homo sapiens
cgcucuaaagggaagcgccuuc

SEQ ID NO: 26256 - RNA, 21 nt, Homo sapiens
gguggagcccugagaaccgga

SEQ ID NO: 26257 - RNA, 22 nt, Homo sapiens
gggagaggucucccugcgcaca

SEQ ID NO: 26258 - RNA, 23 nt, Homo sapiens
gcacaugugcacacagccgggug

SEQ ID NO: 26259 - RNA, 23 nt, Homo sapiens
ggaagccaucaagucgcugcagg

SEQ ID NO: 26260 - RNA, 20 nt, Homo sapiens
cucaaagcaaacccugcaga

SEQ ID NO: 26261 - RNA, 21 nt, Homo sapiens
aaagagaccgguucacuguga

SEQ ID NO: 26262 - RNA, 17 nt, Homo sapiens
gggagaggaggaggcga

SEQ ID NO: 26263 - RNA, 24 nt, Homo sapiens
gaagucacucccaggcagcugcaa

SEQ ID NO: 26264 - RNA, 20 nt, Homo sapiens
acagcaaggagggcaggagg

SEQ ID NO: 26265 - RNA, 22 nt, Homo sapiens
aagcgguuuaccaucccacaua

SEQ ID NO: 26266 - RNA, 22 nt, Homo sapiens
agcugaguguaggauguuuaca

SEQ ID NO: 26267 - RNA, 22 nt, Homo sapiens
ucaccauugcuaaagugcaauu

SEQ ID NO: 26268 - RNA, 21 nt, Homo sapiens
uugucuaaccagucaccuguu

SEQ ID NO: 26269 - RNA, 19 nt, Homo sapiens
ucccacaggaagcagacac

SEQ ID NO: 26270 - RNA, 22 nt, Homo sapiens
gacucuugaacaacacagguuu

SEQ ID NO: 26271 - RNA, 22 nt, Homo sapiens
auacauacuucuuuacauucca

SEQ ID NO: 26272 - RNA, 21 nt, Homo sapiens
cugggggacggagcagaagga

SEQ ID NO: 26273 - RNA, 18 nt, Homo sapiens
uggcgccugaacagggac

SEQ ID NO: 26274 - RNA, 17 nt, Homo sapiens
uggcgcccgaacaggga

SEQ ID NO: 26275 - RNA, 22 nt, Homo sapiens
agagcaagaccccgucucuaaa

SEQ ID NO: 26276 - RNA, 22 nt, Homo sapiens
ccacacacuuccuuacauucca

SEQ ID NO: 26277 - RNA, 22 nt, Homo sapiens
ggagagccuccacccaacccuc

SEQ ID NO: 26278 - RNA, 24 nt, Homo sapiens
ugggagaaccucccugcuucugcu

SEQ ID NO: 26279 - RNA, 22 nt, Homo sapiens
uacagauggauaccgugcaauu

SEQ ID NO: 26280 - RNA, 23 nt, Homo sapiens
ccacccaaugaccuacuccaaga

SEQ ID NO: 26281 - RNA, 22 nt, Homo sapiens
gccagcuaacaauacacugccu

SEQ ID NO: 26282 - RNA, 20 nt, Homo sapiens
ggcaaagaaggaacauuccu

SEQ ID NO: 26283 - RNA, 23 nt, Homo sapiens
cacaaauucggaucuacagggua

SEQ ID NO: 26284 - RNA, 23 nt, Homo sapiens
cacaaauucgguucuacagggua

SEQ ID NO: 26285 - RNA, 23 nt, Homo sapiens
ggaagccaucaagucgcugcagg

SEQ ID NO: 26286 - RNA, 21 nt, Homo sapiens
uggggauuacacuucaacagg

SEQ ID NO: 26287 - RNA, 25 nt, Homo sapiens
cagcgucugccggaacccguuccca

SEQ ID NO: 26288 - RNA, 22 nt, Homo sapiens
acaaaguucugugaugcacuga

SEQ ID NO: 26289 - RNA, 23 nt, Homo sapiens
cuaccugcacuguaagcacuuug

SEQ ID NO: 26290 - RNA, 22 nt, Homo sapiens
cagaagugggccgggcacaggg

SEQ ID NO: 26291 - RNA, 22 nt, Homo sapiens
ucacaguugccagcugagauua

SEQ ID NO: 26292 - RNA, 22 nt, Homo sapiens
agucuucacaacagcccugugu

SEQ ID NO: 26293 - RNA, 23 nt, Homo sapiens
gcgcccaauuaaugucuguugau

SEQ ID NO: 26294 - RNA, 22 nt, Homo sapiens
auauuaggaacacaucgcaaaa

SEQ ID NO: 26295 - RNA, 22 nt, Homo sapiens
caugauugccacgucugcagua

SEQ ID NO: 26296 - RNA, 21 nt, Homo sapiens
ugauugccacugucugcagua

SEQ ID NO: 26297 - RNA, 21 nt, Homo sapiens
ugacugcagagcaaaagacac

SEQ ID NO: 26298 - RNA, 19 nt, Homo sapiens
ucccacaggaagcagacac

SEQ ID NO: 26299 - RNA, 23 nt, Homo sapiens
acagcgcucgcaaccgcagcgau

SEQ ID NO: 26300 - RNA, 22 nt, Homo sapiens
ugaauuacuuuguaaaccacca

SEQ ID NO: 26301 - RNA, 26 nt, Homo sapiens
aaccaucucauacaaaccaacuacuu

SEQ ID NO: 26302 - RNA, 21 nt, Homo sapiens
uuccacgaccuaauccuaacu

SEQ ID NO: 26303 - RNA, 19 nt, Homo sapiens
aagccaaagccuuauccau

SEQ ID NO: 26304 - RNA, 19 nt, Homo sapiens
ucccugauccaaaaaucca

SEQ ID NO: 26305 - RNA, 23 nt, Homo sapiens
ucaguuuugcauagauuugcaca

SEQ ID NO: 26306 - RNA, 23 nt, Homo sapiens
ucaguuuugcauggauuugcaca

SEQ ID NO: 26307 - RNA, 22 nt, Homo sapiens
aagaagugcaccauguuuguuu

SEQ ID NO: 26308 - RNA, 21 nt, Homo sapiens
uucacuccaaaaggugcaaaa

SEQ ID NO: 26309 - RNA, 23 nt, Homo sapiens
ucucgugacaugaugauccccga

SEQ ID NO: 26310 - RNA, 22 nt, Homo sapiens
gcaaaaguaauugagauuuuug

SEQ ID NO: 26311 - RNA, 23 nt, Homo sapiens
agacaaggcccacccgugcaaac

SEQ ID NO: 26312 - RNA, 23 nt, Homo sapiens
aggagaaggcaccaugggauuua

SEQ ID NO: 26313 - RNA, 22 nt, Homo sapiens
ggcagagagucagagcgcggau

SEQ ID NO: 26314 - RNA, 22 nt, Homo sapiens
gaggcucagaauggcucaggag

SEQ ID NO: 26315 - RNA, 22 nt, Homo sapiens
cgaccauggcuguagacuguua

SEQ ID NO: 26316 - RNA, 21 nt, Homo sapiens
auguaggccuuuagaucacuu

SEQ ID NO: 26317 - RNA, 21 nt, Homo sapiens
ggccgugacuggagacuguua

SEQ ID NO: 26318 - RNA, 20 nt, Homo sapiens
cuggaggaagggcccagagg

SEQ ID NO: 26319 - RNA, 22 nt, Homo sapiens
gccuaagacacaggcccagaga

SEQ ID NO: 26320 - RNA, 21 nt, Homo sapiens
ugcaaugcaacuacaaugcac

SEQ ID NO: 26321 - RNA, 22 nt, Homo sapiens
ucaguuuccucugcaaacaguu

SEQ ID NO: 26322 - RNA, 22 nt, Homo sapiens
auaaacgacaccuccuugagaa

SEQ ID NO: 26323 - RNA, 23 nt, Homo sapiens
acagaaagugcuucccucaagag

SEQ ID NO: 26324 - RNA, 22 nt, Homo sapiens
acacaccaaggauaauuucucc

SEQ ID NO: 26325 - RNA, 23 nt, Homo sapiens
cacaaauucggaucuacagggua

SEQ ID NO: 26326 - RNA, 23 nt, Homo sapiens
cacaaauucgguucuacagggua

SEQ ID NO: 26327 - RNA, 18 nt, Homo sapiens
gaaaugagggccagcuga

SEQ ID NO: 26328 - RNA, 19 nt, Homo sapiens
ccaccucccgaguccucac

SEQ ID NO: 26329 - RNA, 23 nt, Homo sapiens
aaucuacuuucuuugcucauccu

SEQ ID NO: 26330 - RNA, 22 nt, Homo sapiens
aaccacuuucuuugcucauccg

SEQ ID NO: 26331 - RNA, 21 nt, Homo sapiens
ccgugguucuacccuguggua

SEQ ID NO: 26332 - RNA, 23 nt, Homo sapiens
gggagugaagacacggagccaga

SEQ ID NO: 26333 - RNA, 22 nt, Homo sapiens
cagaaagugcuucccucuagag

SEQ ID NO: 26334 - RNA, 21 nt, Homo sapiens
ugcaaacccugcaugugggag

SEQ ID NO: 26335 - RNA, 21 nt, Homo sapiens
gaccaaucgccguccccgccg

SEQ ID NO: 26336 - RNA, 22 nt, Homo sapiens
uggcagcagcggagggggcaga

SEQ ID NO: 26337 - RNA, 22 nt, Homo sapiens
uccacauggaguugcuguuaca

SEQ ID NO: 26338 - RNA, 21 nt, Homo sapiens
gugacagagccaagcacaaau

SEQ ID NO: 26339 - RNA, 22 nt, Homo sapiens
agcugaguguaggauguuuaca

SEQ ID NO: 26340 - RNA, 20 nt, Homo sapiens
ccagcagcaccuggggcagu

SEQ ID NO: 26341 - RNA, 23 nt, Homo sapiens
cgugagcuccuggaggacaggga

SEQ ID NO: 26342 - RNA, 23 nt, Homo sapiens
aaaucagaaucacaccuggggga

SEQ ID NO: 26343 - RNA, 21 nt, Homo sapiens
auccuguacugagcugccccg

SEQ ID NO: 26344 - RNA, 22 nt, Homo sapiens
ccucauggaaggguuccccacu

SEQ ID NO: 26345 - RNA, 23 nt, Homo sapiens
aagaaucuugucccgcagguccu

SEQ ID NO: 26346 - RNA, 18 nt, Homo sapiens
augacaccucccugugaa

SEQ ID NO: 26347 - RNA, 22 nt, Homo sapiens
ugcaagccuugggugugggagg

SEQ ID NO: 26348 - RNA, 23 nt, Homo sapiens
ugcgggcgggacgagcaagcaca

SEQ ID NO: 26349 - RNA, 24 nt, Homo sapiens
acgcagagcccgaaagcccccagu

SEQ ID NO: 26350 - RNA, 22 nt, Homo sapiens
gcggucccgcggcgccccgccu

SEQ ID NO: 26351 - RNA, 22 nt, Homo sapiens
ugcuguuagcccuagccccgca

SEQ ID NO: 26352 - RNA, 21 nt, Homo sapiens
ugacugacagcuuuuugagua

SEQ ID NO: 26353 - RNA, 24 nt, Homo sapiens
cacccccagagccucagcucccca

SEQ ID NO: 26354 - RNA, 21 nt, Homo sapiens
ucuccagaucagggcagucca

SEQ ID NO: 26355 - RNA, 22 nt, Homo sapiens
uggcagcagcggagggggcaga

SEQ ID NO: 26356 - RNA, 22 nt, Homo sapiens
ucagccgcugucacacgcacag

SEQ ID NO: 26357 - RNA, 21 nt, Homo sapiens
aacggaaccacuagugacuug

SEQ ID NO: 26358 - RNA, 21 nt, Homo sapiens
caugcacaugcacacauacau

SEQ ID NO: 26359 - RNA, 20 nt, Homo sapiens
ccagcagcaccuggggcagu

SEQ ID NO: 26360 - RNA, 22 nt, Homo sapiens
auggcaguggaguuagugauug

SEQ ID NO: 26361 - RNA, 23 nt, Homo sapiens
aaagucucgcucucugccccuca

SEQ ID NO: 26362 - RNA, 21 nt, Homo sapiens
auccuguacugagcugccccg

SEQ ID NO: 26363 - RNA, 18 nt, Homo sapiens
aucacauucaccucccug

SEQ ID NO: 26364 - RNA, 22 nt, Homo sapiens
acuccaacagggccgcgucucc

SEQ ID NO: 26365 - RNA, 23 nt, Homo sapiens
gggagugaagacacggagccaga

SEQ ID NO: 26366 - RNA, 22 nt, Homo sapiens
ucaggaacugccuuucucucca

SEQ ID NO: 26367 - RNA, 22 nt, Homo sapiens
cagaagugggccgggcacaggg

SEQ ID NO: 26368 - RNA, 22 nt, Homo sapiens
aggcauaggaugacaaagggaa

SEQ ID NO: 26369 - RNA, 22 nt, Homo sapiens
aggcgaaggaugacaaagggaa

SEQ ID NO: 26370 - RNA, 22 nt, Homo sapiens
cagcauggaguccuccagguug

SEQ ID NO: 26371 - RNA, 24 nt, Homo sapiens
acugggcacaaacauguccagguc

SEQ ID NO: 26372 - RNA, 22 nt, Homo sapiens
agcucagaacccagaggucuca

SEQ ID NO: 26373 - RNA, 22 nt, Homo sapiens
ucggucccucgggccagggcag

SEQ ID NO: 26374 - RNA, 23 nt, Homo sapiens
aacaggugcucaaauaagacuug

SEQ ID NO: 26375 - RNA, 21 nt, Homo sapiens
gcaagcccagaccgcaaaaag

SEQ ID NO: 26376 - RNA, 22 nt, Homo sapiens
ucaguuuccucugcaaacaguu

SEQ ID NO: 26377 - RNA, 24 nt, Homo sapiens
agugugaguucuaccauugccaaa

SEQ ID NO: 26378 - RNA, 21 nt, Homo sapiens
gccaauauuucugugcugcua

SEQ ID NO: 26379 - RNA, 22 nt, Homo sapiens
ugggguauuugacaaacugaca

SEQ ID NO: 26380 - RNA, 23 nt, Homo sapiens
ucucugcaggccgugugcuuugc

SEQ ID NO: 26381 - RNA, 22 nt, Homo sapiens
cacucagcaccaggauauuguu

SEQ ID NO: 26382 - RNA, 22 nt, Homo sapiens
gccagcuaacaauacacugccu

SEQ ID NO: 26383 - RNA, 21 nt, Homo sapiens
cugaaaccaaguaugggucgc

SEQ ID NO: 26384 - RNA, 19 nt, Homo sapiens
ucagcaguaccagccuaga

SEQ ID NO: 26385 - RNA, 26 nt, Homo sapiens
uuucagaauuugcugccaucaucauc

SEQ ID NO: 26386 - RNA, 21 nt, Homo sapiens
aaagagaccgguucacuguga

SEQ ID NO: 26387 - RNA, 21 nt, Homo sapiens
gcaagcccagaccgcaaaaag

SEQ ID NO: 26388 - RNA, 21 nt, Homo sapiens
ccgugguucuacccuguggua

SEQ ID NO: 26389 - RNA, 22 nt, Homo sapiens
ccaucuuuaccagacaguguua

SEQ ID NO: 26390 - RNA, 21 nt, Homo sapiens
aggcggcaggcacaggacugg

SEQ ID NO: 26391 - RNA, 23 nt, Homo sapiens
cccaacagacauggcgguacuca

SEQ ID NO: 26392 - RNA, 22 nt, Homo sapiens
acaucguuaccagacaguguua

SEQ ID NO: 26393 - RNA, 21 nt, Homo sapiens
accuauccugaauuacuugaa

SEQ ID NO: 26394 - RNA, 21 nt, Homo sapiens
gcggaacuuagccacugugaa

SEQ ID NO: 26395 - RNA, 21 nt, Homo sapiens
gcagaacuuagccacugugaa

SEQ ID NO: 26396 - RNA, 23 nt, Homo sapiens
ucucugcaggccgugugcuuugc

SEQ ID NO: 26397 - RNA, 21 nt, Homo sapiens
acaaaccacagugugcugcug

SEQ ID NO: 26398 - RNA, 20 nt, Homo sapiens
gaaagggcuucccuuugcag

SEQ ID NO: 26399 - RNA, 20 nt, Homo sapiens
gaaagggcuucccuuugcag

SEQ ID NO: 26400 - RNA, 22 nt, Homo sapiens
gcaaaagaaacugugguuuuug

SEQ ID NO: 26401 - RNA, 22 nt, Homo sapiens
aaaguaacugcaguuuuugcua

SEQ ID NO: 26402 - RNA, 19 nt, Homo sapiens
auuuugguacagcagcuca

SEQ ID NO: 26403 - RNA, 20 nt, Homo sapiens
ugggccaccgccgagcggac

SEQ ID NO: 26404 - RNA, 21 nt, Homo sapiens
acaauccuagagcacaagaag

SEQ ID NO: 26405 - RNA, 22 nt, Homo sapiens
cucagagcagacgugguucuca

SEQ ID NO: 26406 - RNA, 21 nt, Homo sapiens
agguaauaccaauaccuugug

SEQ ID NO: 26407 - RNA, 19 nt, Homo sapiens
gccucagaggcagcugcuu

SEQ ID NO: 26408 - RNA, 22 nt, Homo sapiens
cgggacguccagacucaacucu

SEQ ID NO: 26409 - RNA, 22 nt, Homo sapiens
cagaaagugcuucccucuagag

SEQ ID NO: 26410 - RNA, 22 nt, Homo sapiens
gagcccuggacuaggagucagc

SEQ ID NO: 26411 - RNA, 22 nt, Homo sapiens
ugugggugugugcaugagcgug

SEQ ID NO: 26412 - RNA, 23 nt, Homo sapiens
ggaagccaucaagucgcugcagg

SEQ ID NO: 26413 - RNA, 20 nt, Homo sapiens
cucaaagcaaacccugcaga

SEQ ID NO: 26414 - RNA, 21 nt, Homo sapiens
ggucagaacccaucauucacu

SEQ ID NO: 26415 - RNA, 22 nt, Homo sapiens
ggcucccaagaaccucaccugu

SEQ ID NO: 26416 - RNA, 23 nt, Homo sapiens
aggaacagcagcagcccgggccg

SEQ ID NO: 26417 - RNA, 21 nt, Homo sapiens
aggcggcaggcacaggacugg

SEQ ID NO: 26418 - RNA, 21 nt, Homo sapiens
acccaguagccagauguagcu

SEQ ID NO: 26419 - RNA, 22 nt, Homo sapiens
uacagauggauaccgugcaauu

SEQ ID NO: 26420 - RNA, 23 nt, Homo sapiens
acggcuaguggaccaggugaagu

SEQ ID NO: 26421 - RNA, 20 nt, Homo sapiens
gaaagggcuucccuuugcag

SEQ ID NO: 26422 - RNA, 20 nt, Homo sapiens
gaaagggcuucccuuugcag

SEQ ID NO: 26423 - RNA, 22 nt, Homo sapiens
guccaaaguuggggugcugguu

SEQ ID NO: 26424 - RNA, 22 nt, Homo sapiens
ccucaggcacggccgggccacc

SEQ ID NO: 26425 - RNA, 22 nt, Homo sapiens
cuuccagucgaggauguuuaca

SEQ ID NO: 26426 - RNA, 22 nt, Homo sapiens
cuuccagucggggauguuuaca

SEQ ID NO: 26427 - RNA, 22 nt, Homo sapiens
cuuccagucaaggauguuuaca

SEQ ID NO: 26428 - RNA, 20 nt, Homo sapiens
cugcgggaggacagggcuca

SEQ ID NO: 26429 - RNA, 25 nt, Homo sapiens
cagcgucugccggaacccguuccca

SEQ ID NO: 26430 - RNA, 22 nt, Homo sapiens
cacugguacaaggguugggaga

SEQ ID NO: 26431 - RNA, 22 nt, Homo sapiens
ucagaccgagacaagugcaaug

SEQ ID NO: 26432 - RNA, 21 nt, Homo sapiens
acaggauugagggggggcccu

SEQ ID NO: 26433 - RNA, 22 nt, Homo sapiens
agcugaguguaggauguuuaca

SEQ ID NO: 26434 - RNA, 23 nt, Homo sapiens
cggcucugucgucgaggcgcuca

SEQ ID NO: 26435 - RNA, 23 nt, Homo sapiens
cugcagaacuguucccgcugcua

SEQ ID NO: 26436 - RNA, 22 nt, Homo sapiens
aggaaaccagcaaguguugacg

SEQ ID NO: 26437 - RNA, 21 nt, Homo sapiens
guucuaacccauuguggccaa

SEQ ID NO: 26438 - RNA, 23 nt, Homo sapiens
acagcgcucgcaaccgcagcgau

SEQ ID NO: 26439 - RNA, 19 nt, Homo sapiens
gcucuaagaaagccacacu

SEQ ID NO: 26440 - RNA, 22 nt, Homo sapiens
ugcuguuagcccuagccccgca

SEQ ID NO: 26441 - RNA, 21 nt, Homo sapiens
caucaccuuccuucuccucca

SEQ ID NO: 26442 - RNA, 22 nt, Homo sapiens
cugggggcggcacaggggcuca

SEQ ID NO: 26443 - RNA, 22 nt, Homo sapiens
agacaacaaugccaaccucaca

SEQ ID NO: 26444 - RNA, 19 nt, Homo sapiens
cagcaucagcagcaucauc

SEQ ID NO: 26445 - RNA, 22 nt, Homo sapiens
cggugagcacccggccccugcg

SEQ ID NO: 26446 - RNA, 22 nt, Homo sapiens
ugagccacugugccuggccuga

SEQ ID NO: 26447 - RNA, 22 nt, Homo sapiens
ugagccacugugccuggccuga

SEQ ID NO: 26448 - RNA, 22 nt, Homo sapiens
acugccugucugugccugcugu

SEQ ID NO: 26449 - RNA, 22 nt, Homo sapiens
acaaccagcuaagacacugcca

SEQ ID NO: 26450 - RNA, 23 nt, Homo sapiens
aaaucagaaucacaccuggggga

SEQ ID NO: 26451 - RNA, 22 nt, Homo sapiens
accagguuccaccccagcaggc

SEQ ID NO: 26452 - RNA, 25 nt, Homo sapiens
acggagcugucccaacaccaccccu

SEQ ID NO: 26453 - RNA, 24 nt, Homo sapiens
acgcagagcccgaaagcccccagu

SEQ ID NO: 26454 - RNA, 19 nt, Homo sapiens
ucagcaguaccagccuaga

SEQ ID NO: 26455 - RNA, 21 nt, Homo sapiens
gaaggaagugagugcagccac

SEQ ID NO: 26456 - RNA, 20 nt, Homo sapiens
uacugcuuccacagcucccc

SEQ ID NO: 26457 - RNA, 22 nt, Homo sapiens
gggagaggucucccugcgcaca

SEQ ID NO: 26458 - RNA, 20 nt, Homo sapiens
cuggaggaagggcccagagg

SEQ ID NO: 26459 - RNA, 22 nt, Homo sapiens
gccuaagacacaggcccagaga

SEQ ID NO: 26460 - RNA, 22 nt, Homo sapiens
gcugccguauaugugaugucac

SEQ ID NO: 26461 - RNA, 22 nt, Homo sapiens
auggcaguggaguuagugauug

SEQ ID NO: 26462 - RNA, 22 nt, Homo sapiens
ucaggaacugccuuucucucca

SEQ ID NO: 26463 - RNA, 22 nt, Homo sapiens
gggagaggucucccugcgcaca

SEQ ID NO: 26464 - RNA, 22 nt, Homo sapiens
ucaggaacugccuuucucucca

SEQ ID NO: 26465 - RNA, 23 nt, Homo sapiens
aagaaucuugucccgcagguccu

SEQ ID NO: 26466 - RNA, 22 nt, Homo sapiens
cagaagugggccgggcacaggg

SEQ ID NO: 26467 - RNA, 23 nt, Homo sapiens
ugcgggcgggacgagcaagcaca

SEQ ID NO: 26468 - RNA, 21 nt, Homo sapiens
acuagacugugagcuccucga

SEQ ID NO: 26469 - RNA, 23 nt, Homo sapiens
acacagcucuuccauaucuccag

SEQ ID NO: 26470 - RNA, 20 nt, Homo sapiens
auuucuauaucuaucuccau

SEQ ID NO: 26471 - RNA, 22 nt, Homo sapiens
cugggggcggcacaggggcuca

SEQ ID NO: 26472 - RNA, 20 nt, Homo sapiens
uccccacagacccagagccg

SEQ ID NO: 26473 - RNA, 20 nt, Homo sapiens
ggcauucaccgcgugccuua

SEQ ID NO: 26474 - RNA, 21 nt, Homo sapiens
ucuacucagaagggugccuua

SEQ ID NO: 26475 - RNA, 17 nt, Homo sapiens
gacagccucucccccac

SEQ ID NO: 26476 - RNA, 21 nt, Homo sapiens
cggggugcacgggcggagggc

SEQ ID NO: 26477 - RNA, 23 nt, Homo sapiens
gggagugaagacacggagccaga

SEQ ID NO: 26478 - RNA, 23 nt, Homo sapiens
gggagugaagacacggagccaga

SEQ ID NO: 26479 - RNA, 21 nt, Homo sapiens
gaccaaucgccguccccgccg

SEQ ID NO: 26480 - RNA, 21 nt, Homo sapiens
gaccaaucgccguccccgccg

SEQ ID NO: 26481 - RNA, 21 nt, Homo sapiens
uucuaggauaggcccaggggc

SEQ ID NO: 26482 - RNA, 23 nt, Homo sapiens
aaagucucgcucucugccccuca

SEQ ID NO: 26483 - RNA, 19 nt, Homo sapiens
uagcauacagauacgccca

SEQ ID NO: 26484 - RNA, 25 nt, Homo sapiens
acggagcugucccaacaccaccccu

SEQ ID NO: 26485 - RNA, 22 nt, Homo sapiens
gcggucccgcggcgccccgccu

SEQ ID NO: 26486 - RNA, 22 nt, Homo sapiens
gcggucccgcggcgccccgccu

SEQ ID NO: 26487 - RNA, 22 nt, Homo sapiens
ugcuguuagcccuagccccgca

SEQ ID NO: 26488 - RNA, 20 nt, Homo sapiens
uacugcuuccacagcucccc

SEQ ID NO: 26489 - RNA, 24 nt, Homo sapiens
acugggcacaaacauguccagguc

SEQ ID NO: 26490 - RNA, 22 nt, Homo sapiens
ucgcccucucaacccagcuuuu

SEQ ID NO: 26491 - RNA, 22 nt, Homo sapiens
uugcccucucaacccagcuuuu

SEQ ID NO: 26492 - RNA, 20 nt, Homo sapiens
acccucucaacccagcuuuu

SEQ ID NO: 26493 - RNA, 19 nt, Homo sapiens
uccucucaacccagcuuuu

SEQ ID NO: 26494 - RNA, 22 nt, Homo sapiens
ugcaagccuugggugugggagg

SEQ ID NO: 26495 - RNA, 22 nt, Homo sapiens
acaaaguucuguagugcacuga

SEQ ID NO: 26496 - RNA, 22 nt, Homo sapiens
acaaaguucugugaugcacuga

SEQ ID NO: 26497 - RNA, 21 nt, Homo sapiens
ccaaguucugucaugcacuga

SEQ ID NO: 26498 - RNA, 22 nt, Homo sapiens
caacuccgauaugcaaugggua

SEQ ID NO: 26499 - RNA, 20 nt, Homo sapiens
uaugaacaauuucuaggaau

SEQ ID NO: 26500 - RNA, 22 nt, Homo sapiens
acuccaacagggccgcgucucc

SEQ ID NO: 26501 - RNA, 18 nt, Homo sapiens
acccucugaaaggaagca

SEQ ID NO: 26502 - RNA, 22 nt, Homo sapiens
aaagugcuucuuaccuccagau

SEQ ID NO: 26503 - RNA, 23 nt, Homo sapiens
cuccagccccuccagggcuuccu

SEQ ID NO: 26504 - RNA, 22 nt, Homo sapiens
cagaagugggccgggcacaggg

SEQ ID NO: 26505 - RNA, 17 nt, Homo sapiens
uggcgcccgaacaggga

SEQ ID NO: 26506 - RNA, 23 nt, Homo sapiens
ucaacgggagugaucgugucauu

SEQ ID NO: 26507 - RNA, 20 nt, Homo sapiens
cccgccgcgucgcccugggg

SEQ ID NO: 26508 - RNA, 21 nt, Homo sapiens
aucugcacugucagcacuuua

SEQ ID NO: 26509 - RNA, 23 nt, Homo sapiens
aggaacagcagcagcccgggccg

SEQ ID NO: 26510 - RNA, 21 nt, Homo sapiens
acaggauugagggggggcccu

SEQ ID NO: 26511 - RNA, 21 nt, Homo sapiens
gaccaaucgccguccccgccg

SEQ ID NO: 26512 - RNA, 22 nt, Homo sapiens
gcggucccgcggcgccccgccu

SEQ ID NO: 26513 - RNA, 21 nt, Homo sapiens
aucugcacugucagcacuuua

SEQ ID NO: 26514 - RNA, 21 nt, Homo sapiens
gagcugcauccuggcuccggg

SEQ ID NO: 26515 - RNA, 22 nt, Homo sapiens
aggucucacuuuguugcccaga

SEQ ID NO: 26516 - RNA, 23 nt, Homo sapiens
aggaacagcagcagcccgggccg

SEQ ID NO: 26517 - RNA, 22 nt, Homo sapiens
cacaaaccauuaugugcugcua

SEQ ID NO: 26518 - RNA, 22 nt, Homo sapiens
uguaaaccaugaugugcugcua

SEQ ID NO: 26519 - RNA, 22 nt, Homo sapiens
cgccaauauuuacgugcugcua

SEQ ID NO: 26520 - RNA, 20 nt, Homo sapiens
cccgccgcgucgcccugggg

SEQ ID NO: 26521 - RNA, 21 nt, Homo sapiens
gccaauauuucugugcugcua

SEQ ID NO: 26522 - RNA, 22 nt, Homo sapiens
acaguucuucaacuggcagcuu

SEQ ID NO: 26523 - RNA, 21 nt, Homo sapiens
acaggauugagggggggcccu

SEQ ID NO: 26524 - RNA, 21 nt, Homo sapiens
uucuaggauaggcccaggggc

SEQ ID NO: 26525 - RNA, 22 nt, Homo sapiens
acaaccagcuaagacacugcca

SEQ ID NO: 26526 - RNA, 23 nt, Homo sapiens
gcaaucagcuaacuacacugccu

SEQ ID NO: 26527 - RNA, 22 nt, Homo sapiens
uucaaaacaugaauugcugcug

SEQ ID NO: 26528 - RNA, 21 nt, Homo sapiens
ugcaugacggccugcaagaca

SEQ ID NO: 26529 - RNA, 22 nt, Homo sapiens
accagcuaacaauacacugcca

SEQ ID NO: 26530 - RNA, 22 nt, Homo sapiens
gccagcuaacaauacacugccu

SEQ ID NO: 26531 - RNA, 21 nt, Homo sapiens
acaaaccacagugugcugcug

SEQ ID NO: 26532 - RNA, 25 nt, Homo sapiens
aaggagcucagaagcccugcccagc

SEQ ID NO: 26533 - RNA, 19 nt, Homo sapiens
gccucagaggcagcugcuu

SEQ ID NO: 26534 - RNA, 22 nt, Homo sapiens
ugcuguuagcccuagccccgca

SEQ ID NO: 26535 - RNA, 22 nt, Homo sapiens
gggagaggucucccugcgcaca

SEQ ID NO: 26536 - RNA, 21 nt, Homo sapiens
ccucaaggagcuucagucuag

SEQ ID NO: 26537 - RNA, 22 nt, Homo sapiens
uggcagcagcggagggggcaga

SEQ ID NO: 26538 - RNA, 21 nt, Homo sapiens
acaggauugagggggggcccu

SEQ ID NO: 26539 - RNA, 20 nt, Homo sapiens
ccagcagcaccuggggcagu

SEQ ID NO: 26540 - RNA, 23 nt, Homo sapiens
aaaucagaaucacaccuggggga

SEQ ID NO: 26541 - RNA, 21 nt, Homo sapiens
auccuguacugagcugccccg

SEQ ID NO: 26542 - RNA, 23 nt, Homo sapiens
caugagugacgcccucuggagua

SEQ ID NO: 26543 - RNA, 23 nt, Homo sapiens
gggcucuuacucccucaggcacu

SEQ ID NO: 26544 - RNA, 22 nt, Homo sapiens
gauccgagcaccggggaccccc

SEQ ID NO: 26545 - RNA, 24 nt, Homo sapiens
acgcagagcccgaaagcccccagu

SEQ ID NO: 26546 - RNA, 24 nt, Homo sapiens
acgcgcaggccagagacccaggca

SEQ ID NO: 26547 - RNA, 22 nt, Homo sapiens
ugcuguuagcccuagccccgca

SEQ ID NO: 26548 - RNA, 21 nt, Homo sapiens
ccccucccagccucccugcca

SEQ ID NO: 26549 - RNA, 18 nt, Homo sapiens
aucacauucaccucccug

SEQ ID NO: 26550 - RNA, 21 nt, Homo sapiens
gcggaacuuagccacugugaa

SEQ ID NO: 26551 - RNA, 21 nt, Homo sapiens
gcagaacuuagccacugugaa

SEQ ID NO: 26552 - RNA, 22 nt, Homo sapiens
caagacacauuuggagagggac

SEQ ID NO: 26553 - RNA, 24 nt, Homo sapiens
cagaaagugcuuucuuuuggagaa

SEQ ID NO: 26554 - RNA, 22 nt, Homo sapiens
aacacucuaaaaggaggcacuu

SEQ ID NO: 26555 - RNA, 22 nt, Homo sapiens
uggcagcagcggagggggcaga

SEQ ID NO: 26556 - RNA, 20 nt, Homo sapiens
ccagcagcaccuggggcagu

SEQ ID NO: 26557 - RNA, 21 nt, Homo sapiens
auccuguacugagcugccccg

SEQ ID NO: 26558 - RNA, 21 nt, Homo sapiens
cggcucggguggcggcgacgg

SEQ ID NO: 26559 - RNA, 22 nt, Homo sapiens
ucaucucgcccgcaaagaccca

SEQ ID NO: 26560 - RNA, 22 nt, Homo sapiens
acacacccacgcgagccggaaa

SEQ ID NO: 26561 - RNA, 18 nt, Homo sapiens
cccccaccaccacgcccg

SEQ ID NO: 26562 - RNA, 18 nt, Homo sapiens
ggagaggagggcacugga

SEQ ID NO: 26563 - RNA, 22 nt, Homo sapiens
agcgggacuuugagggccaguu

SEQ ID NO: 26564 - RNA, 22 nt, Homo sapiens
ucagccgcugucacacgcacag

SEQ ID NO: 26565 - RNA, 21 nt, Homo sapiens
agaauugcguuuggacaauca

SEQ ID NO: 26566 - RNA, 25 nt, Homo sapiens
acggagcugucccaacaccaccccu

SEQ ID NO: 26567 - RNA, 20 nt, Homo sapiens
uacugcuuccacagcucccc

SEQ ID NO: 26568 - RNA, 23 nt, Homo sapiens
aaucgcgguuuauaccaaaugaa

SEQ ID NO: 26569 - RNA, 19 nt, Homo sapiens
gcuccuguccaacuggcuc

SEQ ID NO: 26570 - RNA, 22 nt, Homo sapiens
ucuacccagaaaggagccagug

SEQ ID NO: 26571 - RNA, 21 nt, Homo sapiens
gggcaucugggacgcgcagga

SEQ ID NO: 26572 - RNA, 21 nt, Homo sapiens
gaccaaucgccguccccgccg

SEQ ID NO: 26573 - RNA, 21 nt, Homo sapiens
cccgaggagccgggcaggcuu

SEQ ID NO: 26574 - RNA, 22 nt, Homo sapiens
gcggucccgcggcgccccgccu

SEQ ID NO: 26575 - RNA, 22 nt, Homo sapiens
aguccagauucugugcccacca

SEQ ID NO: 26576 - RNA, 22 nt, Homo sapiens
gcacauguucugcggcccacca

SEQ ID NO: 26577 - RNA, 22 nt, Homo sapiens
uaaccgauuucagauggugcua

SEQ ID NO: 26578 - RNA, 22 nt, Homo sapiens
cugggggcggcacaggggcuca

SEQ ID NO: 26579 - RNA, 21 nt, Homo sapiens
cuggaggacggcaacagucag

SEQ ID NO: 26580 - RNA, 22 nt, Homo sapiens
gcugaggcuguggggcuggagu

SEQ ID NO: 26581 - RNA, 19 nt, Homo sapiens
guccugaauuccgcagccu

SEQ ID NO: 26582 - RNA, 24 nt, Homo sapiens
cacccccagagccucagcucccca

SEQ ID NO: 26583 - RNA, 21 nt, Homo sapiens
cugaggagagaggaggugggg

SEQ ID NO: 26584 - RNA, 23 nt, Homo sapiens
cuaccugcacuaugagcacuuug

SEQ ID NO: 26585 - RNA, 22 nt, Homo sapiens
cucaauagacugugagcuccuu

SEQ ID NO: 26586 - RNA, 22 nt, Homo sapiens
aagagggagacccaggcucgga

SEQ ID NO: 26587 - RNA, 23 nt, Homo sapiens
cccagcuagauuguaagcuccuu

SEQ ID NO: 26588 - RNA, 22 nt, Homo sapiens
aacccauggaauucaguucuca

SEQ ID NO: 26589 - RNA, 21 nt, Homo sapiens
aggcggcaggcacaggacugg

SEQ ID NO: 26590 - RNA, 22 nt, Homo sapiens
agugaauucuaccagugccaua

SEQ ID NO: 26591 - RNA, 22 nt, Homo sapiens
ggaggccgggacgagugcaaua

SEQ ID NO: 26592 - RNA, 23 nt, Homo sapiens
cuaucugcacuagaugcaccuua

SEQ ID NO: 26593 - RNA, 21 nt, Homo sapiens
uagaaaggcuaggaccaaacc

SEQ ID NO: 26594 - RNA, 21 nt, Homo sapiens
gcggaacuuagccacugugaa

SEQ ID NO: 26595 - RNA, 21 nt, Homo sapiens
gcagaacuuagccacugugaa

SEQ ID NO: 26596 - RNA, 23 nt, Homo sapiens
acaccccaaaaucgaagcacuuc

SEQ ID NO: 26597 - RNA, 22 nt, Homo sapiens
gccagcuaacaauacacugccu

SEQ ID NO: 26598 - RNA, 22 nt, Homo sapiens
aggaaaccagcaaguguugacg

SEQ ID NO: 26599 - RNA, 18 nt, Homo sapiens
acccucugaaaggaagca

SEQ ID NO: 26600 - RNA, 22 nt, Homo sapiens
aaagugcuucuuaccuccagau

SEQ ID NO: 26601 - RNA, 22 nt, Homo sapiens
acuucaaggaucuuaaacuuug

SEQ ID NO: 26602 - RNA, 23 nt, Homo sapiens
acacacucacacacacacacuca

SEQ ID NO: 26603 - RNA, 22 nt, Homo sapiens
cugcucaaacccuccaaugacu

SEQ ID NO: 26604 - RNA, 19 nt, Homo sapiens
gcucuaagaaagccacacu

SEQ ID NO: 26605 - RNA, 23 nt, Homo sapiens
ccuagagagggugagaaccugcc

SEQ ID NO: 26606 - RNA, 21 nt, Homo sapiens
caucaccuuccuucuccucca

SEQ ID NO: 26607 - RNA, 21 nt, Homo sapiens
cacaaccucaguguuuccagg

SEQ ID NO: 26608 - RNA, 18 nt, Homo sapiens
cccccaccaccacgcccg

SEQ ID NO: 26609 - RNA, 21 nt, Homo sapiens
cugggggacggagcagaagga

SEQ ID NO: 26610 - RNA, 22 nt, Homo sapiens
agcgggacuuugagggccaguu

SEQ ID NO: 26611 - RNA, 23 nt, Homo sapiens
gggcucuuacucccucaggcacu

SEQ ID NO: 26612 - RNA, 23 nt, Homo sapiens
cccaacagacauggcgguacuca

SEQ ID NO: 26613 - RNA, 22 nt, Homo sapiens
ccucaggcacggccgggccacc

SEQ ID NO: 26614 - RNA, 23 nt, Homo sapiens
guagugggccgagccgagugaca

SEQ ID NO: 26615 - RNA, 20 nt, Homo sapiens
ugucuccacagggcucuuua

SEQ ID NO: 26616 - RNA, 20 nt, Homo sapiens
cccugcgccaucuccucuac

SEQ ID NO: 26617 - RNA, 22 nt, Homo sapiens
acaacuguaacuagacgguuuu

SEQ ID NO: 26618 - RNA, 23 nt, Homo sapiens
accccuaucacgauuagcauuaa

SEQ ID NO: 26619 - RNA, 22 nt, Homo sapiens
cugggggcggcacaggggcuca

SEQ ID NO: 26620 - RNA, 21 nt, Homo sapiens
uucuaggauaggcccaggggc

SEQ ID NO: 26621 - RNA, 22 nt, Homo sapiens
gcuggguggagaagguggugaa

SEQ ID NO: 26622 - RNA, 23 nt, Homo sapiens
ggacauuguuucagugcccaagu

SEQ ID NO: 26623 - RNA, 22 nt, Homo sapiens
ugagccacugugccuggccuga

SEQ ID NO: 26624 - RNA, 19 nt, Homo sapiens
uagcauacagauacgccca

SEQ ID NO: 26625 - RNA, 18 nt, Homo sapiens
aucacauucaccucccug

SEQ ID NO: 26626 - RNA, 22 nt, Homo sapiens
aggcauaggaugacaaagggaa

SEQ ID NO: 26627 - RNA, 22 nt, Homo sapiens
aggcgaaggaugacaaagggaa

SEQ ID NO: 26628 - RNA, 23 nt, Homo sapiens
cuacuaaaacauggaagcacuua

SEQ ID NO: 26629 - RNA, 23 nt, Homo sapiens
acacucaaacauggaagcacuua

SEQ ID NO: 26630 - RNA, 23 nt, Homo sapiens
cgugagcuccuggaggacaggga

SEQ ID NO: 26631 - RNA, 21 nt, Homo sapiens
gagcugcauccuggcuccggg

SEQ ID NO: 26632 - RNA, 23 nt, Homo sapiens
cuccagccccuccagggcuuccu

SEQ ID NO: 26633 - RNA, 22 nt, Homo sapiens
cugggggcggcacaggggcuca

SEQ ID NO: 26634 - RNA, 20 nt, Homo sapiens
cucaaagcaaacccugcaga

SEQ ID NO: 26635 - RNA, 17 nt, Homo sapiens
ggguggcagcgguggga

SEQ ID NO: 26636 - RNA, 21 nt, Homo sapiens
gggcaucugggacgcgcagga

SEQ ID NO: 26637 - RNA, 22 nt, Homo sapiens
aggaaaccagcaaguguugacg

SEQ ID NO: 26638 - RNA, 21 nt, Homo sapiens
gaccaaucgccguccccgccg

SEQ ID NO: 26639 - RNA, 22 nt, Homo sapiens
gcggucccgcggcgccccgccu

SEQ ID NO: 26640 - RNA, 23 nt, Homo sapiens
aaagucucgcucucugccccuca

SEQ ID NO: 26641 - RNA, 21 nt, Homo sapiens
aaagagaccgguucacuguga

SEQ ID NO: 26642 - RNA, 23 nt, Homo sapiens
agaggcaggcaugcgggcagaca

SEQ ID NO: 26643 - RNA, 22 nt, Homo sapiens
cacaaaccauuaugugcugcua

SEQ ID NO: 26644 - RNA, 22 nt, Homo sapiens
accagcuaacaauacacugcca

SEQ ID NO: 26645 - RNA, 23 nt, Homo sapiens
augcaaaguugcucggguaaccu

SEQ ID NO: 26646 - RNA, 22 nt, Homo sapiens
uucacacugcaugcucugggua

SEQ ID NO: 26647 - RNA, 21 nt, Homo sapiens
aagggucaguaagcacccgcg

SEQ ID NO: 26648 - RNA, 22 nt, Homo sapiens
acaaaaguugccuuugugugau

SEQ ID NO: 26649 - RNA, 23 nt, Homo sapiens
acgggugcgauuucugugugaga

SEQ ID NO: 26650 - RNA, 22 nt, Homo sapiens
ccucauggaaggguuccccacu

SEQ ID NO: 26651 - RNA, 22 nt, Homo sapiens
caaacaccauugucacacucca

SEQ ID NO: 26652 - RNA, 21 nt, Homo sapiens
gagcugcauccuggcuccggg

SEQ ID NO: 26653 - RNA, 17 nt, Homo sapiens
gggagaggaggaggcga

SEQ ID NO: 26654 - RNA, 21 nt, Homo sapiens
agagcucauccauaguuguca

SEQ ID NO: 26655 - RNA, 22 nt, Homo sapiens
caaacaccauugucacacucca

SEQ ID NO: 26656 - RNA, 24 nt, Homo sapiens
ucacagguuaaagggucucaggga

SEQ ID NO: 26657 - RNA, 22 nt, Homo sapiens
ucacaaguuagggucucaggga

SEQ ID NO: 26658 - RNA, 23 nt, Homo sapiens
agcccuguucuacagcccugagg

SEQ ID NO: 26659 - RNA, 22 nt, Homo sapiens
cacgaccgacgccacgccgagu

SEQ ID NO: 26660 - RNA, 23 nt, Homo sapiens
gggagugaagacacggagccaga

SEQ ID NO: 26661 - RNA, 21 nt, Homo sapiens
acuagacugugagcuccucga

SEQ ID NO: 26662 - RNA, 22 nt, Homo sapiens
agcgggacuuugagggccaguu

SEQ ID NO: 26663 - RNA, 21 nt, Homo sapiens
ucaaucacagauagcaccccu

SEQ ID NO: 26664 - RNA, 20 nt, Homo sapiens
uacugcuuccacagcucccc

SEQ ID NO: 26665 - RNA, 22 nt, Homo sapiens
cucaauagacugugagcuccuu

SEQ ID NO: 26666 - RNA, 22 nt, Homo sapiens
acuucaaggaucuuaaacuuug

SEQ ID NO: 26667 - RNA, 23 nt, Homo sapiens
cccagcuagauuguaagcuccuu

SEQ ID NO: 26668 - RNA, 21 nt, Homo sapiens
ugcaaacccugcaugugggag

SEQ ID NO: 26669 - RNA, 22 nt, Homo sapiens
accagcuaacaauacacugcca

SEQ ID NO: 26670 - RNA, 22 nt, Homo sapiens
ugcaagccuugggugugggagg

SEQ ID NO: 26671 - RNA, 22 nt, Homo sapiens
auaaggauuuuuaggggcauua

SEQ ID NO: 26672 - RNA, 21 nt, Homo sapiens
guuauagaucuggauuugaac

SEQ ID NO: 26673 - RNA, 27 nt, Homo sapiens
auugcguucgaagugucgaugaucaau

SEQ ID NO: 26674 - RNA, 27 nt, Homo sapiens
auugcguucgaagugucgaugaucaau

SEQ ID NO: 26675 - RNA, 22 nt, Homo sapiens
acuucaaggaucuuaaacuuug

SEQ ID NO: 26676 - RNA, 18 nt, Homo sapiens
auucaaucuacugccuca

SEQ ID NO: 26677 - RNA, 21 nt, Homo sapiens
cggggugcacgggcggagggc

SEQ ID NO: 26678 - RNA, 25 nt, Homo sapiens
accaacggaccuacuucccuccgcc

SEQ ID NO: 26679 - RNA, 20 nt, Homo sapiens
gcagaagcauuuccacacac

SEQ ID NO: 26680 - RNA, 21 nt, Homo sapiens
gcggaacuuagccacugugaa

SEQ ID NO: 26681 - RNA, 22 nt, Homo sapiens
cacuccuauaauugauccaguu

SEQ ID NO: 26682 - RNA, 18 nt, Homo sapiens
aucacauucaccucccug

SEQ ID NO: 26683 - RNA, 21 nt, Homo sapiens
caucaccuuccuucuccucca

SEQ ID NO: 26684 - RNA, 20 nt, Homo sapiens
cccugcgccaucuccucuac

SEQ ID NO: 26685 - RNA, 20 nt, Homo sapiens
cugcgggaggacagggcuca

SEQ ID NO: 26686 - RNA, 22 nt, Homo sapiens
ucccucacacagaauuccagaa

SEQ ID NO: 26687 - RNA, 22 nt, Homo sapiens
augcuuuuugggguaagggcuu

SEQ ID NO: 26688 - RNA, 22 nt, Homo sapiens
gugauugccacucuccugagua

SEQ ID NO: 26689 - RNA, 18 nt, Homo sapiens
aucacauucaccucccug

SEQ ID NO: 26690 - RNA, 22 nt, Homo sapiens
caagacacauuuggagagggac

SEQ ID NO: 26691 - RNA, 21 nt, Homo sapiens
ugcaggcugaucuucuucucu

SEQ ID NO: 26692 - RNA, 22 nt, Homo sapiens
cacauggccaaaacagagaaga

SEQ ID NO: 26693 - RNA, 22 nt, Homo sapiens
caaacaccauugucacacucca

SEQ ID NO: 26694 - RNA, 23 nt, Homo sapiens
gggagugaagacacggagccaga

SEQ ID NO: 26695 - RNA, 22 nt, Homo sapiens
ucaacaucagucugauaagcua

SEQ ID NO: 26696 - RNA, 21 nt, Homo sapiens
ucccagcacacauuuagcuca

SEQ ID NO: 26697 - RNA, 23 nt, Homo sapiens
gggagugaagacacggagccaga

SEQ ID NO: 26698 - RNA, 22 nt, Homo sapiens
gaauucaucacggccagccucu

SEQ ID NO: 26699 - RNA, 23 nt, Homo sapiens
gggagugaagacacggagccaga

SEQ ID NO: 26700 - RNA, 21 nt, Homo sapiens
gaccaaucgccguccccgccg

SEQ ID NO: 26701 - RNA, 23 nt, Homo sapiens
aaagucucgcucucugccccuca

SEQ ID NO: 26702 - RNA, 22 nt, Homo sapiens
gcggucccgcggcgccccgccu

SEQ ID NO: 26703 - RNA, 22 nt, Homo sapiens
ugcuguuagcccuagccccgca

SEQ ID NO: 26704 - RNA, 23 nt, Homo sapiens
gagcaaggcucuugucuguaagu

SEQ ID NO: 26705 - RNA, 22 nt, Homo sapiens
acaguucuucaacuggcagcuu

SEQ ID NO: 26706 - RNA, 23 nt, Homo sapiens
acccucuauagggaagcgcguuc

SEQ ID NO: 26707 - RNA, 19 nt, Homo sapiens
guccugaauuccgcagccu

SEQ ID NO: 26708 - RNA, 21 nt, Homo sapiens
gcggaacuuagccacugugaa

SEQ ID NO: 26709 - RNA, 21 nt, Homo sapiens
gcagaacuuagccacugugaa

SEQ ID NO: 26710 - RNA, 22 nt, Homo sapiens
auccuucuacaaauucacccau

SEQ ID NO: 26711 - RNA, 18 nt, Homo sapiens
aucacauucaccucccug

SEQ ID NO: 26712 - RNA, 22 nt, Homo sapiens
agagaggagagccguguaugac

SEQ ID NO: 26713 - RNA, 21 nt, Homo sapiens
agaaguagaccauguguccua

SEQ ID NO: 26714 - RNA, 27 nt, Homo sapiens
uuuagcacagugcuuauacaagaaggu

SEQ ID NO: 26715 - RNA, 21 nt, Homo sapiens
cggggugcacgggcggagggc

SEQ ID NO: 26716 - RNA, 19 nt, Homo sapiens
guccugaauuccgcagccu

SEQ ID NO: 26717 - RNA, 20 nt, Homo sapiens
uacugcuuccacagcucccc

SEQ ID NO: 26718 - RNA, 27 nt, Homo sapiens
uuuagcacagugcuuauacaagaaggu

SEQ ID NO: 26719 - RNA, 22 nt, Homo sapiens
aacaacacuugaccacauccug

SEQ ID NO: 26720 - RNA, 22 nt, Homo sapiens
cgggacguccagacucaacucu

SEQ ID NO: 26721 - RNA, 21 nt, Homo sapiens
aaagaucaaccauguauuauu

SEQ ID NO: 26722 - RNA, 21 nt, Homo sapiens
gagcugcauccuggcuccggg

SEQ ID NO: 26723 - RNA, 22 nt, Homo sapiens
cuagggaacacagggcugguga

SEQ ID NO: 26724 - RNA, 20 nt, Homo sapiens
ggggcagacagacgaggaag

SEQ ID NO: 26725 - RNA, 22 nt, Homo sapiens
agccaagcucagacggauccga

SEQ ID NO: 26726 - RNA, 23 nt, Homo sapiens
cggccugauucacaacaccagcu

SEQ ID NO: 26727 - RNA, 23 nt, Homo sapiens
gggagugaagacacggagccaga

SEQ ID NO: 26728 - RNA, 22 nt, Homo sapiens
uauggaugcaaaaugaucccaa

SEQ ID NO: 26729 - RNA, 19 nt, Homo sapiens
gcuccuguccaacuggcuc

SEQ ID NO: 26730 - RNA, 23 nt, Homo sapiens
ggacauuguuucagugcccaagu

SEQ ID NO: 26731 - RNA, 23 nt, Homo sapiens
cuccagccccuccagggcuuccu

SEQ ID NO: 26732 - RNA, 21 nt, Homo sapiens
caucaccuuccuucuccucca

SEQ ID NO: 26733 - RNA, 23 nt, Homo sapiens
aaccaagaccccggagaucccag

SEQ ID NO: 26734 - RNA, 22 nt, Homo sapiens
ucuacccagaaaggagccagug

SEQ ID NO: 26735 - RNA, 22 nt, Homo sapiens
cacucuaaagggaggcacuuug

SEQ ID NO: 26736 - RNA, 21 nt, Homo sapiens
aagugucagacacgguggugg

SEQ ID NO: 26737 - RNA, 22 nt, Homo sapiens
aggucucacuuuguugcccaga

SEQ ID NO: 26738 - RNA, 21 nt, Homo sapiens
ggcugucaauucauaggucag

SEQ ID NO: 26739 - RNA, 21 nt, Homo sapiens
gucugucaauucauaggucau

SEQ ID NO: 26740 - RNA, 25 nt, Homo sapiens
aaggagcucagaagcccugcccagc

SEQ ID NO: 26741 - RNA, 24 nt, Homo sapiens
cagaaagugcuuucuuuuggagaa

SEQ ID NO: 26742 - RNA, 22 nt, Homo sapiens
aacacucuaaaaggaggcacuu

SEQ ID NO: 26743 - RNA, 24 nt, Homo sapiens
acugcuggucuucagucagggcca

SEQ ID NO: 26744 - RNA, 22 nt, Homo sapiens
gcgaacgcgccacggaccaccu

SEQ ID NO: 26745 - RNA, 22 nt, Homo sapiens
acaaccagcuaagacacugcca

SEQ ID NO: 26746 - RNA, 22 nt, Homo sapiens
ugcuguuagcccuagccccgca

SEQ ID NO: 26747 - RNA, 22 nt, Homo sapiens
ucaaugacucagguaaguugca

SEQ ID NO: 26748 - RNA, 22 nt, Homo sapiens
cagaaagugcuucccucuagag

SEQ ID NO: 26749 - RNA, 23 nt, Homo sapiens
cgugagcuccuggaggacaggga

SEQ ID NO: 26750 - RNA, 22 nt, Homo sapiens
cuaccauaggguaaaaccacug

SEQ ID NO: 26751 - RNA, 20 nt, Homo sapiens
gcagaagcauuuccacacac

SEQ ID NO: 26752 - RNA, 21 nt, Homo sapiens
acugaucuagagaacacaaga

SEQ ID NO: 26753 - RNA, 24 nt, Homo sapiens
acgcgcaggccagagacccaggca

SEQ ID NO: 26754 - RNA, 21 nt, Homo sapiens
aucugcacugucagcacuuua

SEQ ID NO: 26755 - RNA, 23 nt, Homo sapiens
gcuuugacaauaucauugcacug

SEQ ID NO: 26756 - RNA, 22 nt, Homo sapiens
gccagcuaacaauacacugccu

SEQ ID NO: 26757 - RNA, 18 nt, Homo sapiens
ugguggcagaggugggau

SEQ ID NO: 26758 - RNA, 22 nt, Homo sapiens
ugcaagccuugggugugggagg

SEQ ID NO: 26759 - RNA, 23 nt, Homo sapiens
guagugggccgagccgagugaca

SEQ ID NO: 26760 - RNA, 21 nt, Homo sapiens
aucugcacugucagcacuuua

SEQ ID NO: 26761 - RNA, 23 nt, Homo sapiens
gcuuugacaauaucauugcacug

SEQ ID NO: 26762 - RNA, 18 nt, Homo sapiens
uggcgccugaacagggac

SEQ ID NO: 26763 - RNA, 20 nt, Homo sapiens
cccgccgcgucgcccugggg

SEQ ID NO: 26764 - RNA, 17 nt, Homo sapiens
gacagccucucccccac

SEQ ID NO: 26765 - RNA, 22 nt, Homo sapiens
cccaacaacaggaaacuaccua

SEQ ID NO: 26766 - RNA, 21 nt, Homo sapiens
agguaauaccaauaccuugug

SEQ ID NO: 26767 - RNA, 22 nt, Homo sapiens
aacuguacaaacuacuaccuca

SEQ ID NO: 26768 - RNA, 17 nt, Homo sapiens
gggagaggaggaggcga

SEQ ID NO: 26769 - RNA, 22 nt, Homo sapiens
ugacgaugacaacgaugacgua

SEQ ID NO: 26770 - RNA, 21 nt, Homo sapiens
gggcaucugggacgcgcagga

SEQ ID NO: 26771 - RNA, 21 nt, Homo sapiens
acuccaaagggaagcgccuuc

SEQ ID NO: 26772 - RNA, 22 nt, Homo sapiens
cgcucuaaagggaagcgccuuc

SEQ ID NO: 26773 - RNA, 20 nt, Homo sapiens
gcagcuguccgcccagacac

SEQ ID NO: 26774 - RNA, 22 nt, Homo sapiens
gugggguggguggucaggccga

SEQ ID NO: 26775 - RNA, 23 nt, Homo sapiens
uccaucaucaaaacaaauggagu

SEQ ID NO: 26776 - RNA, 23 nt, Homo sapiens
gaaacccagcagacaauguagcu

SEQ ID NO: 26777 - RNA, 19 nt, Homo sapiens
guccugaauuccgcagccu

SEQ ID NO: 26778 - RNA, 22 nt, Homo sapiens
ucgcccucucaacccagcuuuu

SEQ ID NO: 26779 - RNA, 22 nt, Homo sapiens
uugcccucucaacccagcuuuu

SEQ ID NO: 26780 - RNA, 20 nt, Homo sapiens
acccucucaacccagcuuuu

SEQ ID NO: 26781 - RNA, 19 nt, Homo sapiens
uccucucaacccagcuuuu

SEQ ID NO: 26782 - RNA, 20 nt, Homo sapiens
uacugcuuccacagcucccc

SEQ ID NO: 26783 - RNA, 23 nt, Homo sapiens
cacugugggcccucuccgcacca

SEQ ID NO: 26784 - RNA, 22 nt, Homo sapiens
aagauguggaccauauuacaua

SEQ ID NO: 26785 - RNA, 21 nt, Homo sapiens
aguucucccaacguaaaccca

SEQ ID NO: 26786 - RNA, 21 nt, Homo sapiens
ugcaaacccugcaugugggag

SEQ ID NO: 26787 - RNA, 20 nt, Homo sapiens
cuggaggaagggcccagagg

SEQ ID NO: 26788 - RNA, 22 nt, Homo sapiens
gccuaagacacaggcccagaga

SEQ ID NO: 26789 - RNA, 23 nt, Homo sapiens
gaaacccagcagacaauguagcu

SEQ ID NO: 26790 - RNA, 21 nt, Homo sapiens
aucugcacugucagcacuuua

SEQ ID NO: 26791 - RNA, 23 nt, Homo sapiens
gcuuugacaauaucauugcacug

SEQ ID NO: 26792 - RNA, 18 nt, Homo sapiens
aucacauucaccucccug

SEQ ID NO: 26793 - RNA, 20 nt, Homo sapiens
cugcgggaggacagggcuca

SEQ ID NO: 26794 - RNA, 21 nt, Homo sapiens
acuccaaagggaagcgccuuc

SEQ ID NO: 26795 - RNA, 22 nt, Homo sapiens
cgcucuaaagggaagcgccuuc

SEQ ID NO: 26796 - RNA, 22 nt, Homo sapiens
ucaggaacugccuuucucucca

SEQ ID NO: 26797 - RNA, 21 nt, Homo sapiens
gcaagcccagaccgcaaaaag

SEQ ID NO: 26798 - RNA, 22 nt, Homo sapiens
uccacauggaguugcuguuaca

SEQ ID NO: 26799 - RNA, 23 nt, Homo sapiens
cagcugcuuuugggauuccguug

SEQ ID NO: 26800 - RNA, 22 nt, Homo sapiens
ggcagagagucagagcgcggau

SEQ ID NO: 26801 - RNA, 24 nt, Homo sapiens
agugugaguucuaccauugccaaa

SEQ ID NO: 26802 - RNA, 21 nt, Homo sapiens
ggggagcgggggcccugccuu

SEQ ID NO: 26803 - RNA, 21 nt, Homo sapiens
auaauggagaccaggccacga

SEQ ID NO: 26804 - RNA, 21 nt, Homo sapiens
auaauggagaccaggccacga

SEQ ID NO: 26805 - RNA, 18 nt, Homo sapiens
cccccaccaccacgcccg

SEQ ID NO: 26806 - RNA, 21 nt, Homo sapiens
gaccaaucgccguccccgccg

SEQ ID NO: 26807 - RNA, 22 nt, Homo sapiens
gcggucccgcggcgccccgccu

SEQ ID NO: 26808 - RNA, 22 nt, Homo sapiens
ugcuguuagcccuagccccgca

SEQ ID NO: 26809 - RNA, 17 nt, Homo sapiens
gggagaggaggaggcga

SEQ ID NO: 26810 - RNA, 22 nt, Homo sapiens
cucauauuacaaugagcucauc

SEQ ID NO: 26811 - RNA, 20 nt, Homo sapiens
aggggccucagccuccuggu

SEQ ID NO: 26812 - RNA, 21 nt, Homo sapiens
caucaccuuccuucuccucca

SEQ ID NO: 26813 - RNA, 22 nt, Homo sapiens
agcugaguguaggauguuuaca

SEQ ID NO: 26814 - RNA, 18 nt, Homo sapiens
aucacauucaccucccug

SEQ ID NO: 26815 - RNA, 20 nt, Homo sapiens
cucaaagcaaacccugcaga

SEQ ID NO: 26816 - RNA, 22 nt, Homo sapiens
ucacauuugccugcagagauuu

SEQ ID NO: 26817 - RNA, 17 nt, Homo sapiens
gacagccucucccccac

SEQ ID NO: 26818 - RNA, 22 nt, Homo sapiens
ggagauggagccagggcccuaa

SEQ ID NO: 26819 - RNA, 18 nt, Homo sapiens
aucacauucaccucccug

SEQ ID NO: 26820 - RNA, 23 nt, Homo sapiens
gggagugaagacacggagccaga

SEQ ID NO: 26821 - RNA, 23 nt, Homo sapiens
aggaacagcagcagcccgggccg

SEQ ID NO: 26822 - RNA, 22 nt, Homo sapiens
ucaggaacugccuuucucucca

SEQ ID NO: 26823 - RNA, 21 nt, Homo sapiens
acaggauugagggggggcccu

SEQ ID NO: 26824 - RNA, 23 nt, Homo sapiens
aaagucucgcucucugccccuca

SEQ ID NO: 26825 - RNA, 20 nt, Homo sapiens
ugggccaccgccgagcggac

SEQ ID NO: 26826 - RNA, 21 nt, Homo sapiens
caucaccuuccuucuccucca

SEQ ID NO: 26827 - RNA, 22 nt, Homo sapiens
ucaucucgcccgcaaagaccca

SEQ ID NO: 26828 - RNA, 21 nt, Homo sapiens
ugcaugacggccugcaagaca

SEQ ID NO: 26829 - RNA, 22 nt, Homo sapiens
gcacacaauaaauguuugcuga

SEQ ID NO: 26830 - RNA, 22 nt, Homo sapiens
auggcaguggaguuagugauug

SEQ ID NO: 26831 - RNA, 23 nt, Homo sapiens
aaucuacuuucuuugcucauccu

SEQ ID NO: 26832 - RNA, 22 nt, Homo sapiens
aaccacuuucuuugcucauccg

SEQ ID NO: 26833 - RNA, 17 nt, Homo sapiens
uggaggccccagcgaga

SEQ ID NO: 26834 - RNA, 21 nt, Homo sapiens
ccccucccagccucccugcca

SEQ ID NO: 26835 - RNA, 22 nt, Homo sapiens
uacagauggauaccgugcaauu

SEQ ID NO: 26836 - RNA, 21 nt, Homo sapiens
ggacuauagaacuuucccccu

SEQ ID NO: 26837 - RNA, 22 nt, Homo sapiens
cugggggcggcacaggggcuca

SEQ ID NO: 26838 - RNA, 20 nt, Homo sapiens
cugcgggaggacagggcuca

SEQ ID NO: 26839 - RNA, 22 nt, Homo sapiens
ucccucacacagaauuccagaa

SEQ ID NO: 26840 - RNA, 22 nt, Homo sapiens
augcuuuuugggguaagggcuu

SEQ ID NO: 26841 - RNA, 23 nt, Homo sapiens
gggagugaagacacggagccaga

SEQ ID NO: 26842 - RNA, 22 nt, Homo sapiens
ucgcccucucaacccagcuuuu

SEQ ID NO: 26843 - RNA, 22 nt, Homo sapiens
uugcccucucaacccagcuuuu

SEQ ID NO: 26844 - RNA, 20 nt, Homo sapiens
acccucucaacccagcuuuu

SEQ ID NO: 26845 - RNA, 19 nt, Homo sapiens
uccucucaacccagcuuuu

SEQ ID NO: 26846 - RNA, 23 nt, Homo sapiens
aaagucucgcucucugccccuca

SEQ ID NO: 26847 - RNA, 23 nt, Homo sapiens
ccacccaaugaccuacuccaaga

SEQ ID NO: 26848 - RNA, 18 nt, Homo sapiens
acccucugaaaggaagca

SEQ ID NO: 26849 - RNA, 22 nt, Homo sapiens
aaagugcuucuuaccuccagau

SEQ ID NO: 26850 - RNA, 22 nt, Homo sapiens
aaagugcuucuuaccuccagau

SEQ ID NO: 26851 - RNA, 23 nt, Homo sapiens
acaacaaaaucacuagucuucca

SEQ ID NO: 26852 - RNA, 22 nt, Homo sapiens
gguuaguggaccaggucacaaa

SEQ ID NO: 26853 - RNA, 21 nt, Homo sapiens
aucagagguucagcuuacccu

SEQ ID NO: 26854 - RNA, 23 nt, Homo sapiens
cggcucugucgucgaggcgcuca

SEQ ID NO: 26855 - RNA, 23 nt, Homo sapiens
gggagugaagacacggagccaga

SEQ ID NO: 26856 - RNA, 23 nt, Homo sapiens
aggaacagcagcagcccgggccg

SEQ ID NO: 26857 - RNA, 20 nt, Homo sapiens
cccugcgccaucuccucuac

SEQ ID NO: 26858 - RNA, 21 nt, Homo sapiens
ggcugucaauucauaggucag

SEQ ID NO: 26859 - RNA, 22 nt, Homo sapiens
cuagugguccuaaacauuucac

SEQ ID NO: 26860 - RNA, 21 nt, Homo sapiens
gucugucaauucauaggucau

SEQ ID NO: 26861 - RNA, 21 nt, Homo sapiens
cagguaccaauauuuuaucua

SEQ ID NO: 26862 - RNA, 21 nt, Homo sapiens
ccccucccagccucccugcca

SEQ ID NO: 26863 - RNA, 22 nt, Homo sapiens
aaucagucucauugcuuuauaa

SEQ ID NO: 26864 - RNA, 22 nt, Homo sapiens
cucccuucuuuccucccgucuu

SEQ ID NO: 26865 - RNA, 22 nt, Homo sapiens
cgaauccaccacgaacaacuuc

SEQ ID NO: 26866 - RNA, 22 nt, Homo sapiens
ugcaagccuugggugugggagg

SEQ ID NO: 26867 - RNA, 18 nt, Homo sapiens
acccucugaaaggaagca

SEQ ID NO: 26868 - RNA, 22 nt, Homo sapiens
aaagugcuucuuaccuccagau

SEQ ID NO: 26869 - RNA, 22 nt, Homo sapiens
aaagagguuaaccauguauuau

SEQ ID NO: 26870 - RNA, 22 nt, Homo sapiens
auaaaugacaccuccuugugaa

SEQ ID NO: 26871 - RNA, 22 nt, Homo sapiens
agcuagugagaagucaaugccu

SEQ ID NO: 26872 - RNA, 24 nt, Homo sapiens
gaggugacucuauccuaugucuuu

SEQ ID NO: 26873 - RNA, 21 nt, Homo sapiens
aaaagcuaagucaucauauau

SEQ ID NO: 26874 - RNA, 25 nt, Homo sapiens
agcuagucaagcgcgguuguggggg

SEQ ID NO: 26875 - RNA, 22 nt, Homo sapiens
acuccaacagggccgcgucucc

SEQ ID NO: 26876 - RNA, 22 nt, Homo sapiens
uauucaggaacauauugcaaaa

SEQ ID NO: 26877 - RNA, 20 nt, Homo sapiens
gaaagggcuucccuuugcag

SEQ ID NO: 26878 - RNA, 20 nt, Homo sapiens
gaaagggcuucccuuugcag

SEQ ID NO: 26879 - RNA, 20 nt, Homo sapiens
gaaagggcuucccuuugcag

SEQ ID NO: 26880 - RNA, 20 nt, Homo sapiens
gaaagggcuucccuuugcag

SEQ ID NO: 26881 - RNA, 23 nt, Homo sapiens
gggagugaagacacggagccaga

SEQ ID NO: 26882 - RNA, 22 nt, Homo sapiens
agcccaaaaggagaauucuuug

SEQ ID NO: 26883 - RNA, 23 nt, Homo sapiens
gcuuugacaauaucauugcacug

SEQ ID NO: 26884 - RNA, 21 nt, Homo sapiens
ucgacugccacucuuacuaga

SEQ ID NO: 26885 - RNA, 23 nt, Homo sapiens
ggaagccaucaagucgcugcagg

SEQ ID NO: 26886 - RNA, 23 nt, Homo sapiens
aaagucucgcucucugccccuca

SEQ ID NO: 26887 - RNA, 25 nt, Homo sapiens
accaacggaccuacuucccuccgcc

SEQ ID NO: 26888 - RNA, 21 nt, Homo sapiens
caucaccuuccuucuccucca

SEQ ID NO: 26889 - RNA, 22 nt, Homo sapiens
uaaaugaauucaauuuccuucu

SEQ ID NO: 26890 - RNA, 18 nt, Homo sapiens
acccucugaaaggaagca

SEQ ID NO: 26891 - RNA, 22 nt, Homo sapiens
aaagugcuucuuaccuccagau

SEQ ID NO: 26892 - RNA, 23 nt, Homo sapiens
acauuuuucguuauugcucuuga

SEQ ID NO: 26893 - RNA, 23 nt, Homo sapiens
acacacucacacacacacacuca

SEQ ID NO: 26894 - RNA, 25 nt, Homo sapiens
acggagcugucccaacaccaccccu

SEQ ID NO: 26895 - RNA, 22 nt, Homo sapiens
cugggggcggcacaggggcuca

SEQ ID NO: 26896 - RNA, 23 nt, Homo sapiens
gggagugaagacacggagccaga

SEQ ID NO: 26897 - RNA, 22 nt, Homo sapiens
cagaagugggccgggcacaggg

SEQ ID NO: 26898 - RNA, 20 nt, Homo sapiens
cuggaggaagggcccagagg

SEQ ID NO: 26899 - RNA, 22 nt, Homo sapiens
gccuaagacacaggcccagaga

SEQ ID NO: 26900 - RNA, 21 nt, Homo sapiens
gaccaagaaauagccuuucaa

SEQ ID NO: 26901 - RNA, 22 nt, Homo sapiens
cagacuccgguggaaugaagga

SEQ ID NO: 26902 - RNA, 24 nt, Homo sapiens
ucagagcauguguuuaaucaggcu

SEQ ID NO: 26903 - RNA, 21 nt, Homo sapiens
gaccaaucgccguccccgccg

SEQ ID NO: 26904 - RNA, 22 nt, Homo sapiens
gcggucccgcggcgccccgccu

SEQ ID NO: 26905 - RNA, 22 nt, Homo sapiens
ugcuguuagcccuagccccgca

SEQ ID NO: 26906 - RNA, 22 nt, Homo sapiens
gcugaggcuguggggcuggagu

SEQ ID NO: 26907 - RNA, 21 nt, Homo sapiens
cggcucggguggcggcgacgg

SEQ ID NO: 26908 - RNA, 22 nt, Homo sapiens
gcacaaaucuccagaccaccca

SEQ ID NO: 26909 - RNA, 22 nt, Homo sapiens
auggcaguggaguuagugauug

SEQ ID NO: 26910 - RNA, 24 nt, Homo sapiens
acugcaggcuccagcuuccaggcu

SEQ ID NO: 26911 - RNA, 22 nt, Homo sapiens
ucaggaacugccuuucucucca

SEQ ID NO: 26912 - RNA, 21 nt, Homo sapiens
ccccucccagccucccugcca

SEQ ID NO: 26913 - RNA, 22 nt, Homo sapiens
acugccugucugugccugcugu

SEQ ID NO: 26914 - RNA, 22 nt, Homo sapiens
accagguuccaccccagcaggc

SEQ ID NO: 26915 - RNA, 23 nt, Homo sapiens
cuaccugcacuguaagcacuuug

SEQ ID NO: 26916 - RNA, 23 nt, Homo sapiens
gaacagguagucugaacacuggg

SEQ ID NO: 26917 - RNA, 23 nt, Homo sapiens
gaacagauagucuaaacacuggg

SEQ ID NO: 26918 - RNA, 23 nt, Homo sapiens
gggagugaagacacggagccaga

SEQ ID NO: 26919 - RNA, 21 nt, Homo sapiens
gagcuacagugcuucaucuca

SEQ ID NO: 26920 - RNA, 23 nt, Homo sapiens
ccgcuugagcuaacuccgacccg

SEQ ID NO: 26921 - RNA, 22 nt, Homo sapiens
auggcaguggaguuagugauug

SEQ ID NO: 26922 - RNA, 23 nt, Homo sapiens
aggaacagcagcagcccgggccg

SEQ ID NO: 26923 - RNA, 20 nt, Homo sapiens
uacugcuuccacagcucccc

SEQ ID NO: 26924 - RNA, 17 nt, Homo sapiens
agaaagaagcaauauga

SEQ ID NO: 26925 - RNA, 20 nt, Homo sapiens
uacugcuuccacagcucccc

SEQ ID NO: 26926 - RNA, 21 nt, Homo sapiens
cggggugcacgggcggagggc

SEQ ID NO: 26927 - RNA, 21 nt, Homo sapiens
aaaacaaaaucucaccguuuu

SEQ ID NO: 26928 - RNA, 23 nt, Homo sapiens
aaaucagaaucacaccuggggga

SEQ ID NO: 26929 - RNA, 24 nt, Homo sapiens
acgcagagcccgaaagcccccagu

SEQ ID NO: 26930 - RNA, 22 nt, Homo sapiens
ucagaccgagacaagugcaaug

SEQ ID NO: 26931 - RNA, 20 nt, Homo sapiens
uccccacagacccagagccg

SEQ ID NO: 26932 - RNA, 22 nt, Homo sapiens
aggucucacuuuguugcccaga

SEQ ID NO: 26933 - RNA, 25 nt, Homo sapiens
aaggagcucagaagcccugcccagc

SEQ ID NO: 26934 - RNA, 23 nt, Homo sapiens
cccagcuagauuguaagcuccuu

SEQ ID NO: 26935 - RNA, 23 nt, Homo sapiens
acagaaagugcuucccucaagag

SEQ ID NO: 26936 - RNA, 23 nt, Homo sapiens
gggagugaagacacggagccaga

SEQ ID NO: 26937 - RNA, 21 nt, Homo sapiens
gggcaucugggacgcgcagga

SEQ ID NO: 26938 - RNA, 21 nt, Homo sapiens
gaccaaucgccguccccgccg

SEQ ID NO: 26939 - RNA, 23 nt, Homo sapiens
aagaaucuugucccgcagguccu

SEQ ID NO: 26940 - RNA, 22 nt, Homo sapiens
gcggucccgcggcgccccgccu

SEQ ID NO: 26941 - RNA, 24 nt, Homo sapiens
cacccccagagccucagcucccca

SEQ ID NO: 26942 - RNA, 21 nt, Homo sapiens
gaaggaagugagugcagccac

SEQ ID NO: 26943 - RNA, 21 nt, Homo sapiens
cggggugcacgggcggagggc

SEQ ID NO: 26944 - RNA, 20 nt, Homo sapiens
uacugcuuccacagcucccc

SEQ ID NO: 26945 - RNA, 21 nt, Homo sapiens
cggggugcacgggcggagggc

SEQ ID NO: 26946 - RNA, 22 nt, Homo sapiens
ucaccauugcuaaagugcaauu

SEQ ID NO: 26947 - RNA, 22 nt, Homo sapiens
uaaccgauuucagauggugcua

SEQ ID NO: 26948 - RNA, 23 nt, Homo sapiens
aacacugauuucaaauggugcua

SEQ ID NO: 26949 - RNA, 22 nt, Homo sapiens
uaaccgauuucaaauggugcua

SEQ ID NO: 26950 - RNA, 22 nt, Homo sapiens
agggguucaccgagcaacauuc

SEQ ID NO: 26951 - RNA, 18 nt, Homo sapiens
gaaaugagggccagcuga

SEQ ID NO: 26952 - RNA, 25 nt, Homo sapiens
agcuagucaagcgcgguuguggggg

SEQ ID NO: 26953 - RNA, 22 nt, Homo sapiens
acaucaucgcauauugacacaa

SEQ ID NO: 26954 - RNA, 22 nt, Homo sapiens
acaguggucaucgagugacaca

SEQ ID NO: 26955 - RNA, 21 nt, Homo sapiens
ccccucccagccucccugcca

SEQ ID NO: 26956 - RNA, 21 nt, Homo sapiens
gaccaaucgccguccccgccg

SEQ ID NO: 26957 - RNA, 23 nt, Homo sapiens
aaagucucgcucucugccccuca

SEQ ID NO: 26958 - RNA, 22 nt, Homo sapiens
gcggucccgcggcgccccgccu

SEQ ID NO: 26959 - RNA, 22 nt, Homo sapiens
ugcuguuagcccuagccccgca

SEQ ID NO: 26960 - RNA, 24 nt, Homo sapiens
acugcaggcuccagcuuccaggcu

SEQ ID NO: 26961 - RNA, 22 nt, Homo sapiens
cagaagugggccgggcacaggg

SEQ ID NO: 26962 - RNA, 22 nt, Homo sapiens
cugggggcggcacaggggcuca

SEQ ID NO: 26963 - RNA, 22 nt, Homo sapiens
cacugguacaaggguugggaga

SEQ ID NO: 26964 - RNA, 21 nt, Homo sapiens
gaccaaucgccguccccgccg

SEQ ID NO: 26965 - RNA, 21 nt, Homo sapiens
gcggaacuuagccacugugaa

SEQ ID NO: 26966 - RNA, 21 nt, Homo sapiens
gcagaacuuagccacugugaa

SEQ ID NO: 26967 - RNA, 21 nt, Homo sapiens
ucaaucacagauagcaccccu

SEQ ID NO: 26968 - RNA, 22 nt, Homo sapiens
gcggucccgcggcgccccgccu

SEQ ID NO: 26969 - RNA, 21 nt, Homo sapiens
ugcaaugcaacuacaaugcac

SEQ ID NO: 26970 - RNA, 20 nt, Homo sapiens
gcaaugcaacagcaaugcac

SEQ ID NO: 26971 - RNA, 21 nt, Homo sapiens
cugggggacggagcagaagga

SEQ ID NO: 26972 - RNA, 22 nt, Homo sapiens
ucagaccgagacaagugcaaug

SEQ ID NO: 26973 - RNA, 21 nt, Homo sapiens
ccccucccagccucccugcca

SEQ ID NO: 26974 - RNA, 22 nt, Homo sapiens
gauagagugcagaccagggucu

SEQ ID NO: 26975 - RNA, 22 nt, Homo sapiens
uccggggacgaacgggacgggu

SEQ ID NO: 26976 - RNA, 21 nt, Homo sapiens
ccgugguucuacccuguggua

SEQ ID NO: 26977 - RNA, 21 nt, Homo sapiens
acaggauugagggggggcccu

SEQ ID NO: 26978 - RNA, 20 nt, Homo sapiens
gcagcuguccgcccagacac

SEQ ID NO: 26979 - RNA, 23 nt, Homo sapiens
aggaacagcagcagcccgggccg

SEQ ID NO: 26980 - RNA, 23 nt, Homo sapiens
aggaacagcagcagcccgggccg

SEQ ID NO: 26981 - RNA, 21 nt, Homo sapiens
acaggauugagggggggcccu

SEQ ID NO: 26982 - RNA, 22 nt, Homo sapiens
cugggggcggcacaggggcuca

SEQ ID NO: 26983 - RNA, 23 nt, Homo sapiens
cuaacugcacuagaugcaccuua

SEQ ID NO: 26984 - RNA, 24 nt, Homo sapiens
gaaagugcauagaauucugucugg

SEQ ID NO: 26985 - RNA, 23 nt, Homo sapiens
gggagugaagacacggagccaga

SEQ ID NO: 26986 - RNA, 21 nt, Homo sapiens
ggcugucaauucauaggucag

SEQ ID NO: 26987 - RNA, 21 nt, Homo sapiens
gucugucaauucauaggucau

SEQ ID NO: 26988 - RNA, 21 nt, Homo sapiens
acaggauugagggggggcccu

SEQ ID NO: 26989 - RNA, 22 nt, Homo sapiens
uaaccgauuucagauggugcua

SEQ ID NO: 26990 - RNA, 22 nt, Homo sapiens
uaaccgauuucagauggugcua

SEQ ID NO: 26991 - RNA, 23 nt, Homo sapiens
aacacugauuucaaauggugcua

SEQ ID NO: 26992 - RNA, 22 nt, Homo sapiens
uaaccgauuucaaauggugcua

SEQ ID NO: 26993 - RNA, 21 nt, Homo sapiens
agguaagcgcuguugcuagcc

SEQ ID NO: 26994 - RNA, 19 nt, Homo sapiens
ucccacaggaagcagacac

SEQ ID NO: 26995 - RNA, 24 nt, Homo sapiens
acgcgcaggccagagacccaggca

SEQ ID NO: 26996 - RNA, 22 nt, Homo sapiens
ugcuguuagcccuagccccgca

SEQ ID NO: 26997 - RNA, 21 nt, Homo sapiens
aggagacucacaaguuccugc

SEQ ID NO: 26998 - RNA, 21 nt, Homo sapiens
caacugaugccuuuccaagua

SEQ ID NO: 26999 - RNA, 22 nt, Homo sapiens
cucauccgauguacaauaauuu

SEQ ID NO: 27000 - RNA, 24 nt, Homo sapiens
acgcgcaggccagagacccaggca

SEQ ID NO: 27001 - RNA, 17 nt, Homo sapiens
gacagccucucccccac

SEQ ID NO: 27002 - RNA, 23 nt, Homo sapiens
ucucugcaggccgugugcuuugc

SEQ ID NO: 27003 - RNA, 17 nt, Homo sapiens
gggagaggaggaggcga

SEQ ID NO: 27004 - RNA, 23 nt, Homo sapiens
aggaacagcagcagcccgggccg

SEQ ID NO: 27005 - RNA, 22 nt, Homo sapiens
augcccuuucaucauugcacug

SEQ ID NO: 27006 - RNA, 22 nt, Homo sapiens
ucgcccucucaacccagcuuuu

SEQ ID NO: 27007 - RNA, 22 nt, Homo sapiens
uugcccucucaacccagcuuuu

SEQ ID NO: 27008 - RNA, 20 nt, Homo sapiens
acccucucaacccagcuuuu

SEQ ID NO: 27009 - RNA, 19 nt, Homo sapiens
uccucucaacccagcuuuu

SEQ ID NO: 27010 - RNA, 18 nt, Homo sapiens
aucacauucaccucccug

SEQ ID NO: 27011 - RNA, 22 nt, Homo sapiens
cucaauagacugugagcuccuu

SEQ ID NO: 27012 - RNA, 23 nt, Homo sapiens
cccagcuagauuguaagcuccuu

SEQ ID NO: 27013 - RNA, 22 nt, Homo sapiens
aaagagguuaaccagguguguu

SEQ ID NO: 27014 - RNA, 22 nt, Homo sapiens
ugaauccuugaauagguguguu

SEQ ID NO: 27015 - RNA, 22 nt, Homo sapiens
aggaaaccagcaaguguugacg

SEQ ID NO: 27016 - RNA, 22 nt, Homo sapiens
agcuagugagaagucaaugccu

SEQ ID NO: 27017 - RNA, 22 nt, Homo sapiens
ucaggaacugccuuucucucca

SEQ ID NO: 27018 - RNA, 21 nt, Homo sapiens
aaagagaccgguucacuguga

SEQ ID NO: 27019 - RNA, 23 nt, Homo sapiens
acccaacagccccugcaagggau

SEQ ID NO: 27020 - RNA, 22 nt, Homo sapiens
cugggggcggcacaggggcuca

SEQ ID NO: 27021 - RNA, 23 nt, Homo sapiens
aggaacagcagcagcccgggccg

SEQ ID NO: 27022 - RNA, 20 nt, Homo sapiens
acaaugagaacccauggucu

SEQ ID NO: 27023 - RNA, 20 nt, Homo sapiens
aggggccucagccuccuggu

SEQ ID NO: 27024 - RNA, 22 nt, Homo sapiens
ugaauuacuuuguaaaccacca

SEQ ID NO: 27025 - RNA, 26 nt, Homo sapiens
aaccaucucauacaaaccaacuacuu

SEQ ID NO: 27026 - RNA, 21 nt, Homo sapiens
aucuuugauuuucaguaguuu

SEQ ID NO: 27027 - RNA, 22 nt, Homo sapiens
uccagcaaagggaagcgcuuuc

SEQ ID NO: 27028 - RNA, 22 nt, Homo sapiens
accucuaaaggggagcgcuuug

SEQ ID NO: 27029 - RNA, 23 nt, Homo sapiens
acacucuaaagagaagcgcuuug

SEQ ID NO: 27030 - RNA, 21 nt, Homo sapiens
gcuccaaagggaagcgcuuug

SEQ ID NO: 27031 - RNA, 21 nt, Homo sapiens
ccucuaaagagaagcgcuuuc

SEQ ID NO: 27032 - RNA, 22 nt, Homo sapiens
cacucuaaagggaggcacuuug

SEQ ID NO: 27033 - RNA, 22 nt, Homo sapiens
cacucagcggccguuuccccaa

SEQ ID NO: 27034 - RNA, 22 nt, Homo sapiens
ucaacaucagucugauaagcua

SEQ ID NO: 27035 - RNA, 22 nt, Homo sapiens
cugcacuuuuaugaauaagcuc

SEQ ID NO: 27036 - RNA, 23 nt, Homo sapiens
gaaacccagcagacaauguagcu

SEQ ID NO: 27037 - RNA, 23 nt, Homo sapiens
gggagugaagacacggagccaga

SEQ ID NO: 27038 - RNA, 21 nt, Homo sapiens
gaccaaucgccguccccgccg

SEQ ID NO: 27039 - RNA, 25 nt, Homo sapiens
acggagcugucccaacaccaccccu

SEQ ID NO: 27040 - RNA, 22 nt, Homo sapiens
gcggucccgcggcgccccgccu

SEQ ID NO: 27041 - RNA, 21 nt, Homo sapiens
gcagaacuuagccacugugaa

SEQ ID NO: 27042 - RNA, 20 nt, Homo sapiens
uucccaugcccuauaccucu

SEQ ID NO: 27043 - RNA, 22 nt, Homo sapiens
caccugauaaaacugagguaua

SEQ ID NO: 27044 - RNA, 22 nt, Homo sapiens
uccggggacgaacgggacgggu

SEQ ID NO: 27045 - RNA, 23 nt, Homo sapiens
gggagugaagacacggagccaga

SEQ ID NO: 27046 - RNA, 25 nt, Homo sapiens
agcuagucaagcgcgguuguggggg

SEQ ID NO: 27047 - RNA, 23 nt, Homo sapiens
cggcucugucgucgaggcgcuca

SEQ ID NO: 27048 - RNA, 21 nt, Homo sapiens
cacucugaagggaagcgcuuu

SEQ ID NO: 27049 - RNA, 21 nt, Homo sapiens
caucaccuuccuucuccucca

SEQ ID NO: 27050 - RNA, 22 nt, Homo sapiens
gaggcucagaauggcucaggag

SEQ ID NO: 27051 - RNA, 19 nt, Homo sapiens
ccaccucccgaguccucac

SEQ ID NO: 27052 - RNA, 22 nt, Homo sapiens
ucaggaacugccuuucucucca

SEQ ID NO: 27053 - RNA, 22 nt, Homo sapiens
cuguuccugcugaacugagcca

SEQ ID NO: 27054 - RNA, 22 nt, Homo sapiens
acaaccagcuaagacacugcca

SEQ ID NO: 27055 - RNA, 23 nt, Homo sapiens
gcaaucagcuaacuacacugccu

SEQ ID NO: 27056 - RNA, 22 nt, Homo sapiens
accagcuaacaauacacugcca

SEQ ID NO: 27057 - RNA, 22 nt, Homo sapiens
gccagcuaacaauacacugccu

SEQ ID NO: 27058 - RNA, 22 nt, Homo sapiens
aucgggaggggacugagccuga

SEQ ID NO: 27059 - RNA, 19 nt, Homo sapiens
ucagcaguaccagccuaga

SEQ ID NO: 27060 - RNA, 20 nt, Homo sapiens
gcagcuguccgcccagacac

SEQ ID NO: 27061 - RNA, 22 nt, Homo sapiens
acaccuggcuccacacgcgggc

SEQ ID NO: 27062 - RNA, 21 nt, Homo sapiens
agagcucauccauaguuguca

SEQ ID NO: 27063 - RNA, 21 nt, Homo sapiens
acaggauugagggggggcccu

SEQ ID NO: 27064 - RNA, 23 nt, Homo sapiens
acugaggggccucagaccgagcu

SEQ ID NO: 27065 - RNA, 20 nt, Homo sapiens
uccccacagacccagagccg

SEQ ID NO: 27066 - RNA, 21 nt, Homo sapiens
ccccucccagccucccugcca

SEQ ID NO: 27067 - RNA, 24 nt, Homo sapiens
ucacagguuaaagggucucaggga

SEQ ID NO: 27068 - RNA, 22 nt, Homo sapiens
ucacaaguuagggucucaggga

SEQ ID NO: 27069 - RNA, 23 nt, Homo sapiens
agcccuguucuacagcccugagg

SEQ ID NO: 27070 - RNA, 25 nt, Homo sapiens
aagaaagagucuugcuuugucgccc

SEQ ID NO: 27071 - RNA, 22 nt, Homo sapiens
acccuuaucaguucuccgucca

SEQ ID NO: 27072 - RNA, 22 nt, Homo sapiens
cccaacaacaggaaacuaccua

SEQ ID NO: 27073 - RNA, 22 nt, Homo sapiens
cgggacguccagacucaacucu

SEQ ID NO: 27074 - RNA, 23 nt, Homo sapiens
ucaccaaaacauggaagcacuua

SEQ ID NO: 27075 - RNA, 23 nt, Homo sapiens
cuacuaaaacauggaagcacuua

SEQ ID NO: 27076 - RNA, 23 nt, Homo sapiens
ccacugaaacauggaagcacuua

SEQ ID NO: 27077 - RNA, 23 nt, Homo sapiens
acacucaaacauggaagcacuua

SEQ ID NO: 27078 - RNA, 17 nt, Homo sapiens
aagcauggaagcacuua

SEQ ID NO: 27079 - RNA, 23 nt, Homo sapiens
acgcucaaaugucgcagcacuuu

SEQ ID NO: 27080 - RNA, 23 nt, Homo sapiens
acaccccaaaaucgaagcacuuc

SEQ ID NO: 27081 - RNA, 22 nt, Homo sapiens
gugauugccacucuccugagua

SEQ ID NO: 27082 - RNA, 22 nt, Homo sapiens
gaccucagcuaugacagcacuu

SEQ ID NO: 27083 - RNA, 22 nt, Homo sapiens
acaguccaaagggaagcacuuu

SEQ ID NO: 27084 - RNA, 21 nt, Homo sapiens
cccucuaaaaggaagcacuuu

SEQ ID NO: 27085 - RNA, 22 nt, Homo sapiens
acccucuaaaaggaagcacuuu

SEQ ID NO: 27086 - RNA, 22 nt, Homo sapiens
acccaccaaagagaagcacuuu

SEQ ID NO: 27087 - RNA, 21 nt, Homo sapiens
cccucaaaaaggaagcacuuu

SEQ ID NO: 27088 - RNA, 21 nt, Homo sapiens
ggacuauagaacuuucccccu

SEQ ID NO: 27089 - RNA, 22 nt, Homo sapiens
caaacaccauugucacacucca

SEQ ID NO: 27090 - RNA, 22 nt, Homo sapiens
uccggggacgaacgggacgggu

SEQ ID NO: 27091 - RNA, 17 nt, Homo sapiens
ggguggcagcgguggga

SEQ ID NO: 27092 - RNA, 22 nt, Homo sapiens
cccaacaacaggaaacuaccua

SEQ ID NO: 27093 - RNA, 22 nt, Homo sapiens
aggcauaggaugacaaagggaa

SEQ ID NO: 27094 - RNA, 22 nt, Homo sapiens
aggcgaaggaugacaaagggaa

SEQ ID NO: 27095 - RNA, 22 nt, Homo sapiens
cucaauagacugugagcuccuu

SEQ ID NO: 27096 - RNA, 22 nt, Homo sapiens
aguccagauucugugcccacca

SEQ ID NO: 27097 - RNA, 21 nt, Homo sapiens
guuauagaucuggauuugaac

SEQ ID NO: 27098 - RNA, 19 nt, Homo sapiens
ucagcaguaccagccuaga

SEQ ID NO: 27099 - RNA, 22 nt, Homo sapiens
gcacauguucugcggcccacca

SEQ ID NO: 27100 - RNA, 20 nt, Homo sapiens
aggggccucagccuccuggu

SEQ ID NO: 27101 - RNA, 23 nt, Homo sapiens
cccagcuagauuguaagcuccuu

SEQ ID NO: 27102 - RNA, 21 nt, Homo sapiens
cacaaccucaguguuuccagg

SEQ ID NO: 27103 - RNA, 22 nt, Homo sapiens
ggaggccgggacgagugcaaua

SEQ ID NO: 27104 - RNA, 21 nt, Homo sapiens
aaaagcuaagucaucauauau

SEQ ID NO: 27105 - RNA, 22 nt, Homo sapiens
ccaucuuuaccagacaguguua

SEQ ID NO: 27106 - RNA, 22 nt, Homo sapiens
ucagaccgagacaagugcaaug

SEQ ID NO: 27107 - RNA, 21 nt, Homo sapiens
aacuccuguaugaagccguuc

SEQ ID NO: 27108 - RNA, 21 nt, Homo sapiens
gaaggaagugagugcagccac

SEQ ID NO: 27109 - RNA, 22 nt, Homo sapiens
aaggugauggucagcagacaua

SEQ ID NO: 27110 - RNA, 20 nt, Homo sapiens
aggggccucagccuccuggu

SEQ ID NO: 27111 - RNA, 23 nt, Homo sapiens
acucagaaggacaaguagaguuu

SEQ ID NO: 27112 - RNA, 21 nt, Homo sapiens
auaauggagaccaggccacga

SEQ ID NO: 27113 - RNA, 22 nt, Homo sapiens
ucccucacacagaauuccagaa

SEQ ID NO: 27114 - RNA, 18 nt, Homo sapiens
aucacauucaccucccug

SEQ ID NO: 27115 - RNA, 22 nt, Homo sapiens
acaccuggcuccacacgcgggc

SEQ ID NO: 27116 - RNA, 23 nt, Homo sapiens
gggagugaagacacggagccaga

SEQ ID NO: 27117 - RNA, 21 nt, Homo sapiens
gaccaaucgccguccccgccg

SEQ ID NO: 27118 - RNA, 22 nt, Homo sapiens
cagaagugggccgggcacaggg

SEQ ID NO: 27119 - RNA, 22 nt, Homo sapiens
uccacauggaguugcuguuaca

SEQ ID NO: 27120 - RNA, 23 nt, Homo sapiens
gaaacccagcagacaauguagcu

SEQ ID NO: 27121 - RNA, 22 nt, Homo sapiens
augggacauccuacauaugcaa

SEQ ID NO: 27122 - RNA, 21 nt, Homo sapiens
guucuaacccauuguggccaa

SEQ ID NO: 27123 - RNA, 22 nt, Homo sapiens
gauccgagcaccggggaccccc

SEQ ID NO: 27124 - RNA, 24 nt, Homo sapiens
acgcgcaggccagagacccaggca

SEQ ID NO: 27125 - RNA, 22 nt, Homo sapiens
gcggucccgcggcgccccgccu

SEQ ID NO: 27126 - RNA, 20 nt, Homo sapiens
aggggccucagccuccuggu

SEQ ID NO: 27127 - RNA, 22 nt, Homo sapiens
ugcuguuagcccuagccccgca

SEQ ID NO: 27128 - RNA, 20 nt, Homo sapiens
acagcaaggagggcaggagg

SEQ ID NO: 27129 - RNA, 24 nt, Homo sapiens
acacucuaaagggaagcacuuugu

SEQ ID NO: 27130 - RNA, 22 nt, Homo sapiens
acucuaaagggaagcacuuugu

SEQ ID NO: 27131 - RNA, 22 nt, Homo sapiens
augcccuuucaucauugcacug

SEQ ID NO: 27132 - RNA, 23 nt, Homo sapiens
cccagcuagauuguaagcuccuu

SEQ ID NO: 27133 - RNA, 20 nt, Homo sapiens
uucccaugcccuauaccucu

SEQ ID NO: 27134 - RNA, 22 nt, Homo sapiens
acucaguaugccaggguaccau

SEQ ID NO: 27135 - RNA, 23 nt, Homo sapiens
cuaucugcacuagaugcaccuua

SEQ ID NO: 27136 - RNA, 22 nt, Homo sapiens
ucggucccucgggccagggcag

SEQ ID NO: 27137 - RNA, 19 nt, Homo sapiens
guccugaauuccgcagccu

SEQ ID NO: 27138 - RNA, 23 nt, Homo sapiens
aaagucucgcucucugccccuca

SEQ ID NO: 27139 - RNA, 20 nt, Homo sapiens
uacugcuuccacagcucccc

SEQ ID NO: 27140 - RNA, 22 nt, Homo sapiens
cgaauccaccacgaacaacuuc

SEQ ID NO: 27141 - RNA, 22 nt, Homo sapiens
uuucaguuaucaaucugucaca

SEQ ID NO: 27142 - RNA, 23 nt, Homo sapiens
guagugggccgagccgagugaca

SEQ ID NO: 27143 - RNA, 22 nt, Homo sapiens
uggcagcagcggagggggcaga

SEQ ID NO: 27144 - RNA, 20 nt, Homo sapiens
ccagcagcaccuggggcagu

SEQ ID NO: 27145 - RNA, 21 nt, Homo sapiens
auccuguacugagcugccccg

SEQ ID NO: 27146 - RNA, 22 nt, Homo sapiens
cagaagugggccgggcacaggg

SEQ ID NO: 27147 - RNA, 21 nt, Homo sapiens
cucccccacugcagcuggcac

SEQ ID NO: 27148 - RNA, 23 nt, Homo sapiens
acacagcucuuccauaucuccag

SEQ ID NO: 27149 - RNA, 22 nt, Homo sapiens
ucccucacacagaauuccagaa

SEQ ID NO: 27150 - RNA, 22 nt, Homo sapiens
augcuuuuugggguaagggcuu

SEQ ID NO: 27151 - RNA, 21 nt, Homo sapiens
gagcuacagugcuucaucuca

SEQ ID NO: 27152 - RNA, 22 nt, Homo sapiens
ccggcugcaacacaagacacga

SEQ ID NO: 27153 - RNA, 22 nt, Homo sapiens
ucagaccgagacaagugcaaug

SEQ ID NO: 27154 - RNA, 20 nt, Homo sapiens
auuucuauaucuaucuccau

SEQ ID NO: 27155 - RNA, 22 nt, Homo sapiens
ccucaggcacggccgggccacc

SEQ ID NO: 27156 - RNA, 22 nt, Homo sapiens
gcugaggcuguggggcuggagu

SEQ ID NO: 27157 - RNA, 22 nt, Homo sapiens
gugggguggguggucaggccga

SEQ ID NO: 27158 - RNA, 22 nt, Homo sapiens
cacgaccgacgccacgccgagu

SEQ ID NO: 27159 - RNA, 19 nt, Homo sapiens
cagcaucagcagcaucauc

SEQ ID NO: 27160 - RNA, 22 nt, Homo sapiens
acuccaacagggccgcgucucc

SEQ ID NO: 27161 - RNA, 22 nt, Homo sapiens
ggagcccgcgccccgcgccgag

SEQ ID NO: 27162 - RNA, 23 nt, Homo sapiens
gggagugaagacacggagccaga

SEQ ID NO: 27163 - RNA, 23 nt, Homo sapiens
cuaucugcacuagaugcaccuua

SEQ ID NO: 27164 - RNA, 23 nt, Homo sapiens
acccucuauagggaagcgcguuc

SEQ ID NO: 27165 - RNA, 22 nt, Homo sapiens
uauccacuacaccccgcugccu

SEQ ID NO: 27166 - RNA, 26 nt, Homo sapiens
uuucagaauuugcugccaucaucauc

SEQ ID NO: 27167 - RNA, 21 nt, Homo sapiens
gagcugcauccuggcuccggg

SEQ ID NO: 27168 - RNA, 23 nt, Homo sapiens
gggagugaagacacggagccaga

SEQ ID NO: 27169 - RNA, 23 nt, Homo sapiens
cagcugcuuuugggauuccguug

SEQ ID NO: 27170 - RNA, 21 nt, Homo sapiens
ugcaaugcaacuacaaugcac

SEQ ID NO: 27171 - RNA, 22 nt, Homo sapiens
ucagaccgagacaagugcaaug

SEQ ID NO: 27172 - RNA, 24 nt, Homo sapiens
acgcgcaggccagagacccaggca

SEQ ID NO: 27173 - RNA, 17 nt, Homo sapiens
gacagccucucccccac

SEQ ID NO: 27174 - RNA, 22 nt, Homo sapiens
cuaccauaggguaaaaccacug

SEQ ID NO: 27175 - RNA, 22 nt, Homo sapiens
cagaaagugcuucccucuagag

SEQ ID NO: 27176 - RNA, 21 nt, Homo sapiens
gaccaaucgccguccccgccg

SEQ ID NO: 27177 - RNA, 22 nt, Homo sapiens
cagaagugggccgggcacaggg

SEQ ID NO: 27178 - RNA, 22 nt, Homo sapiens
aggcauaggaugacaaagggaa

SEQ ID NO: 27179 - RNA, 22 nt, Homo sapiens
aggcgaaggaugacaaagggaa

SEQ ID NO: 27180 - RNA, 21 nt, Homo sapiens
agagcucauccauaguuguca

SEQ ID NO: 27181 - RNA, 22 nt, Homo sapiens
agccacaaucaccuucugaucu

SEQ ID NO: 27182 - RNA, 22 nt, Homo sapiens
aaucagucucauugcuuuauaa

SEQ ID NO: 27183 - RNA, 21 nt, Homo sapiens
acaaaccacagugugcugcug

SEQ ID NO: 27184 - RNA, 21 nt, Homo sapiens
guucuaacccauuguggccaa

SEQ ID NO: 27185 - RNA, 24 nt, Homo sapiens
acgcgcaggccagagacccaggca

SEQ ID NO: 27186 - RNA, 22 nt, Homo sapiens
gcggucccgcggcgccccgccu

SEQ ID NO: 27187 - RNA, 22 nt, Homo sapiens
ugcuguuagcccuagccccgca

SEQ ID NO: 27188 - RNA, 21 nt, Homo sapiens
aggagacucacaaguuccugc

SEQ ID NO: 27189 - RNA, 20 nt, Homo sapiens
uacugcuuccacagcucccc

SEQ ID NO: 27190 - RNA, 24 nt, Homo sapiens
cacccccagagccucagcucccca

SEQ ID NO: 27191 - RNA, 21 nt, Homo sapiens
gcuccaaccucagcagacugu

SEQ ID NO: 27192 - RNA, 17 nt, Homo sapiens
gggagaggaggaggcga

SEQ ID NO: 27193 - RNA, 19 nt, Homo sapiens
guugggaucacaggcgccc

SEQ ID NO: 27194 - RNA, 24 nt, Homo sapiens
acugcuggucuucagucagggcca

SEQ ID NO: 27195 - RNA, 22 nt, Homo sapiens
ccucaggcacggccgggccacc

SEQ ID NO: 27196 - RNA, 18 nt, Homo sapiens
uggcgccugaacagggac

SEQ ID NO: 27197 - RNA, 23 nt, Homo sapiens
cgugagcuccuggaggacaggga

SEQ ID NO: 27198 - RNA, 22 nt, Homo sapiens
ggcucccaagaaccucaccugu

SEQ ID NO: 27199 - RNA, 18 nt, Homo sapiens
uggcgccugaacagggac

SEQ ID NO: 27200 - RNA, 22 nt, Homo sapiens
uuucaguuaucaaucugucaca

SEQ ID NO: 27201 - RNA, 21 nt, Homo sapiens
agagguugacuguauaauauu

SEQ ID NO: 27202 - RNA, 21 nt, Homo sapiens
agaggcagguuccuggaucau

SEQ ID NO: 27203 - RNA, 21 nt, Homo sapiens
cuagggaagaacagugagcaa

SEQ ID NO: 27204 - RNA, 21 nt, Homo sapiens
caucaccuuccuucuccucca

SEQ ID NO: 27205 - RNA, 23 nt, Homo sapiens
agaaaccaugggguaugagcaga

SEQ ID NO: 27206 - RNA, 21 nt, Homo sapiens
cucccccacugcagcuggcac

SEQ ID NO: 27207 - RNA, 22 nt, Homo sapiens
cucccuucuuuccucccgucuu

SEQ ID NO: 27208 - RNA, 22 nt, Homo sapiens
ucaaugacucagguaaguugca

SEQ ID NO: 27209 - RNA, 21 nt, Homo sapiens
ccccucccagccucccugcca

SEQ ID NO: 27210 - RNA, 22 nt, Homo sapiens
cugggggcggcacaggggcuca

SEQ ID NO: 27211 - RNA, 22 nt, Homo sapiens
caaacaccauugucacacucca

SEQ ID NO: 27212 - RNA, 18 nt, Homo sapiens
aucacauucaccucccug

SEQ ID NO: 27213 - RNA, 23 nt, Homo sapiens
gggagugaagacacggagccaga

SEQ ID NO: 27214 - RNA, 27 nt, Homo sapiens
uuuagcacagugcuuauacaagaaggu

SEQ ID NO: 27215 - RNA, 21 nt, Homo sapiens
ugcaggcugaucuucuucucu

SEQ ID NO: 27216 - RNA, 21 nt, Homo sapiens
ggucagaacccaucauucacu

SEQ ID NO: 27217 - RNA, 22 nt, Homo sapiens
aucagagcccucugagcuucag

SEQ ID NO: 27218 - RNA, 21 nt, Homo sapiens
acuagacugugagcuccucga

SEQ ID NO: 27219 - RNA, 21 nt, Homo sapiens
aagacgggaggagaggaguga

SEQ ID NO: 27220 - RNA, 22 nt, Homo sapiens
aucgggaggggacugagccuga

SEQ ID NO: 27221 - RNA, 23 nt, Homo sapiens
gaaagugcccucaaggcugagug

SEQ ID NO: 27222 - RNA, 18 nt, Homo sapiens
augacaccucccugugaa

SEQ ID NO: 27223 - RNA, 22 nt, Homo sapiens
uccagcaaagggaagcgcuuuc

SEQ ID NO: 27224 - RNA, 22 nt, Homo sapiens
accucuaaaggggagcgcuuug

SEQ ID NO: 27225 - RNA, 23 nt, Homo sapiens
acacucuaaagagaagcgcuuug

SEQ ID NO: 27226 - RNA, 21 nt, Homo sapiens
gcuccaaagggaagcgcuuug

SEQ ID NO: 27227 - RNA, 21 nt, Homo sapiens
cacucugaagggaagcgcuuu

SEQ ID NO: 27228 - RNA, 21 nt, Homo sapiens
ccucuaaagagaagcgcuuuc

SEQ ID NO: 27229 - RNA, 22 nt, Homo sapiens
uccucuuuucuuagagacucac

SEQ ID NO: 27230 - RNA, 17 nt, Homo sapiens
uggaggccccagcgaga

SEQ ID NO: 27231 - RNA, 20 nt, Homo sapiens
uccccacagacccagagccg

SEQ ID NO: 27232 - RNA, 21 nt, Homo sapiens
caucaccuuccuucuccucca

SEQ ID NO: 27233 - RNA, 22 nt, Homo sapiens
aggcauaggaugacaaagggaa

SEQ ID NO: 27234 - RNA, 22 nt, Homo sapiens
aggcgaaggaugacaaagggaa

SEQ ID NO: 27235 - RNA, 22 nt, Homo sapiens
ucaggaacugccuuucucucca

SEQ ID NO: 27236 - RNA, 23 nt, Homo sapiens
cggcucugucgucgaggcgcuca

SEQ ID NO: 27237 - RNA, 22 nt, Homo sapiens
gagguuucccguguauguuuca

SEQ ID NO: 27238 - RNA, 23 nt, Homo sapiens
acucagaaggacaaguagaguuu

SEQ ID NO: 27239 - RNA, 23 nt, Homo sapiens
ugcgaacucaccacggacaaccu

SEQ ID NO: 27240 - RNA, 22 nt, Homo sapiens
uucacacugcaugcucugggua

SEQ ID NO: 27241 - RNA, 20 nt, Homo sapiens
cuggaggaagggcccagagg

SEQ ID NO: 27242 - RNA, 22 nt, Homo sapiens
gccuaagacacaggcccagaga

SEQ ID NO: 27243 - RNA, 22 nt, Homo sapiens
gcugaggcuguggggcuggagu

SEQ ID NO: 27244 - RNA, 22 nt, Homo sapiens
gauuccaauuuuuccacaucuu

SEQ ID NO: 27245 - RNA, 21 nt, Homo sapiens
caucaccuuccuucuccucca

SEQ ID NO: 27246 - RNA, 21 nt, Homo sapiens
gaccaaucgccguccccgccg

SEQ ID NO: 27247 - RNA, 22 nt, Homo sapiens
gcggucccgcggcgccccgccu

SEQ ID NO: 27248 - RNA, 23 nt, Homo sapiens
cacugugggcccucuccgcacca

SEQ ID NO: 27249 - RNA, 21 nt, Homo sapiens
gaccaaucgccguccccgccg

SEQ ID NO: 27250 - RNA, 22 nt, Homo sapiens
gcggucccgcggcgccccgccu

SEQ ID NO: 27251 - RNA, 23 nt, Homo sapiens
cacugugggcccucuccgcacca

SEQ ID NO: 27252 - RNA, 22 nt, Homo sapiens
cacauggccaaaacagagaaga

SEQ ID NO: 27253 - RNA, 21 nt, Homo sapiens
aaagagaccgguucacuguga

SEQ ID NO: 27254 - RNA, 22 nt, Homo sapiens
uagucaagugaagcagugggag

SEQ ID NO: 27255 - RNA, 22 nt, Homo sapiens
ucagccgcugucacacgcacag

SEQ ID NO: 27256 - RNA, 22 nt, Homo sapiens
cuguuccugcugaacugagcca

SEQ ID NO: 27257 - RNA, 22 nt, Homo sapiens
gaacuugcuaaaaaugcagaau

SEQ ID NO: 27258 - RNA, 22 nt, Homo sapiens
cucagagcagacgugguucuca

SEQ ID NO: 27259 - RNA, 25 nt, Homo sapiens
agcuagucaagcgcgguuguggggg

SEQ ID NO: 27260 - RNA, 25 nt, Homo sapiens
accaacggaccuacuucccuccgcc

SEQ ID NO: 27261 - RNA, 22 nt, Homo sapiens
uacagauggauaccgugcaauu

SEQ ID NO: 27262 - RNA, 25 nt, Homo sapiens
acggagcugucccaacaccaccccu

SEQ ID NO: 27263 - RNA, 22 nt, Homo sapiens
uccacauggaguugcuguuaca

SEQ ID NO: 27264 - RNA, 23 nt, Homo sapiens
acacacucacacacacacacuca

SEQ ID NO: 27265 - RNA, 22 nt, Homo sapiens
uauccacuacaccccgcugccu

SEQ ID NO: 27266 - RNA, 20 nt, Homo sapiens
cccgccgcgucgcccugggg

SEQ ID NO: 27267 - RNA, 25 nt, Homo sapiens
gaauccugguucugucccucacuag

SEQ ID NO: 27268 - RNA, 22 nt, Homo sapiens
cacgaccgacgccacgccgagu

SEQ ID NO: 27269 - RNA, 23 nt, Homo sapiens
cccaacagacauggcgguacuca

SEQ ID NO: 27270 - RNA, 21 nt, Homo sapiens
acaggauugagggggggcccu

SEQ ID NO: 27271 - RNA, 22 nt, Homo sapiens
caacaaaaucacugaugcugga

SEQ ID NO: 27272 - RNA, 23 nt, Homo sapiens
cggcucugucgucgaggcgcuca

SEQ ID NO: 27273 - RNA, 25 nt, Homo sapiens
acggagcugucccaacaccaccccu

SEQ ID NO: 27274 - RNA, 20 nt, Homo sapiens
uacugcuuccacagcucccc

SEQ ID NO: 27275 - RNA, 20 nt, Homo sapiens
ugucuccacagggcucuuua

SEQ ID NO: 27276 - RNA, 22 nt, Homo sapiens
acuccaacagggccgcgucucc

SEQ ID NO: 27277 - RNA, 21 nt, Homo sapiens
gaccaaucgccguccccgccg

SEQ ID NO: 27278 - RNA, 22 nt, Homo sapiens
gcggucccgcggcgccccgccu

SEQ ID NO: 27279 - RNA, 22 nt, Homo sapiens
acaaaguucuguagugcacuga

SEQ ID NO: 27280 - RNA, 22 nt, Homo sapiens
cuagugguccuaaacauuucac

SEQ ID NO: 27281 - RNA, 23 nt, Homo sapiens
aaaucagaaucacaccuggggga

SEQ ID NO: 27282 - RNA, 21 nt, Homo sapiens
acguggaauuuccucuauguu

SEQ ID NO: 27283 - RNA, 22 nt, Homo sapiens
gccagcuaacaauacacugccu

SEQ ID NO: 27284 - RNA, 24 nt, Homo sapiens
acgcagagcccgaaagcccccagu

SEQ ID NO: 27285 - RNA, 20 nt, Homo sapiens
uccccacagacccagagccg

SEQ ID NO: 27286 - RNA, 23 nt, Homo sapiens
aauaaauuaaauuuauauuacag

SEQ ID NO: 27287 - RNA, 23 nt, Homo sapiens
aaagucucgcucucugccccuca

SEQ ID NO: 27288 - RNA, 18 nt, Homo sapiens
gaaaugagggccagcuga

SEQ ID NO: 27289 - RNA, 23 nt, Homo sapiens
acgggugcgauuucugugugaga

SEQ ID NO: 27290 - RNA, 22 nt, Homo sapiens
aggcauaggaugacaaagggaa

SEQ ID NO: 27291 - RNA, 22 nt, Homo sapiens
aggcgaaggaugacaaagggaa

SEQ ID NO: 27292 - RNA, 22 nt, Homo sapiens
aggucucacuuuguugcccaga

SEQ ID NO: 27293 - RNA, 25 nt, Homo sapiens
aaggagcucagaagcccugcccagc

SEQ ID NO: 27294 - RNA, 19 nt, Homo sapiens
ccaccucccgaguccucac

SEQ ID NO: 27295 - RNA, 21 nt, Homo sapiens
ggucagaacccaucauucacu

SEQ ID NO: 27296 - RNA, 23 nt, Homo sapiens
aggaacagcagcagcccgggccg

SEQ ID NO: 27297 - RNA, 22 nt, Homo sapiens
accagguuccaccccagcaggc

SEQ ID NO: 27298 - RNA, 23 nt, Homo sapiens
guucuguccuggaagaacauacu

SEQ ID NO: 27299 - RNA, 22 nt, Homo sapiens
cucccuucuuuccucccgucuu

SEQ ID NO: 27300 - RNA, 23 nt, Homo sapiens
uccaucaucaaaacaaauggagu

SEQ ID NO: 27301 - RNA, 23 nt, Homo sapiens
acucaccgacagcguugaauguu

SEQ ID NO: 27302 - RNA, 23 nt, Homo sapiens
acccaccgacagcaaugaauguu

SEQ ID NO: 27303 - RNA, 22 nt, Homo sapiens
acucaccgacagguugaauguu

SEQ ID NO: 27304 - RNA, 23 nt, Homo sapiens
acccaccgacaacaaugaauguu

SEQ ID NO: 27305 - RNA, 22 nt, Homo sapiens
aagaagugcaccgcgaauguuu

SEQ ID NO: 27306 - RNA, 21 nt, Homo sapiens
gaccaaucgccguccccgccg

SEQ ID NO: 27307 - RNA, 22 nt, Homo sapiens
gcggucccgcggcgccccgccu

SEQ ID NO: 27308 - RNA, 22 nt, Homo sapiens
ugcuguuagcccuagccccgca

SEQ ID NO: 27309 - RNA, 22 nt, Homo sapiens
cugggggcggcacaggggcuca

SEQ ID NO: 27310 - RNA, 22 nt, Homo sapiens
cagaagugggccgggcacaggg

SEQ ID NO: 27311 - RNA, 20 nt, Homo sapiens
uccgccugucugaacaguga

SEQ ID NO: 27312 - RNA, 21 nt, Homo sapiens
uggggauuacacuucaacagg

SEQ ID NO: 27313 - RNA, 22 nt, Homo sapiens
augcccuuuuaacauugcacug

SEQ ID NO: 27314 - RNA, 22 nt, Homo sapiens
augcccuuucaucauugcacug

SEQ ID NO: 27315 - RNA, 22 nt, Homo sapiens
acaaaguucuguagugcacuga

SEQ ID NO: 27316 - RNA, 22 nt, Homo sapiens
acaaaguucugugaugcacuga

SEQ ID NO: 27317 - RNA, 21 nt, Homo sapiens
ccaaguucugucaugcacuga

SEQ ID NO: 27318 - RNA, 22 nt, Homo sapiens
uccacauggaguugcuguuaca

SEQ ID NO: 27319 - RNA, 22 nt, Homo sapiens
uagucaagugaagcagugggag

SEQ ID NO: 27320 - RNA, 23 nt, Homo sapiens
ucaguuuugcauagauuugcaca

SEQ ID NO: 27321 - RNA, 23 nt, Homo sapiens
ucaguuuugcauggauuugcaca

SEQ ID NO: 27322 - RNA, 23 nt, Homo sapiens
gcuuugacaauacuauugcacug

SEQ ID NO: 27323 - RNA, 23 nt, Homo sapiens
gcuuugacaauaucauugcacug

SEQ ID NO: 27324 - RNA, 23 nt, Homo sapiens
gcgcccaauuaaugucuguugau

SEQ ID NO: 27325 - RNA, 23 nt, Homo sapiens
ugcgaacucaccacggacaaccu

SEQ ID NO: 27326 - RNA, 23 nt, Homo sapiens
acccuauaagcaauauugcacua

SEQ ID NO: 27327 - RNA, 21 nt, Homo sapiens
aaacaucacugcaagucuuaa

SEQ ID NO: 27328 - RNA, 21 nt, Homo sapiens
uucacuccaaaaggugcaaaa

SEQ ID NO: 27329 - RNA, 21 nt, Homo sapiens
cugaaaccaaguaugggucgc

SEQ ID NO: 27330 - RNA, 23 nt, Homo sapiens
agacaaggcccacccgugcaaac

SEQ ID NO: 27331 - RNA, 22 nt, Homo sapiens
uggggacccucccugaaccaag

SEQ ID NO: 27332 - RNA, 21 nt, Homo sapiens
cugcugggccacaacguggga

SEQ ID NO: 27333 - RNA, 20 nt, Homo sapiens
gcaagacaucacaagacucu

SEQ ID NO: 27334 - RNA, 22 nt, Homo sapiens
caaacaccauugucacacucca

SEQ ID NO: 27335 - RNA, 22 nt, Homo sapiens
ucccucacacagaauuccagaa

SEQ ID NO: 27336 - RNA, 23 nt, Homo sapiens
cccaacagacauggcgguacuca

SEQ ID NO: 27337 - RNA, 23 nt, Homo sapiens
acacucuaaagagaagcgcuuug

SEQ ID NO: 27338 - RNA, 23 nt, Homo sapiens
ucucgugacaugaugauccccga

SEQ ID NO: 27339 - RNA, 21 nt, Homo sapiens
acuggcugagucaggacuagc

SEQ ID NO: 27340 - RNA, 19 nt, Homo sapiens
guccugaauuccgcagccu

SEQ ID NO: 27341 - RNA, 25 nt, Homo sapiens
acggagcugucccaacaccaccccu

SEQ ID NO: 27342 - RNA, 23 nt, Homo sapiens
cuccagccccuccagggcuuccu

SEQ ID NO: 27343 - RNA, 24 nt, Homo sapiens
cacccccagagccucagcucccca

SEQ ID NO: 27344 - RNA, 22 nt, Homo sapiens
caaacaccauugucacacucca

SEQ ID NO: 27345 - RNA, 23 nt, Homo sapiens
cacugugggcccucuccgcacca

SEQ ID NO: 27346 - RNA, 21 nt, Homo sapiens
gaccaaucgccguccccgccg

SEQ ID NO: 27347 - RNA, 22 nt, Homo sapiens
gcggucccgcggcgccccgccu

SEQ ID NO: 27348 - RNA, 22 nt, Homo sapiens
gcacaaaucuccagaccaccca

SEQ ID NO: 27349 - RNA, 18 nt, Homo sapiens
aucacauucaccucccug

SEQ ID NO: 27350 - RNA, 22 nt, Homo sapiens
gaggcucagaauggcucaggag

SEQ ID NO: 27351 - RNA, 21 nt, Homo sapiens
acaggauugagggggggcccu

SEQ ID NO: 27352 - RNA, 22 nt, Homo sapiens
ugcuguuagcccuagccccgca

SEQ ID NO: 27353 - RNA, 22 nt, Homo sapiens
cggugagcacccggccccugcg

SEQ ID NO: 27354 - RNA, 22 nt, Homo sapiens
aagagggagacccaggcucgga

SEQ ID NO: 27355 - RNA, 22 nt, Homo sapiens
cagcugguugaaggggaccaaa

SEQ ID NO: 27356 - RNA, 21 nt, Homo sapiens
cuggaggacggcaacagucag

SEQ ID NO: 27357 - RNA, 20 nt, Homo sapiens
cccugcgccaucuccucuac

SEQ ID NO: 27358 - RNA, 21 nt, Homo sapiens
gcagaacuuagccacugugaa

SEQ ID NO: 27359 - RNA, 23 nt, Homo sapiens
gggagugaagacacggagccaga

SEQ ID NO: 27360 - RNA, 22 nt, Homo sapiens
aacccauggaauucaguucuca

SEQ ID NO: 27361 - RNA, 22 nt, Homo sapiens
agugaauucuaccagugccaua

SEQ ID NO: 27362 - RNA, 21 nt, Homo sapiens
aggcggcaggcacaggacugg

SEQ ID NO: 27363 - RNA, 22 nt, Homo sapiens
uagucaagugaagcagugggag

SEQ ID NO: 27364 - RNA, 22 nt, Homo sapiens
ucagccgcugucacacgcacag

SEQ ID NO: 27365 - RNA, 22 nt, Homo sapiens
agcugaguguaggauguuuaca

SEQ ID NO: 27366 - RNA, 22 nt, Homo sapiens
ugcaagccuugggugugggagg

SEQ ID NO: 27367 - RNA, 22 nt, Homo sapiens
gguucaguuguucaaccaguua

SEQ ID NO: 27368 - RNA, 21 nt, Homo sapiens
guaaugggaccuuccucuuug

SEQ ID NO: 27369 - RNA, 23 nt, Homo sapiens
uguaggcuggggauaaaugaaua

SEQ ID NO: 27370 - RNA, 22 nt, Homo sapiens
cacauggccaaaacagagaaga

SEQ ID NO: 27371 - RNA, 22 nt, Homo sapiens
cucauccgauguacaauaauuu

SEQ ID NO: 27372 - RNA, 23 nt, Homo sapiens
cacaaauucgguucuacagggua

SEQ ID NO: 27373 - RNA, 18 nt, Homo sapiens
gaaaugagggccagcuga

SEQ ID NO: 27374 - RNA, 23 nt, Homo sapiens
ucucacccagguagcaaggauua

SEQ ID NO: 27375 - RNA, 22 nt, Homo sapiens
aguccagauucugugcccacca

SEQ ID NO: 27376 - RNA, 22 nt, Homo sapiens
cuggagagacaaggggaagagg

SEQ ID NO: 27377 - RNA, 22 nt, Homo sapiens
gcacaaaucuccagaccaccca

SEQ ID NO: 27378 - RNA, 22 nt, Homo sapiens
ugaauuacuuuguaaaccacca

SEQ ID NO: 27379 - RNA, 21 nt, Homo sapiens
uggaaaccaagagugggucgc

SEQ ID NO: 27380 - RNA, 21 nt, Homo sapiens
cugaaaccaaguaugggucgc

SEQ ID NO: 27381 - RNA, 22 nt, Homo sapiens
cuggagagacaaggggaagagg

SEQ ID NO: 27382 - RNA, 20 nt, Homo sapiens
cccugcgccaucuccucuac

SEQ ID NO: 27383 - RNA, 21 nt, Homo sapiens
gaccaaucgccguccccgccg

SEQ ID NO: 27384 - RNA, 23 nt, Homo sapiens
aaagucucgcucucugccccuca

SEQ ID NO: 27385 - RNA, 22 nt, Homo sapiens
gcggucccgcggcgccccgccu

SEQ ID NO: 27386 - RNA, 22 nt, Homo sapiens
ugcuguuagcccuagccccgca

SEQ ID NO: 27387 - RNA, 22 nt, Homo sapiens
ggcagagagucagagcgcggau

SEQ ID NO: 27388 - RNA, 22 nt, Homo sapiens
augcccuuucaucauugcacug

SEQ ID NO: 27389 - RNA, 22 nt, Homo sapiens
uaaaugaauucaauuuccuucu

SEQ ID NO: 27390 - RNA, 23 nt, Homo sapiens
acacucuaaagagaagcgcuuug

SEQ ID NO: 27391 - RNA, 21 nt, Homo sapiens
agaaaguacuucccucuggag

SEQ ID NO: 27392 - RNA, 21 nt, Homo sapiens
agaaagugcaucccucuggag

SEQ ID NO: 27393 - RNA, 22 nt, Homo sapiens
caacaaaaucacugaugcugga

SEQ ID NO: 27394 - RNA, 22 nt, Homo sapiens
ugcuguuagcccuagccccgca

SEQ ID NO: 27395 - RNA, 22 nt, Homo sapiens
ugaauuacuuuguaaaccacca

SEQ ID NO: 27396 - RNA, 23 nt, Homo sapiens
aaagucucgcucucugccccuca

SEQ ID NO: 27397 - RNA, 22 nt, Homo sapiens
aggaaaccagcaaguguugacg

SEQ ID NO: 27398 - RNA, 18 nt, Homo sapiens
acccucugaaaggaagca

SEQ ID NO: 27399 - RNA, 22 nt, Homo sapiens
aaagugcuucuuaccuccagau

SEQ ID NO: 27400 - RNA, 22 nt, Homo sapiens
cuggagagacaaggggaagagg

SEQ ID NO: 27401 - RNA, 22 nt, Homo sapiens
aaagugcuucuuaccuccagau

SEQ ID NO: 27402 - RNA, 24 nt, Homo sapiens
gaagucacucccaggcagcugcaa

SEQ ID NO: 27403 - RNA, 18 nt, Homo sapiens
aucacauucaccucccug

SEQ ID NO: 27404 - RNA, 22 nt, Homo sapiens
guacaaaaguaauuacaguuuu

SEQ ID NO: 27405 - RNA, 21 nt, Homo sapiens
ggcugucaauucauaggucag

SEQ ID NO: 27406 - RNA, 21 nt, Homo sapiens
gucugucaauucauaggucau

SEQ ID NO: 27407 - RNA, 23 nt, Homo sapiens
uguaggcuggggauaaaugaaua

SEQ ID NO: 27408 - RNA, 21 nt, Homo sapiens
agcuaugccagcaucuugccu

SEQ ID NO: 27409 - RNA, 23 nt, Homo sapiens
ucucacccagguagcaaggauua

SEQ ID NO: 27410 - RNA, 23 nt, Homo sapiens
aaaaugcagauuccuggacucca

SEQ ID NO: 27411 - RNA, 23 nt, Homo sapiens
cagcugcuuuugggauuccguug

SEQ ID NO: 27412 - RNA, 20 nt, Homo sapiens
acagcaaggagggcaggagg

SEQ ID NO: 27413 - RNA, 23 nt, Homo sapiens
cuccagccccuccagggcuuccu

SEQ ID NO: 27414 - RNA, 21 nt, Homo sapiens
ccgugguucuacccuguggua

SEQ ID NO: 27415 - RNA, 22 nt, Homo sapiens
gcuggguggagaagguggugaa

SEQ ID NO: 27416 - RNA, 22 nt, Homo sapiens
cacgaccgacgccacgccgagu

SEQ ID NO: 27417 - RNA, 22 nt, Homo sapiens
aaaguaacugcaguuuuugcua

SEQ ID NO: 27418 - RNA, 22 nt, Homo sapiens
acuucaaggaucuuaaacuuug

SEQ ID NO: 27419 - RNA, 22 nt, Homo sapiens
cagacuccgguggaaugaagga

SEQ ID NO: 27420 - RNA, 22 nt, Homo sapiens
ccucaggcacggccgggccacc

SEQ ID NO: 27421 - RNA, 24 nt, Homo sapiens
gaaagugcauagaauucugucugg

SEQ ID NO: 27422 - RNA, 22 nt, Homo sapiens
cagcugguugaaggggaccaaa

SEQ ID NO: 27423 - RNA, 22 nt, Homo sapiens
uagcugguugaaggggaccaaa

SEQ ID NO: 27424 - RNA, 22 nt, Homo sapiens
ugagccacugugccuggccuga

SEQ ID NO: 27425 - RNA, 21 nt, Homo sapiens
acccaguagccagauguagcu

SEQ ID NO: 27426 - RNA, 21 nt, Homo sapiens
gagcugcauccuggcuccggg

SEQ ID NO: 27427 - RNA, 22 nt, Homo sapiens
cuggagagacaaggggaagagg

SEQ ID NO: 27428 - RNA, 23 nt, Homo sapiens
aggaacagcagcagcccgggccg

SEQ ID NO: 27429 - RNA, 21 nt, Homo sapiens
acaggauugagggggggcccu

SEQ ID NO: 27430 - RNA, 22 nt, Homo sapiens
ccucauggaaggguuccccacu

SEQ ID NO: 27431 - RNA, 24 nt, Homo sapiens
cagaaagugcuuucuuuuggagaa

SEQ ID NO: 27432 - RNA, 22 nt, Homo sapiens
uccagcaaagggaagcgcuuuc

SEQ ID NO: 27433 - RNA, 22 nt, Homo sapiens
accucuaaaggggagcgcuuug

SEQ ID NO: 27434 - RNA, 23 nt, Homo sapiens
acacucuaaagagaagcgcuuug

SEQ ID NO: 27435 - RNA, 21 nt, Homo sapiens
gcuccaaagggaagcgcuuug

SEQ ID NO: 27436 - RNA, 21 nt, Homo sapiens
cacucugaagggaagcgcuuu

SEQ ID NO: 27437 - RNA, 21 nt, Homo sapiens
ccucuaaagagaagcgcuuuc

SEQ ID NO: 27438 - RNA, 22 nt, Homo sapiens
aacacucuaaaaggaggcacuu

SEQ ID NO: 27439 - RNA, 25 nt, Homo sapiens
acggagcugucccaacaccaccccu

SEQ ID NO: 27440 - RNA, 22 nt, Homo sapiens
gcggucccgcggcgccccgccu

SEQ ID NO: 27441 - RNA, 23 nt, Homo sapiens
cuccagccccuccagggcuuccu

SEQ ID NO: 27442 - RNA, 22 nt, Homo sapiens
ugcuguuagcccuagccccgca

SEQ ID NO: 27443 - RNA, 21 nt, Homo sapiens
caucaccuuccuucuccucca

SEQ ID NO: 27444 - RNA, 20 nt, Homo sapiens
uacugcuuccacagcucccc

SEQ ID NO: 27445 - RNA, 24 nt, Homo sapiens
cacccccagagccucagcucccca

SEQ ID NO: 27446 - RNA, 22 nt, Homo sapiens
cacauggccaaaacagagaaga

SEQ ID NO: 27447 - RNA, 23 nt, Homo sapiens
ucacauaggaaugaaaagccaua

SEQ ID NO: 27448 - RNA, 23 nt, Homo sapiens
ggaagccaucaagucgcugcagg

SEQ ID NO: 27449 - RNA, 23 nt, Homo sapiens
ggaagccaucaagucgcugcagg

SEQ ID NO: 27450 - RNA, 22 nt, Homo sapiens
ugaagaagggggggaagggcgu

SEQ ID NO: 27451 - RNA, 17 nt, Homo sapiens
gacagccucucccccac

SEQ ID NO: 27452 - RNA, 23 nt, Homo sapiens
aaaaugcagauuccuggacucca

SEQ ID NO: 27453 - RNA, 23 nt, Homo sapiens
gggagugaagacacggagccaga

SEQ ID NO: 27454 - RNA, 21 nt, Homo sapiens
acuagacugugagcuccucga

SEQ ID NO: 27455 - RNA, 25 nt, Homo sapiens
agcuagucaagcgcgguuguggggg

SEQ ID NO: 27456 - RNA, 23 nt, Homo sapiens
cggcucugucgucgaggcgcuca

SEQ ID NO: 27457 - RNA, 23 nt, Homo sapiens
aaaucagaaucacaccuggggga

SEQ ID NO: 27458 - RNA, 22 nt, Homo sapiens
uacagauggauaccgugcaauu

SEQ ID NO: 27459 - RNA, 25 nt, Homo sapiens
acggagcugucccaacaccaccccu

SEQ ID NO: 27460 - RNA, 23 nt, Homo sapiens
gucagaccccgagggguccucgc

SEQ ID NO: 27461 - RNA, 24 nt, Homo sapiens
acgcagagcccgaaagcccccagu

SEQ ID NO: 27462 - RNA, 21 nt, Homo sapiens
caucaccuuccuucuccucca

SEQ ID NO: 27463 - RNA, 24 nt, Homo sapiens
acugcaggcuccagcuuccaggcu

SEQ ID NO: 27464 - RNA, 24 nt, Homo sapiens
acugcuggucuucagucagggcca

SEQ ID NO: 27465 - RNA, 22 nt, Homo sapiens
cacugguacaaggguugggaga

SEQ ID NO: 27466 - RNA, 21 nt, Homo sapiens
ugcaaacccugcaugugggag

SEQ ID NO: 27467 - RNA, 23 nt, Homo sapiens
cccaacagacauggcgguacuca

SEQ ID NO: 27468 - RNA, 22 nt, Homo sapiens
ugagccacugugccuggccuga

SEQ ID NO: 27469 - RNA, 22 nt, Homo sapiens
uaaccgauuucagauggugcua

SEQ ID NO: 27470 - RNA, 23 nt, Homo sapiens
aacacugauuucaaauggugcua

SEQ ID NO: 27471 - RNA, 22 nt, Homo sapiens
uaaccgauuucaaauggugcua

SEQ ID NO: 27472 - RNA, 22 nt, Homo sapiens
agcugaguguaggauguuuaca

SEQ ID NO: 27473 - RNA, 21 nt, Homo sapiens
aucugcacugucagcacuuua

SEQ ID NO: 27474 - RNA, 23 nt, Homo sapiens
gcuuugacaauaucauugcacug

SEQ ID NO: 27475 - RNA, 22 nt, Homo sapiens
acggaagggcagagagggccag

SEQ ID NO: 27476 - RNA, 21 nt, Homo sapiens
uucuaggauaggcccaggggc

SEQ ID NO: 27477 - RNA, 23 nt, Homo sapiens
aaaucagaaucacaccuggggga

SEQ ID NO: 27478 - RNA, 23 nt, Homo sapiens
caugagugacgcccucuggagua

SEQ ID NO: 27479 - RNA, 24 nt, Homo sapiens
acacucuaaagggaagcacuuugu

SEQ ID NO: 27480 - RNA, 22 nt, Homo sapiens
acucuaaagggaagcacuuugu

SEQ ID NO: 27481 - RNA, 24 nt, Homo sapiens
gaggugacucuauccuaugucuuu

SEQ ID NO: 27482 - RNA, 23 nt, Homo sapiens
aaccaagaccccggagaucccag

SEQ ID NO: 27483 - RNA, 22 nt, Homo sapiens
ucaguuuccucugcaaacaguu

SEQ ID NO: 27484 - RNA, 21 nt, Homo sapiens
gccaauauuucugugcugcua

SEQ ID NO: 27485 - RNA, 22 nt, Homo sapiens
cacucagcaccaggauauuguu

SEQ ID NO: 27486 - RNA, 22 nt, Homo sapiens
ucaguuuccucugcaaacaguu

SEQ ID NO: 27487 - RNA, 21 nt, Homo sapiens
acaugguuagaucaagcacaa

SEQ ID NO: 27488 - RNA, 22 nt, Homo sapiens
aaagugcuucuuaccuccagau

SEQ ID NO: 27489 - RNA, 21 nt, Homo sapiens
acaaaccacagugugcugcug

SEQ ID NO: 27490 - RNA, 23 nt, Homo sapiens
cccagcuagauuguaagcuccuu

SEQ ID NO: 27491 - RNA, 22 nt, Homo sapiens
guaccccuggagauucugauaa

SEQ ID NO: 27492 - RNA, 21 nt, Homo sapiens
ugacugacagcuuuuugagua

SEQ ID NO: 27493 - RNA, 22 nt, Homo sapiens
ucaguuuccucugcaaacaguu

SEQ ID NO: 27494 - RNA, 22 nt, Homo sapiens
aaagugcuucuuaccuccagau

SEQ ID NO: 27495 - RNA, 24 nt, Homo sapiens
ugggagaaccucccugcuucugcu

SEQ ID NO: 27496 - RNA, 22 nt, Homo sapiens
aagaagugcaccauguuuguuu

SEQ ID NO: 27497 - RNA, 20 nt, Homo sapiens
uccccacagacccagagccg

SEQ ID NO: 27498 - RNA, 21 nt, Homo sapiens
cacaaccucaguguuuccagg

SEQ ID NO: 27499 - RNA, 20 nt, Homo sapiens
cccugcgccaucuccucuac

SEQ ID NO: 27500 - RNA, 21 nt, Homo sapiens
acuccaaagggaagcgccuuc

SEQ ID NO: 27501 - RNA, 22 nt, Homo sapiens
cgcucuaaagggaagcgccuuc

SEQ ID NO: 27502 - RNA, 19 nt, Homo sapiens
guugggaucacaggcgccc

SEQ ID NO: 27503 - RNA, 23 nt, Homo sapiens
aaucuacuuucuuugcucauccu

SEQ ID NO: 27504 - RNA, 22 nt, Homo sapiens
aaccacuuucuuugcucauccg

SEQ ID NO: 27505 - RNA, 22 nt, Homo sapiens
agcgggacuuugagggccaguu

SEQ ID NO: 27506 - RNA, 21 nt, Homo sapiens
ccaaccaaugaaagaaugcuu

SEQ ID NO: 27507 - RNA, 20 nt, Homo sapiens
cuggggaaaaggguggcacg

SEQ ID NO: 27508 - RNA, 22 nt, Homo sapiens
cagcugguugaaggggaccaaa

SEQ ID NO: 27509 - RNA, 23 nt, Homo sapiens
uccauaaaguaggaaacacuaca

SEQ ID NO: 27510 - RNA, 25 nt, Homo sapiens
agcuagucaagcgcgguuguggggg

SEQ ID NO: 27511 - RNA, 22 nt, Homo sapiens
acaaccagcuaagacacugcca

SEQ ID NO: 27512 - RNA, 23 nt, Homo sapiens
gcaaucagcuaacuacacugccu

SEQ ID NO: 27513 - RNA, 23 nt, Homo sapiens
aaaucagaaucacaccuggggga

SEQ ID NO: 27514 - RNA, 22 nt, Homo sapiens
accagcuaacaauacacugcca

SEQ ID NO: 27515 - RNA, 22 nt, Homo sapiens
gccagcuaacaauacacugccu

SEQ ID NO: 27516 - RNA, 21 nt, Homo sapiens
gaccaagaaauagccuuucaa

SEQ ID NO: 27517 - RNA, 20 nt, Homo sapiens
gcaaaugguacagcuacuuu

SEQ ID NO: 27518 - RNA, 21 nt, Homo sapiens
acugaucuagagaacacaaga

SEQ ID NO: 27519 - RNA, 22 nt, Homo sapiens
cucagagcagacgugguucuca

SEQ ID NO: 27520 - RNA, 20 nt, Homo sapiens
agagaugagagaaacacccu

SEQ ID NO: 27521 - RNA, 24 nt, Homo sapiens
acgcagagcccgaaagcccccagu

SEQ ID NO: 27522 - RNA, 19 nt, Homo sapiens
accagugcccugcacacuu

SEQ ID NO: 27523 - RNA, 23 nt, Homo sapiens
acccuauaagcaauauugcacua

SEQ ID NO: 27524 - RNA, 22 nt, Homo sapiens
ucaggaacugccuuucucucca

SEQ ID NO: 27525 - RNA, 21 nt, Homo sapiens
ugcaaugcaacuacaaugcac

SEQ ID NO: 27526 - RNA, 23 nt, Homo sapiens
uggcccugacacgugguacugga

SEQ ID NO: 27527 - RNA, 22 nt, Homo sapiens
aggucucacuuuguugcccaga

SEQ ID NO: 27528 - RNA, 25 nt, Homo sapiens
aaggagcucagaagcccugcccagc

SEQ ID NO: 27529 - RNA, 22 nt, Homo sapiens
acacacccacgcgagccggaaa

SEQ ID NO: 27530 - RNA, 27 nt, Homo sapiens
auugcguucgaagugucgaugaucaau

SEQ ID NO: 27531 - RNA, 20 nt, Homo sapiens
acagcaaggagggcaggagg

SEQ ID NO: 27532 - RNA, 23 nt, Homo sapiens
aaagucucgcucucugccccuca

SEQ ID NO: 27533 - RNA, 21 nt, Homo sapiens
cucccccacugcagcuggcac

SEQ ID NO: 27534 - RNA, 21 nt, Homo sapiens
ccccucccagccucccugcca

SEQ ID NO: 27535 - RNA, 17 nt, Homo sapiens
gacagccucucccccac

SEQ ID NO: 27536 - RNA, 23 nt, Homo sapiens
gggagugaagacacggagccaga

SEQ ID NO: 27537 - RNA, 22 nt, Homo sapiens
ucaggaacugccuuucucucca

SEQ ID NO: 27538 - RNA, 22 nt, Homo sapiens
cggugagcacccggccccugcg

SEQ ID NO: 27539 - RNA, 22 nt, Homo sapiens
gaaccuaucuccccucuggacc

SEQ ID NO: 27540 - RNA, 22 nt, Homo sapiens
agcugaguguaggauguuuaca

SEQ ID NO: 27541 - RNA, 22 nt, Homo sapiens
auggcaguggaguuagugauug

SEQ ID NO: 27542 - RNA, 23 nt, Homo sapiens
aaaucagaaucacaccuggggga

SEQ ID NO: 27543 - RNA, 22 nt, Homo sapiens
gaauucaucacggccagccucu

SEQ ID NO: 27544 - RNA, 21 nt, Homo sapiens
ggacuauagaacuuucccccu

SEQ ID NO: 27545 - RNA, 24 nt, Homo sapiens
acgcagagcccgaaagcccccagu

SEQ ID NO: 27546 - RNA, 22 nt, Homo sapiens
aaagugcuucuuaccuccagau

SEQ ID NO: 27547 - RNA, 22 nt, Homo sapiens
caaacaccauugucacacucca

SEQ ID NO: 27548 - RNA, 23 nt, Homo sapiens
gggagugaagacacggagccaga

SEQ ID NO: 27549 - RNA, 23 nt, Homo sapiens
gggagugaagacacggagccaga

SEQ ID NO: 27550 - RNA, 23 nt, Homo sapiens
cuaucugcacuagaugcaccuua

SEQ ID NO: 27551 - RNA, 21 nt, Homo sapiens
gaccaaucgccguccccgccg

SEQ ID NO: 27552 - RNA, 23 nt, Homo sapiens
cccaacagacauggcgguacuca

SEQ ID NO: 27553 - RNA, 22 nt, Homo sapiens
cagaagugggccgggcacaggg

SEQ ID NO: 27554 - RNA, 22 nt, Homo sapiens
cagaagugggccgggcacaggg

SEQ ID NO: 27555 - RNA, 22 nt, Homo sapiens
ugagccacugugccuggccuga

SEQ ID NO: 27556 - RNA, 22 nt, Homo sapiens
aggaaaccagcaaguguugacg

SEQ ID NO: 27557 - RNA, 22 nt, Homo sapiens
gcggucccgcggcgccccgccu

SEQ ID NO: 27558 - RNA, 22 nt, Homo sapiens
ucggucccucgggccagggcag

SEQ ID NO: 27559 - RNA, 21 nt, Homo sapiens
ggggagcgggggcccugccuu

SEQ ID NO: 27560 - RNA, 23 nt, Homo sapiens
aaaaugcagauuccuggacucca

SEQ ID NO: 27561 - RNA, 23 nt, Homo sapiens
caugagugacgcccucuggagua

SEQ ID NO: 27562 - RNA, 22 nt, Homo sapiens
ucagaccgagacaagugcaaug

SEQ ID NO: 27563 - RNA, 21 nt, Homo sapiens
aguagugcuuucuacuuuaug

SEQ ID NO: 27564 - RNA, 22 nt, Homo sapiens
cagacuccgguggaaugaagga

SEQ ID NO: 27565 - RNA, 21 nt, Homo sapiens
gaccaaucgccguccccgccg

SEQ ID NO: 27566 - RNA, 23 nt, Homo sapiens
gaaacccagcagacaauguagcu

SEQ ID NO: 27567 - RNA, 23 nt, Homo sapiens
acugaggggccucagaccgagcu

SEQ ID NO: 27568 - RNA, 19 nt, Homo sapiens
auuuugguacagcagcuca

SEQ ID NO: 27569 - RNA, 22 nt, Homo sapiens
acaguggucaucgagugacaca

SEQ ID NO: 27570 - RNA, 19 nt, Homo sapiens
gccucagaggcagcugcuu

SEQ ID NO: 27571 - RNA, 22 nt, Homo sapiens
gcggucccgcggcgccccgccu

SEQ ID NO: 27572 - RNA, 22 nt, Homo sapiens
uauccacuacaccccgcugccu

SEQ ID NO: 27573 - RNA, 19 nt, Homo sapiens
auuuugguacagcagcuca

SEQ ID NO: 27574 - RNA, 22 nt, Homo sapiens
auccuucuacaaauucacccau

SEQ ID NO: 27575 - RNA, 22 nt, Homo sapiens
aagauguggaccauauuacaua

SEQ ID NO: 27576 - RNA, 21 nt, Homo sapiens
auccuguacugagcugccccg

SEQ ID NO: 27577 - RNA, 19 nt, Homo sapiens
gggaaacguaugucaaccu

SEQ ID NO: 27578 - RNA, 22 nt, Homo sapiens
ugugggugugugcaugagcgug

SEQ ID NO: 27579 - RNA, 21 nt, Homo sapiens
cugaggagagaggaggugggg

SEQ ID NO: 27580 - RNA, 22 nt, Homo sapiens
gcaaaaguaauugccaguuuug

SEQ ID NO: 27581 - RNA, 22 nt, Homo sapiens
ugcaaaaguagucucaguuuuu

SEQ ID NO: 27582 - RNA, 19 nt, Homo sapiens
aaaaguaauuacaguuuuu

SEQ ID NO: 27583 - RNA, 18 nt, Homo sapiens
cccccaccaccacgcccg

SEQ ID NO: 27584 - RNA, 22 nt, Homo sapiens
cacaucucacuguagccucaaa

SEQ ID NO: 27585 - RNA, 22 nt, Homo sapiens
aacccauggaauucaguucuca

SEQ ID NO: 27586 - RNA, 22 nt, Homo sapiens
agccuauggaauucaguucuca

SEQ ID NO: 27587 - RNA, 22 nt, Homo sapiens
gaaccuaucuccccucuggacc

SEQ ID NO: 27588 - RNA, 23 nt, Homo sapiens
guaaauagagguuuaauuaacac

SEQ ID NO: 27589 - RNA, 22 nt, Homo sapiens
cgggacguccagacucaacucu

SEQ ID NO: 27590 - RNA, 22 nt, Homo sapiens
ggaucccugggaccauaccuag

SEQ ID NO: 27591 - RNA, 23 nt, Homo sapiens
ucaacgggagugaucgugucauu

SEQ ID NO: 27592 - RNA, 22 nt, Homo sapiens
gaauucaucacggccagccucu

SEQ ID NO: 27593 - RNA, 23 nt, Homo sapiens
acacucuaaagagaagcgcuuug

SEQ ID NO: 27594 - RNA, 21 nt, Homo sapiens
agaaaguacuucccucuggag

SEQ ID NO: 27595 - RNA, 21 nt, Homo sapiens
agaaagugcaucccucuggag

SEQ ID NO: 27596 - RNA, 21 nt, Homo sapiens
acuuuccaggauucauuaacu

SEQ ID NO: 27597 - RNA, 22 nt, Homo sapiens
acaucaucgcauauugacacaa

SEQ ID NO: 27598 - RNA, 19 nt, Homo sapiens
ucccacaggaagcagacac

SEQ ID NO: 27599 - RNA, 24 nt, Homo sapiens
acugcaggcuccagcuuccaggcu

SEQ ID NO: 27600 - RNA, 22 nt, Homo sapiens
ggcagagagucagagcgcggau

SEQ ID NO: 27601 - RNA, 21 nt, Homo sapiens
ccccucccagccucccugcca

SEQ ID NO: 27602 - RNA, 21 nt, Homo sapiens
acaggauugagggggggcccu

SEQ ID NO: 27603 - RNA, 21 nt, Homo sapiens
gcggaacuuagccacugugaa

SEQ ID NO: 27604 - RNA, 22 nt, Homo sapiens
uucacacugcaugcucugggua

SEQ ID NO: 27605 - RNA, 19 nt, Homo sapiens
guccugaauuccgcagccu

SEQ ID NO: 27606 - RNA, 22 nt, Homo sapiens
acaaaauccacaauuacuuuug

SEQ ID NO: 27607 - RNA, 22 nt, Homo sapiens
aacagcacaaacuacuaccuca

SEQ ID NO: 27608 - RNA, 21 nt, Homo sapiens
cugaggagagaggaggugggg

SEQ ID NO: 27609 - RNA, 22 nt, Homo sapiens
aggucucacuuuguugcccaga

SEQ ID NO: 27610 - RNA, 20 nt, Homo sapiens
cccgccgcgucgcccugggg

SEQ ID NO: 27611 - RNA, 22 nt, Homo sapiens
uccacauggaguugcuguuaca

SEQ ID NO: 27612 - RNA, 22 nt, Homo sapiens
aaagagguuaaccagguguguu

SEQ ID NO: 27613 - RNA, 22 nt, Homo sapiens
ugaauccuugaauagguguguu

SEQ ID NO: 27614 - RNA, 22 nt, Homo sapiens
aguccagauucugugcccacca

SEQ ID NO: 27615 - RNA, 22 nt, Homo sapiens
gcacacaauaaauguuugcuga

SEQ ID NO: 27616 - RNA, 19 nt, Homo sapiens
gccugcugacaccgugccu

SEQ ID NO: 27617 - RNA, 25 nt, Homo sapiens
aaggagcucagaagcccugcccagc

SEQ ID NO: 27618 - RNA, 22 nt, Homo sapiens
gcacauguucugcggcccacca

SEQ ID NO: 27619 - RNA, 22 nt, Homo sapiens
cugcucaaacccuccaaugacu

SEQ ID NO: 27620 - RNA, 22 nt, Homo sapiens
uuucaguuaucaaucugucaca

SEQ ID NO: 27621 - RNA, 18 nt, Homo sapiens
auucaaucuacugccuca

SEQ ID NO: 27622 - RNA, 22 nt, Homo sapiens
ugcuguuagcccuagccccgca

SEQ ID NO: 27623 - RNA, 21 nt, Homo sapiens
cugaggagagaggaggugggg

SEQ ID NO: 27624 - RNA, 20 nt, Homo sapiens
cucaaagcaaacccugcaga

SEQ ID NO: 27625 - RNA, 20 nt, Homo sapiens
cucaaagcaaacccugcaga

SEQ ID NO: 27626 - RNA, 23 nt, Homo sapiens
gggagugaagacacggagccaga

SEQ ID NO: 27627 - RNA, 22 nt, Homo sapiens
agcugaguguaggauguuuaca

SEQ ID NO: 27628 - RNA, 18 nt, Homo sapiens
aucacauucaccucccug

SEQ ID NO: 27629 - RNA, 19 nt, Homo sapiens
accagugcccugcacacuu

SEQ ID NO: 27630 - RNA, 23 nt, Homo sapiens
caugagugacgcccucuggagua

SEQ ID NO: 27631 - RNA, 22 nt, Homo sapiens
ucaggaacugccuuucucucca

SEQ ID NO: 27632 - RNA, 23 nt, Homo sapiens
aggaacagcagcagcccgggccg

SEQ ID NO: 27633 - RNA, 22 nt, Homo sapiens
caaacaccauugucacacucca

SEQ ID NO: 27634 - RNA, 22 nt, Homo sapiens
uaaaugaauucaauuuccuucu

SEQ ID NO: 27635 - RNA, 20 nt, Homo sapiens
aagcagaaaaaggcaaacga

SEQ ID NO: 27636 - RNA, 22 nt, Homo sapiens
agaaagcgcuuuccuuuguaga

SEQ ID NO: 27637 - RNA, 18 nt, Homo sapiens
cagcagccuccuucucaa

SEQ ID NO: 27638 - RNA, 23 nt, Homo sapiens
ucacauaggaaugaaaagccaua

SEQ ID NO: 27639 - RNA, 23 nt, Homo sapiens
ucucugcaggccgugugcuuugc

SEQ ID NO: 27640 - RNA, 22 nt, Homo sapiens
aaucagucucauugcuuuauaa

SEQ ID NO: 27641 - RNA, 23 nt, Homo sapiens
acgggugcgauuucugugugaga

SEQ ID NO: 27642 - RNA, 22 nt, Homo sapiens
cucccuucuuuccucccgucuu

SEQ ID NO: 27643 - RNA, 23 nt, Homo sapiens
gaaagugcccucaaggcugagug

SEQ ID NO: 27644 - RNA, 20 nt, Homo sapiens
gaaagggcuucccuuuguag

SEQ ID NO: 27645 - RNA, 22 nt, Homo sapiens
gagaaagugcuucccuuuguag

SEQ ID NO: 27646 - RNA, 21 nt, Homo sapiens
acuuuccaggauucauuaacu

SEQ ID NO: 27647 - RNA, 23 nt, Homo sapiens
aggagaaggcaccaugggauuua

SEQ ID NO: 27648 - RNA, 22 nt, Homo sapiens
uggugauucacaaagaaaucca

SEQ ID NO: 27649 - RNA, 22 nt, Homo sapiens
uucacacugcaugcucugggua

SEQ ID NO: 27650 - RNA, 23 nt, Homo sapiens
cacugugggcccucuccgcacca

SEQ ID NO: 27651 - RNA, 23 nt, Homo sapiens
agcagcauuguacagggcuauga

SEQ ID NO: 27652 - RNA, 22 nt, Homo sapiens
cagaaagugcuucccucuagag

SEQ ID NO: 27653 - RNA, 22 nt, Homo sapiens
cccaacaacaugaaacuaccua

SEQ ID NO: 27654 - RNA, 23 nt, Homo sapiens
gaaacccagcagacaauguagcu

SEQ ID NO: 27655 - RNA, 21 nt, Homo sapiens
agcuaugccagcaucuugccu

SEQ ID NO: 27656 - RNA, 21 nt, Homo sapiens
uucuaggauaggcccaggggc

SEQ ID NO: 27657 - RNA, 19 nt, Homo sapiens
guccugaauuccgcagccu

SEQ ID NO: 27658 - RNA, 25 nt, Homo sapiens
acggagcugucccaacaccaccccu

SEQ ID NO: 27659 - RNA, 20 nt, Homo sapiens
agagaugagagaaacacccu

SEQ ID NO: 27660 - RNA, 22 nt, Homo sapiens
ugcuguuagcccuagccccgca

SEQ ID NO: 27661 - RNA, 20 nt, Homo sapiens
uacugcuuccacagcucccc

SEQ ID NO: 27662 - RNA, 20 nt, Homo sapiens
uacugcuuccacagcucccc

SEQ ID NO: 27663 - RNA, 24 nt, Homo sapiens
cacccccagagccucagcucccca

SEQ ID NO: 27664 - RNA, 21 nt, Homo sapiens
uucuaggauaggcccaggggc

SEQ ID NO: 27665 - RNA, 23 nt, Homo sapiens
cgugagcuccuggaggacaggga

SEQ ID NO: 27666 - RNA, 22 nt, Homo sapiens
uacagauggauaccgugcaauu

SEQ ID NO: 27667 - RNA, 18 nt, Homo sapiens
ugguggcagaggugggau

SEQ ID NO: 27668 - RNA, 17 nt, Homo sapiens
ggguggcagcgguggga

SEQ ID NO: 27669 - RNA, 22 nt, Homo sapiens
acugccugucugugccugcugu

SEQ ID NO: 27670 - RNA, 21 nt, Homo sapiens
ucaaucacagauagcaccccu

SEQ ID NO: 27671 - RNA, 22 nt, Homo sapiens
accagguuccaccccagcaggc

SEQ ID NO: 27672 - RNA, 23 nt, Homo sapiens
aagaaucuugucccgcagguccu

SEQ ID NO: 27673 - RNA, 21 nt, Homo sapiens
acuccaaagggaagcgccuuc

SEQ ID NO: 27674 - RNA, 22 nt, Homo sapiens
cgcucuaaagggaagcgccuuc

SEQ ID NO: 27675 - RNA, 21 nt, Homo sapiens
gcugaggucugggccaggucu

SEQ ID NO: 27676 - RNA, 25 nt, Homo sapiens
accaacggaccuacuucccuccgcc

SEQ ID NO: 27677 - RNA, 23 nt, Homo sapiens
cacugugggcccucuccgcacca

SEQ ID NO: 27678 - RNA, 21 nt, Homo sapiens
caucaccuuccuucuccucca

SEQ ID NO: 27679 - RNA, 22 nt, Homo sapiens
agcuagugagaagucaaugccu

SEQ ID NO: 27680 - RNA, 21 nt, Homo sapiens
aguagugcuuucuacuuuaug

SEQ ID NO: 27681 - RNA, 22 nt, Homo sapiens
agcccaaaaggagaauucuuug

SEQ ID NO: 27682 - RNA, 22 nt, Homo sapiens
uccacauggaguugcuguuaca

SEQ ID NO: 27683 - RNA, 22 nt, Homo sapiens
cagacuccgguggaaugaagga

SEQ ID NO: 27684 - RNA, 22 nt, Homo sapiens
gguaaaacucgcaauuacuuuu

SEQ ID NO: 27685 - RNA, 22 nt, Homo sapiens
ggccaaaaccacaauuacuuuu

SEQ ID NO: 27686 - RNA, 22 nt, Homo sapiens
ggcaaaaaccgcaauuacuuuu

SEQ ID NO: 27687 - RNA, 22 nt, Homo sapiens
ggcaaaaaccacaauuacuuuu

SEQ ID NO: 27688 - RNA, 22 nt, Homo sapiens
gacaaaaaccgcgauuacuuuu

SEQ ID NO: 27689 - RNA, 22 nt, Homo sapiens
ggcaaaauccgcaauuacuuuu

SEQ ID NO: 27690 - RNA, 22 nt, Homo sapiens
accaaagaccgcaauuacuuuu

SEQ ID NO: 27691 - RNA, 21 nt, Homo sapiens
uuuuggugcauauuuacuuua

SEQ ID NO: 27692 - RNA, 21 nt, Homo sapiens
ucgacugccacucuuacuaga

SEQ ID NO: 27693 - RNA, 23 nt, Homo sapiens
acaaggaugaaucuuuguuacug

SEQ ID NO: 27694 - RNA, 23 nt, Homo sapiens
acgggugcgauuucugugugaga

SEQ ID NO: 27695 - RNA, 22 nt, Homo sapiens
agcucagaacccagaggucuca

SEQ ID NO: 27696 - RNA, 20 nt, Homo sapiens
agagaugagagaaacacccu

SEQ ID NO: 27697 - RNA, 23 nt, Homo sapiens
cugcagaacuguucccgcugcua

SEQ ID NO: 27698 - RNA, 25 nt, Homo sapiens
acggagcugucccaacaccaccccu

SEQ ID NO: 27699 - RNA, 22 nt, Homo sapiens
ugcuguuagcccuagccccgca

SEQ ID NO: 27700 - RNA, 21 nt, Homo sapiens
agacacaccacggcacacuuc

SEQ ID NO: 27701 - RNA, 23 nt, Homo sapiens
cccaacagacauggcgguacuca

SEQ ID NO: 27702 - RNA, 22 nt, Homo sapiens
uccucuuuucuuagagacucac

SEQ ID NO: 27703 - RNA, 22 nt, Homo sapiens
uccggggacgaacgggacgggu

SEQ ID NO: 27704 - RNA, 17 nt, Homo sapiens
gggagaggaggaggcga

SEQ ID NO: 27705 - RNA, 21 nt, Homo sapiens
gaccaaucgccguccccgccg

SEQ ID NO: 27706 - RNA, 22 nt, Homo sapiens
ucagaccgagacaagugcaaug

SEQ ID NO: 27707 - RNA, 25 nt, Homo sapiens
accaacggaccuacuucccuccgcc

SEQ ID NO: 27708 - RNA, 25 nt, Homo sapiens
accaacggaccuacuucccuccgcc

SEQ ID NO: 27709 - RNA, 22 nt, Homo sapiens
gcggucccgcggcgccccgccu

SEQ ID NO: 27710 - RNA, 22 nt, Homo sapiens
ugcuguuagcccuagccccgca

SEQ ID NO: 27711 - RNA, 22 nt, Homo sapiens
ggaggccgggacgagugcaaua

SEQ ID NO: 27712 - RNA, 24 nt, Homo sapiens
acucacaccuagguuccaaggauu

SEQ ID NO: 27713 - RNA, 23 nt, Homo sapiens
caugagugacgcccucuggagua

SEQ ID NO: 27714 - RNA, 21 nt, Homo sapiens
uggaaaccaagagugggucgc

SEQ ID NO: 27715 - RNA, 21 nt, Homo sapiens
cugaaaccaaguaugggucgc

SEQ ID NO: 27716 - RNA, 22 nt, Homo sapiens
ggcagagagucagagcgcggau

SEQ ID NO: 27717 - RNA, 23 nt, Homo sapiens
ucacauaggaauaaaaagccaua

SEQ ID NO: 27718 - RNA, 22 nt, Homo sapiens
caaacaccauugucacacucca

SEQ ID NO: 27719 - RNA, 21 nt, Homo sapiens
aaaggccacauccagcaccgu

SEQ ID NO: 27720 - RNA, 18 nt, Homo sapiens
aucacauucaccucccug

SEQ ID NO: 27721 - RNA, 21 nt, Homo sapiens
gaccaaucgccguccccgccg

SEQ ID NO: 27722 - RNA, 22 nt, Homo sapiens
aggcauaggaugacaaagggaa

SEQ ID NO: 27723 - RNA, 22 nt, Homo sapiens
aggcgaaggaugacaaagggaa

SEQ ID NO: 27724 - RNA, 22 nt, Homo sapiens
acaaaaguugccuuugugugau

SEQ ID NO: 27725 - RNA, 19 nt, Homo sapiens
auuuugguacagcagcuca

SEQ ID NO: 27726 - RNA, 22 nt, Homo sapiens
gauccgagcaccggggaccccc

SEQ ID NO: 27727 - RNA, 22 nt, Homo sapiens
gcggucccgcggcgccccgccu

SEQ ID NO: 27728 - RNA, 22 nt, Homo sapiens
cacucuaaagggaggcacuuug

SEQ ID NO: 27729 - RNA, 22 nt, Homo sapiens
ggcagagagucagagcgcggau

SEQ ID NO: 27730 - RNA, 22 nt, Homo sapiens
auccuucuacaaauucacccau

SEQ ID NO: 27731 - RNA, 21 nt, Homo sapiens
aaaggccacauccagcaccgu

SEQ ID NO: 27732 - RNA, 23 nt, Homo sapiens
ggacauuguuucagugcccaagu

SEQ ID NO: 27733 - RNA, 27 nt, Homo sapiens
ugcccacucucaccaucaccuacagug

SEQ ID NO: 27734 - RNA, 22 nt, Homo sapiens
cuggagacacgugcacuguaga

SEQ ID NO: 27735 - RNA, 19 nt, Homo sapiens
cagcaucagcagcaucauc

SEQ ID NO: 27736 - RNA, 23 nt, Homo sapiens
gggagugaagacacggagccaga

SEQ ID NO: 27737 - RNA, 22 nt, Homo sapiens
ucaggaacugccuuucucucca

SEQ ID NO: 27738 - RNA, 21 nt, Homo sapiens
uagcacccagauagcaaggau

SEQ ID NO: 27739 - RNA, 21 nt, Homo sapiens
cccgaggagccgggcaggcuu

SEQ ID NO: 27740 - RNA, 24 nt, Homo sapiens
cacccccagagccucagcucccca

SEQ ID NO: 27741 - RNA, 22 nt, Homo sapiens
aggcauaggaugacaaagggaa

SEQ ID NO: 27742 - RNA, 22 nt, Homo sapiens
aggcgaaggaugacaaagggaa

SEQ ID NO: 27743 - RNA, 23 nt, Homo sapiens
acaccaaugcccuaggggaugcg

SEQ ID NO: 27744 - RNA, 23 nt, Homo sapiens
acaccaaugcccuaggggaugcg

SEQ ID NO: 27745 - RNA, 22 nt, Homo sapiens
gcaaagguaauugcuguuuucg

SEQ ID NO: 27746 - RNA, 27 nt, Homo sapiens
uuuagcacagugcuuauacaagaaggu

SEQ ID NO: 27747 - RNA, 21 nt, Homo sapiens
ggggagcgggggcccugccuu

SEQ ID NO: 27748 - RNA, 22 nt, Homo sapiens
cuagggaacacagggcugguga

SEQ ID NO: 27749 - RNA, 23 nt, Homo sapiens
cggccugauucacaacaccagcu

SEQ ID NO: 27750 - RNA, 21 nt, Homo sapiens
acaaaccacagugugcugcug

SEQ ID NO: 27751 - RNA, 22 nt, Homo sapiens
ugcaagccuugggugugggagg

SEQ ID NO: 27752 - RNA, 22 nt, Homo sapiens
agugaauucuaccagugccaua

SEQ ID NO: 27753 - RNA, 21 nt, Homo sapiens
acaggauugagggggggcccu

SEQ ID NO: 27754 - RNA, 21 nt, Homo sapiens
acaggauugagggggggcccu

SEQ ID NO: 27755 - RNA, 23 nt, Homo sapiens
aaagucucgcucucugccccuca

SEQ ID NO: 27756 - RNA, 21 nt, Homo sapiens
aagugucagacacgguggugg

SEQ ID NO: 27757 - RNA, 22 nt, Homo sapiens
ucaggaacugccuuucucucca

SEQ ID NO: 27758 - RNA, 23 nt, Homo sapiens
cccaacagacauggcgguacuca

SEQ ID NO: 27759 - RNA, 20 nt, Homo sapiens
cuggaggaagggcccagagg

SEQ ID NO: 27760 - RNA, 22 nt, Homo sapiens
gccuaagacacaggcccagaga

SEQ ID NO: 27761 - RNA, 22 nt, Homo sapiens
gaagaaaggcaucauauaggag

SEQ ID NO: 27762 - RNA, 23 nt, Homo sapiens
aagaaucuugucccgcagguccu

SEQ ID NO: 27763 - RNA, 22 nt, Homo sapiens
ccuggcacacaguagaccuuca

SEQ ID NO: 27764 - RNA, 22 nt, Homo sapiens
aagaagugcaccauguuuguuu

SEQ ID NO: 27765 - RNA, 23 nt, Homo sapiens
gggcucuuacucccucaggcacu

SEQ ID NO: 27766 - RNA, 22 nt, Homo sapiens
guccaaaguuggggugcugguu

SEQ ID NO: 27767 - RNA, 22 nt, Homo sapiens
ggcaaaauccgcaauuacuuuu

SEQ ID NO: 27768 - RNA, 22 nt, Homo sapiens
uccggggacgaacgggacgggu

SEQ ID NO: 27769 - RNA, 22 nt, Homo sapiens
cagaagugggccgggcacaggg

SEQ ID NO: 27770 - RNA, 21 nt, Homo sapiens
caugcacaugcacacauacau

SEQ ID NO: 27771 - RNA, 22 nt, Homo sapiens
acaucaucgcauauugacacaa

SEQ ID NO: 27772 - RNA, 22 nt, Homo sapiens
acaguggucaucgagugacaca

SEQ ID NO: 27773 - RNA, 21 nt, Homo sapiens
cacaacccuaguggcgccauu

SEQ ID NO: 27774 - RNA, 20 nt, Homo sapiens
uacugcuuccacagcucccc

SEQ ID NO: 27775 - RNA, 22 nt, Homo sapiens
ggaggccgggacgagugcaaua

SEQ ID NO: 27776 - RNA, 17 nt, Homo sapiens
gggagaggaggaggcga

SEQ ID NO: 27777 - RNA, 21 nt, Homo sapiens
acuagacugugagcuccucga

SEQ ID NO: 27778 - RNA, 21 nt, Homo sapiens
aacggaaccacuagugacuug

SEQ ID NO: 27779 - RNA, 19 nt, Homo sapiens
guccugaauuccgcagccu

SEQ ID NO: 27780 - RNA, 20 nt, Homo sapiens
aggggccucagccuccuggu

SEQ ID NO: 27781 - RNA, 20 nt, Homo sapiens
guuugauaaacugacacaac

SEQ ID NO: 27782 - RNA, 21 nt, Homo sapiens
gaaggaagugagugcagccac

SEQ ID NO: 27783 - RNA, 21 nt, Homo sapiens
ucuccagaucagggcagucca

SEQ ID NO: 27784 - RNA, 19 nt, Homo sapiens
guugggaucacaggcgccc

SEQ ID NO: 27785 - RNA, 17 nt, Homo sapiens
gggagaggaggaggcga

SEQ ID NO: 27786 - RNA, 21 nt, Homo sapiens
gagcugcauccuggcuccggg

SEQ ID NO: 27787 - RNA, 22 nt, Homo sapiens
caaacaccauugucacacucca

SEQ ID NO: 27788 - RNA, 21 nt, Homo sapiens
gaccaaucgccguccccgccg

SEQ ID NO: 27789 - RNA, 22 nt, Homo sapiens
acugccugucugugccugcugu

SEQ ID NO: 27790 - RNA, 22 nt, Homo sapiens
accagguuccaccccagcaggc

SEQ ID NO: 27791 - RNA, 22 nt, Homo sapiens
ccucuaguaaauaugucagcau

SEQ ID NO: 27792 - RNA, 22 nt, Homo sapiens
gcggucccgcggcgccccgccu

SEQ ID NO: 27793 - RNA, 22 nt, Homo sapiens
ugcuguuagcccuagccccgca

SEQ ID NO: 27794 - RNA, 22 nt, Homo sapiens
gggagaggucucccugcgcaca

SEQ ID NO: 27795 - RNA, 21 nt, Homo sapiens
gaccaaucgccguccccgccg

SEQ ID NO: 27796 - RNA, 21 nt, Homo sapiens
gaccaaucgccguccccgccg

SEQ ID NO: 27797 - RNA, 22 nt, Homo sapiens
cggugagcacccggccccugcg

SEQ ID NO: 27798 - RNA, 22 nt, Homo sapiens
gcggucccgcggcgccccgccu

SEQ ID NO: 27799 - RNA, 22 nt, Homo sapiens
gcggucccgcggcgccccgccu

SEQ ID NO: 27800 - RNA, 22 nt, Homo sapiens
ugcuguuagcccuagccccgca

SEQ ID NO: 27801 - RNA, 22 nt, Homo sapiens
ugcuguuagcccuagccccgca

SEQ ID NO: 27802 - RNA, 21 nt, Homo sapiens
ccccucccagccucccugcca

SEQ ID NO: 27803 - RNA, 18 nt, Homo sapiens
auucaaucuacugccuca

SEQ ID NO: 27804 - RNA, 23 nt, Homo sapiens
aaaucagaaucacaccuggggga

SEQ ID NO: 27805 - RNA, 24 nt, Homo sapiens
acgcagagcccgaaagcccccagu

SEQ ID NO: 27806 - RNA, 22 nt, Homo sapiens
ggcucccaagaaccucaccugu

SEQ ID NO: 27807 - RNA, 21 nt, Homo sapiens
aacggaaccacuagugacuug

SEQ ID NO: 27808 - RNA, 20 nt, Homo sapiens
guguguauacauuuauacau

SEQ ID NO: 27809 - RNA, 22 nt, Homo sapiens
caaacaccauugucacacucca

SEQ ID NO: 27810 - RNA, 24 nt, Homo sapiens
gaaagugcauagaauucugucugg

SEQ ID NO: 27811 - RNA, 19 nt, Homo sapiens
ucccacaggaagcagacac

SEQ ID NO: 27812 - RNA, 24 nt, Homo sapiens
acucacaccuagguuccaaggauu

SEQ ID NO: 27813 - RNA, 19 nt, Homo sapiens
auuuugguacagcagcuca

SEQ ID NO: 27814 - RNA, 22 nt, Homo sapiens
gaggcucagaauggcucaggag

SEQ ID NO: 27815 - RNA, 22 nt, Homo sapiens
caaacaccauugucacacucca

SEQ ID NO: 27816 - RNA, 20 nt, Homo sapiens
ggggcagacagacgaggaag

SEQ ID NO: 27817 - RNA, 20 nt, Homo sapiens
cccgccgcgucgcccugggg

SEQ ID NO: 27818 - RNA, 21 nt, Homo sapiens
agcuaugccagcaucuugccu

SEQ ID NO: 27819 - RNA, 20 nt, Homo sapiens
aggggccucagccuccuggu

SEQ ID NO: 27820 - RNA, 21 nt, Homo sapiens
caucaccuuccuucuccucca

SEQ ID NO: 27821 - RNA, 23 nt, Homo sapiens
gacguaguccuauucucugcugc

SEQ ID NO: 27822 - RNA, 22 nt, Homo sapiens
ggaggccgggacgagugcaaua

SEQ ID NO: 27823 - RNA, 21 nt, Homo sapiens
gaccaaucgccguccccgccg

SEQ ID NO: 27824 - RNA, 22 nt, Homo sapiens
gcggucccgcggcgccccgccu

SEQ ID NO: 27825 - RNA, 20 nt, Homo sapiens
uacugcuuccacagcucccc

SEQ ID NO: 27826 - RNA, 19 nt, Homo sapiens
gccucagaggcagcugcuu

SEQ ID NO: 27827 - RNA, 23 nt, Homo sapiens
acaaggaugaaucuuuguuacug

SEQ ID NO: 27828 - RNA, 23 nt, Homo sapiens
cgugagcuccuggaggacaggga

SEQ ID NO: 27829 - RNA, 21 nt, Homo sapiens
gaccaaucgccguccccgccg

SEQ ID NO: 27830 - RNA, 22 nt, Homo sapiens
gcggucccgcggcgccccgccu

SEQ ID NO: 27831 - RNA, 22 nt, Homo sapiens
caaacaccauugucacacucca

SEQ ID NO: 27832 - RNA, 21 nt, Homo sapiens
gaccaaucgccguccccgccg

SEQ ID NO: 27833 - RNA, 22 nt, Homo sapiens
ucagaccgagacaagugcaaug

SEQ ID NO: 27834 - RNA, 23 nt, Homo sapiens
aaagucucgcucucugccccuca

SEQ ID NO: 27835 - RNA, 22 nt, Homo sapiens
cuacccacagacguaccaauca

SEQ ID NO: 27836 - RNA, 22 nt, Homo sapiens
gcggucccgcggcgccccgccu

SEQ ID NO: 27837 - RNA, 23 nt, Homo sapiens
cuccagccccuccagggcuuccu

SEQ ID NO: 27838 - RNA, 22 nt, Homo sapiens
ggcagagagucagagcgcggau

SEQ ID NO: 27839 - RNA, 22 nt, Homo sapiens
ugcaagccuugggugugggagg

SEQ ID NO: 27840 - RNA, 23 nt, Homo sapiens
ucucgugacaugaugauccccga

SEQ ID NO: 27841 - RNA, 19 nt, Homo sapiens
ucccacaggaagcagacac

SEQ ID NO: 27842 - RNA, 22 nt, Homo sapiens
aaggugauggucagcagacaua

SEQ ID NO: 27843 - RNA, 22 nt, Homo sapiens
cggugagcacccggccccugcg

SEQ ID NO: 27844 - RNA, 23 nt, Homo sapiens
cggcucugucgucgaggcgcuca

SEQ ID NO: 27845 - RNA, 23 nt, Homo sapiens
aaaucagaaucacaccuggggga

SEQ ID NO: 27846 - RNA, 23 nt, Homo sapiens
acugaggggccucagaccgagcu

SEQ ID NO: 27847 - RNA, 22 nt, Homo sapiens
gaauucaucacggccagccucu

SEQ ID NO: 27848 - RNA, 24 nt, Homo sapiens
acgcagagcccgaaagcccccagu

SEQ ID NO: 27849 - RNA, 21 nt, Homo sapiens
caucaccuuccuucuccucca

SEQ ID NO: 27850 - RNA, 22 nt, Homo sapiens
gggagaggucucccugcgcaca

SEQ ID NO: 27851 - RNA, 21 nt, Homo sapiens
gagcugcauccuggcuccggg

SEQ ID NO: 27852 - RNA, 18 nt, Homo sapiens
auucaaucuacugccuca

SEQ ID NO: 27853 - RNA, 22 nt, Homo sapiens
ccuggcacacaguagaccuuca

SEQ ID NO: 27854 - RNA, 22 nt, Homo sapiens
gaauucaucacggccagccucu

SEQ ID NO: 27855 - RNA, 18 nt, Homo sapiens
gaaaugagggccagcuga

SEQ ID NO: 27856 - RNA, 22 nt, Homo sapiens
gcaaagguaauugcuguuuucg

SEQ ID NO: 27857 - RNA, 20 nt, Homo sapiens
aagcagaaaaaggcaaacga

SEQ ID NO: 27858 - RNA, 23 nt, Homo sapiens
cacugugggcccucuccgcacca

SEQ ID NO: 27859 - RNA, 20 nt, Homo sapiens
uacugcuuccacagcucccc

SEQ ID NO: 27860 - RNA, 22 nt, Homo sapiens
caaacaccauugucacacucca

SEQ ID NO: 27861 - RNA, 22 nt, Homo sapiens
ugcuguuagcccuagccccgca

SEQ ID NO: 27862 - RNA, 22 nt, Homo sapiens
ccuggcacacaguagaccuuca

SEQ ID NO: 27863 - RNA, 18 nt, Homo sapiens
cccccaccaccacgcccg

SEQ ID NO: 27864 - RNA, 23 nt, Homo sapiens
aaaaugcagauuccuggacucca

SEQ ID NO: 27865 - RNA, 18 nt, Homo sapiens
aucacauucaccucccug

SEQ ID NO: 27866 - RNA, 23 nt, Homo sapiens
gggagugaagacacggagccaga

SEQ ID NO: 27867 - RNA, 24 nt, Homo sapiens
agugugaguucuaccauugccaaa

SEQ ID NO: 27868 - RNA, 20 nt, Homo sapiens
cccgccgcgucgcccugggg

SEQ ID NO: 27869 - RNA, 22 nt, Homo sapiens
aggcauaggaugacaaagggaa

SEQ ID NO: 27870 - RNA, 22 nt, Homo sapiens
aggcgaaggaugacaaagggaa

SEQ ID NO: 27871 - RNA, 22 nt, Homo sapiens
ccucauggaaggguuccccacu

SEQ ID NO: 27872 - RNA, 23 nt, Homo sapiens
acagcgcucgcaaccgcagcgau

SEQ ID NO: 27873 - RNA, 17 nt, Homo sapiens
uggaggccccagcgaga

SEQ ID NO: 27874 - RNA, 21 nt, Homo sapiens
caucaccuuccuucuccucca

SEQ ID NO: 27875 - RNA, 22 nt, Homo sapiens
uauccacuacaccccgcugccu

SEQ ID NO: 27876 - RNA, 22 nt, Homo sapiens
gcugaggcuguggggcuggagu

SEQ ID NO: 27877 - RNA, 21 nt, Homo sapiens
gaccaaucgccguccccgccg

SEQ ID NO: 27878 - RNA, 22 nt, Homo sapiens
gcggucccgcggcgccccgccu

SEQ ID NO: 27879 - RNA, 22 nt, Homo sapiens
ugcuguuagcccuagccccgca

SEQ ID NO: 27880 - RNA, 21 nt, Homo sapiens
ccccucccagccucccugcca

SEQ ID NO: 27881 - RNA, 22 nt, Homo sapiens
acaaaaguugccuuugugugau

SEQ ID NO: 27882 - RNA, 21 nt, Homo sapiens
aagugucagacacgguggugg

SEQ ID NO: 27883 - RNA, 24 nt, Homo sapiens
acugcaggcuccagcuuccaggcu

SEQ ID NO: 27884 - RNA, 23 nt, Homo sapiens
guaaauagagguuuaauuaacac

SEQ ID NO: 27885 - RNA, 18 nt, Homo sapiens
ugguggcagaggugggau

SEQ ID NO: 27886 - RNA, 23 nt, Homo sapiens
agcccuguucuacagcccugagg

SEQ ID NO: 27887 - RNA, 21 nt, Homo sapiens
aggcggcaggcacaggacugg

SEQ ID NO: 27888 - RNA, 23 nt, Homo sapiens
cuaccugcacuauaagcacuuua

SEQ ID NO: 27889 - RNA, 22 nt, Homo sapiens
agccacaaucaccuucugaucu

SEQ ID NO: 27890 - RNA, 21 nt, Homo sapiens
ugcaaugcaacuacaaugcac

SEQ ID NO: 27891 - RNA, 20 nt, Homo sapiens
gcaaugcaacagcaaugcac

SEQ ID NO: 27892 - RNA, 20 nt, Homo sapiens
cugcgggaggacagggcuca

SEQ ID NO: 27893 - RNA, 17 nt, Homo sapiens
gacagccucucccccac

SEQ ID NO: 27894 - RNA, 21 nt, Homo sapiens
gggcaucugggacgcgcagga

SEQ ID NO: 27895 - RNA, 21 nt, Homo sapiens
gaccaaucgccguccccgccg

SEQ ID NO: 27896 - RNA, 21 nt, Homo sapiens
ucaaucacagauagcaccccu

SEQ ID NO: 27897 - RNA, 19 nt, Homo sapiens
guccugaauuccgcagccu

SEQ ID NO: 27898 - RNA, 22 nt, Homo sapiens
gcggucccgcggcgccccgccu

SEQ ID NO: 27899 - RNA, 22 nt, Homo sapiens
ugcuguuagcccuagccccgca

SEQ ID NO: 27900 - RNA, 22 nt, Homo sapiens
ggcucccaagaaccucaccugu

SEQ ID NO: 27901 - RNA, 22 nt, Homo sapiens
agacaacaaugccaaccucaca

SEQ ID NO: 27902 - RNA, 21 nt, Homo sapiens
ugcaaugcaacuacaaugcac

SEQ ID NO: 27903 - RNA, 20 nt, Homo sapiens
gcaaugcaacagcaaugcac

SEQ ID NO: 27904 - RNA, 22 nt, Homo sapiens
cacugguacaaggguugggaga

SEQ ID NO: 27905 - RNA, 23 nt, Homo sapiens
acccaacagccccugcaagggau

SEQ ID NO: 27906 - RNA, 21 nt, Homo sapiens
ugcaaacccugcaugugggag

SEQ ID NO: 27907 - RNA, 23 nt, Homo sapiens
gaaagugcccucaaggcugagug

SEQ ID NO: 27908 - RNA, 21 nt, Homo sapiens
uucuaggauaggcccaggggc

SEQ ID NO: 27909 - RNA, 22 nt, Homo sapiens
ccaucuuuaccagacaguguua

SEQ ID NO: 27910 - RNA, 22 nt, Homo sapiens
acaucguuaccagacaguguua

SEQ ID NO: 27911 - RNA, 21 nt, Homo sapiens
gaccaaucgccguccccgccg

SEQ ID NO: 27912 - RNA, 22 nt, Homo sapiens
gcggucccgcggcgccccgccu

SEQ ID NO: 27913 - RNA, 22 nt, Homo sapiens
ugcuguuagcccuagccccgca

SEQ ID NO: 27914 - RNA, 22 nt, Homo sapiens
cacucagcggccguuuccccaa

SEQ ID NO: 27915 - RNA, 21 nt, Homo sapiens
gcugaggucugggccaggucu

SEQ ID NO: 27916 - RNA, 22 nt, Homo sapiens
ucccucacacagaauuccagaa

SEQ ID NO: 27917 - RNA, 22 nt, Homo sapiens
augcuuuuugggguaagggcuu

SEQ ID NO: 27918 - RNA, 22 nt, Homo sapiens
ccccucuggucaaccagucaca

SEQ ID NO: 27919 - RNA, 22 nt, Homo sapiens
caaacaccauugucacacucca

SEQ ID NO: 27920 - RNA, 22 nt, Homo sapiens
ucaacaucagucugauaagcua

SEQ ID NO: 27921 - RNA, 22 nt, Homo sapiens
acuucaaggaucuuaaacuuug

SEQ ID NO: 27922 - RNA, 22 nt, Homo sapiens
cagcugguugaaggggaccaaa

SEQ ID NO: 27923 - RNA, 20 nt, Homo sapiens
aggggccucagccuccuggu

SEQ ID NO: 27924 - RNA, 17 nt, Homo sapiens
gacagccucucccccac

SEQ ID NO: 27925 - RNA, 23 nt, Homo sapiens
gggagugaagacacggagccaga

SEQ ID NO: 27926 - RNA, 21 nt, Homo sapiens
ccaaccaaugaaagaaugcuu

SEQ ID NO: 27927 - RNA, 22 nt, Homo sapiens
acccuuaucaguucuccgucca

SEQ ID NO: 27928 - RNA, 22 nt, Homo sapiens
ucaggaacugccuuucucucca

SEQ ID NO: 27929 - RNA, 23 nt, Homo sapiens
gaaacccagcagacaauguagcu

SEQ ID NO: 27930 - RNA, 21 nt, Homo sapiens
acccaguagccagauguagcu

SEQ ID NO: 27931 - RNA, 22 nt, Homo sapiens
ggagagccuccacccaacccuc

SEQ ID NO: 27932 - RNA, 23 nt, Homo sapiens
aaagucucgcucucugccccuca

SEQ ID NO: 27933 - RNA, 23 nt, Homo sapiens
aaagucucgcucucugccccuca

SEQ ID NO: 27934 - RNA, 19 nt, Homo sapiens
guccugaauuccgcagccu

SEQ ID NO: 27935 - RNA, 22 nt, Homo sapiens
aaucagucucauugcuuuauaa

SEQ ID NO: 27936 - RNA, 23 nt, Homo sapiens
gggagugaagacacggagccaga

SEQ ID NO: 27937 - RNA, 21 nt, Homo sapiens
gagcuacagugcuucaucuca

SEQ ID NO: 27938 - RNA, 20 nt, Homo sapiens
cuggaggaagggcccagagg

SEQ ID NO: 27939 - RNA, 22 nt, Homo sapiens
gccuaagacacaggcccagaga

SEQ ID NO: 27940 - RNA, 22 nt, Homo sapiens
agcccaaaaggagaauucuuug

SEQ ID NO: 27941 - RNA, 22 nt, Homo sapiens
uauccacuacaccccgcugccu

SEQ ID NO: 27942 - RNA, 22 nt, Homo sapiens
accagguuccaccccagcaggc

SEQ ID NO: 27943 - RNA, 22 nt, Homo sapiens
gggagaggucucccugcgcaca

SEQ ID NO: 27944 - RNA, 22 nt, Homo sapiens
acugggacuuuguaggccaguu

SEQ ID NO: 27945 - RNA, 22 nt, Homo sapiens
agcgggacuuugagggccaguu

SEQ ID NO: 27946 - RNA, 20 nt, Homo sapiens
cucaaagcaaacccugcaga

SEQ ID NO: 27947 - RNA, 21 nt, Homo sapiens
ggcugucaauucauaggucag

SEQ ID NO: 27948 - RNA, 22 nt, Homo sapiens
agcugaguguaggauguuuaca

SEQ ID NO: 27949 - RNA, 23 nt, Homo sapiens
gucagaccccgagggguccucgc

SEQ ID NO: 27950 - RNA, 21 nt, Homo sapiens
caucaccuuccuucuccucca

SEQ ID NO: 27951 - RNA, 21 nt, Homo sapiens
gcugaggucugggccaggucu

SEQ ID NO: 27952 - RNA, 22 nt, Homo sapiens
agcccaaaaggagaauucuuug

SEQ ID NO: 27953 - RNA, 22 nt, Homo sapiens
cggugagcacccggccccugcg

SEQ ID NO: 27954 - RNA, 22 nt, Homo sapiens
cuagggaacacagggcugguga

SEQ ID NO: 27955 - RNA, 23 nt, Homo sapiens
cggccugauucacaacaccagcu

SEQ ID NO: 27956 - RNA, 22 nt, Homo sapiens
ucaggaacugccuuucucucca

SEQ ID NO: 27957 - RNA, 21 nt, Homo sapiens
gaccaaucgccguccccgccg

SEQ ID NO: 27958 - RNA, 22 nt, Homo sapiens
ucagaccgagacaagugcaaug

SEQ ID NO: 27959 - RNA, 22 nt, Homo sapiens
gcggucccgcggcgccccgccu

SEQ ID NO: 27960 - RNA, 23 nt, Homo sapiens
cacugugggcccucuccgcacca

SEQ ID NO: 27961 - RNA, 23 nt, Homo sapiens
uauucucgcacggacuacaacca

SEQ ID NO: 27962 - RNA, 21 nt, Homo sapiens
guucuaacccauuguggccaa

SEQ ID NO: 27963 - RNA, 22 nt, Homo sapiens
uacagauggauaccgugcaauu

SEQ ID NO: 27964 - RNA, 24 nt, Homo sapiens
agugugaguucuaccauugccaaa

SEQ ID NO: 27965 - RNA, 23 nt, Homo sapiens
acccuauaagcaauauugcacua

SEQ ID NO: 27966 - RNA, 21 nt, Homo sapiens
aggagacucacaaguuccugc

SEQ ID NO: 27967 - RNA, 18 nt, Homo sapiens
cagcagccuccuucucaa

SEQ ID NO: 27968 - RNA, 22 nt, Homo sapiens
ccaguagcacggcucaguccag

SEQ ID NO: 27969 - RNA, 22 nt, Homo sapiens
cacaaaccauuaugugcugcua

SEQ ID NO: 27970 - RNA, 22 nt, Homo sapiens
uguaaaccaugaugugcugcua

SEQ ID NO: 27971 - RNA, 22 nt, Homo sapiens
cgccaauauuuacgugcugcua

SEQ ID NO: 27972 - RNA, 22 nt, Homo sapiens
ucaggaacugccuuucucucca

SEQ ID NO: 27973 - RNA, 23 nt, Homo sapiens
cuaucugcacuagaugcaccuua

SEQ ID NO: 27974 - RNA, 21 nt, Homo sapiens
gccaauauuucugugcugcua

SEQ ID NO: 27975 - RNA, 21 nt, Homo sapiens
acaugguuagaucaagcacaa

SEQ ID NO: 27976 - RNA, 21 nt, Homo sapiens
ccuucugacuccaaguccagu

SEQ ID NO: 27977 - RNA, 22 nt, Homo sapiens
gccuucugacccuaaguccagu

SEQ ID NO: 27978 - RNA, 22 nt, Homo sapiens
uucaaaacaugaauugcugcug

SEQ ID NO: 27979 - RNA, 21 nt, Homo sapiens
guguauaugcccauggacugc

SEQ ID NO: 27980 - RNA, 21 nt, Homo sapiens
acaaaccacagugugcugcug

SEQ ID NO: 27981 - RNA, 21 nt, Homo sapiens
uagcacccagauagcaaggau

SEQ ID NO: 27982 - RNA, 22 nt, Homo sapiens
gcacacaauaaauguuugcuga

SEQ ID NO: 27983 - RNA, 22 nt, Homo sapiens
cucauauuacaaugagcucauc

SEQ ID NO: 27984 - RNA, 19 nt, Homo sapiens
auuuugguacagcagcuca

SEQ ID NO: 27985 - RNA, 23 nt, Homo sapiens
ugcgggcgggacgagcaagcaca

SEQ ID NO: 27986 - RNA, 19 nt, Homo sapiens
gccucagaggcagcugcuu

SEQ ID NO: 27987 - RNA, 20 nt, Homo sapiens
uacugcuuccacagcucccc

SEQ ID NO: 27988 - RNA, 22 nt, Homo sapiens
acuggguucaccuuuaagggca

SEQ ID NO: 27989 - RNA, 24 nt, Homo sapiens
cacccccagagccucagcucccca

SEQ ID NO: 27990 - RNA, 21 nt, Homo sapiens
ugcaaugcaacuacaaugcac

SEQ ID NO: 27991 - RNA, 20 nt, Homo sapiens
gcaaugcaacagcaaugcac

SEQ ID NO: 27992 - RNA, 21 nt, Homo sapiens
gaaggaagugagugcagccac

SEQ ID NO: 27993 - RNA, 23 nt, Homo sapiens
aaagucucgcucucugccccuca

SEQ ID NO: 27994 - RNA, 22 nt, Homo sapiens
ugcuguuagcccuagccccgca

SEQ ID NO: 27995 - RNA, 22 nt, Homo sapiens
ggaggccgggacgagugcaaua

SEQ ID NO: 27996 - RNA, 21 nt, Homo sapiens
ccccucccagccucccugcca

SEQ ID NO: 27997 - RNA, 22 nt, Homo sapiens
cugggggcggcacaggggcuca

SEQ ID NO: 27998 - RNA, 24 nt, Homo sapiens
acugcuggucuucagucagggcca

SEQ ID NO: 27999 - RNA, 25 nt, Homo sapiens
acggagcugucccaacaccaccccu

SEQ ID NO: 28000 - RNA, 23 nt, Homo sapiens
guagugggccgagccgagugaca

SEQ ID NO: 28001 - RNA, 23 nt, Homo sapiens
cacugugggcccucuccgcacca

SEQ ID NO: 28002 - RNA, 22 nt, Homo sapiens
ugcuguuagcccuagccccgca

SEQ ID NO: 28003 - RNA, 22 nt, Homo sapiens
gcugaggcuguggggcuggagu

SEQ ID NO: 28004 - RNA, 20 nt, Homo sapiens
uacugcuuccacagcucccc

SEQ ID NO: 28005 - RNA, 22 nt, Homo sapiens
ggcagagagucagagcgcggau

SEQ ID NO: 28006 - RNA, 24 nt, Homo sapiens
cacccccagagccucagcucccca

SEQ ID NO: 28007 - RNA, 20 nt, Homo sapiens
aguacaucaucuauacugua

SEQ ID NO: 28008 - RNA, 23 nt, Homo sapiens
aggaacagcagcagcccgggccg

SEQ ID NO: 28009 - RNA, 19 nt, Homo sapiens
guccugaauuccgcagccu

SEQ ID NO: 28010 - RNA, 23 nt, Homo sapiens
acacagcucuuccauaucuccag

SEQ ID NO: 28011 - RNA, 17 nt, Homo sapiens
ggguggcagcgguggga

SEQ ID NO: 28012 - RNA, 17 nt, Homo sapiens
gggagaggaggaggcga

SEQ ID NO: 28013 - RNA, 22 nt, Homo sapiens
accuaauauaucaaacauauca

SEQ ID NO: 28014 - RNA, 23 nt, Homo sapiens
gaaacccagcagacaauguagcu

SEQ ID NO: 28015 - RNA, 23 nt, Homo sapiens
ucucugcaggccgugugcuuugc

SEQ ID NO: 28016 - RNA, 20 nt, Homo sapiens
gcaaugcaacagcaaugcac

SEQ ID NO: 28017 - RNA, 22 nt, Homo sapiens
guaccccuggagauucugauaa

SEQ ID NO: 28018 - RNA, 22 nt, Homo sapiens
aacgcuccaaaagaaggcacuc

SEQ ID NO: 28019 - RNA, 22 nt, Homo sapiens
aacacucuaaaaggaggcacuu

SEQ ID NO: 28020 - RNA, 22 nt, Homo sapiens
aguccagauucugugcccacca

SEQ ID NO: 28021 - RNA, 20 nt, Homo sapiens
auuucuauaucuaucuccau

SEQ ID NO: 28022 - RNA, 22 nt, Homo sapiens
gcacauguucugcggcccacca

SEQ ID NO: 28023 - RNA, 22 nt, Homo sapiens
agcucagaacccagaggucuca

SEQ ID NO: 28024 - RNA, 23 nt, Homo sapiens
cacaaauucgguucuacagggua

SEQ ID NO: 28025 - RNA, 25 nt, Homo sapiens
acggagcugucccaacaccaccccu

SEQ ID NO: 28026 - RNA, 22 nt, Homo sapiens
gccagcuaacaauacacugccu

SEQ ID NO: 28027 - RNA, 21 nt, Homo sapiens
ccgugguucuacccuguggua

SEQ ID NO: 28028 - RNA, 22 nt, Homo sapiens
uggggacccucccugaaccaag

SEQ ID NO: 28029 - RNA, 22 nt, Homo sapiens
auacauacuucuuuacauucca

SEQ ID NO: 28030 - RNA, 21 nt, Homo sapiens
cugggggacggagcagaagga

SEQ ID NO: 28031 - RNA, 21 nt, Homo sapiens
gaccaaucgccguccccgccg

SEQ ID NO: 28032 - RNA, 22 nt, Homo sapiens
ccacacacuuccuuacauucca

SEQ ID NO: 28033 - RNA, 22 nt, Homo sapiens
aagcgguuuaccaucccacaua

SEQ ID NO: 28034 - RNA, 22 nt, Homo sapiens
uacagauggauaccgugcaauu

SEQ ID NO: 28035 - RNA, 24 nt, Homo sapiens
cagaaagugcuuucuuuuggagaa

SEQ ID NO: 28036 - RNA, 22 nt, Homo sapiens
aacacucuaaaaggaggcacuu

SEQ ID NO: 28037 - RNA, 21 nt, Homo sapiens
ucccagcacacauuuagcuca

SEQ ID NO: 28038 - RNA, 20 nt, Homo sapiens
ggcaaagaaggaacauuccu

SEQ ID NO: 28039 - RNA, 22 nt, Homo sapiens
gcggucccgcggcgccccgccu

SEQ ID NO: 28040 - RNA, 23 nt, Homo sapiens
ccgcuugagcuaacuccgacccg

SEQ ID NO: 28041 - RNA, 23 nt, Homo sapiens
uccaaucaguuccugaugcagua

SEQ ID NO: 28042 - RNA, 23 nt, Homo sapiens
agggauuccugggaaaacuggac

SEQ ID NO: 28043 - RNA, 22 nt, Homo sapiens
aagagggagacccaggcucgga

SEQ ID NO: 28044 - RNA, 22 nt, Homo sapiens
cagcugguugaaggggaccaaa

SEQ ID NO: 28045 - RNA, 22 nt, Homo sapiens
uagcugguugaaggggaccaaa

SEQ ID NO: 28046 - RNA, 22 nt, Homo sapiens
cuacccacagacguaccaauca

SEQ ID NO: 28047 - RNA, 22 nt, Homo sapiens
cugggggcggcacaggggcuca

SEQ ID NO: 28048 - RNA, 22 nt, Homo sapiens
ggagcccgcgccccgcgccgag

SEQ ID NO: 28049 - RNA, 22 nt, Homo sapiens
ucaacaucagucugauaagcua

SEQ ID NO: 28050 - RNA, 22 nt, Homo sapiens
ucagaccgagacaagugcaaug

SEQ ID NO: 28051 - RNA, 20 nt, Homo sapiens
agagaugagagaaacacccu

SEQ ID NO: 28052 - RNA, 25 nt, Homo sapiens
accaacggaccuacuucccuccgcc

SEQ ID NO: 28053 - RNA, 22 nt, Homo sapiens
ugcuguuagcccuagccccgca

SEQ ID NO: 28054 - RNA, 20 nt, Homo sapiens
cuggaggaagggcccagagg

SEQ ID NO: 28055 - RNA, 22 nt, Homo sapiens
gccuaagacacaggcccagaga

SEQ ID NO: 28056 - RNA, 20 nt, Homo sapiens
uccccacagacccagagccg

SEQ ID NO: 28057 - RNA, 17 nt, Homo sapiens
ggguggcagcgguggga

SEQ ID NO: 28058 - RNA, 21 nt, Homo sapiens
cacucugaagggaagcgcuuu

SEQ ID NO: 28059 - RNA, 22 nt, Homo sapiens
cacaaaccauuaugugcugcua

SEQ ID NO: 28060 - RNA, 22 nt, Homo sapiens
uguaaaccaugaugugcugcua

SEQ ID NO: 28061 - RNA, 22 nt, Homo sapiens
cgccaauauuuacgugcugcua

SEQ ID NO: 28062 - RNA, 21 nt, Homo sapiens
gccaauauuucugugcugcua

SEQ ID NO: 28063 - RNA, 22 nt, Homo sapiens
uucaaaacaugaauugcugcug

SEQ ID NO: 28064 - RNA, 21 nt, Homo sapiens
acaaaccacagugugcugcug

SEQ ID NO: 28065 - RNA, 22 nt, Homo sapiens
acaguggucaucgagugacaca

SEQ ID NO: 28066 - RNA, 22 nt, Homo sapiens
ucaggaacugccuuucucucca

SEQ ID NO: 28067 - RNA, 22 nt, Homo sapiens
ucagaccgagacaagugcaaug

SEQ ID NO: 28068 - RNA, 20 nt, Homo sapiens
gcaaugcaacagcaaugcac

SEQ ID NO: 28069 - RNA, 22 nt, Homo sapiens
aacgcuccaaaagaaggcacuc

SEQ ID NO: 28070 - RNA, 22 nt, Homo sapiens
aacacucuaaaaggaggcacuu

SEQ ID NO: 28071 - RNA, 22 nt, Homo sapiens
gcugccguauaugugaugucac

SEQ ID NO: 28072 - RNA, 22 nt, Homo sapiens
caaacaccauugucacacucca

SEQ ID NO: 28073 - RNA, 22 nt, Homo sapiens
acggaagggcagagagggccag

SEQ ID NO: 28074 - RNA, 23 nt, Homo sapiens
ggaagccaucaagucgcugcagg

SEQ ID NO: 28075 - RNA, 22 nt, Homo sapiens
cucccuucuuuccucccgucuu

SEQ ID NO: 28076 - RNA, 21 nt, Homo sapiens
gaaggaagugagugcagccac

SEQ ID NO: 28077 - RNA, 21 nt, Homo sapiens
agguaagcgcuguugcuagcc

SEQ ID NO: 28078 - RNA, 24 nt, Homo sapiens
cacccccagagccucagcucccca

SEQ ID NO: 28079 - RNA, 22 nt, Homo sapiens
ucaggaacugccuuucucucca

SEQ ID NO: 28080 - RNA, 22 nt, Homo sapiens
gcugaggcuguggggcuggagu

SEQ ID NO: 28081 - RNA, 20 nt, Homo sapiens
cuggggaaaaggguggcacg

SEQ ID NO: 28082 - RNA, 22 nt, Homo sapiens
gauuccaauuuuuccacaucuu

SEQ ID NO: 28083 - RNA, 21 nt, Homo sapiens
ccuucugacuccaaguccagu

SEQ ID NO: 28084 - RNA, 21 nt, Homo sapiens
agguaauaccaauaccuugug

SEQ ID NO: 28085 - RNA, 22 nt, Homo sapiens
aacuguacaaacuacuaccuca

SEQ ID NO: 28086 - RNA, 22 nt, Homo sapiens
uaaaugaauucaauuuccuucu

SEQ ID NO: 28087 - RNA, 22 nt, Homo sapiens
cuggagagacaaggggaagagg

SEQ ID NO: 28088 - RNA, 20 nt, Homo sapiens
gcagaagcauuuccacacac

SEQ ID NO: 28089 - RNA, 22 nt, Homo sapiens
acccuuaucaguucuccgucca

SEQ ID NO: 28090 - RNA, 20 nt, Homo sapiens
cuggaggaagggcccagagg

SEQ ID NO: 28091 - RNA, 22 nt, Homo sapiens
gccuaagacacaggcccagaga

SEQ ID NO: 28092 - RNA, 21 nt, Homo sapiens
caucaccuuccuucuccucca

SEQ ID NO: 28093 - RNA, 22 nt, Homo sapiens
caaacaccauugucacacucca

SEQ ID NO: 28094 - RNA, 22 nt, Homo sapiens
cucaauagacugugagcuccuu

SEQ ID NO: 28095 - RNA, 23 nt, Homo sapiens
cccagcuagauuguaagcuccuu

SEQ ID NO: 28096 - RNA, 22 nt, Homo sapiens
gccagcuaacaauacacugccu

SEQ ID NO: 28097 - RNA, 23 nt, Homo sapiens
caugagugacgcccucuggagua

SEQ ID NO: 28098 - RNA, 23 nt, Homo sapiens
ucucacccagguagcaaggauua

SEQ ID NO: 28099 - RNA, 19 nt, Homo sapiens
gcucuaagaaagccacacu

SEQ ID NO: 28100 - RNA, 22 nt, Homo sapiens
caaacaccauugucacacucca

SEQ ID NO: 28101 - RNA, 22 nt, Homo sapiens
ucccucacacagaauuccagaa

SEQ ID NO: 28102 - RNA, 21 nt, Homo sapiens
cggggugcacgggcggagggc

SEQ ID NO: 28103 - RNA, 22 nt, Homo sapiens
acccuuaucaguucuccgucca

SEQ ID NO: 28104 - RNA, 21 nt, Homo sapiens
gaccaaucgccguccccgccg

SEQ ID NO: 28105 - RNA, 21 nt, Homo sapiens
gaccaaucgccguccccgccg

SEQ ID NO: 28106 - RNA, 22 nt, Homo sapiens
ucaucucgcccgcaaagaccca

SEQ ID NO: 28107 - RNA, 23 nt, Homo sapiens
aaagucucgcucucugccccuca

SEQ ID NO: 28108 - RNA, 23 nt, Homo sapiens
ugcgaacucaccacggacaaccu

SEQ ID NO: 28109 - RNA, 22 nt, Homo sapiens
gcggucccgcggcgccccgccu

SEQ ID NO: 28110 - RNA, 22 nt, Homo sapiens
gcggucccgcggcgccccgccu

SEQ ID NO: 28111 - RNA, 22 nt, Homo sapiens
ugcuguuagcccuagccccgca

SEQ ID NO: 28112 - RNA, 22 nt, Homo sapiens
ugcuguuagcccuagccccgca

SEQ ID NO: 28113 - RNA, 22 nt, Homo sapiens
gguuaguggaccaggucacaaa

SEQ ID NO: 28114 - RNA, 23 nt, Homo sapiens
aaagucucgcucucugccccuca

SEQ ID NO: 28115 - RNA, 22 nt, Homo sapiens
aucgggaggggacugagccuga

SEQ ID NO: 28116 - RNA, 22 nt, Homo sapiens
gcugaggcuguggggcuggagu

SEQ ID NO: 28117 - RNA, 22 nt, Homo sapiens
aacuauacaaccuacuaccuca

SEQ ID NO: 28118 - RNA, 22 nt, Homo sapiens
aaccacacaaccuacuaccuca

SEQ ID NO: 28119 - RNA, 22 nt, Homo sapiens
aaccauacaaccuacuaccuca

SEQ ID NO: 28120 - RNA, 22 nt, Homo sapiens
aacuaugcaaccuacuaccucu

SEQ ID NO: 28121 - RNA, 22 nt, Homo sapiens
aacuauacaaccuccuaccuca

SEQ ID NO: 28122 - RNA, 22 nt, Homo sapiens
aacuauacaaucuacuaccuca

SEQ ID NO: 28123 - RNA, 22 nt, Homo sapiens
aacuguacaaacuacuaccuca

SEQ ID NO: 28124 - RNA, 22 nt, Homo sapiens
aacagcacaaacuacuaccuca

SEQ ID NO: 28125 - RNA, 22 nt, Homo sapiens
aacaauacaacuuacuaccuca

SEQ ID NO: 28126 - RNA, 22 nt, Homo sapiens
aggcauaggaugacaaagggaa

SEQ ID NO: 28127 - RNA, 22 nt, Homo sapiens
aggcgaaggaugacaaagggaa

SEQ ID NO: 28128 - RNA, 22 nt, Homo sapiens
acacucuaaaaggaugcacuuu

SEQ ID NO: 28129 - RNA, 22 nt, Homo sapiens
aaccucuaaaaggaugcacuuu

SEQ ID NO: 28130 - RNA, 22 nt, Homo sapiens
auccucuaaaaagaugcacuuu

SEQ ID NO: 28131 - RNA, 22 nt, Homo sapiens
agaaaaugccccucaguuuuga

SEQ ID NO: 28132 - RNA, 22 nt, Homo sapiens
gcaaaaguaacugcaguuuugg

SEQ ID NO: 28133 - RNA, 21 nt, Homo sapiens
gaccaaucgccguccccgccg

SEQ ID NO: 28134 - RNA, 22 nt, Homo sapiens
gcggucccgcggcgccccgccu

SEQ ID NO: 28135 - RNA, 23 nt, Homo sapiens
gggcucuuacucccucaggcacu

SEQ ID NO: 28136 - RNA, 22 nt, Homo sapiens
gugggguggguggucaggccga

SEQ ID NO: 28137 - RNA, 17 nt, Homo sapiens
gggagaggaggaggcga

SEQ ID NO: 28138 - RNA, 22 nt, Homo sapiens
cacgaccgacgccacgccgagu

SEQ ID NO: 28139 - RNA, 22 nt, Homo sapiens
ggagcccgcgccccgcgccgag

SEQ ID NO: 28140 - RNA, 23 nt, Homo sapiens
gggagugaagacacggagccaga

SEQ ID NO: 28141 - RNA, 22 nt, Homo sapiens
cuguuccugcugaacugagcca

SEQ ID NO: 28142 - RNA, 22 nt, Homo sapiens
ucagaccgagacaagugcaaug

SEQ ID NO: 28143 - RNA, 22 nt, Homo sapiens
uacagauggauaccgugcaauu

SEQ ID NO: 28144 - RNA, 22 nt, Homo sapiens
aggaaaccagcaaguguugacg

SEQ ID NO: 28145 - RNA, 25 nt, Homo sapiens
acggagcugucccaacaccaccccu

SEQ ID NO: 28146 - RNA, 22 nt, Homo sapiens
ugcuguuagcccuagccccgca

SEQ ID NO: 28147 - RNA, 23 nt, Homo sapiens
aggagaaggcaccaugggauuua

SEQ ID NO: 28148 - RNA, 21 nt, Homo sapiens
ucccagcacacauuuagcuca

SEQ ID NO: 28149 - RNA, 21 nt, Homo sapiens
cggggugcacgggcggagggc

SEQ ID NO: 28150 - RNA, 22 nt, Homo sapiens
aaucagucucauugcuuuauaa

SEQ ID NO: 28151 - RNA, 25 nt, Homo sapiens
accaacggaccuacuucccuccgcc

SEQ ID NO: 28152 - RNA, 23 nt, Homo sapiens
cuaucugcacuagaugcaccuua

SEQ ID NO: 28153 - RNA, 23 nt, Homo sapiens
aggaacagcagcagcccgggccg

SEQ ID NO: 28154 - RNA, 24 nt, Homo sapiens
acgcgcaggccagagacccaggca

SEQ ID NO: 28155 - RNA, 22 nt, Homo sapiens
ugcuguuagcccuagccccgca

SEQ ID NO: 28156 - RNA, 22 nt, Homo sapiens
ucaggaacugccuuucucucca

SEQ ID NO: 28157 - RNA, 20 nt, Homo sapiens
uacugcuuccacagcucccc

SEQ ID NO: 28158 - RNA, 22 nt, Homo sapiens
cuagggaacacagggcugguga

SEQ ID NO: 28159 - RNA, 23 nt, Homo sapiens
cggccugauucacaacaccagcu

SEQ ID NO: 28160 - RNA, 24 nt, Homo sapiens
ucacagguuaaagggucucaggga

SEQ ID NO: 28161 - RNA, 22 nt, Homo sapiens
ucacaaguuagggucucaggga

SEQ ID NO: 28162 - RNA, 23 nt, Homo sapiens
agcccuguucuacagcccugagg

SEQ ID NO: 28163 - RNA, 21 nt, Homo sapiens
ccgugguucuacccuguggua

SEQ ID NO: 28164 - RNA, 21 nt, Homo sapiens
aagggucaguaagcacccgcg

SEQ ID NO: 28165 - RNA, 21 nt, Homo sapiens
cccuccaccaugcaagggaug

SEQ ID NO: 28166 - RNA, 18 nt, Homo sapiens
ugguggcagaggugggau

SEQ ID NO: 28167 - RNA, 23 nt, Homo sapiens
uccauaaaguaggaaacacuaca

SEQ ID NO: 28168 - RNA, 22 nt, Homo sapiens
aaagugcuucuuaccuccagau

SEQ ID NO: 28169 - RNA, 23 nt, Homo sapiens
acacucuaaagagaagcgcuuug

SEQ ID NO: 28170 - RNA, 21 nt, Homo sapiens
agaaaguacuucccucuggag

SEQ ID NO: 28171 - RNA, 21 nt, Homo sapiens
agaaagugcaucccucuggag

SEQ ID NO: 28172 - RNA, 22 nt, Homo sapiens
gauuccaauuuuuccacaucuu

SEQ ID NO: 28173 - RNA, 23 nt, Homo sapiens
cuccagccccuccagggcuuccu

SEQ ID NO: 28174 - RNA, 22 nt, Homo sapiens
acaguucuucaacuggcagcuu

SEQ ID NO: 28175 - RNA, 23 nt, Homo sapiens
gcacaugugcacacagccgggug

SEQ ID NO: 28176 - RNA, 24 nt, Homo sapiens
cacccccagagccucagcucccca

SEQ ID NO: 28177 - RNA, 21 nt, Homo sapiens
guaaugggaccuuccucuuug

SEQ ID NO: 28178 - RNA, 21 nt, Homo sapiens
aagacgggaggagaggaguga

SEQ ID NO: 28179 - RNA, 22 nt, Homo sapiens
ugagccacugugccuggccuga

SEQ ID NO: 28180 - RNA, 23 nt, Homo sapiens
acucaccgacagcguugaauguu

SEQ ID NO: 28181 - RNA, 22 nt, Homo sapiens
cuguuccugcugaacugagcca

SEQ ID NO: 28182 - RNA, 22 nt, Homo sapiens
ugaagaagggggggaagggcgu

SEQ ID NO: 28183 - RNA, 22 nt, Homo sapiens
ccccucuggucaaccagucaca

SEQ ID NO: 28184 - RNA, 22 nt, Homo sapiens
cacaaaccauuaugugcugcua

SEQ ID NO: 28185 - RNA, 22 nt, Homo sapiens
uguaaaccaugaugugcugcua

SEQ ID NO: 28186 - RNA, 22 nt, Homo sapiens
cgccaauauuuacgugcugcua

SEQ ID NO: 28187 - RNA, 21 nt, Homo sapiens
gccaauauuucugugcugcua

SEQ ID NO: 28188 - RNA, 22 nt, Homo sapiens
cacucagcggccguuuccccaa

SEQ ID NO: 28189 - RNA, 22 nt, Homo sapiens
ggagagccuccacccaacccuc

SEQ ID NO: 28190 - RNA, 21 nt, Homo sapiens
ucaaucacagauagcaccccu

SEQ ID NO: 28191 - RNA, 22 nt, Homo sapiens
uucaaaacaugaauugcugcug

SEQ ID NO: 28192 - RNA, 21 nt, Homo sapiens
acaaaccacagugugcugcug

SEQ ID NO: 28193 - RNA, 19 nt, Homo sapiens
agaaaccccagcagagaca

SEQ ID NO: 28194 - RNA, 22 nt, Homo sapiens
gccaccuucaaaugggaagucu

SEQ ID NO: 28195 - RNA, 23 nt, Homo sapiens
acagcgcucgcaaccgcagcgau

SEQ ID NO: 28196 - RNA, 17 nt, Homo sapiens
uggaggccccagcgaga

SEQ ID NO: 28197 - RNA, 22 nt, Homo sapiens
uauccacuacaccccgcugccu

SEQ ID NO: 28198 - RNA, 22 nt, Homo sapiens
cacucuaaagggaggcacuuug

SEQ ID NO: 28199 - RNA, 22 nt, Homo sapiens
cacucuaaagggaggcacuuug

SEQ ID NO: 28200 - RNA, 22 nt, Homo sapiens
gggagaggucucccugcgcaca

SEQ ID NO: 28201 - RNA, 24 nt, Homo sapiens
acugcaggcuccagcuuccaggcu

SEQ ID NO: 28202 - RNA, 17 nt, Homo sapiens
gggagaggaggaggcga

SEQ ID NO: 28203 - RNA, 21 nt, Homo sapiens
acccaguagccagauguagcu

SEQ ID NO: 28204 - RNA, 21 nt, Homo sapiens
cguacgcuauacggucuacua

SEQ ID NO: 28205 - RNA, 22 nt, Homo sapiens
gcaaaagaaacugugguuuuug

SEQ ID NO: 28206 - RNA, 25 nt, Homo sapiens
acggagcugucccaacaccaccccu

SEQ ID NO: 28207 - RNA, 25 nt, Homo sapiens
accaacggaccuacuucccuccgcc

SEQ ID NO: 28208 - RNA, 21 nt, Homo sapiens
caucaccuuccuucuccucca

SEQ ID NO: 28209 - RNA, 20 nt, Homo sapiens
uacugcuuccacagcucccc

SEQ ID NO: 28210 - RNA, 22 nt, Homo sapiens
ccagugucuccaguaguagaca

SEQ ID NO: 28211 - RNA, 21 nt, Homo sapiens
gagcugcauccuggcuccggg

SEQ ID NO: 28212 - RNA, 20 nt, Homo sapiens
cugcgggaggacagggcuca

SEQ ID NO: 28213 - RNA, 22 nt, Homo sapiens
cuggagagacaaggggaagagg

SEQ ID NO: 28214 - RNA, 24 nt, Homo sapiens
gaaagugcauagaauucugucugg

SEQ ID NO: 28215 - RNA, 23 nt, Homo sapiens
ucacauaggaaugaaaagccaua

SEQ ID NO: 28216 - RNA, 21 nt, Homo sapiens
gggcaucugggacgcgcagga

SEQ ID NO: 28217 - RNA, 23 nt, Homo sapiens
agaggcaggcaugcgggcagaca

SEQ ID NO: 28218 - RNA, 23 nt, Homo sapiens
gaaagugcccucaaggcugagug

SEQ ID NO: 28219 - RNA, 19 nt, Homo sapiens
aagacauuuucagacagcu

SEQ ID NO: 28220 - RNA, 19 nt, Homo sapiens
ucccacaggaagcagacac

SEQ ID NO: 28221 - RNA, 20 nt, Homo sapiens
cccugcgccaucuccucuac

SEQ ID NO: 28222 - RNA, 22 nt, Homo sapiens
agacaacaaugccaaccucaca

SEQ ID NO: 28223 - RNA, 22 nt, Homo sapiens
acaaaaguugccuuugugugau

SEQ ID NO: 28224 - RNA, 23 nt, Homo sapiens
ucacauaggaaugaaaagccaua

SEQ ID NO: 28225 - RNA, 19 nt, Homo sapiens
accagugcccugcacacuu

SEQ ID NO: 28226 - RNA, 23 nt, Homo sapiens
cugugggagggcaguggugagag

SEQ ID NO: 28227 - RNA, 22 nt, Homo sapiens
ucaggaacugccuuucucucca

SEQ ID NO: 28228 - RNA, 20 nt, Homo sapiens
cccgccgcgucgcccugggg

SEQ ID NO: 28229 - RNA, 22 nt, Homo sapiens
ucgcccucucaacccagcuuuu

SEQ ID NO: 28230 - RNA, 22 nt, Homo sapiens
uugcccucucaacccagcuuuu

SEQ ID NO: 28231 - RNA, 20 nt, Homo sapiens
acccucucaacccagcuuuu

SEQ ID NO: 28232 - RNA, 19 nt, Homo sapiens
uccucucaacccagcuuuu

SEQ ID NO: 28233 - RNA, 21 nt, Homo sapiens
aguucucccaacguaaaccca

SEQ ID NO: 28234 - RNA, 23 nt, Homo sapiens
ggaagccaucaagucgcugcagg

SEQ ID NO: 28235 - RNA, 21 nt, Homo sapiens
cugaggagagaggaggugggg

SEQ ID NO: 28236 - RNA, 20 nt, Homo sapiens
uacugcuuccacagcucccc

SEQ ID NO: 28237 - RNA, 26 nt, Homo sapiens
uuucagaauuugcugccaucaucauc

SEQ ID NO: 28238 - RNA, 18 nt, Homo sapiens
aucacauucaccucccug

SEQ ID NO: 28239 - RNA, 23 nt, Homo sapiens
gggagugaagacacggagccaga

SEQ ID NO: 28240 - RNA, 21 nt, Homo sapiens
gaccaaucgccguccccgccg

SEQ ID NO: 28241 - RNA, 22 nt, Homo sapiens
cuacccacagacguaccaauca

SEQ ID NO: 28242 - RNA, 22 nt, Homo sapiens
gcggucccgcggcgccccgccu

SEQ ID NO: 28243 - RNA, 24 nt, Homo sapiens
cacccccagagccucagcucccca

SEQ ID NO: 28244 - RNA, 22 nt, Homo sapiens
cacaaguucggaucuacggguu

SEQ ID NO: 28245 - RNA, 21 nt, Homo sapiens
gagcugcauccuggcuccggg

SEQ ID NO: 28246 - RNA, 22 nt, Homo sapiens
gcacaaaucuccagaccaccca

SEQ ID NO: 28247 - RNA, 22 nt, Homo sapiens
ggagcccgcgccccgcgccgag

SEQ ID NO: 28248 - RNA, 21 nt, Homo sapiens
cccuccaccaugcaagggaug

SEQ ID NO: 28249 - RNA, 22 nt, Homo sapiens
agcugaguguaggauguuuaca

SEQ ID NO: 28250 - RNA, 23 nt, Homo sapiens
acaccaaugcccuaggggaugcg

SEQ ID NO: 28251 - RNA, 21 nt, Homo sapiens
uucuaggauaggcccaggggc

SEQ ID NO: 28252 - RNA, 23 nt, Homo sapiens
ucucacccagguagcaaggauua

SEQ ID NO: 28253 - RNA, 21 nt, Homo sapiens
acuccaaagggaagcgccuuc

SEQ ID NO: 28254 - RNA, 22 nt, Homo sapiens
cgcucuaaagggaagcgccuuc

SEQ ID NO: 28255 - RNA, 22 nt, Homo sapiens
ugcaagccuugggugugggagg

SEQ ID NO: 28256 - RNA, 22 nt, Homo sapiens
aguccagauucugugcccacca

SEQ ID NO: 28257 - RNA, 22 nt, Homo sapiens
acaguucuucaacuggcagcuu

SEQ ID NO: 28258 - RNA, 22 nt, Homo sapiens
ucgcccucucaacccagcuuuu

SEQ ID NO: 28259 - RNA, 22 nt, Homo sapiens
uugcccucucaacccagcuuuu

SEQ ID NO: 28260 - RNA, 20 nt, Homo sapiens
acccucucaacccagcuuuu

SEQ ID NO: 28261 - RNA, 19 nt, Homo sapiens
uccucucaacccagcuuuu

SEQ ID NO: 28262 - RNA, 23 nt, Homo sapiens
gaaagugcccucaaggcugagug

SEQ ID NO: 28263 - RNA, 22 nt, Homo sapiens
aacccucuaaaaggaagcacuu

SEQ ID NO: 28264 - RNA, 22 nt, Homo sapiens
aggucucacuuuguugcccaga

SEQ ID NO: 28265 - RNA, 25 nt, Homo sapiens
aaggagcucagaagcccugcccagc

SEQ ID NO: 28266 - RNA, 23 nt, Homo sapiens
cuaccugcacuauaagcacuuua

SEQ ID NO: 28267 - RNA, 17 nt, Homo sapiens
gacagccucucccccac

SEQ ID NO: 28268 - RNA, 23 nt, Homo sapiens
gaaagugcccucaaggcugagug

SEQ ID NO: 28269 - RNA, 24 nt, Homo sapiens
gaaagugcauagaauucugucugg

SEQ ID NO: 28270 - RNA, 19 nt, Homo sapiens
aagacauuuucagacagcu

SEQ ID NO: 28271 - RNA, 23 nt, Homo sapiens
aaaaugcagauuccuggacucca

SEQ ID NO: 28272 - RNA, 22 nt, Homo sapiens
gauccgagcaccggggaccccc

SEQ ID NO: 28273 - RNA, 19 nt, Homo sapiens
ucagcaguaccagccuaga

SEQ ID NO: 28274 - RNA, 20 nt, Homo sapiens
cucaaagcaaacccugcaga

SEQ ID NO: 28275 - RNA, 19 nt, Homo sapiens
cagcaucagcagcaucauc

SEQ ID NO: 28276 - RNA, 23 nt, Homo sapiens
aaaucagaaucacaccuggggga

SEQ ID NO: 28277 - RNA, 24 nt, Homo sapiens
acgcagagcccgaaagcccccagu

SEQ ID NO: 28278 - RNA, 22 nt, Homo sapiens
cuaccauaggguaaaaccacug

SEQ ID NO: 28279 - RNA, 23 nt, Homo sapiens
aaagucucgcucucugccccuca

SEQ ID NO: 28280 - RNA, 22 nt, Homo sapiens
cggugagcacccggccccugcg

SEQ ID NO: 28281 - RNA, 23 nt, Homo sapiens
agggauuccugggaaaacuggac

SEQ ID NO: 28282 - RNA, 20 nt, Homo sapiens
uaugaacaauuucuaggaau

SEQ ID NO: 28283 - RNA, 22 nt, Homo sapiens
cuagugguccuaaacauuucac

SEQ ID NO: 28284 - RNA, 21 nt, Homo sapiens
gcggaacuuagccacugugaa

SEQ ID NO: 28285 - RNA, 23 nt, Homo sapiens
caugagugacgcccucuggagua

SEQ ID NO: 28286 - RNA, 26 nt, Homo sapiens
uuucagaauuugcugccaucaucauc

SEQ ID NO: 28287 - RNA, 24 nt, Homo sapiens
cacccccagagccucagcucccca

SEQ ID NO: 28288 - RNA, 21 nt, Homo sapiens
acuccaaagggaagcgccuuc

SEQ ID NO: 28289 - RNA, 22 nt, Homo sapiens
cgcucuaaagggaagcgccuuc

SEQ ID NO: 28290 - RNA, 22 nt, Homo sapiens
uggcagcagcggagggggcaga

SEQ ID NO: 28291 - RNA, 20 nt, Homo sapiens
ccagcagcaccuggggcagu

SEQ ID NO: 28292 - RNA, 21 nt, Homo sapiens
auccuguacugagcugccccg

SEQ ID NO: 28293 - RNA, 25 nt, Homo sapiens
cagcgucugccggaacccguuccca

SEQ ID NO: 28294 - RNA, 22 nt, Homo sapiens
auggcaguggaguuagugauug

SEQ ID NO: 28295 - RNA, 21 nt, Homo sapiens
guccugagagcgcugccuccu

SEQ ID NO: 28296 - RNA, 25 nt, Homo sapiens
agcuagucaagcgcgguuguggggg

SEQ ID NO: 28297 - RNA, 22 nt, Homo sapiens
aacagcacaaacuacuaccuca

SEQ ID NO: 28298 - RNA, 22 nt, Homo sapiens
uagucaagugaagcagugggag

SEQ ID NO: 28299 - RNA, 23 nt, Homo sapiens
gaaagugcccucaaggcugagug

SEQ ID NO: 28300 - RNA, 22 nt, Homo sapiens
ugacgaugacaacgaugacgua

SEQ ID NO: 28301 - RNA, 20 nt, Homo sapiens
agagaugagagaaacacccu

SEQ ID NO: 28302 - RNA, 21 nt, Homo sapiens
ucacccagaucugcggccuaa

SEQ ID NO: 28303 - RNA, 22 nt, Homo sapiens
cuacccacagacguaccaauca

SEQ ID NO: 28304 - RNA, 22 nt, Homo sapiens
ugcaagccuugggugugggagg

SEQ ID NO: 28305 - RNA, 23 nt, Homo sapiens
cuaccugcacuauaagcacuuua

SEQ ID NO: 28306 - RNA, 21 nt, Homo sapiens
ugcaggcugaucuucuucucu

SEQ ID NO: 28307 - RNA, 21 nt, Homo sapiens
aacggaaccacuagugacuug

SEQ ID NO: 28308 - RNA, 22 nt, Homo sapiens
agccacaaucaccuucugaucu

SEQ ID NO: 28309 - RNA, 23 nt, Homo sapiens
cggcucugucgucgaggcgcuca

SEQ ID NO: 28310 - RNA, 17 nt, Homo sapiens
gacagccucucccccac

SEQ ID NO: 28311 - RNA, 22 nt, Homo sapiens
uccacauggaguugcuguuaca

SEQ ID NO: 28312 - RNA, 20 nt, Homo sapiens
uacugcuuccacagcucccc

SEQ ID NO: 28313 - RNA, 22 nt, Homo sapiens
cggugagcacccggccccugcg

SEQ ID NO: 28314 - RNA, 22 nt, Homo sapiens
gugggguggguggucaggccga

SEQ ID NO: 28315 - RNA, 22 nt, Homo sapiens
ucccucacacagaauuccagaa

SEQ ID NO: 28316 - RNA, 19 nt, Homo sapiens
aagacauuuucagacagcu

SEQ ID NO: 28317 - RNA, 22 nt, Homo sapiens
uccggggacgaacgggacgggu

SEQ ID NO: 28318 - RNA, 22 nt, Homo sapiens
agcccaaaaggagaauucuuug

SEQ ID NO: 28319 - RNA, 23 nt, Homo sapiens
caugagugacgcccucuggagua

SEQ ID NO: 28320 - RNA, 22 nt, Homo sapiens
gcugaggcuguggggcuggagu

SEQ ID NO: 28321 - RNA, 22 nt, Homo sapiens
acgguccuacacucaaggcaug

SEQ ID NO: 28322 - RNA, 23 nt, Homo sapiens
aggaacagcagcagcccgggccg

SEQ ID NO: 28323 - RNA, 18 nt, Homo sapiens
cccccaccaccacgcccg

SEQ ID NO: 28324 - RNA, 23 nt, Homo sapiens
gggagugaagacacggagccaga

SEQ ID NO: 28325 - RNA, 21 nt, Homo sapiens
acuccaaagggaagcgccuuc

SEQ ID NO: 28326 - RNA, 22 nt, Homo sapiens
cgcucuaaagggaagcgccuuc

SEQ ID NO: 28327 - RNA, 22 nt, Homo sapiens
ccucaggcacggccgggccacc

SEQ ID NO: 28328 - RNA, 20 nt, Homo sapiens
acaaugagaacccauggucu

SEQ ID NO: 28329 - RNA, 21 nt, Homo sapiens
gaccaagaaauagccuuucaa

SEQ ID NO: 28330 - RNA, 23 nt, Homo sapiens
caugagugacgcccucuggagua

SEQ ID NO: 28331 - RNA, 22 nt, Homo sapiens
gcaaaaguaauugcagugugug

SEQ ID NO: 28332 - RNA, 24 nt, Homo sapiens
cagaaagugcuuucuuuuggagaa

SEQ ID NO: 28333 - RNA, 22 nt, Homo sapiens
aacacucuaaaaggaggcacuu

SEQ ID NO: 28334 - RNA, 22 nt, Homo sapiens
agccacaaucaccuucugaucu

SEQ ID NO: 28335 - RNA, 21 nt, Homo sapiens
uucuaggauaggcccaggggc

SEQ ID NO: 28336 - RNA, 23 nt, Homo sapiens
gaaacccagcagacaauguagcu

SEQ ID NO: 28337 - RNA, 21 nt, Homo sapiens
gaccaagaaauagccuuucaa

SEQ ID NO: 28338 - RNA, 23 nt, Homo sapiens
gaaacccagcagacaauguagcu

SEQ ID NO: 28339 - RNA, 23 nt, Homo sapiens
gucagaccccgagggguccucgc

SEQ ID NO: 28340 - RNA, 22 nt, Homo sapiens
gugggguggguggucaggccga

SEQ ID NO: 28341 - RNA, 23 nt, Homo sapiens
cccaacagacauggcgguacuca

SEQ ID NO: 28342 - RNA, 22 nt, Homo sapiens
uagcagaagcauuuccgcacac

SEQ ID NO: 28343 - RNA, 22 nt, Homo sapiens
ugacgaugacaacgaugacgua

SEQ ID NO: 28344 - RNA, 22 nt, Homo sapiens
gcgaauauaacacggucgaucu

SEQ ID NO: 28345 - RNA, 21 nt, Homo sapiens
aagggucaguaagcacccgcg

SEQ ID NO: 28346 - RNA, 21 nt, Homo sapiens
gagcugcauccuggcuccggg

SEQ ID NO: 28347 - RNA, 23 nt, Homo sapiens
gggagugaagacacggagccaga

SEQ ID NO: 28348 - RNA, 21 nt, Homo sapiens
gaccaaucgccguccccgccg

SEQ ID NO: 28349 - RNA, 23 nt, Homo sapiens
aaagucucgcucucugccccuca

SEQ ID NO: 28350 - RNA, 22 nt, Homo sapiens
gcggucccgcggcgccccgccu

SEQ ID NO: 28351 - RNA, 17 nt, Homo sapiens
gggagaggaggaggcga

SEQ ID NO: 28352 - RNA, 21 nt, Homo sapiens
gaccaaucgccguccccgccg

SEQ ID NO: 28353 - RNA, 23 nt, Homo sapiens
aaagucucgcucucugccccuca

SEQ ID NO: 28354 - RNA, 22 nt, Homo sapiens
cucccuucuuuccucccgucuu

SEQ ID NO: 28355 - RNA, 22 nt, Homo sapiens
gugauugccacucuccugagua

SEQ ID NO: 28356 - RNA, 24 nt, Homo sapiens
cagaaagugcuuucuuuuggagaa

SEQ ID NO: 28357 - RNA, 22 nt, Homo sapiens
aacacucuaaaaggaggcacuu

SEQ ID NO: 28358 - RNA, 22 nt, Homo sapiens
gcggucccgcggcgccccgccu

SEQ ID NO: 28359 - RNA, 22 nt, Homo sapiens
ugcuguuagcccuagccccgca

SEQ ID NO: 28360 - RNA, 23 nt, Homo sapiens
ggaagccaucaagucgcugcagg

SEQ ID NO: 28361 - RNA, 21 nt, Homo sapiens
cucccccacugcagcuggcac

SEQ ID NO: 28362 - RNA, 18 nt, Homo sapiens
aucacauucaccucccug

SEQ ID NO: 28363 - RNA, 22 nt, Homo sapiens
acaccuggcuccacacgcgggc

SEQ ID NO: 28364 - RNA, 23 nt, Homo sapiens
gggagugaagacacggagccaga

SEQ ID NO: 28365 - RNA, 23 nt, Homo sapiens
cgugagcuccuggaggacaggga

SEQ ID NO: 28366 - RNA, 23 nt, Homo sapiens
aaagucucgcucucugccccuca

SEQ ID NO: 28367 - RNA, 21 nt, Homo sapiens
ugcaugacggccugcaagaca

SEQ ID NO: 28368 - RNA, 22 nt, Homo sapiens
ugugggugugugcaugagcgug

SEQ ID NO: 28369 - RNA, 22 nt, Homo sapiens
gauccgagcaccggggaccccc

SEQ ID NO: 28370 - RNA, 22 nt, Homo sapiens
caagacacauuuggagagggac

SEQ ID NO: 28371 - RNA, 20 nt, Homo sapiens
ugggccaccgccgagcggac

SEQ ID NO: 28372 - RNA, 23 nt, Homo sapiens
aaucgcgguuuauaccaaaugaa

SEQ ID NO: 28373 - RNA, 22 nt, Homo sapiens
gguuaguggaccaggucacaaa

SEQ ID NO: 28374 - RNA, 22 nt, Homo sapiens
caacaaaaucacugaugcugga

SEQ ID NO: 28375 - RNA, 20 nt, Homo sapiens
cccugcgccaucuccucuac

SEQ ID NO: 28376 - RNA, 23 nt, Homo sapiens
gaaacccagcagacaauguagcu

SEQ ID NO: 28377 - RNA, 23 nt, Homo sapiens
uguaggcuggggauaaaugaaua

SEQ ID NO: 28378 - RNA, 18 nt, Homo sapiens
acccucugaaaggaagca

SEQ ID NO: 28379 - RNA, 22 nt, Homo sapiens
aaagugcuucuuaccuccagau

SEQ ID NO: 28380 - RNA, 25 nt, Homo sapiens
accaacggaccuacuucccuccgcc

SEQ ID NO: 28381 - RNA, 22 nt, Homo sapiens
acacucuaaagggaagugcguu

SEQ ID NO: 28382 - RNA, 21 nt, Homo sapiens
agagcucauccauaguuguca

SEQ ID NO: 28383 - RNA, 22 nt, Homo sapiens
ucccucacacagaauuccagaa

SEQ ID NO: 28384 - RNA, 22 nt, Homo sapiens
augcuuuuugggguaagggcuu

SEQ ID NO: 28385 - RNA, 22 nt, Homo sapiens
uccacauggaguugcuguuaca

SEQ ID NO: 28386 - RNA, 23 nt, Homo sapiens
aaaucagaaucacaccuggggga

SEQ ID NO: 28387 - RNA, 24 nt, Homo sapiens
acgcagagcccgaaagcccccagu

SEQ ID NO: 28388 - RNA, 23 nt, Homo sapiens
cuccagccccuccagggcuuccu

SEQ ID NO: 28389 - RNA, 22 nt, Homo sapiens
gcaaaagaaacugugguuuuug

SEQ ID NO: 28390 - RNA, 22 nt, Homo sapiens
auccuucuacaaauucacccau

SEQ ID NO: 28391 - RNA, 21 nt, Homo sapiens
ugacugacagcuuuuugagua

SEQ ID NO: 28392 - RNA, 20 nt, Homo sapiens
uucccaugcccuauaccucu

SEQ ID NO: 28393 - RNA, 23 nt, Homo sapiens
acacagcucuuccauaucuccag

SEQ ID NO: 28394 - RNA, 20 nt, Homo sapiens
auuucuauaucuaucuccau

SEQ ID NO: 28395 - RNA, 19 nt, Homo sapiens
gccucagaggcagcugcuu

SEQ ID NO: 28396 - RNA, 22 nt, Homo sapiens
aggucucacuuuguugcccaga

SEQ ID NO: 28397 - RNA, 25 nt, Homo sapiens
aaggagcucagaagcccugcccagc

SEQ ID NO: 28398 - RNA, 24 nt, Homo sapiens
agugugaguucuaccauugccaaa

SEQ ID NO: 28399 - RNA, 22 nt, Homo sapiens
gauagagugcagaccagggucu

SEQ ID NO: 28400 - RNA, 26 nt, Homo sapiens
uuucagaauuugcugccaucaucauc

SEQ ID NO: 28401 - RNA, 20 nt, Homo sapiens
cuggaggaagggcccagagg

SEQ ID NO: 28402 - RNA, 22 nt, Homo sapiens
gccuaagacacaggcccagaga

SEQ ID NO: 28403 - RNA, 22 nt, Homo sapiens
cuggagagacaaggggaagagg

SEQ ID NO: 28404 - RNA, 21 nt, Homo sapiens
acaggauugagggggggcccu

SEQ ID NO: 28405 - RNA, 21 nt, Homo sapiens
acaggauugagggggggcccu

SEQ ID NO: 28406 - RNA, 21 nt, Homo sapiens
uucuaggauaggcccaggggc

SEQ ID NO: 28407 - RNA, 17 nt, Homo sapiens
gacagccucucccccac

SEQ ID NO: 28408 - RNA, 20 nt, Homo sapiens
uccccacagacccagagccg

SEQ ID NO: 28409 - RNA, 21 nt, Homo sapiens
gaccaaucgccguccccgccg

SEQ ID NO: 28410 - RNA, 22 nt, Homo sapiens
gcggucccgcggcgccccgccu

SEQ ID NO: 28411 - RNA, 22 nt, Homo sapiens
cucaauagacugugagcuccuu

SEQ ID NO: 28412 - RNA, 23 nt, Homo sapiens
cccagcuagauuguaagcuccuu

SEQ ID NO: 28413 - RNA, 18 nt, Homo sapiens
ggagaggagggcacugga

SEQ ID NO: 28414 - RNA, 24 nt, Homo sapiens
acacucuaaagggaagcacuuugu

SEQ ID NO: 28415 - RNA, 22 nt, Homo sapiens
acucuaaagggaagcacuuugu

SEQ ID NO: 28416 - RNA, 22 nt, Homo sapiens
cacugguacaaggguugggaga

SEQ ID NO: 28417 - RNA, 17 nt, Homo sapiens
gggagaggaggaggcga

SEQ ID NO: 28418 - RNA, 23 nt, Homo sapiens
gggagugaagacacggagccaga

SEQ ID NO: 28419 - RNA, 23 nt, Homo sapiens
gaaagugcccucaaggcugagug

SEQ ID NO: 28420 - RNA, 18 nt, Homo sapiens
ggagaggagggcacugga

SEQ ID NO: 28421 - RNA, 21 nt, Homo sapiens
acugaucuagagaacacaaga

SEQ ID NO: 28422 - RNA, 20 nt, Homo sapiens
guuugauaaacugacacaac

SEQ ID NO: 28423 - RNA, 22 nt, Homo sapiens
acaccuggcuccacacgcgggc

SEQ ID NO: 28424 - RNA, 22 nt, Homo sapiens
ugcuguuagcccuagccccgca

SEQ ID NO: 28425 - RNA, 21 nt, Homo sapiens
uucacuccaaaaggugcaaaa

SEQ ID NO: 28426 - RNA, 22 nt, Homo sapiens
gaacuugcuaaaaaugcagaau

SEQ ID NO: 28427 - RNA, 23 nt, Homo sapiens
agacaaggcccacccgugcaaac

SEQ ID NO: 28428 - RNA, 24 nt, Homo sapiens
acacucuaaagggaagcacuuugu

SEQ ID NO: 28429 - RNA, 22 nt, Homo sapiens
acucuaaagggaagcacuuugu

SEQ ID NO: 28430 - RNA, 21 nt, Homo sapiens
agaaguagaccauguguccua

SEQ ID NO: 28431 - RNA, 23 nt, Homo sapiens
gggagugaagacacggagccaga

SEQ ID NO: 28432 - RNA, 21 nt, Homo sapiens
gaccaaucgccguccccgccg

SEQ ID NO: 28433 - RNA, 22 nt, Homo sapiens
gcggucccgcggcgccccgccu

SEQ ID NO: 28434 - RNA, 21 nt, Homo sapiens
agggcucaucuugguccugca

SEQ ID NO: 28435 - RNA, 21 nt, Homo sapiens
gcugaggucugggccaggucu

SEQ ID NO: 28436 - RNA, 25 nt, Homo sapiens
accaacggaccuacuucccuccgcc

SEQ ID NO: 28437 - RNA, 22 nt, Homo sapiens
cuagugguccuaaacauuucac

SEQ ID NO: 28438 - RNA, 23 nt, Homo sapiens
agcaaaaaugugcuagugccaaa

SEQ ID NO: 28439 - RNA, 23 nt, Homo sapiens
ggaagccaucaagucgcugcagg

SEQ ID NO: 28440 - RNA, 22 nt, Homo sapiens
guccaaaguuggggugcugguu

SEQ ID NO: 28441 - RNA, 22 nt, Homo sapiens
cccaacaacaggaaacuaccua

SEQ ID NO: 28442 - RNA, 22 nt, Homo sapiens
ugugggugugugcaugagcgug

SEQ ID NO: 28443 - RNA, 22 nt, Homo sapiens
gaauucaucacggccagccucu

SEQ ID NO: 28444 - RNA, 24 nt, Homo sapiens
acgcgcaggccagagacccaggca

SEQ ID NO: 28445 - RNA, 22 nt, Homo sapiens
ucggucccucgggccagggcag

SEQ ID NO: 28446 - RNA, 21 nt, Homo sapiens
aucagagguucagcuuacccu

SEQ ID NO: 28447 - RNA, 19 nt, Homo sapiens
guugggaucacaggcgccc

SEQ ID NO: 28448 - RNA, 20 nt, Homo sapiens
ggggcagacagacgaggaag

SEQ ID NO: 28449 - RNA, 22 nt, Homo sapiens
aacccauggaauucaguucuca

SEQ ID NO: 28450 - RNA, 21 nt, Homo sapiens
gcagaacuuagccacugugaa

SEQ ID NO: 28451 - RNA, 25 nt, Homo sapiens
accaacggaccuacuucccuccgcc

SEQ ID NO: 28452 - RNA, 17 nt, Homo sapiens
gggagaggaggaggcga

SEQ ID NO: 28453 - RNA, 22 nt, Homo sapiens
uauccacuacaccccgcugccu

SEQ ID NO: 28454 - RNA, 21 nt, Homo sapiens
acuagcuuauacauaaaauua

SEQ ID NO: 28455 - RNA, 23 nt, Homo sapiens
aaagucucgcucucugccccuca

SEQ ID NO: 28456 - RNA, 21 nt, Homo sapiens
ggcugucaauucauaggucag

SEQ ID NO: 28457 - RNA, 24 nt, Homo sapiens
acugcaggcuccagcuuccaggcu

SEQ ID NO: 28458 - RNA, 23 nt, Homo sapiens
ucucacccagguagcaaggauua

SEQ ID NO: 28459 - RNA, 22 nt, Homo sapiens
ucaacaucagucugauaagcua

SEQ ID NO: 28460 - RNA, 20 nt, Homo sapiens
uacugcuuccacagcucccc

SEQ ID NO: 28461 - RNA, 19 nt, Homo sapiens
guccugaauuccgcagccu

SEQ ID NO: 28462 - RNA, 22 nt, Homo sapiens
uggcagcagcggagggggcaga

SEQ ID NO: 28463 - RNA, 20 nt, Homo sapiens
ccagcagcaccuggggcagu

SEQ ID NO: 28464 - RNA, 22 nt, Homo sapiens
aguccagauucugugcccacca

SEQ ID NO: 28465 - RNA, 22 nt, Homo sapiens
gcacauguucugcggcccacca

SEQ ID NO: 28466 - RNA, 23 nt, Homo sapiens
acacucaaaagauggcggcacuu

SEQ ID NO: 28467 - RNA, 22 nt, Homo sapiens
uccacauggaguugcuguuaca

SEQ ID NO: 28468 - RNA, 23 nt, Homo sapiens
acgggugcgauuucugugugaga

SEQ ID NO: 28469 - RNA, 22 nt, Homo sapiens
gcugaggcuguggggcuggagu

SEQ ID NO: 28470 - RNA, 18 nt, Homo sapiens
gaaaugagggccagcuga

SEQ ID NO: 28471 - RNA, 24 nt, Homo sapiens
cacccccagagccucagcucccca

SEQ ID NO: 28472 - RNA, 22 nt, Homo sapiens
acucaguaugccaggguaccau

SEQ ID NO: 28473 - RNA, 21 nt, Homo sapiens
gaccaaucgccguccccgccg

SEQ ID NO: 28474 - RNA, 22 nt, Homo sapiens
gcggucccgcggcgccccgccu

SEQ ID NO: 28475 - RNA, 22 nt, Homo sapiens
ugcuguuagcccuagccccgca

SEQ ID NO: 28476 - RNA, 20 nt, Homo sapiens
acaaugagaacccauggucu

SEQ ID NO: 28477 - RNA, 22 nt, Homo sapiens
caaacaccauugucacacucca

SEQ ID NO: 28478 - RNA, 23 nt, Homo sapiens
acccucuauagggaagcgcguuc

SEQ ID NO: 28479 - RNA, 22 nt, Homo sapiens
gcugccguauaugugaugucac

SEQ ID NO: 28480 - RNA, 21 nt, Homo sapiens
cugggggacggagcagaagga

SEQ ID NO: 28481 - RNA, 22 nt, Homo sapiens
ugagugcuugcuaggugccaag

SEQ ID NO: 28482 - RNA, 22 nt, Homo sapiens
agcccaaaaggagaauucuuug

SEQ ID NO: 28483 - RNA, 23 nt, Homo sapiens
agcaaaaaugugcuagugccaaa

SEQ ID NO: 28484 - RNA, 22 nt, Homo sapiens
agcuagugagaagucaaugccu

SEQ ID NO: 28485 - RNA, 22 nt, Homo sapiens
auaaggauuuuuaggggcauua

SEQ ID NO: 28486 - RNA, 23 nt, Homo sapiens
cggcucugucgucgaggcgcuca

SEQ ID NO: 28487 - RNA, 22 nt, Homo sapiens
uccggggacgaacgggacgggu

SEQ ID NO: 28488 - RNA, 25 nt, Homo sapiens
acggagcugucccaacaccaccccu

SEQ ID NO: 28489 - RNA, 22 nt, Homo sapiens
ugcuguuagcccuagccccgca

SEQ ID NO: 28490 - RNA, 20 nt, Homo sapiens
uacugcuuccacagcucccc

SEQ ID NO: 28491 - RNA, 22 nt, Homo sapiens
ggaggccgggacgagugcaaua

SEQ ID NO: 28492 - RNA, 23 nt, Homo sapiens
aagaaucuugucccgcagguccu

SEQ ID NO: 28493 - RNA, 21 nt, Homo sapiens
ggaaaucccuggcaaugugau

SEQ ID NO: 28494 - RNA, 21 nt, Homo sapiens
gguaaucccuggcaaugugau

SEQ ID NO: 28495 - RNA, 26 nt, Homo sapiens
uuucagaauuugcugccaucaucauc

SEQ ID NO: 28496 - RNA, 22 nt, Homo sapiens
aaggugauggucagcagacaua

SEQ ID NO: 28497 - RNA, 22 nt, Homo sapiens
ucaggaacugccuuucucucca

SEQ ID NO: 28498 - RNA, 22 nt, Homo sapiens
ggagcccgcgccccgcgccgag

SEQ ID NO: 28499 - RNA, 22 nt, Homo sapiens
uucacacugcaugcucugggua

SEQ ID NO: 28500 - RNA, 20 nt, Homo sapiens
acccaccuggagauccaugg

SEQ ID NO: 28501 - RNA, 19 nt, Homo sapiens
gcucuaagaaagccacacu

SEQ ID NO: 28502 - RNA, 20 nt, Homo sapiens
uccgccugucugaacaguga

SEQ ID NO: 28503 - RNA, 22 nt, Homo sapiens
agcugaguguaggauguuuaca

SEQ ID NO: 28504 - RNA, 24 nt, Homo sapiens
acgcgcaggccagagacccaggca

SEQ ID NO: 28505 - RNA, 20 nt, Homo sapiens
guuugauaaacugacacaac

SEQ ID NO: 28506 - RNA, 22 nt, Homo sapiens
cugggggcggcacaggggcuca

SEQ ID NO: 28507 - RNA, 21 nt, Homo sapiens
auaauggagaccaggccacga

SEQ ID NO: 28508 - RNA, 25 nt, Homo sapiens
acggagcugucccaacaccaccccu

SEQ ID NO: 28509 - RNA, 23 nt, Homo sapiens
cuaucugcacuagaugcaccuua

SEQ ID NO: 28510 - RNA, 22 nt, Homo sapiens
acacucuaaaaggaugcacuuu

SEQ ID NO: 28511 - RNA, 22 nt, Homo sapiens
aaccucuaaaaggaugcacuuu

SEQ ID NO: 28512 - RNA, 22 nt, Homo sapiens
auccucuaaaaagaugcacuuu

SEQ ID NO: 28513 - RNA, 22 nt, Homo sapiens
cuggagagacaaggggaagagg

SEQ ID NO: 28514 - RNA, 20 nt, Homo sapiens
cccugcgccaucuccucuac

SEQ ID NO: 28515 - RNA, 23 nt, Homo sapiens
agcagcauuguacagggcuauga

SEQ ID NO: 28516 - RNA, 18 nt, Homo sapiens
ugguggcagaggugggau

SEQ ID NO: 28517 - RNA, 24 nt, Homo sapiens
gaagucacucccaggcagcugcaa

SEQ ID NO: 28518 - RNA, 22 nt, Homo sapiens
ggcagagagucagagcgcggau

SEQ ID NO: 28519 - RNA, 21 nt, Homo sapiens
cugaggagagaggaggugggg

SEQ ID NO: 28520 - RNA, 22 nt, Homo sapiens
uggcagcagcggagggggcaga

SEQ ID NO: 28521 - RNA, 20 nt, Homo sapiens
cugcgggaggacagggcuca

SEQ ID NO: 28522 - RNA, 22 nt, Homo sapiens
ccucauggaaggguuccccacu

SEQ ID NO: 28523 - RNA, 22 nt, Homo sapiens
gugggguggguggucaggccga

SEQ ID NO: 28524 - RNA, 22 nt, Homo sapiens
cacucagcggccguuuccccaa

SEQ ID NO: 28525 - RNA, 22 nt, Homo sapiens
acugccugucugugccugcugu

SEQ ID NO: 28526 - RNA, 19 nt, Homo sapiens
uaugcuaccuuugcacggu

SEQ ID NO: 28527 - RNA, 21 nt, Homo sapiens
ggcugucaauucauaggucag

SEQ ID NO: 28528 - RNA, 22 nt, Homo sapiens
augcccuuuuaacauugcacug

SEQ ID NO: 28529 - RNA, 21 nt, Homo sapiens
ggaaaucccuggcaaugugau

SEQ ID NO: 28530 - RNA, 21 nt, Homo sapiens
gguaaucccuggcaaugugau

SEQ ID NO: 28531 - RNA, 21 nt, Homo sapiens
ccccucccagccucccugcca

SEQ ID NO: 28532 - RNA, 22 nt, Homo sapiens
agcugaguguaggauguuuaca

SEQ ID NO: 28533 - RNA, 21 nt, Homo sapiens
acaggauugagggggggcccu

SEQ ID NO: 28534 - RNA, 18 nt, Homo sapiens
gaaaugagggccagcuga

SEQ ID NO: 28535 - RNA, 21 nt, Homo sapiens
cccgaggagccgggcaggcuu

SEQ ID NO: 28536 - RNA, 22 nt, Homo sapiens
acaaaauccacaauuacuuuug

SEQ ID NO: 28537 - RNA, 23 nt, Homo sapiens
ucacauaggaauaaaaagccaua

SEQ ID NO: 28538 - RNA, 23 nt, Homo sapiens
ucacauaggaaugaaaagccaua

SEQ ID NO: 28539 - RNA, 23 nt, Homo sapiens
gggagugaagacacggagccaga

SEQ ID NO: 28540 - RNA, 23 nt, Homo sapiens
cuaacugcacuagaugcaccuua

SEQ ID NO: 28541 - RNA, 23 nt, Homo sapiens
uccaucauuacccggcaguauua

SEQ ID NO: 28542 - RNA, 22 nt, Homo sapiens
acaagcuuuuugcucgucuuau

SEQ ID NO: 28543 - RNA, 22 nt, Homo sapiens
acaaaccuuuuguucgucuuau

SEQ ID NO: 28544 - RNA, 22 nt, Homo sapiens
acggaagggcagagagggccag

SEQ ID NO: 28545 - RNA, 23 nt, Homo sapiens
ucucacccagguagcaaggauua

SEQ ID NO: 28546 - RNA, 22 nt, Homo sapiens
aguccagauucugugcccacca

SEQ ID NO: 28547 - RNA, 23 nt, Homo sapiens
gggcucuuacucccucaggcacu

SEQ ID NO: 28548 - RNA, 25 nt, Homo sapiens
aggccgccacccgcccgcgaucccu

SEQ ID NO: 28549 - RNA, 23 nt, Homo sapiens
cugugggagggcaguggugagag

SEQ ID NO: 28550 - RNA, 21 nt, Homo sapiens
gaccaagaaauagccuuucaa

SEQ ID NO: 28551 - RNA, 21 nt, Homo sapiens
aucugcacugucagcacuuua

SEQ ID NO: 28552 - RNA, 23 nt, Homo sapiens
gcuuugacaauaucauugcacug

SEQ ID NO: 28553 - RNA, 22 nt, Homo sapiens
aucgggaggggacugagccuga

SEQ ID NO: 28554 - RNA, 22 nt, Homo sapiens
acaaaaguugccuuugugugau

SEQ ID NO: 28555 - RNA, 19 nt, Homo sapiens
agaaaccccagcagagaca

SEQ ID NO: 28556 - RNA, 24 nt, Homo sapiens
ucacagguuaaagggucucaggga

SEQ ID NO: 28557 - RNA, 22 nt, Homo sapiens
ucacaaguuagggucucaggga

SEQ ID NO: 28558 - RNA, 23 nt, Homo sapiens
agcccuguucuacagcccugagg

SEQ ID NO: 28559 - RNA, 25 nt, Homo sapiens
acggagcugucccaacaccaccccu

SEQ ID NO: 28560 - RNA, 20 nt, Homo sapiens
uacugcuuccacagcucccc

SEQ ID NO: 28561 - RNA, 22 nt, Homo sapiens
aagcgguuuaccaucccacaua

SEQ ID NO: 28562 - RNA, 20 nt, Homo sapiens
uacugcuuccacagcucccc

SEQ ID NO: 28563 - RNA, 21 nt, Homo sapiens
ccuucugacuccaaguccagu

SEQ ID NO: 28564 - RNA, 22 nt, Homo sapiens
gccuucugacccuaaguccagu

SEQ ID NO: 28565 - RNA, 22 nt, Homo sapiens
ggagauggagccagggcccuaa

SEQ ID NO: 28566 - RNA, 23 nt, Homo sapiens
ucucgugacaugaugauccccga

SEQ ID NO: 28567 - RNA, 22 nt, Homo sapiens
caaacaccauugucacacucca

SEQ ID NO: 28568 - RNA, 23 nt, Homo sapiens
ucacauaggaaugaaaagccaua

SEQ ID NO: 28569 - RNA, 22 nt, Homo sapiens
acaaaaguugccuuugugugau

SEQ ID NO: 28570 - RNA, 21 nt, Homo sapiens
aggcggcaggcacaggacugg

SEQ ID NO: 28571 - RNA, 22 nt, Homo sapiens
accagcuaacaauacacugcca

SEQ ID NO: 28572 - RNA, 22 nt, Homo sapiens
aggaaaccagcaaguguugacg

SEQ ID NO: 28573 - RNA, 20 nt, Homo sapiens
cuggaggaagggcccagagg

SEQ ID NO: 28574 - RNA, 22 nt, Homo sapiens
gccuaagacacaggcccagaga

SEQ ID NO: 28575 - RNA, 22 nt, Homo sapiens
ugcaagccuugggugugggagg

SEQ ID NO: 28576 - RNA, 22 nt, Homo sapiens
gagcccuggacuaggagucagc

SEQ ID NO: 28577 - RNA, 22 nt, Homo sapiens
ugaagaagggggggaagggcgu

SEQ ID NO: 28578 - RNA, 19 nt, Homo sapiens
guccugaauuccgcagccu

SEQ ID NO: 28579 - RNA, 21 nt, Homo sapiens
agagcucauccauaguuguca

SEQ ID NO: 28580 - RNA, 22 nt, Homo sapiens
cacaaaccauuaugugcugcua

SEQ ID NO: 28581 - RNA, 23 nt, Homo sapiens
gggagugaagacacggagccaga

SEQ ID NO: 28582 - RNA, 23 nt, Homo sapiens
aggaacagcagcagcccgggccg

SEQ ID NO: 28583 - RNA, 21 nt, Homo sapiens
acaggauugagggggggcccu

SEQ ID NO: 28584 - RNA, 23 nt, Homo sapiens
aaagucucgcucucugccccuca

SEQ ID NO: 28585 - RNA, 22 nt, Homo sapiens
ugcuguuagcccuagccccgca

SEQ ID NO: 28586 - RNA, 22 nt, Homo sapiens
guagaagggaaucuugcauaag

SEQ ID NO: 28587 - RNA, 22 nt, Homo sapiens
aguccagauucugugcccacca

SEQ ID NO: 28588 - RNA, 22 nt, Homo sapiens
gcacauguucugcggcccacca

SEQ ID NO: 28589 - RNA, 21 nt, Homo sapiens
uggaaaccaagagugggucgc

SEQ ID NO: 28590 - RNA, 21 nt, Homo sapiens
cugaaaccaaguaugggucgc

SEQ ID NO: 28591 - RNA, 24 nt, Homo sapiens
acugggcacaaacauguccagguc

SEQ ID NO: 28592 - RNA, 22 nt, Homo sapiens
cucaauagacugugagcuccuu

SEQ ID NO: 28593 - RNA, 23 nt, Homo sapiens
cccagcuagauuguaagcuccuu

SEQ ID NO: 28594 - RNA, 20 nt, Homo sapiens
ggcauucaccgcgugccuua

SEQ ID NO: 28595 - RNA, 22 nt, Homo sapiens
cagaaagugcuucccucuagag

SEQ ID NO: 28596 - RNA, 21 nt, Homo sapiens
cacucugaagggaagcgcuuu

SEQ ID NO: 28597 - RNA, 21 nt, Homo sapiens
ccucuaaagagaagcgcuuuc

SEQ ID NO: 28598 - RNA, 22 nt, Homo sapiens
acacucuaaaaggaugcacuuu

SEQ ID NO: 28599 - RNA, 22 nt, Homo sapiens
cagaaagcgcuucccucuagag

SEQ ID NO: 28600 - RNA, 22 nt, Homo sapiens
cagaaagcgcuucccucuagag

SEQ ID NO: 28601 - RNA, 22 nt, Homo sapiens
cagaaagugcuucccucuagag

SEQ ID NO: 28602 - RNA, 22 nt, Homo sapiens
acacucuaaagggaaccauuuu

SEQ ID NO: 28603 - RNA, 23 nt, Homo sapiens
acccucuauagggaagcgcguuc

SEQ ID NO: 28604 - RNA, 22 nt, Homo sapiens
cagaaagugcuucccucuagag

SEQ ID NO: 28605 - RNA, 22 nt, Homo sapiens
cagacuccgguggaaugaagga

SEQ ID NO: 28606 - RNA, 21 nt, Homo sapiens
acaggauugagggggggcccu

SEQ ID NO: 28607 - RNA, 22 nt, Homo sapiens
gcugaggcuguggggcuggagu

SEQ ID NO: 28608 - RNA, 18 nt, Homo sapiens
ugguggcagaggugggau

SEQ ID NO: 28609 - RNA, 22 nt, Homo sapiens
ugcaagccuugggugugggagg

SEQ ID NO: 28610 - RNA, 21 nt, Homo sapiens
ugcaaugcaacuacaaugcac

SEQ ID NO: 28611 - RNA, 21 nt, Homo sapiens
gaccaaucgccguccccgccg

SEQ ID NO: 28612 - RNA, 22 nt, Homo sapiens
gcggucccgcggcgccccgccu

SEQ ID NO: 28613 - RNA, 24 nt, Homo sapiens
acgcgcaggccagagacccaggca

SEQ ID NO: 28614 - RNA, 22 nt, Homo sapiens
gaauucaucacggccagccucu

SEQ ID NO: 28615 - RNA, 21 nt, Homo sapiens
ccccucccagccucccugcca

SEQ ID NO: 28616 - RNA, 22 nt, Homo sapiens
gugggguggguggucaggccga

SEQ ID NO: 28617 - RNA, 18 nt, Homo sapiens
ugguggcagaggugggau

SEQ ID NO: 28618 - RNA, 24 nt, Homo sapiens
acugcuggucuucagucagggcca

SEQ ID NO: 28619 - RNA, 24 nt, Homo sapiens
acugcuggucuucagucagggcca

SEQ ID NO: 28620 - RNA, 23 nt, Homo sapiens
aggaacagcagcagcccgggccg

SEQ ID NO: 28621 - RNA, 21 nt, Homo sapiens
gaccaaucgccguccccgccg

SEQ ID NO: 28622 - RNA, 22 nt, Homo sapiens
uggcagcagcggagggggcaga

SEQ ID NO: 28623 - RNA, 20 nt, Homo sapiens
ccagcagcaccuggggcagu

SEQ ID NO: 28624 - RNA, 22 nt, Homo sapiens
gcggucccgcggcgccccgccu

SEQ ID NO: 28625 - RNA, 22 nt, Homo sapiens
cacucuaaagggaggcacuuug

SEQ ID NO: 28626 - RNA, 20 nt, Homo sapiens
uacugcuuccacagcucccc

SEQ ID NO: 28627 - RNA, 22 nt, Homo sapiens
ggaggccgggacgagugcaaua

SEQ ID NO: 28628 - RNA, 20 nt, Homo sapiens
acagcaaggagggcaggagg

SEQ ID NO: 28629 - RNA, 22 nt, Homo sapiens
acugccugucugugccugcugu

SEQ ID NO: 28630 - RNA, 21 nt, Homo sapiens
aaagaucaaccauguauuauu

SEQ ID NO: 28631 - RNA, 22 nt, Homo sapiens
accagguuccaccccagcaggc

SEQ ID NO: 28632 - RNA, 22 nt, Homo sapiens
aaagagguuaaccauguauuau

SEQ ID NO: 28633 - RNA, 20 nt, Homo sapiens
uacugcuuccacagcucccc

SEQ ID NO: 28634 - RNA, 22 nt, Homo sapiens
acacacccacgcgagccggaaa

SEQ ID NO: 28635 - RNA, 19 nt, Homo sapiens
ccaccucccgaguccucac

SEQ ID NO: 28636 - RNA, 22 nt, Homo sapiens
aggucucacuuuguugcccaga

SEQ ID NO: 28637 - RNA, 18 nt, Homo sapiens
aucacauucaccucccug

SEQ ID NO: 28638 - RNA, 23 nt, Homo sapiens
gggagugaagacacggagccaga

SEQ ID NO: 28639 - RNA, 21 nt, Homo sapiens
acuagacugugagcuccucga

SEQ ID NO: 28640 - RNA, 21 nt, Homo sapiens
gaccaaucgccguccccgccg

SEQ ID NO: 28641 - RNA, 19 nt, Homo sapiens
auuuugguacagcagcuca

SEQ ID NO: 28642 - RNA, 19 nt, Homo sapiens
gccugcugacaccgugccu

SEQ ID NO: 28643 - RNA, 19 nt, Homo sapiens
guccugaauuccgcagccu

SEQ ID NO: 28644 - RNA, 25 nt, Homo sapiens
aaggagcucagaagcccugcccagc

SEQ ID NO: 28645 - RNA, 19 nt, Homo sapiens
gccucagaggcagcugcuu

SEQ ID NO: 28646 - RNA, 22 nt, Homo sapiens
gcggucccgcggcgccccgccu

SEQ ID NO: 28647 - RNA, 22 nt, Homo sapiens
gaggcucagaauggcucaggag

SEQ ID NO: 28648 - RNA, 22 nt, Homo sapiens
cuagggaacacagggcugguga

SEQ ID NO: 28649 - RNA, 22 nt, Homo sapiens
cuggagagacaaggggaagagg

SEQ ID NO: 28650 - RNA, 23 nt, Homo sapiens
gaaacccagcagacaauguagcu

SEQ ID NO: 28651 - RNA, 22 nt, Homo sapiens
uacagauggauaccgugcaauu

SEQ ID NO: 28652 - RNA, 23 nt, Homo sapiens
ccacccaaugaccuacuccaaga

SEQ ID NO: 28653 - RNA, 25 nt, Homo sapiens
acggagcugucccaacaccaccccu

SEQ ID NO: 28654 - RNA, 21 nt, Homo sapiens
aggagacucacaaguuccugc

SEQ ID NO: 28655 - RNA, 21 nt, Homo sapiens
aggagacucacaaguuccugc

SEQ ID NO: 28656 - RNA, 24 nt, Homo sapiens
acugcuggucuucagucagggcca

SEQ ID NO: 28657 - RNA, 21 nt, Homo sapiens
ccccucccagccucccugcca

SEQ ID NO: 28658 - RNA, 21 nt, Homo sapiens
aaagagaccgguucacuguga

SEQ ID NO: 28659 - RNA, 20 nt, Homo sapiens
cucaaagcaaacccugcaga

SEQ ID NO: 28660 - RNA, 22 nt, Homo sapiens
cagaaagugcuucccucuagag

SEQ ID NO: 28661 - RNA, 20 nt, Homo sapiens
guuugauaaacugacacaac

SEQ ID NO: 28662 - RNA, 22 nt, Homo sapiens
gcaaaagaaacugugguuuuug

SEQ ID NO: 28663 - RNA, 23 nt, Homo sapiens
gggagugaagacacggagccaga

SEQ ID NO: 28664 - RNA, 22 nt, Homo sapiens
ucaggaacugccuuucucucca

SEQ ID NO: 28665 - RNA, 22 nt, Homo sapiens
gagcccuggacuaggagucagc

SEQ ID NO: 28666 - RNA, 22 nt, Homo sapiens
agcugaguguaggauguuuaca

SEQ ID NO: 28667 - RNA, 21 nt, Homo sapiens
ccccucccagccucccugcca

SEQ ID NO: 28668 - RNA, 22 nt, Homo sapiens
cuagggaacacagggcugguga

SEQ ID NO: 28669 - RNA, 23 nt, Homo sapiens
cggccugauucacaacaccagcu

SEQ ID NO: 28670 - RNA, 20 nt, Homo sapiens
cccgccgcgucgcccugggg

SEQ ID NO: 28671 - RNA, 22 nt, Homo sapiens
agcgggacuuugagggccaguu

SEQ ID NO: 28672 - RNA, 20 nt, Homo sapiens
acagcaaggagggcaggagg

SEQ ID NO: 28673 - RNA, 22 nt, Homo sapiens
gaaccuaucuccccucuggacc

SEQ ID NO: 28674 - RNA, 21 nt, Homo sapiens
aucugcacugucagcacuuua

SEQ ID NO: 28675 - RNA, 23 nt, Homo sapiens
gcuuugacaauaucauugcacug

SEQ ID NO: 28676 - RNA, 21 nt, Homo sapiens
uucuaggauaggcccaggggc

SEQ ID NO: 28677 - RNA, 23 nt, Homo sapiens
cugcagaacuguucccgcugcua

SEQ ID NO: 28678 - RNA, 19 nt, Homo sapiens
agaaaccccagcagagaca

SEQ ID NO: 28679 - RNA, 22 nt, Homo sapiens
uggggacccucccugaaccaag

SEQ ID NO: 28680 - RNA, 21 nt, Homo sapiens
caucaccuuccuucuccucca

SEQ ID NO: 28681 - RNA, 21 nt, Homo sapiens
ggggagcgggggcccugccuu

SEQ ID NO: 28682 - RNA, 23 nt, Homo sapiens
cugugggagggcaguggugagag

SEQ ID NO: 28683 - RNA, 22 nt, Homo sapiens
auccuucuacaaauucacccau

SEQ ID NO: 28684 - RNA, 22 nt, Homo sapiens
gaaccuaucuccccucuggacc

SEQ ID NO: 28685 - RNA, 22 nt, Homo sapiens
ucacauuugccugcagagauuu

SEQ ID NO: 28686 - RNA, 21 nt, Homo sapiens
ccuucugacuccaaguccagu

SEQ ID NO: 28687 - RNA, 22 nt, Homo sapiens
gccuucugacccuaaguccagu

SEQ ID NO: 28688 - RNA, 22 nt, Homo sapiens
cucagagcagacgugguucuca

SEQ ID NO: 28689 - RNA, 22 nt, Homo sapiens
cacauggccaaaacagagaaga

SEQ ID NO: 28690 - RNA, 21 nt, Homo sapiens
ccccucccagccucccugcca

SEQ ID NO: 28691 - RNA, 21 nt, Homo sapiens
cugaggagagaggaggugggg

SEQ ID NO: 28692 - RNA, 22 nt, Homo sapiens
caaacaccauugucacacucca

SEQ ID NO: 28693 - RNA, 22 nt, Homo sapiens
gugggguggguggucaggccga

SEQ ID NO: 28694 - RNA, 23 nt, Homo sapiens
ucacauaggaaugaaaagccaua

SEQ ID NO: 28695 - RNA, 22 nt, Homo sapiens
uucacacugcaugcucugggua

SEQ ID NO: 28696 - RNA, 22 nt, Homo sapiens
cccaacaacaggaaacuaccua

SEQ ID NO: 28697 - RNA, 22 nt, Homo sapiens
cacucagcggccguuuccccaa

SEQ ID NO: 28698 - RNA, 22 nt, Homo sapiens
agcugaguguaggauguuuaca

SEQ ID NO: 28699 - RNA, 22 nt, Homo sapiens
ccucauggaaggguuccccacu

SEQ ID NO: 28700 - RNA, 22 nt, Homo sapiens
aguccagauucugugcccacca

SEQ ID NO: 28701 - RNA, 25 nt, Homo sapiens
acggagcugucccaacaccaccccu

SEQ ID NO: 28702 - RNA, 22 nt, Homo sapiens
gcacauguucugcggcccacca

SEQ ID NO: 28703 - RNA, 24 nt, Homo sapiens
acgcgcaggccagagacccaggca

SEQ ID NO: 28704 - RNA, 20 nt, Homo sapiens
aggggccucagccuccuggu

SEQ ID NO: 28705 - RNA, 20 nt, Homo sapiens
uacugcuuccacagcucccc

SEQ ID NO: 28706 - RNA, 21 nt, Homo sapiens
ggggagcgggggcccugccuu

SEQ ID NO: 28707 - RNA, 23 nt, Homo sapiens
cacaaauucggaucuacagggua

SEQ ID NO: 28708 - RNA, 23 nt, Homo sapiens
cacaaauucgguucuacagggua

SEQ ID NO: 28709 - RNA, 22 nt, Homo sapiens
ggcucccaagaaccucaccugu

SEQ ID NO: 28710 - RNA, 23 nt, Homo sapiens
ccuucucagaaaggugaaauuua

SEQ ID NO: 28711 - RNA, 23 nt, Homo sapiens
ccuucucagaaaggugaaauuua

SEQ ID NO: 28712 - RNA, 22 nt, Homo sapiens
uuucaguuaucaaucugucaca

SEQ ID NO: 28713 - RNA, 21 nt, Homo sapiens
aucagagguucagcuuacccu

SEQ ID NO: 28714 - RNA, 18 nt, Homo sapiens
cccccaccaccacgcccg

SEQ ID NO: 28715 - RNA, 23 nt, Homo sapiens
aggaacagcagcagcccgggccg

SEQ ID NO: 28716 - RNA, 22 nt, Homo sapiens
ucaggaacugccuuucucucca

SEQ ID NO: 28717 - RNA, 21 nt, Homo sapiens
gaccaaucgccguccccgccg

SEQ ID NO: 28718 - RNA, 22 nt, Homo sapiens
gcggucccgcggcgccccgccu

SEQ ID NO: 28719 - RNA, 22 nt, Homo sapiens
ugcuguuagcccuagccccgca

SEQ ID NO: 28720 - RNA, 24 nt, Homo sapiens
cacccccagagccucagcucccca

SEQ ID NO: 28721 - RNA, 21 nt, Homo sapiens
gagcugcauccuggcuccggg

SEQ ID NO: 28722 - RNA, 20 nt, Homo sapiens
cucaaagcaaacccugcaga

SEQ ID NO: 28723 - RNA, 20 nt, Homo sapiens
ggggggcgaggcagguguga

SEQ ID NO: 28724 - RNA, 23 nt, Homo sapiens
aaaaugcagauuccuggacucca

SEQ ID NO: 28725 - RNA, 23 nt, Homo sapiens
cuaccugcacuguaagcacuuug

SEQ ID NO: 28726 - RNA, 20 nt, Homo sapiens
acagcaaggagggcaggagg

SEQ ID NO: 28727 - RNA, 22 nt, Homo sapiens
caugauugccacgucugcagua

SEQ ID NO: 28728 - RNA, 21 nt, Homo sapiens
ugauugccacugucugcagua

SEQ ID NO: 28729 - RNA, 22 nt, Homo sapiens
gauccgagcaccggggaccccc

SEQ ID NO: 28730 - RNA, 25 nt, Homo sapiens
aggccgccacccgcccgcgaucccu

SEQ ID NO: 28731 - RNA, 24 nt, Homo sapiens
acgcgcaggccagagacccaggca

SEQ ID NO: 28732 - RNA, 24 nt, Homo sapiens
acgcgcaggccagagacccaggca

SEQ ID NO: 28733 - RNA, 22 nt, Homo sapiens
cugggggcggcacaggggcuca

SEQ ID NO: 28734 - RNA, 22 nt, Homo sapiens
cuggagagacaaggggaagagg

SEQ ID NO: 28735 - RNA, 22 nt, Homo sapiens
uaaaugaauucaauuuccuucu

SEQ ID NO: 28736 - RNA, 17 nt, Homo sapiens
gggagaggaggaggcga

SEQ ID NO: 28737 - RNA, 18 nt, Homo sapiens
aucacauucaccucccug

SEQ ID NO: 28738 - RNA, 23 nt, Homo sapiens
gggagugaagacacggagccaga

SEQ ID NO: 28739 - RNA, 22 nt, Homo sapiens
aggcauaggaugacaaagggaa

SEQ ID NO: 28740 - RNA, 22 nt, Homo sapiens
aggcgaaggaugacaaagggaa

SEQ ID NO: 28741 - RNA, 23 nt, Homo sapiens
aaagucucgcucucugccccuca

SEQ ID NO: 28742 - RNA, 20 nt, Homo sapiens
cccugcgccaucuccucuac

SEQ ID NO: 28743 - RNA, 23 nt, Homo sapiens
cacaaauucgguucuacagggua

SEQ ID NO: 28744 - RNA, 22 nt, Homo sapiens
ugaagaagggggggaagggcgu

SEQ ID NO: 28745 - RNA, 22 nt, Homo sapiens
agccaagcucagacggauccga

SEQ ID NO: 28746 - RNA, 24 nt, Homo sapiens
agugugaguucuaccauugccaaa

SEQ ID NO: 28747 - RNA, 22 nt, Homo sapiens
cuguuccugcugaacugagcca

SEQ ID NO: 28748 - RNA, 22 nt, Homo sapiens
aaagugcuucuuaccuccagau

SEQ ID NO: 28749 - RNA, 20 nt, Homo sapiens
uccccacagacccagagccg

SEQ ID NO: 28750 - RNA, 22 nt, Homo sapiens
gaggcucagaauggcucaggag

SEQ ID NO: 28751 - RNA, 20 nt, Homo sapiens
ggcauucaccgcgugccuua

SEQ ID NO: 28752 - RNA, 17 nt, Homo sapiens
gggagaggaggaggcga

SEQ ID NO: 28753 - RNA, 22 nt, Homo sapiens
acuccaacagggccgcgucucc

SEQ ID NO: 28754 - RNA, 21 nt, Homo sapiens
gagcuacagugcuucaucuca

SEQ ID NO: 28755 - RNA, 22 nt, Homo sapiens
ccggcugcaacacaagacacga

SEQ ID NO: 28756 - RNA, 21 nt, Homo sapiens
agagcucauccauaguuguca

SEQ ID NO: 28757 - RNA, 23 nt, Homo sapiens
cugcagaacuguucccgcugcua

SEQ ID NO: 28758 - RNA, 21 nt, Homo sapiens
ucuacucagaagggugccuua

SEQ ID NO: 28759 - RNA, 23 nt, Homo sapiens
acagcgcucgcaaccgcagcgau

SEQ ID NO: 28760 - RNA, 19 nt, Homo sapiens
accagugcccugcacacuu

SEQ ID NO: 28761 - RNA, 22 nt, Homo sapiens
uggggacccucccugaaccaag

SEQ ID NO: 28762 - RNA, 21 nt, Homo sapiens
aggagacucacaaguuccugc

SEQ ID NO: 28763 - RNA, 23 nt, Homo sapiens
gucacaucccucccaagacccuc

SEQ ID NO: 28764 - RNA, 24 nt, Homo sapiens
acugcuggucuucagucagggcca

SEQ ID NO: 28765 - RNA, 21 nt, Homo sapiens
aggcggcaggcacaggacugg

SEQ ID NO: 28766 - RNA, 20 nt, Homo sapiens
cccgccgcgucgcccugggg

SEQ ID NO: 28767 - RNA, 22 nt, Homo sapiens
ucaucucgcccgcaaagaccca

SEQ ID NO: 28768 - RNA, 19 nt, Homo sapiens
uaugcuaccuuugcacggu

SEQ ID NO: 28769 - RNA, 22 nt, Homo sapiens
acggaagggcagagagggccag

SEQ ID NO: 28770 - RNA, 23 nt, Homo sapiens
aaaucagaaucacaccuggggga

SEQ ID NO: 28771 - RNA, 21 nt, Homo sapiens
ccuucugacuccaaguccagu

SEQ ID NO: 28772 - RNA, 22 nt, Homo sapiens
gccagcuaacaauacacugccu

SEQ ID NO: 28773 - RNA, 21 nt, Homo sapiens
auccuguacugagcugccccg

SEQ ID NO: 28774 - RNA, 24 nt, Homo sapiens
acgcagagcccgaaagcccccagu

SEQ ID NO: 28775 - RNA, 22 nt, Homo sapiens
ccucaggcacggccgggccacc

SEQ ID NO: 28776 - RNA, 21 nt, Homo sapiens
ccccucccagccucccugcca

SEQ ID NO: 28777 - RNA, 22 nt, Homo sapiens
cuagggaacacagggcugguga

SEQ ID NO: 28778 - RNA, 22 nt, Homo sapiens
ucaggaacugccuuucucucca

SEQ ID NO: 28779 - RNA, 22 nt, Homo sapiens
cggugagcacccggccccugcg

SEQ ID NO: 28780 - RNA, 21 nt, Homo sapiens
ggaaaucccuggcaaugugau

SEQ ID NO: 28781 - RNA, 21 nt, Homo sapiens
gguaaucccuggcaaugugau

SEQ ID NO: 28782 - RNA, 22 nt, Homo sapiens
ccucauggaaggguuccccacu

SEQ ID NO: 28783 - RNA, 19 nt, Homo sapiens
uagcauacagauacgccca

SEQ ID NO: 28784 - RNA, 19 nt, Homo sapiens
guccugaauuccgcagccu

SEQ ID NO: 28785 - RNA, 20 nt, Homo sapiens
uacugcuuccacagcucccc

SEQ ID NO: 28786 - RNA, 22 nt, Homo sapiens
aacuauacaaccuacuaccuca

SEQ ID NO: 28787 - RNA, 22 nt, Homo sapiens
aaccacacaaccuacuaccuca

SEQ ID NO: 28788 - RNA, 22 nt, Homo sapiens
aaccauacaaccuacuaccuca

SEQ ID NO: 28789 - RNA, 22 nt, Homo sapiens
aacuaugcaaccuacuaccucu

SEQ ID NO: 28790 - RNA, 22 nt, Homo sapiens
aacuauacaaccuccuaccuca

SEQ ID NO: 28791 - RNA, 22 nt, Homo sapiens
aacuauacaaucuacuaccuca

SEQ ID NO: 28792 - RNA, 22 nt, Homo sapiens
aacuguacaaacuacuaccuca

SEQ ID NO: 28793 - RNA, 22 nt, Homo sapiens
aacagcacaaacuacuaccuca

SEQ ID NO: 28794 - RNA, 21 nt, Homo sapiens
cugaggagagaggaggugggg

SEQ ID NO: 28795 - RNA, 22 nt, Homo sapiens
agacaacaaugccaaccucaca

SEQ ID NO: 28796 - RNA, 22 nt, Homo sapiens
cacucagcggccguuuccccaa

SEQ ID NO: 28797 - RNA, 22 nt, Homo sapiens
ccucauggaaggguuccccacu

SEQ ID NO: 28798 - RNA, 20 nt, Homo sapiens
uacugcuuccacagcucccc

SEQ ID NO: 28799 - RNA, 22 nt, Homo sapiens
aacaauacaacuuacuaccuca

SEQ ID NO: 28800 - RNA, 22 nt, Homo sapiens
acaaaguucuguagugcacuga

SEQ ID NO: 28801 - RNA, 20 nt, Homo sapiens
cccgccgcgucgcccugggg

SEQ ID NO: 28802 - RNA, 21 nt, Homo sapiens
aucugcacugucagcacuuua

SEQ ID NO: 28803 - RNA, 23 nt, Homo sapiens
gcuuugacaauaucauugcacug

SEQ ID NO: 28804 - RNA, 23 nt, Homo sapiens
augcaaaguugcucggguaaccu

SEQ ID NO: 28805 - RNA, 21 nt, Homo sapiens
aguucucccaacguaaaccca

SEQ ID NO: 28806 - RNA, 23 nt, Homo sapiens
uguaggcuggggauaaaugaaua

SEQ ID NO: 28807 - RNA, 23 nt, Homo sapiens
ggaagccaucaagucgcugcagg

SEQ ID NO: 28808 - RNA, 20 nt, Homo sapiens
ggcauucaccgcgugccuua

SEQ ID NO: 28809 - RNA, 21 nt, Homo sapiens
aagacgggaggagaggaguga

SEQ ID NO: 28810 - RNA, 22 nt, Homo sapiens
cucccuucuuuccucccgucuu

SEQ ID NO: 28811 - RNA, 21 nt, Homo sapiens
ucuacucagaagggugccuua

SEQ ID NO: 28812 - RNA, 19 nt, Homo sapiens
gccugcugacaccgugccu

SEQ ID NO: 28813 - RNA, 20 nt, Homo sapiens
aggggccucagccuccuggu

SEQ ID NO: 28814 - RNA, 22 nt, Homo sapiens
agcucagaacccagaggucuca

SEQ ID NO: 28815 - RNA, 20 nt, Homo sapiens
uacugcuuccacagcucccc

SEQ ID NO: 28816 - RNA, 23 nt, Homo sapiens
ucacauaggaaugaaaagccaua

SEQ ID NO: 28817 - RNA, 23 nt, Homo sapiens
gggagugaagacacggagccaga

SEQ ID NO: 28818 - RNA, 21 nt, Homo sapiens
ugcaaacccugcaugugggag

SEQ ID NO: 28819 - RNA, 21 nt, Homo sapiens
aucugcacugucagcacuuua

SEQ ID NO: 28820 - RNA, 23 nt, Homo sapiens
gcuuugacaauaucauugcacug

SEQ ID NO: 28821 - RNA, 22 nt, Homo sapiens
ugcaagccuugggugugggagg

SEQ ID NO: 28822 - RNA, 20 nt, Homo sapiens
agagaugagagaaacacccu

SEQ ID NO: 28823 - RNA, 21 nt, Homo sapiens
caucaccuuccuucuccucca

SEQ ID NO: 28824 - RNA, 22 nt, Homo sapiens
agcuagugagaagucaaugccu

SEQ ID NO: 28825 - RNA, 22 nt, Homo sapiens
ucccucacacagaauuccagaa

SEQ ID NO: 28826 - RNA, 22 nt, Homo sapiens
cagaagugggccgggcacaggg

SEQ ID NO: 28827 - RNA, 22 nt, Homo sapiens
aaagagguuaaccagguguguu

SEQ ID NO: 28828 - RNA, 22 nt, Homo sapiens
gagcccuggacuaggagucagc

SEQ ID NO: 28829 - RNA, 22 nt, Homo sapiens
auggcaguggaguuagugauug

SEQ ID NO: 28830 - RNA, 22 nt, Homo sapiens
ugaauccuugaauagguguguu

SEQ ID NO: 28831 - RNA, 22 nt, Homo sapiens
aggaaaccagcaaguguugacg

SEQ ID NO: 28832 - RNA, 23 nt, Homo sapiens
acacucuaaagagaagcgcuuug

SEQ ID NO: 28833 - RNA, 21 nt, Homo sapiens
agaaaguacuucccucuggag

SEQ ID NO: 28834 - RNA, 21 nt, Homo sapiens
agaaagugcaucccucuggag

SEQ ID NO: 28835 - RNA, 20 nt, Homo sapiens
guguguauacauuuauacau

SEQ ID NO: 28836 - RNA, 20 nt, Homo sapiens
agagaugagagaaacacccu

SEQ ID NO: 28837 - RNA, 22 nt, Homo sapiens
ccucuaguaaauaugucagcau

SEQ ID NO: 28838 - RNA, 23 nt, Homo sapiens
uguaggcuggggauaaaugaaua

SEQ ID NO: 28839 - RNA, 21 nt, Homo sapiens
caucaccuuccuucuccucca

SEQ ID NO: 28840 - RNA, 21 nt, Homo sapiens
cacaaccucaguguuuccagg

SEQ ID NO: 28841 - RNA, 20 nt, Homo sapiens
uacugcuuccacagcucccc

SEQ ID NO: 28842 - RNA, 22 nt, Homo sapiens
uccggggacgaacgggacgggu

SEQ ID NO: 28843 - RNA, 22 nt, Homo sapiens
ccacacacuuccuuacauucca

SEQ ID NO: 28844 - RNA, 23 nt, Homo sapiens
aaaucagaaucacaccuggggga

SEQ ID NO: 28845 - RNA, 22 nt, Homo sapiens
aggaaaccagcaaguguugacg

SEQ ID NO: 28846 - RNA, 24 nt, Homo sapiens
acgcagagcccgaaagcccccagu

SEQ ID NO: 28847 - RNA, 24 nt, Homo sapiens
acgcgcaggccagagacccaggca

SEQ ID NO: 28848 - RNA, 22 nt, Homo sapiens
ggaggccgggacgagugcaaua

SEQ ID NO: 28849 - RNA, 22 nt, Homo sapiens
ggcagagagucagagcgcggau

SEQ ID NO: 28850 - RNA, 21 nt, Homo sapiens
cugaggagagaggaggugggg

SEQ ID NO: 28851 - RNA, 19 nt, Homo sapiens
aagccaaagccuuauccau

SEQ ID NO: 28852 - RNA, 20 nt, Homo sapiens
gcagaagcauuuccacacac

SEQ ID NO: 28853 - RNA, 22 nt, Homo sapiens
cagaaagugcuucccucuagag

SEQ ID NO: 28854 - RNA, 21 nt, Homo sapiens
ugcaaacccugcaugugggag

SEQ ID NO: 28855 - RNA, 22 nt, Homo sapiens
cucaauagacugugagcuccuu

SEQ ID NO: 28856 - RNA, 22 nt, Homo sapiens
agcugaguguaggauguuuaca

SEQ ID NO: 28857 - RNA, 22 nt, Homo sapiens
ugcaacuuaguaaugugcaaua

SEQ ID NO: 28858 - RNA, 21 nt, Homo sapiens
uucuaggauaggcccaggggc

SEQ ID NO: 28859 - RNA, 22 nt, Homo sapiens
caacaaaaucacugaugcugga

SEQ ID NO: 28860 - RNA, 22 nt, Homo sapiens
uauggaugcaaaaugaucccaa

SEQ ID NO: 28861 - RNA, 22 nt, Homo sapiens
guagaagggaaucuugcauaag

SEQ ID NO: 28862 - RNA, 22 nt, Homo sapiens
ccuggcacacaguagaccuuca

SEQ ID NO: 28863 - RNA, 22 nt, Homo sapiens
ugcaagccuugggugugggagg

SEQ ID NO: 28864 - RNA, 21 nt, Homo sapiens
uugucuaaccagucaccuguu

SEQ ID NO: 28865 - RNA, 22 nt, Homo sapiens
ccucaggcacggccgggccacc

SEQ ID NO: 28866 - RNA, 23 nt, Homo sapiens
cccagcuagauuguaagcuccuu

SEQ ID NO: 28867 - RNA, 21 nt, Homo sapiens
caucaccuuccuucuccucca

SEQ ID NO: 28868 - RNA, 23 nt, Homo sapiens
aaccaagaccccggagaucccag

SEQ ID NO: 28869 - RNA, 20 nt, Homo sapiens
uacugcuuccacagcucccc

SEQ ID NO: 28870 - RNA, 22 nt, Homo sapiens
ccccucuggucaaccagucaca

SEQ ID NO: 28871 - RNA, 22 nt, Homo sapiens
ucacaguugccagcugagauua

SEQ ID NO: 28872 - RNA, 22 nt, Homo sapiens
cucaauagacugugagcuccuu

SEQ ID NO: 28873 - RNA, 22 nt, Homo sapiens
agcugaguguaggauguuuaca

SEQ ID NO: 28874 - RNA, 23 nt, Homo sapiens
aaagucucgcucucugccccuca

SEQ ID NO: 28875 - RNA, 22 nt, Homo sapiens
cucagagcagacgugguucuca

SEQ ID NO: 28876 - RNA, 24 nt, Homo sapiens
acgcgcaggccagagacccaggca

SEQ ID NO: 28877 - RNA, 23 nt, Homo sapiens
cccagcuagauuguaagcuccuu

SEQ ID NO: 28878 - RNA, 21 nt, Homo sapiens
caucaccuuccuucuccucca

SEQ ID NO: 28879 - RNA, 22 nt, Homo sapiens
caaacaccauugucacacucca

SEQ ID NO: 28880 - RNA, 22 nt, Homo sapiens
gugggguggguggucaggccga

SEQ ID NO: 28881 - RNA, 21 nt, Homo sapiens
uuuagcauaaguaugucccaa

SEQ ID NO: 28882 - RNA, 22 nt, Homo sapiens
ucaggaacugccuuucucucca

SEQ ID NO: 28883 - RNA, 21 nt, Homo sapiens
gaccaaucgccguccccgccg

SEQ ID NO: 28884 - RNA, 22 nt, Homo sapiens
uggcagcagcggagggggcaga

SEQ ID NO: 28885 - RNA, 20 nt, Homo sapiens
acagcaaggagggcaggagg

SEQ ID NO: 28886 - RNA, 21 nt, Homo sapiens
acaggauugagggggggcccu

SEQ ID NO: 28887 - RNA, 20 nt, Homo sapiens
ccagcagcaccuggggcagu

SEQ ID NO: 28888 - RNA, 21 nt, Homo sapiens
auccuguacugagcugccccg

SEQ ID NO: 28889 - RNA, 23 nt, Homo sapiens
cugcagaacuguucccgcugcua

SEQ ID NO: 28890 - RNA, 19 nt, Homo sapiens
guccugaauuccgcagccu

SEQ ID NO: 28891 - RNA, 23 nt, Homo sapiens
acagcgcucgcaaccgcagcgau

SEQ ID NO: 28892 - RNA, 22 nt, Homo sapiens
gcggucccgcggcgccccgccu

SEQ ID NO: 28893 - RNA, 22 nt, Homo sapiens
gcggucccgcggcgccccgccu

SEQ ID NO: 28894 - RNA, 22 nt, Homo sapiens
ugcuguuagcccuagccccgca

SEQ ID NO: 28895 - RNA, 22 nt, Homo sapiens
ugcuguuagcccuagccccgca

SEQ ID NO: 28896 - RNA, 22 nt, Homo sapiens
acuggguucaccuuuaagggca

SEQ ID NO: 28897 - RNA, 24 nt, Homo sapiens
ucagagcauguguuuaaucaggcu

SEQ ID NO: 28898 - RNA, 23 nt, Homo sapiens
aggaacagcagcagcccgggccg

SEQ ID NO: 28899 - RNA, 22 nt, Homo sapiens
ucaucucgcccgcaaagaccca

SEQ ID NO: 28900 - RNA, 22 nt, Homo sapiens
acaaaaguugccuuugugugau

SEQ ID NO: 28901 - RNA, 22 nt, Homo sapiens
cacucuaaagggaggcacuuug

SEQ ID NO: 28902 - RNA, 24 nt, Homo sapiens
acugcuggucuucagucagggcca

SEQ ID NO: 28903 - RNA, 23 nt, Homo sapiens
gggagugaagacacggagccaga

SEQ ID NO: 28904 - RNA, 23 nt, Homo sapiens
aggaacagcagcagcccgggccg

SEQ ID NO: 28905 - RNA, 22 nt, Homo sapiens
uagucaagugaagcagugggag

SEQ ID NO: 28906 - RNA, 21 nt, Homo sapiens
acaggauugagggggggcccu

SEQ ID NO: 28907 - RNA, 22 nt, Homo sapiens
agcugaguguaggauguuuaca

SEQ ID NO: 28908 - RNA, 23 nt, Homo sapiens
aaagucucgcucucugccccuca

SEQ ID NO: 28909 - RNA, 22 nt, Homo sapiens
ugcaagccuugggugugggagg

SEQ ID NO: 28910 - RNA, 25 nt, Homo sapiens
aggccgccacccgcccgcgaucccu

SEQ ID NO: 28911 - RNA, 20 nt, Homo sapiens
aggggccucagccuccuggu

SEQ ID NO: 28912 - RNA, 18 nt, Homo sapiens
gaaaugagggccagcuga

SEQ ID NO: 28913 - RNA, 23 nt, Homo sapiens
gggagugaagacacggagccaga

SEQ ID NO: 28914 - RNA, 22 nt, Homo sapiens
ucaggaacugccuuucucucca

SEQ ID NO: 28915 - RNA, 22 nt, Homo sapiens
uccacauggaguugcuguuaca

SEQ ID NO: 28916 - RNA, 22 nt, Homo sapiens
uagucaagugaagcagugggag

SEQ ID NO: 28917 - RNA, 22 nt, Homo sapiens
agcugaguguaggauguuuaca

SEQ ID NO: 28918 - RNA, 21 nt, Homo sapiens
aguucucccaacguaaaccca

SEQ ID NO: 28919 - RNA, 24 nt, Homo sapiens
acgcgcaggccagagacccaggca

SEQ ID NO: 28920 - RNA, 21 nt, Homo sapiens
gguggagcccugagaaccgga

SEQ ID NO: 28921 - RNA, 23 nt, Homo sapiens
cacugugggcccucuccgcacca

SEQ ID NO: 28922 - RNA, 21 nt, Homo sapiens
caucaccuuccuucuccucca

SEQ ID NO: 28923 - RNA, 27 nt, Homo sapiens
ugcccacucucaccaucaccuacagug

SEQ ID NO: 28924 - RNA, 22 nt, Homo sapiens
cugggggcggcacaggggcuca

SEQ ID NO: 28925 - RNA, 21 nt, Homo sapiens
uggggauuacacuucaacagg

SEQ ID NO: 28926 - RNA, 22 nt, Homo sapiens
cuggagacacgugcacuguaga

SEQ ID NO: 28927 - RNA, 23 nt, Homo sapiens
gcgcccaauuaaugucuguugau

SEQ ID NO: 28928 - RNA, 21 nt, Homo sapiens
gcuccaaccucagcagacugu

SEQ ID NO: 28929 - RNA, 22 nt, Homo sapiens
ccucuaguaaauaugucagcau

SEQ ID NO: 28930 - RNA, 19 nt, Homo sapiens
gccucagaggcagcugcuu

SEQ ID NO: 28931 - RNA, 22 nt, Homo sapiens
gggagaggucucccugcgcaca

SEQ ID NO: 28932 - RNA, 22 nt, Homo sapiens
cugggggcggcacaggggcuca

SEQ ID NO: 28933 - RNA, 22 nt, Homo sapiens
caaacaccauugucacacucca

SEQ ID NO: 28934 - RNA, 22 nt, Homo sapiens
agccaagcucagacggauccga

SEQ ID NO: 28935 - RNA, 17 nt, Homo sapiens
gggagaggaggaggcga

SEQ ID NO: 28936 - RNA, 22 nt, Homo sapiens
ucaggaacugccuuucucucca

SEQ ID NO: 28937 - RNA, 21 nt, Homo sapiens
ugcaaacccugcaugugggag

SEQ ID NO: 28938 - RNA, 22 nt, Homo sapiens
uauggaugcaaaaugaucccaa

SEQ ID NO: 28939 - RNA, 19 nt, Homo sapiens
guugggaucacaggcgccc

SEQ ID NO: 28940 - RNA, 22 nt, Homo sapiens
aagagggagacccaggcucgga

SEQ ID NO: 28941 - RNA, 23 nt, Homo sapiens
aaccaagaccccggagaucccag

SEQ ID NO: 28942 - RNA, 20 nt, Homo sapiens
uacugcuuccacagcucccc

SEQ ID NO: 28943 - RNA, 17 nt, Homo sapiens
gggagaggaggaggcga

SEQ ID NO: 28944 - RNA, 23 nt, Homo sapiens
gggagugaagacacggagccaga

SEQ ID NO: 28945 - RNA, 21 nt, Homo sapiens
gaccaaucgccguccccgccg

SEQ ID NO: 28946 - RNA, 21 nt, Homo sapiens
cucacucagauggccaacuca

SEQ ID NO: 28947 - RNA, 25 nt, Homo sapiens
acggagcugucccaacaccaccccu

SEQ ID NO: 28948 - RNA, 22 nt, Homo sapiens
gcggucccgcggcgccccgccu

SEQ ID NO: 28949 - RNA, 22 nt, Homo sapiens
gcugaggcuguggggcuggagu

SEQ ID NO: 28950 - RNA, 24 nt, Homo sapiens
ucagagcauguguuuaaucaggcu

SEQ ID NO: 28951 - RNA, 22 nt, Homo sapiens
cuggagagacaaggggaagagg

SEQ ID NO: 28952 - RNA, 22 nt, Homo sapiens
gcacaaaucuccagaccaccca

SEQ ID NO: 28953 - RNA, 22 nt, Homo sapiens
aacccauggaauucaguucuca

SEQ ID NO: 28954 - RNA, 22 nt, Homo sapiens
gcuggguggagaagguggugaa

SEQ ID NO: 28955 - RNA, 22 nt, Homo sapiens
acaguucuucaacuggcagcuu

SEQ ID NO: 28956 - RNA, 21 nt, Homo sapiens
aagugucagacacgguggugg

SEQ ID NO: 28957 - RNA, 23 nt, Homo sapiens
aaaucagaaucacaccuggggga

SEQ ID NO: 28958 - RNA, 22 nt, Homo sapiens
uacagauggauaccgugcaauu

SEQ ID NO: 28959 - RNA, 23 nt, Homo sapiens
caugagugacgcccucuggagua

SEQ ID NO: 28960 - RNA, 19 nt, Homo sapiens
auuuugguacagcagcuca

SEQ ID NO: 28961 - RNA, 25 nt, Homo sapiens
acggagcugucccaacaccaccccu

SEQ ID NO: 28962 - RNA, 24 nt, Homo sapiens
acgcagagcccgaaagcccccagu

SEQ ID NO: 28963 - RNA, 22 nt, Homo sapiens
cacauggccaaaacagagaaga

SEQ ID NO: 28964 - RNA, 22 nt, Homo sapiens
caaacaccauugucacacucca

SEQ ID NO: 28965 - RNA, 20 nt, Homo sapiens
ggggcagacagacgaggaag

SEQ ID NO: 28966 - RNA, 21 nt, Homo sapiens
gggcaucugggacgcgcagga

SEQ ID NO: 28967 - RNA, 23 nt, Homo sapiens
acccucuauagggaagcgcguuc

SEQ ID NO: 28968 - RNA, 26 nt, Homo sapiens
aaccaucucauacaaaccaacuacuu

SEQ ID NO: 28969 - RNA, 22 nt, Homo sapiens
acaguucuucaacuggcagcuu

SEQ ID NO: 28970 - RNA, 22 nt, Homo sapiens
auaaggauuuuuaggggcauua

SEQ ID NO: 28971 - RNA, 19 nt, Homo sapiens
auuuugguacagcagcuca

SEQ ID NO: 28972 - RNA, 21 nt, Homo sapiens
aucuuugauuuucaguaguuu

SEQ ID NO: 28973 - RNA, 21 nt, Homo sapiens
aguucucccaacguaaaccca

SEQ ID NO: 28974 - RNA, 23 nt, Homo sapiens
cacugugggcccucuccgcacca

SEQ ID NO: 28975 - RNA, 22 nt, Homo sapiens
ugcuguuagcccuagccccgca

SEQ ID NO: 28976 - RNA, 20 nt, Homo sapiens
cucaaagcaaacccugcaga

SEQ ID NO: 28977 - RNA, 21 nt, Homo sapiens
cugaggagagaggaggugggg

SEQ ID NO: 28978 - RNA, 23 nt, Homo sapiens
gggagugaagacacggagccaga

SEQ ID NO: 28979 - RNA, 23 nt, Homo sapiens
cuaccugcacuguaagcacuuug

SEQ ID NO: 28980 - RNA, 21 nt, Homo sapiens
gaccaaucgccguccccgccg

SEQ ID NO: 28981 - RNA, 21 nt, Homo sapiens
aggcggcaggcacaggacugg

SEQ ID NO: 28982 - RNA, 23 nt, Homo sapiens
gaaacccagcagacaauguagcu

SEQ ID NO: 28983 - RNA, 22 nt, Homo sapiens
agcugaguguaggauguuuaca

SEQ ID NO: 28984 - RNA, 23 nt, Homo sapiens
aaagucucgcucucugccccuca

SEQ ID NO: 28985 - RNA, 22 nt, Homo sapiens
caugauugccacgucugcagua

SEQ ID NO: 28986 - RNA, 21 nt, Homo sapiens
ugauugccacugucugcagua

SEQ ID NO: 28987 - RNA, 22 nt, Homo sapiens
aguccagauucugugcccacca

SEQ ID NO: 28988 - RNA, 21 nt, Homo sapiens
cucacucagauggccaacuca

SEQ ID NO: 28989 - RNA, 19 nt, Homo sapiens
uagcauacagauacgccca

SEQ ID NO: 28990 - RNA, 23 nt, Homo sapiens
aggagaaggcaccaugggauuua

SEQ ID NO: 28991 - RNA, 22 nt, Homo sapiens
aagagggagacccaggcucgga

SEQ ID NO: 28992 - RNA, 22 nt, Homo sapiens
gcacauguucugcggcccacca

SEQ ID NO: 28993 - RNA, 22 nt, Homo sapiens
gcggucccgcggcgccccgccu

SEQ ID NO: 28994 - RNA, 22 nt, Homo sapiens
uggugauucacaaagaaaucca

SEQ ID NO: 28995 - RNA, 20 nt, Homo sapiens
uacugcuuccacagcucccc

SEQ ID NO: 28996 - RNA, 24 nt, Homo sapiens
cacccccagagccucagcucccca

SEQ ID NO: 28997 - RNA, 24 nt, Homo sapiens
cacccccagagccucagcucccca

SEQ ID NO: 28998 - RNA, 22 nt, Homo sapiens
uccggggacgaacgggacgggu

SEQ ID NO: 28999 - RNA, 22 nt, Homo sapiens
cuaccauaggguaaaaccacug

SEQ ID NO: 29000 - RNA, 21 nt, Homo sapiens
gaccaaucgccguccccgccg

SEQ ID NO: 29001 - RNA, 21 nt, Homo sapiens
agagcucauccauaguuguca

SEQ ID NO: 29002 - RNA, 22 nt, Homo sapiens
gcggucccgcggcgccccgccu

SEQ ID NO: 29003 - RNA, 22 nt, Homo sapiens
ugcuguuagcccuagccccgca

SEQ ID NO: 29004 - RNA, 22 nt, Homo sapiens
ugcuguuagcccuagccccgca

SEQ ID NO: 29005 - RNA, 21 nt, Homo sapiens
aacauacaaaggguauccucu

SEQ ID NO: 29006 - RNA, 27 nt, Homo sapiens
uuuagcacagugcuuauacaagaaggu

SEQ ID NO: 29007 - RNA, 20 nt, Homo sapiens
ugucuccacagggcucuuua

SEQ ID NO: 29008 - RNA, 22 nt, Homo sapiens
augcccuuucaucauugcacug

SEQ ID NO: 29009 - RNA, 18 nt, Homo sapiens
aucacauucaccucccug

SEQ ID NO: 29010 - RNA, 22 nt, Homo sapiens
accuaauauaucaaacauauca

SEQ ID NO: 29011 - RNA, 22 nt, Homo sapiens
cccaacaacaggaaacuaccua

SEQ ID NO: 29012 - RNA, 23 nt, Homo sapiens
acacucaaaagauggcggcacuu

SEQ ID NO: 29013 - RNA, 21 nt, Homo sapiens
aagacgggaggagaggaguga

SEQ ID NO: 29014 - RNA, 22 nt, Homo sapiens
aucgggaggggacugagccuga

SEQ ID NO: 29015 - RNA, 22 nt, Homo sapiens
gccaccuucaaaugggaagucu

SEQ ID NO: 29016 - RNA, 23 nt, Homo sapiens
ggacauuguuucagugcccaagu

SEQ ID NO: 29017 - RNA, 21 nt, Homo sapiens
caucaccuuccuucuccucca

SEQ ID NO: 29018 - RNA, 21 nt, Homo sapiens
aucugcacugucagcacuuua

SEQ ID NO: 29019 - RNA, 22 nt, Homo sapiens
ugaagaagggggggaagggcgu

SEQ ID NO: 29020 - RNA, 18 nt, Homo sapiens
ggagaggagggcacugga

SEQ ID NO: 29021 - RNA, 22 nt, Homo sapiens
caacaaaaucacugaugcugga

SEQ ID NO: 29022 - RNA, 22 nt, Homo sapiens
ugugggugugugcaugagcgug

SEQ ID NO: 29023 - RNA, 22 nt, Homo sapiens
gggagaggucucccugcgcaca

SEQ ID NO: 29024 - RNA, 23 nt, Homo sapiens
gcacaugugcacacagccgggug

SEQ ID NO: 29025 - RNA, 23 nt, Homo sapiens
ucauagcccuguacaaugcugcu

SEQ ID NO: 29026 - RNA, 23 nt, Homo sapiens
ugauagcccuguacaaugcugcu

SEQ ID NO: 29027 - RNA, 21 nt, Homo sapiens
ccaaccaaugaaagaaugcuu

SEQ ID NO: 29028 - RNA, 22 nt, Homo sapiens
cugggggcggcacaggggcuca

SEQ ID NO: 29029 - RNA, 22 nt, Homo sapiens
agcccaaaaggagaauucuuug

SEQ ID NO: 29030 - RNA, 22 nt, Homo sapiens
cuguuccugcugaacugagcca

SEQ ID NO: 29031 - RNA, 22 nt, Homo sapiens
uccagcaaagggaagcgcuuuc

SEQ ID NO: 29032 - RNA, 22 nt, Homo sapiens
accucuaaaggggagcgcuuug

SEQ ID NO: 29033 - RNA, 23 nt, Homo sapiens
acacucuaaagagaagcgcuuug

SEQ ID NO: 29034 - RNA, 21 nt, Homo sapiens
gcuccaaagggaagcgcuuug

SEQ ID NO: 29035 - RNA, 21 nt, Homo sapiens
cacucugaagggaagcgcuuu

SEQ ID NO: 29036 - RNA, 21 nt, Homo sapiens
cacucugaagggaagcgcuuu

SEQ ID NO: 29037 - RNA, 21 nt, Homo sapiens
ccucuaaagagaagcgcuuuc

SEQ ID NO: 29038 - RNA, 19 nt, Homo sapiens
auuuugguacagcagcuca

SEQ ID NO: 29039 - RNA, 21 nt, Homo sapiens
acaauccuagagcacaagaag

SEQ ID NO: 29040 - RNA, 19 nt, Homo sapiens
gccucagaggcagcugcuu

SEQ ID NO: 29041 - RNA, 21 nt, Homo sapiens
ugacugacagcuuuuugagua

SEQ ID NO: 29042 - RNA, 20 nt, Homo sapiens
cugcgggaggacagggcuca

SEQ ID NO: 29043 - RNA, 18 nt, Homo sapiens
ugguggcagaggugggau

SEQ ID NO: 29044 - RNA, 22 nt, Homo sapiens
aggucucacuuuguugcccaga

SEQ ID NO: 29045 - RNA, 22 nt, Homo sapiens
agcugaguguaggauguuuaca

SEQ ID NO: 29046 - RNA, 21 nt, Homo sapiens
ccuucugacuccaaguccagu

SEQ ID NO: 29047 - RNA, 22 nt, Homo sapiens
gccuucugacccuaaguccagu

SEQ ID NO: 29048 - RNA, 22 nt, Homo sapiens
ugcaagccuugggugugggagg

SEQ ID NO: 29049 - RNA, 23 nt, Homo sapiens
gggccgcagcugucgcccguguc

SEQ ID NO: 29050 - RNA, 25 nt, Homo sapiens
aaggagcucagaagcccugcccagc

SEQ ID NO: 29051 - RNA, 22 nt, Homo sapiens
gccaccuucaaaugggaagucu

SEQ ID NO: 29052 - RNA, 20 nt, Homo sapiens
uacugcuuccacagcucccc

SEQ ID NO: 29053 - RNA, 21 nt, Homo sapiens
aguagugcuuucuacuuuaug

SEQ ID NO: 29054 - RNA, 23 nt, Homo sapiens
cuaucugcacuagaugcaccuua

SEQ ID NO: 29055 - RNA, 23 nt, Homo sapiens
aauaaauuaaauuuauauuacag

SEQ ID NO: 29056 - RNA, 23 nt, Homo sapiens
acccuauaagcaauauugcacua

SEQ ID NO: 29057 - RNA, 21 nt, Homo sapiens
ugacugcagagcaaaagacac

SEQ ID NO: 29058 - RNA, 22 nt, Homo sapiens
gacaaaacccgcaaauacuuuu

SEQ ID NO: 29059 - RNA, 22 nt, Homo sapiens
cugcgauuccucccucuacugu

SEQ ID NO: 29060 - RNA, 23 nt, Homo sapiens
aggaacagcagcagcccgggccg

SEQ ID NO: 29061 - RNA, 22 nt, Homo sapiens
cucagagcagacgugguucuca

SEQ ID NO: 29062 - RNA, 21 nt, Homo sapiens
cggcucggguggcggcgacgg

SEQ ID NO: 29063 - RNA, 21 nt, Homo sapiens
gagcugcauccuggcuccggg

SEQ ID NO: 29064 - RNA, 17 nt, Homo sapiens
gggagaggaggaggcga

SEQ ID NO: 29065 - RNA, 21 nt, Homo sapiens
gaccaaucgccguccccgccg

SEQ ID NO: 29066 - RNA, 21 nt, Homo sapiens
uucuaggauaggcccaggggc

SEQ ID NO: 29067 - RNA, 23 nt, Homo sapiens
aaagucucgcucucugccccuca

SEQ ID NO: 29068 - RNA, 22 nt, Homo sapiens
aagagggagacccaggcucgga

SEQ ID NO: 29069 - RNA, 22 nt, Homo sapiens
gcggucccgcggcgccccgccu

SEQ ID NO: 29070 - RNA, 17 nt, Homo sapiens
uggaggccccagcgaga

SEQ ID NO: 29071 - RNA, 22 nt, Homo sapiens
ugcuguuagcccuagccccgca

SEQ ID NO: 29072 - RNA, 23 nt, Homo sapiens
aaaaugcagauuccuggacucca

SEQ ID NO: 29073 - RNA, 18 nt, Homo sapiens
auucaaucuacugccuca

SEQ ID NO: 29074 - RNA, 22 nt, Homo sapiens
cagaagugggccgggcacaggg

SEQ ID NO: 29075 - RNA, 20 nt, Homo sapiens
acagcaaggagggcaggagg

SEQ ID NO: 29076 - RNA, 21 nt, Homo sapiens
ucaaucacagauagcaccccu

SEQ ID NO: 29077 - RNA, 22 nt, Homo sapiens
acaaccagcuaagacacugcca

SEQ ID NO: 29078 - RNA, 22 nt, Homo sapiens
auggcaguggaguuagugauug

SEQ ID NO: 29079 - RNA, 23 nt, Homo sapiens
gcaaucagcuaacuacacugccu

SEQ ID NO: 29080 - RNA, 22 nt, Homo sapiens
accagcuaacaauacacugcca

SEQ ID NO: 29081 - RNA, 22 nt, Homo sapiens
gccagcuaacaauacacugccu

SEQ ID NO: 29082 - RNA, 21 nt, Homo sapiens
guccugagagcgcugccuccu

SEQ ID NO: 29083 - RNA, 20 nt, Homo sapiens
cucaaagcaaacccugcaga

SEQ ID NO: 29084 - RNA, 22 nt, Homo sapiens
agccaagcucagacggauccga

SEQ ID NO: 29085 - RNA, 18 nt, Homo sapiens
aucacauucaccucccug

SEQ ID NO: 29086 - RNA, 23 nt, Homo sapiens
gggagugaagacacggagccaga

SEQ ID NO: 29087 - RNA, 21 nt, Homo sapiens
gaccaaucgccguccccgccg

SEQ ID NO: 29088 - RNA, 23 nt, Homo sapiens
ucucugcaggccgugugcuuugc

SEQ ID NO: 29089 - RNA, 22 nt, Homo sapiens
aaucagucucauugcuuuauaa

SEQ ID NO: 29090 - RNA, 22 nt, Homo sapiens
cucccuucuuuccucccgucuu

SEQ ID NO: 29091 - RNA, 22 nt, Homo sapiens
ccucauggaaggguuccccacu

SEQ ID NO: 29092 - RNA, 19 nt, Homo sapiens
guccugaauuccgcagccu

SEQ ID NO: 29093 - RNA, 19 nt, Homo sapiens
ucagcaguaccagccuaga

SEQ ID NO: 29094 - RNA, 22 nt, Homo sapiens
gcggucccgcggcgccccgccu

SEQ ID NO: 29095 - RNA, 21 nt, Homo sapiens
caucaccuuccuucuccucca

SEQ ID NO: 29096 - RNA, 22 nt, Homo sapiens
ugaauuacuuuguaaaccacca

SEQ ID NO: 29097 - RNA, 22 nt, Homo sapiens
cacaaguucggaucuacggguu

SEQ ID NO: 29098 - RNA, 22 nt, Homo sapiens
caaacaccauugucacacucca

SEQ ID NO: 29099 - RNA, 23 nt, Homo sapiens
gggagugaagacacggagccaga

SEQ ID NO: 29100 - RNA, 21 nt, Homo sapiens
gaccaaucgccguccccgccg

SEQ ID NO: 29101 - RNA, 21 nt, Homo sapiens
aggcggcaggcacaggacugg

SEQ ID NO: 29102 - RNA, 25 nt, Homo sapiens
agcuagucaagcgcgguuguggggg

SEQ ID NO: 29103 - RNA, 21 nt, Homo sapiens
uucuaggauaggcccaggggc

SEQ ID NO: 29104 - RNA, 22 nt, Homo sapiens
ccucauggaaggguuccccacu

SEQ ID NO: 29105 - RNA, 22 nt, Homo sapiens
gcggucccgcggcgccccgccu

SEQ ID NO: 29106 - RNA, 22 nt, Homo sapiens
cuggagagacaaggggaagagg

SEQ ID NO: 29107 - RNA, 22 nt, Homo sapiens
auccuucuacaaauucacccau

SEQ ID NO: 29108 - RNA, 17 nt, Homo sapiens
gacagccucucccccac

SEQ ID NO: 29109 - RNA, 18 nt, Homo sapiens
auucaaucuacugccuca

SEQ ID NO: 29110 - RNA, 23 nt, Homo sapiens
cuaucugcacuagaugcaccuua

SEQ ID NO: 29111 - RNA, 23 nt, Homo sapiens
cuaacugcacuagaugcaccuua

SEQ ID NO: 29112 - RNA, 23 nt, Homo sapiens
agaggcaggcaugcgggcagaca

SEQ ID NO: 29113 - RNA, 22 nt, Homo sapiens
auggcaguggaguuagugauug

SEQ ID NO: 29114 - RNA, 22 nt, Homo sapiens
augggacauccuacauaugcaa

SEQ ID NO: 29115 - RNA, 23 nt, Homo sapiens
ucucacccagguagcaaggauua

SEQ ID NO: 29116 - RNA, 22 nt, Homo sapiens
agaauccuugcccgggugcauu

SEQ ID NO: 29117 - RNA, 22 nt, Homo sapiens
ugaauccuugcccaggugcauu

SEQ ID NO: 29118 - RNA, 24 nt, Homo sapiens
acugggcacaaacauguccagguc

SEQ ID NO: 29119 - RNA, 21 nt, Homo sapiens
gcugaggucugggccaggucu

SEQ ID NO: 29120 - RNA, 21 nt, Homo sapiens
cacaaccucaguguuuccagg

SEQ ID NO: 29121 - RNA, 21 nt, Homo sapiens
aacauacaaaggguauccucu

SEQ ID NO: 29122 - RNA, 21 nt, Homo sapiens
ccccucccagccucccugcca

SEQ ID NO: 29123 - RNA, 22 nt, Homo sapiens
ggcucccaagaaccucaccugu

SEQ ID NO: 29124 - RNA, 24 nt, Homo sapiens
gaaagugcauagaauucugucugg

SEQ ID NO: 29125 - RNA, 22 nt, Homo sapiens
uggcagcagcggagggggcaga

SEQ ID NO: 29126 - RNA, 22 nt, Homo sapiens
uccacauggaguugcuguuaca

SEQ ID NO: 29127 - RNA, 22 nt, Homo sapiens
cuuccagucgaggauguuuaca

SEQ ID NO: 29128 - RNA, 22 nt, Homo sapiens
agcugaguguaggauguuuaca

SEQ ID NO: 29129 - RNA, 23 nt, Homo sapiens
gcugagaguguaggauguuuaca

SEQ ID NO: 29130 - RNA, 22 nt, Homo sapiens
cuuccagucggggauguuuaca

SEQ ID NO: 29131 - RNA, 22 nt, Homo sapiens
cuuccagucaaggauguuuaca

SEQ ID NO: 29132 - RNA, 20 nt, Homo sapiens
ccagcagcaccuggggcagu

SEQ ID NO: 29133 - RNA, 23 nt, Homo sapiens
cgugagcuccuggaggacaggga

SEQ ID NO: 29134 - RNA, 23 nt, Homo sapiens
ccacccaaugaccuacuccaaga

SEQ ID NO: 29135 - RNA, 21 nt, Homo sapiens
auccuguacugagcugccccg

SEQ ID NO: 29136 - RNA, 25 nt, Homo sapiens
acggagcugucccaacaccaccccu

SEQ ID NO: 29137 - RNA, 22 nt, Homo sapiens
gcugaggcuguggggcuggagu

SEQ ID NO: 29138 - RNA, 18 nt, Homo sapiens
ugguggcagaggugggau

SEQ ID NO: 29139 - RNA, 22 nt, Homo sapiens
aacccauggaauucaguucuca

SEQ ID NO: 29140 - RNA, 22 nt, Homo sapiens
agccuauggaauucaguucuca

SEQ ID NO: 29141 - RNA, 22 nt, Homo sapiens
uagcagaagcauuuccgcacac

SEQ ID NO: 29142 - RNA, 23 nt, Homo sapiens
aaaucagaaucacaccuggggga

SEQ ID NO: 29143 - RNA, 25 nt, Homo sapiens
acggagcugucccaacaccaccccu

SEQ ID NO: 29144 - RNA, 24 nt, Homo sapiens
acgcagagcccgaaagcccccagu

SEQ ID NO: 29145 - RNA, 21 nt, Homo sapiens
auaauggagaccaggccacga

SEQ ID NO: 29146 - RNA, 20 nt, Homo sapiens
cucaaagcaaacccugcaga

SEQ ID NO: 29147 - RNA, 20 nt, Homo sapiens
cucaaagcaaacccugcaga

SEQ ID NO: 29148 - RNA, 23 nt, Homo sapiens
cccaacagacauggcgguacuca

SEQ ID NO: 29149 - RNA, 22 nt, Homo sapiens
acugggacuuuguaggccaguu

SEQ ID NO: 29150 - RNA, 22 nt, Homo sapiens
agcgggacuuugagggccaguu

SEQ ID NO: 29151 - RNA, 22 nt, Homo sapiens
ccucaggcacggccgggccacc

SEQ ID NO: 29152 - RNA, 20 nt, Homo sapiens
aggggccucagccuccuggu

SEQ ID NO: 29153 - RNA, 22 nt, Homo sapiens
cacaaaccauuaugugcugcua

SEQ ID NO: 29154 - RNA, 22 nt, Homo sapiens
uguaaaccaugaugugcugcua

SEQ ID NO: 29155 - RNA, 22 nt, Homo sapiens
cgccaauauuuacgugcugcua

SEQ ID NO: 29156 - RNA, 23 nt, Homo sapiens
cuaucugcacuagaugcaccuua

SEQ ID NO: 29157 - RNA, 21 nt, Homo sapiens
gccaauauuucugugcugcua

SEQ ID NO: 29158 - RNA, 20 nt, Homo sapiens
acagcaaggagggcaggagg

SEQ ID NO: 29159 - RNA, 22 nt, Homo sapiens
acugccugucugugccugcugu

SEQ ID NO: 29160 - RNA, 22 nt, Homo sapiens
ucagaccgagacaagugcaaug

SEQ ID NO: 29161 - RNA, 22 nt, Homo sapiens
accagguuccaccccagcaggc

SEQ ID NO: 29162 - RNA, 22 nt, Homo sapiens
uucaaaacaugaauugcugcug

SEQ ID NO: 29163 - RNA, 21 nt, Homo sapiens
acaaaccacagugugcugcug

SEQ ID NO: 29164 - RNA, 23 nt, Homo sapiens
acagcgcucgcaaccgcagcgau

SEQ ID NO: 29165 - RNA, 25 nt, Homo sapiens
accaacggaccuacuucccuccgcc

SEQ ID NO: 29166 - RNA, 21 nt, Homo sapiens
caucaccuuccuucuccucca

SEQ ID NO: 29167 - RNA, 22 nt, Homo sapiens
uauccacuacaccccgcugccu

SEQ ID NO: 29168 - RNA, 22 nt, Homo sapiens
ggcagagagucagagcgcggau

SEQ ID NO: 29169 - RNA, 23 nt, Homo sapiens
cuaccugcacuguaagcacuuuu

SEQ ID NO: 29170 - RNA, 22 nt, Homo sapiens
gaggcucagaauggcucaggag

SEQ ID NO: 29171 - RNA, 18 nt, Homo sapiens
cccccaccaccacgcccg

SEQ ID NO: 29172 - RNA, 23 nt, Homo sapiens
cuacgcguauucuuaagcaauaa

SEQ ID NO: 29173 - RNA, 23 nt, Homo sapiens
cuaacugcacuagaugcaccuua

SEQ ID NO: 29174 - RNA, 23 nt, Homo sapiens
ucaguuuugcauagauuugcaca

SEQ ID NO: 29175 - RNA, 22 nt, Homo sapiens
cacucagcaccaggauauuguu

SEQ ID NO: 29176 - RNA, 22 nt, Homo sapiens
aacuaugcaaccuacuaccucu

SEQ ID NO: 29177 - RNA, 21 nt, Homo sapiens
gcugaggucugggccaggucu

SEQ ID NO: 29178 - RNA, 22 nt, Homo sapiens
ucaggaacugccuuucucucca

SEQ ID NO: 29179 - RNA, 21 nt, Homo sapiens
gaccaaucgccguccccgccg

SEQ ID NO: 29180 - RNA, 21 nt, Homo sapiens
gaccaaucgccguccccgccg

SEQ ID NO: 29181 - RNA, 22 nt, Homo sapiens
cggugagcacccggccccugcg

SEQ ID NO: 29182 - RNA, 21 nt, Homo sapiens
aaagugucagauacggugugg

SEQ ID NO: 29183 - RNA, 23 nt, Homo sapiens
gcgcccaauuaaugucuguugau

SEQ ID NO: 29184 - RNA, 22 nt, Homo sapiens
ucagaccgagacaagugcaaug

SEQ ID NO: 29185 - RNA, 23 nt, Homo sapiens
acaccaaugcccuaggggaugcg

SEQ ID NO: 29186 - RNA, 23 nt, Homo sapiens
aaaucagaaucacaccuggggga

SEQ ID NO: 29187 - RNA, 22 nt, Homo sapiens
gaauucaucacggccagccucu

SEQ ID NO: 29188 - RNA, 22 nt, Homo sapiens
aggaaaccagcaaguguugacg

SEQ ID NO: 29189 - RNA, 24 nt, Homo sapiens
acgcagagcccgaaagcccccagu

SEQ ID NO: 29190 - RNA, 22 nt, Homo sapiens
gcggucccgcggcgccccgccu

SEQ ID NO: 29191 - RNA, 22 nt, Homo sapiens
gcggucccgcggcgccccgccu

SEQ ID NO: 29192 - RNA, 22 nt, Homo sapiens
gggagaggucucccugcgcaca

SEQ ID NO: 29193 - RNA, 21 nt, Homo sapiens
gcggaacuuagccacugugaa

SEQ ID NO: 29194 - RNA, 22 nt, Homo sapiens
cucaauagacugugagcuccuu

SEQ ID NO: 29195 - RNA, 21 nt, Homo sapiens
acaaaccacagugugcugcug

SEQ ID NO: 29196 - RNA, 22 nt, Homo sapiens
gcacacaauaaauguuugcuga

SEQ ID NO: 29197 - RNA, 21 nt, Homo sapiens
ucccagcacacauuuagcuca

SEQ ID NO: 29198 - RNA, 23 nt, Homo sapiens
cccagcuagauuguaagcuccuu

SEQ ID NO: 29199 - RNA, 21 nt, Homo sapiens
caucaccuuccuucuccucca

SEQ ID NO: 29200 - RNA, 22 nt, Homo sapiens
ugaauuacuuuguaaaccacca

SEQ ID NO: 29201 - RNA, 21 nt, Homo sapiens
cugaggagagaggaggugggg

SEQ ID NO: 29202 - RNA, 22 nt, Homo sapiens
caaacaccauugucacacucca

SEQ ID NO: 29203 - RNA, 22 nt, Homo sapiens
uccggggacgaacgggacgggu

SEQ ID NO: 29204 - RNA, 18 nt, Homo sapiens
ugguggcagaggugggau

SEQ ID NO: 29205 - RNA, 23 nt, Homo sapiens
gggagugaagacacggagccaga

SEQ ID NO: 29206 - RNA, 23 nt, Homo sapiens
cuaucugcacuagaugcaccuua

SEQ ID NO: 29207 - RNA, 21 nt, Homo sapiens
gaccaaucgccguccccgccg

SEQ ID NO: 29208 - RNA, 22 nt, Homo sapiens
ucagaccgagacaagugcaaug

SEQ ID NO: 29209 - RNA, 21 nt, Homo sapiens
acaggauugagggggggcccu

SEQ ID NO: 29210 - RNA, 21 nt, Homo sapiens
acaggauugagggggggcccu

SEQ ID NO: 29211 - RNA, 22 nt, Homo sapiens
agcugaguguaggauguuuaca

SEQ ID NO: 29212 - RNA, 23 nt, Homo sapiens
aaaucagaaucacaccuggggga

SEQ ID NO: 29213 - RNA, 23 nt, Homo sapiens
aaagucucgcucucugccccuca

SEQ ID NO: 29214 - RNA, 23 nt, Homo sapiens
aaagucucgcucucugccccuca

SEQ ID NO: 29215 - RNA, 22 nt, Homo sapiens
ugcaagccuugggugugggagg

SEQ ID NO: 29216 - RNA, 24 nt, Homo sapiens
acgcagagcccgaaagcccccagu

SEQ ID NO: 29217 - RNA, 25 nt, Homo sapiens
accaacggaccuacuucccuccgcc

SEQ ID NO: 29218 - RNA, 24 nt, Homo sapiens
acgcgcaggccagagacccaggca

SEQ ID NO: 29219 - RNA, 22 nt, Homo sapiens
gcggucccgcggcgccccgccu

SEQ ID NO: 29220 - RNA, 22 nt, Homo sapiens
ugcuguuagcccuagccccgca

SEQ ID NO: 29221 - RNA, 21 nt, Homo sapiens
caucaccuuccuucuccucca

SEQ ID NO: 29222 - RNA, 21 nt, Homo sapiens
aacauacaaaggguauccucu

SEQ ID NO: 29223 - RNA, 22 nt, Homo sapiens
cgcauuauuacucacgguacga

SEQ ID NO: 29224 - RNA, 22 nt, Homo sapiens
uagucaagugaagcagugggag

SEQ ID NO: 29225 - RNA, 23 nt, Homo sapiens
acaccccaaaaucgaagcacuuc

SEQ ID NO: 29226 - RNA, 22 nt, Homo sapiens
cugcucaaacccuccaaugacu

SEQ ID NO: 29227 - RNA, 23 nt, Homo sapiens
cccagcuagauuguaagcuccuu

SEQ ID NO: 29228 - RNA, 22 nt, Homo sapiens
ccccccacugggccguacccac

SEQ ID NO: 29229 - RNA, 17 nt, Homo sapiens
agaaagaagcaauauga

SEQ ID NO: 29230 - RNA, 22 nt, Homo sapiens
aacccauggaauucaguucuca

SEQ ID NO: 29231 - RNA, 22 nt, Homo sapiens
uguaaaccaugaugugcugcua

SEQ ID NO: 29232 - RNA, 22 nt, Homo sapiens
ugagccacugugccuggccuga

SEQ ID NO: 29233 - RNA, 23 nt, Homo sapiens
cuaccugcacuauaagcacuuua

SEQ ID NO: 29234 - RNA, 19 nt, Homo sapiens
ucccacaggaagcagacac

SEQ ID NO: 29235 - RNA, 24 nt, Homo sapiens
acgcgcaggccagagacccaggca

SEQ ID NO: 29236 - RNA, 23 nt, Homo sapiens
ucauacagcuagauaaccaaaga

SEQ ID NO: 29237 - RNA, 22 nt, Homo sapiens
cuagggaacacagggcugguga

SEQ ID NO: 29238 - RNA, 23 nt, Homo sapiens
cggccugauucacaacaccagcu

SEQ ID NO: 29239 - RNA, 21 nt, Homo sapiens
aggcggcaggcacaggacugg

SEQ ID NO: 29240 - RNA, 22 nt, Homo sapiens
uucacacugcaugcucugggua

SEQ ID NO: 29241 - RNA, 20 nt, Homo sapiens
uaugaacaauuucuaggaau

SEQ ID NO: 29242 - RNA, 22 nt, Homo sapiens
ccuggcacacaguagaccuuca

SEQ ID NO: 29243 - RNA, 22 nt, Homo sapiens
aguccagauucugugcccacca

SEQ ID NO: 29244 - RNA, 22 nt, Homo sapiens
aguccagauucugugcccacca

SEQ ID NO: 29245 - RNA, 19 nt, Homo sapiens
guccugaauuccgcagccu

SEQ ID NO: 29246 - RNA, 22 nt, Homo sapiens
gcacauguucugcggcccacca

SEQ ID NO: 29247 - RNA, 22 nt, Homo sapiens
gcacauguucugcggcccacca

SEQ ID NO: 29248 - RNA, 21 nt, Homo sapiens
ucuccagaucagggcagucca

SEQ ID NO: 29249 - RNA, 22 nt, Homo sapiens
gcacaaaucuccagaccaccca

SEQ ID NO: 29250 - RNA, 22 nt, Homo sapiens
cacgaccgacgccacgccgagu

SEQ ID NO: 29251 - RNA, 19 nt, Homo sapiens
cagcaucagcagcaucauc

SEQ ID NO: 29252 - RNA, 22 nt, Homo sapiens
ggagcccgcgccccgcgccgag

SEQ ID NO: 29253 - RNA, 21 nt, Homo sapiens
aggcggcaggcacaggacugg

SEQ ID NO: 29254 - RNA, 22 nt, Homo sapiens
ugagccacugugccuggccuga

SEQ ID NO: 29255 - RNA, 21 nt, Homo sapiens
aagugucagacacgguggugg

SEQ ID NO: 29256 - RNA, 22 nt, Homo sapiens
cuguuccugcugaacugagcca

SEQ ID NO: 29257 - RNA, 22 nt, Homo sapiens
uaaccgauuucagauggugcua

SEQ ID NO: 29258 - RNA, 23 nt, Homo sapiens
aacacugauuucaaauggugcua

SEQ ID NO: 29259 - RNA, 22 nt, Homo sapiens
uaaccgauuucaaauggugcua

SEQ ID NO: 29260 - RNA, 22 nt, Homo sapiens
acaaccagcuaagacacugcca

SEQ ID NO: 29261 - RNA, 22 nt, Homo sapiens
auggcaguggaguuagugauug

SEQ ID NO: 29262 - RNA, 22 nt, Homo sapiens
aucgggaggggacugagccuga

SEQ ID NO: 29263 - RNA, 25 nt, Homo sapiens
acggagcugucccaacaccaccccu

SEQ ID NO: 29264 - RNA, 21 nt, Homo sapiens
gaaggaagugagugcagccac

SEQ ID NO: 29265 - RNA, 21 nt, Homo sapiens
ggggagcgggggcccugccuu

SEQ ID NO: 29266 - RNA, 22 nt, Homo sapiens
caaacaccauugucacacucca

SEQ ID NO: 29267 - RNA, 23 nt, Homo sapiens
cugugggagggcaguggugagag

SEQ ID NO: 29268 - RNA, 17 nt, Homo sapiens
gggagaggaggaggcga

SEQ ID NO: 29269 - RNA, 21 nt, Homo sapiens
acuagacugugagcuccucga

SEQ ID NO: 29270 - RNA, 21 nt, Homo sapiens
gaccaaucgccguccccgccg

SEQ ID NO: 29271 - RNA, 22 nt, Homo sapiens
cagaagugggccgggcacaggg

SEQ ID NO: 29272 - RNA, 22 nt, Homo sapiens
aguccagauucugugcccacca

SEQ ID NO: 29273 - RNA, 25 nt, Homo sapiens
acggagcugucccaacaccaccccu

SEQ ID NO: 29274 - RNA, 22 nt, Homo sapiens
gcacauguucugcggcccacca

SEQ ID NO: 29275 - RNA, 22 nt, Homo sapiens
gcggucccgcggcgccccgccu

SEQ ID NO: 29276 - RNA, 21 nt, Homo sapiens
caucaccuuccuucuccucca

SEQ ID NO: 29277 - RNA, 20 nt, Homo sapiens
uacugcuuccacagcucccc

SEQ ID NO: 29278 - RNA, 17 nt, Homo sapiens
ggguggcagcgguggga

SEQ ID NO: 29279 - RNA, 23 nt, Homo sapiens
gggagugaagacacggagccaga

SEQ ID NO: 29280 - RNA, 22 nt, Homo sapiens
ucaggaacugccuuucucucca

SEQ ID NO: 29281 - RNA, 21 nt, Homo sapiens
gaccaaucgccguccccgccg

SEQ ID NO: 29282 - RNA, 21 nt, Homo sapiens
gaccaaucgccguccccgccg

SEQ ID NO: 29283 - RNA, 22 nt, Homo sapiens
cagaagugggccgggcacaggg

SEQ ID NO: 29284 - RNA, 22 nt, Homo sapiens
ggcaaaauccgcaauuacuuuu

SEQ ID NO: 29285 - RNA, 22 nt, Homo sapiens
ucagaccgagacaagugcaaug

SEQ ID NO: 29286 - RNA, 21 nt, Homo sapiens
ucaaucacagauagcaccccu

SEQ ID NO: 29287 - RNA, 22 nt, Homo sapiens
ccucauggaaggguuccccacu

SEQ ID NO: 29288 - RNA, 22 nt, Homo sapiens
gcggucccgcggcgccccgccu

SEQ ID NO: 29289 - RNA, 22 nt, Homo sapiens
gcggucccgcggcgccccgccu

SEQ ID NO: 29290 - RNA, 23 nt, Homo sapiens
cacugugggcccucuccgcacca

SEQ ID NO: 29291 - RNA, 22 nt, Homo sapiens
ugcuguuagcccuagccccgca

SEQ ID NO: 29292 - RNA, 22 nt, Homo sapiens
ugcuguuagcccuagccccgca

SEQ ID NO: 29293 - RNA, 20 nt, Homo sapiens
uacugcuuccacagcucccc

SEQ ID NO: 29294 - RNA, 22 nt, Homo sapiens
ucacauuugccugcagagauuu

SEQ ID NO: 29295 - RNA, 21 nt, Homo sapiens
agagcucauccauaguuguca

SEQ ID NO: 29296 - RNA, 21 nt, Homo sapiens
gaccaagaaauagccuuucaa

SEQ ID NO: 29297 - RNA, 21 nt, Homo sapiens
ucccagcacacauuuagcuca

SEQ ID NO: 29298 - RNA, 22 nt, Homo sapiens
caagacacauuuggagagggac

SEQ ID NO: 29299 - RNA, 21 nt, Homo sapiens
caucaccuuccuucuccucca

SEQ ID NO: 29300 - RNA, 24 nt, Homo sapiens
cacccccagagccucagcucccca

SEQ ID NO: 29301 - RNA, 22 nt, Homo sapiens
caaacaccauugucacacucca

SEQ ID NO: 29302 - RNA, 22 nt, Homo sapiens
ccagaacugaguccacagggca

SEQ ID NO: 29303 - RNA, 21 nt, Homo sapiens
gaccaaucgccguccccgccg

SEQ ID NO: 29304 - RNA, 22 nt, Homo sapiens
cagaagugggccgggcacaggg

SEQ ID NO: 29305 - RNA, 22 nt, Homo sapiens
ugagccacugugccuggccuga

SEQ ID NO: 29306 - RNA, 22 nt, Homo sapiens
agcugaguguaggauguuuaca

SEQ ID NO: 29307 - RNA, 22 nt, Homo sapiens
gcaaaaguaauugccaguuuug

SEQ ID NO: 29308 - RNA, 22 nt, Homo sapiens
ugcaaaaguagucucaguuuuu

SEQ ID NO: 29309 - RNA, 19 nt, Homo sapiens
aaaaguaauuacaguuuuu

SEQ ID NO: 29310 - RNA, 25 nt, Homo sapiens
acggagcugucccaacaccaccccu

SEQ ID NO: 29311 - RNA, 22 nt, Homo sapiens
gcggucccgcggcgccccgccu

SEQ ID NO: 29312 - RNA, 22 nt, Homo sapiens
ugcuguuagcccuagccccgca

SEQ ID NO: 29313 - RNA, 23 nt, Homo sapiens
gcacaugugcacacagccgggug

SEQ ID NO: 29314 - RNA, 23 nt, Homo sapiens
aaaaugcagauuccuggacucca

SEQ ID NO: 29315 - RNA, 24 nt, Homo sapiens
cugaucaguuacacaucacuucag

SEQ ID NO: 29316 - RNA, 23 nt, Homo sapiens
acaaggaugaaucuuuguuacug

SEQ ID NO: 29317 - RNA, 21 nt, Homo sapiens
ucuccagaucagggcagucca

SEQ ID NO: 29318 - RNA, 18 nt, Homo sapiens
ccacugaaccacccaugc

SEQ ID NO: 29319 - RNA, 22 nt, Homo sapiens
accuaauauaucaaacauauca

SEQ ID NO: 29320 - RNA, 21 nt, Homo sapiens
ggaaaucccuggcaaugugau

SEQ ID NO: 29321 - RNA, 21 nt, Homo sapiens
gguaaucccuggcaaugugau

SEQ ID NO: 29322 - RNA, 20 nt, Homo sapiens
cuggaggaagggcccagagg

SEQ ID NO: 29323 - RNA, 22 nt, Homo sapiens
gccuaagacacaggcccagaga

SEQ ID NO: 29324 - RNA, 22 nt, Homo sapiens
auggcaguggaguuagugauug

SEQ ID NO: 29325 - RNA, 23 nt, Homo sapiens
aaaucagaaucacaccuggggga

SEQ ID NO: 29326 - RNA, 24 nt, Homo sapiens
acgcagagcccgaaagcccccagu

SEQ ID NO: 29327 - RNA, 18 nt, Homo sapiens
ugguggcagaggugggau

SEQ ID NO: 29328 - RNA, 19 nt, Homo sapiens
cagcaucagcagcaucauc

SEQ ID NO: 29329 - RNA, 22 nt, Homo sapiens
cagaagugggccgggcacaggg

SEQ ID NO: 29330 - RNA, 23 nt, Homo sapiens
cagcugcuuuugggauuccguug

SEQ ID NO: 29331 - RNA, 25 nt, Homo sapiens
acggagcugucccaacaccaccccu

SEQ ID NO: 29332 - RNA, 21 nt, Homo sapiens
ggacuauagaacuuucccccu

SEQ ID NO: 29333 - RNA, 22 nt, Homo sapiens
cacucuaaagggaggcacuuug

SEQ ID NO: 29334 - RNA, 20 nt, Homo sapiens
ggggggcgaggcagguguga

SEQ ID NO: 29335 - RNA, 22 nt, Homo sapiens
cuaccauaggguaaaaccacug

SEQ ID NO: 29336 - RNA, 21 nt, Homo sapiens
acaugguuagaucaagcacaa

SEQ ID NO: 29337 - RNA, 20 nt, Homo sapiens
gcaaugcaacagcaaugcac

SEQ ID NO: 29338 - RNA, 23 nt, Homo sapiens
gaaagugcccucaaggcugagug

SEQ ID NO: 29339 - RNA, 22 nt, Homo sapiens
aacgcuccaaaagaaggcacuc

SEQ ID NO: 29340 - RNA, 22 nt, Homo sapiens
aacacucuaaaaggaggcacuu

SEQ ID NO: 29341 - RNA, 23 nt, Homo sapiens
acacacucacacacacacacuca

SEQ ID NO: 29342 - RNA, 22 nt, Homo sapiens
gcaaaaguaauugcagugugug

SEQ ID NO: 29343 - RNA, 25 nt, Homo sapiens
acggagcugucccaacaccaccccu

SEQ ID NO: 29344 - RNA, 22 nt, Homo sapiens
gggagaggucucccugcgcaca

SEQ ID NO: 29345 - RNA, 23 nt, Homo sapiens
gggagugaagacacggagccaga

SEQ ID NO: 29346 - RNA, 22 nt, Homo sapiens
ucagaccgagacaagugcaaug

SEQ ID NO: 29347 - RNA, 23 nt, Homo sapiens
aaaucagaaucacaccuggggga

SEQ ID NO: 29348 - RNA, 22 nt, Homo sapiens
aggaaaccagcaaguguugacg

SEQ ID NO: 29349 - RNA, 23 nt, Homo sapiens
aaucgcgguuuauaccaaaugaa

SEQ ID NO: 29350 - RNA, 24 nt, Homo sapiens
acgcagagcccgaaagcccccagu

SEQ ID NO: 29351 - RNA, 22 nt, Homo sapiens
uggggacccucccugaaccaag

SEQ ID NO: 29352 - RNA, 24 nt, Homo sapiens
acgcgcaggccagagacccaggca

SEQ ID NO: 29353 - RNA, 20 nt, Homo sapiens
uccccacagacccagagccg

SEQ ID NO: 29354 - RNA, 21 nt, Homo sapiens
caucaccuuccuucuccucca

SEQ ID NO: 29355 - RNA, 22 nt, Homo sapiens
gcacaaaucuccagaccaccca

SEQ ID NO: 29356 - RNA, 25 nt, Homo sapiens
acggagcugucccaacaccaccccu

SEQ ID NO: 29357 - RNA, 23 nt, Homo sapiens
uguaggcuggggauaaaugaaua

SEQ ID NO: 29358 - RNA, 22 nt, Homo sapiens
ggcagagagucagagcgcggau

SEQ ID NO: 29359 - RNA, 21 nt, Homo sapiens
auaauggagaccaggccacga

SEQ ID NO: 29360 - RNA, 19 nt, Homo sapiens
cagcaucagcagcaucauc

SEQ ID NO: 29361 - RNA, 18 nt, Homo sapiens
aucacauucaccucccug

SEQ ID NO: 29362 - RNA, 23 nt, Homo sapiens
gggagugaagacacggagccaga

SEQ ID NO: 29363 - RNA, 23 nt, Homo sapiens
cuaucugcacuagaugcaccuua

SEQ ID NO: 29364 - RNA, 22 nt, Homo sapiens
cagaagugggccgggcacaggg

SEQ ID NO: 29365 - RNA, 20 nt, Homo sapiens
cccgccgcgucgcccugggg

SEQ ID NO: 29366 - RNA, 22 nt, Homo sapiens
acaguucuucaacuggcagcuu

SEQ ID NO: 29367 - RNA, 22 nt, Homo sapiens
agcugaguguaggauguuuaca

SEQ ID NO: 29368 - RNA, 22 nt, Homo sapiens
acggaagggcagagagggccag

SEQ ID NO: 29369 - RNA, 23 nt, Homo sapiens
ugcgaacucaccacggacaaccu

SEQ ID NO: 29370 - RNA, 22 nt, Homo sapiens
aaagugcuucuuaccuccagau

SEQ ID NO: 29371 - RNA, 19 nt, Homo sapiens
ucagcaguaccagccuaga

SEQ ID NO: 29372 - RNA, 21 nt, Homo sapiens
caucaccuuccuucuccucca

SEQ ID NO: 29373 - RNA, 21 nt, Homo sapiens
gagcugcauccuggcuccggg

SEQ ID NO: 29374 - RNA, 21 nt, Homo sapiens
gagcugcauccuggcuccggg

SEQ ID NO: 29375 - RNA, 21 nt, Homo sapiens
ccccucccagccucccugcca

SEQ ID NO: 29376 - RNA, 22 nt, Homo sapiens
cugggggcggcacaggggcuca

SEQ ID NO: 29377 - RNA, 17 nt, Homo sapiens
gggagaggaggaggcga

SEQ ID NO: 29378 - RNA, 22 nt, Homo sapiens
aggucucacuuuguugcccaga

SEQ ID NO: 29379 - RNA, 22 nt, Homo sapiens
uacaucuggacagccgaaugaa

SEQ ID NO: 29380 - RNA, 21 nt, Homo sapiens
gaccaaucgccguccccgccg

SEQ ID NO: 29381 - RNA, 23 nt, Homo sapiens
cccaacagacauggcgguacuca

SEQ ID NO: 29382 - RNA, 23 nt, Homo sapiens
gaacagguagucugaacacuggg

SEQ ID NO: 29383 - RNA, 23 nt, Homo sapiens
gaacagauagucuaaacacuggg

SEQ ID NO: 29384 - RNA, 23 nt, Homo sapiens
ucaacgggagugaucgugucauu

SEQ ID NO: 29385 - RNA, 22 nt, Homo sapiens
aggaaaccagcaaguguugacg

SEQ ID NO: 29386 - RNA, 23 nt, Homo sapiens
gaaagugcccucaaggcugagug

SEQ ID NO: 29387 - RNA, 19 nt, Homo sapiens
gccugcugacaccgugccu

SEQ ID NO: 29388 - RNA, 25 nt, Homo sapiens
aaggagcucagaagcccugcccagc

SEQ ID NO: 29389 - RNA, 22 nt, Homo sapiens
gcggucccgcggcgccccgccu

SEQ ID NO: 29390 - RNA, 22 nt, Homo sapiens
ugcuguuagcccuagccccgca

SEQ ID NO: 29391 - RNA, 21 nt, Homo sapiens
cugaggagagaggaggugggg

SEQ ID NO: 29392 - RNA, 21 nt, Homo sapiens
aaaggccacauccagcaccgu

SEQ ID NO: 29393 - RNA, 22 nt, Homo sapiens
ucccucacacagaauuccagaa

SEQ ID NO: 29394 - RNA, 19 nt, Homo sapiens
cagcaucagcagcaucauc

SEQ ID NO: 29395 - RNA, 23 nt, Homo sapiens
gggagugaagacacggagccaga

SEQ ID NO: 29396 - RNA, 22 nt, Homo sapiens
ucaggaacugccuuucucucca

SEQ ID NO: 29397 - RNA, 22 nt, Homo sapiens
gcuggguggagaagguggugaa

SEQ ID NO: 29398 - RNA, 23 nt, Homo sapiens
aaaucagaaucacaccuggggga

SEQ ID NO: 29399 - RNA, 24 nt, Homo sapiens
acgcagagcccgaaagcccccagu

SEQ ID NO: 29400 - RNA, 20 nt, Homo sapiens
aggggccucagccuccuggu

SEQ ID NO: 29401 - RNA, 23 nt, Homo sapiens
cuccagccccuccagggcuuccu

SEQ ID NO: 29402 - RNA, 20 nt, Homo sapiens
uacugcuuccacagcucccc

SEQ ID NO: 29403 - RNA, 24 nt, Homo sapiens
cacccccagagccucagcucccca

SEQ ID NO: 29404 - RNA, 22 nt, Homo sapiens
cacgaccgacgccacgccgagu

SEQ ID NO: 29405 - RNA, 18 nt, Homo sapiens
aucacauucaccucccug

SEQ ID NO: 29406 - RNA, 21 nt, Homo sapiens
caucaccuuccuucuccucca

SEQ ID NO: 29407 - RNA, 22 nt, Homo sapiens
cacauggccaaaacagagaaga

SEQ ID NO: 29408 - RNA, 22 nt, Homo sapiens
cacaucucacuguagccucaaa

SEQ ID NO: 29409 - RNA, 23 nt, Homo sapiens
gggagugaagacacggagccaga

SEQ ID NO: 29410 - RNA, 22 nt, Homo sapiens
uggcagcagcggagggggcaga

SEQ ID NO: 29411 - RNA, 20 nt, Homo sapiens
ccagcagcaccuggggcagu

SEQ ID NO: 29412 - RNA, 21 nt, Homo sapiens
auccuguacugagcugccccg

SEQ ID NO: 29413 - RNA, 19 nt, Homo sapiens
guugggaucacaggcgccc

SEQ ID NO: 29414 - RNA, 20 nt, Homo sapiens
acaaugagaacccauggucu

SEQ ID NO: 29415 - RNA, 22 nt, Homo sapiens
caaacaccauugucacacucca

SEQ ID NO: 29416 - RNA, 22 nt, Homo sapiens
agcucagaacccagaggucuca

SEQ ID NO: 29417 - RNA, 22 nt, Homo sapiens
uauccacuacaccccgcugccu

SEQ ID NO: 29418 - RNA, 20 nt, Homo sapiens
uacugcuuccacagcucccc

SEQ ID NO: 29419 - RNA, 24 nt, Homo sapiens
cacccccagagccucagcucccca

SEQ ID NO: 29420 - RNA, 22 nt, Homo sapiens
cacaucucacuguagccucaaa

SEQ ID NO: 29421 - RNA, 22 nt, Homo sapiens
uggcagcagcggagggggcaga

SEQ ID NO: 29422 - RNA, 20 nt, Homo sapiens
ccagcagcaccuggggcagu

SEQ ID NO: 29423 - RNA, 21 nt, Homo sapiens
auccuguacugagcugccccg

SEQ ID NO: 29424 - RNA, 22 nt, Homo sapiens
gauagagugcagaccagggucu

SEQ ID NO: 29425 - RNA, 21 nt, Homo sapiens
aucagagguucagcuuacccu

SEQ ID NO: 29426 - RNA, 19 nt, Homo sapiens
guugggaucacaggcgccc

SEQ ID NO: 29427 - RNA, 20 nt, Homo sapiens
acaaugagaacccauggucu

SEQ ID NO: 29428 - RNA, 22 nt, Homo sapiens
caaacaccauugucacacucca

SEQ ID NO: 29429 - RNA, 22 nt, Homo sapiens
uauccacuacaccccgcugccu

SEQ ID NO: 29430 - RNA, 23 nt, Homo sapiens
cacaaauucggaucuacagggua

SEQ ID NO: 29431 - RNA, 23 nt, Homo sapiens
cacaaauucgguucuacagggua

SEQ ID NO: 29432 - RNA, 21 nt, Homo sapiens
ccccucccagccucccugcca

SEQ ID NO: 29433 - RNA, 21 nt, Homo sapiens
cugaggagagaggaggugggg

SEQ ID NO: 29434 - RNA, 22 nt, Homo sapiens
aggucucacuuuguugcccaga

SEQ ID NO: 29435 - RNA, 21 nt, Homo sapiens
gaccaaucgccguccccgccg

SEQ ID NO: 29436 - RNA, 22 nt, Homo sapiens
ucagaccgagacaagugcaaug

SEQ ID NO: 29437 - RNA, 22 nt, Homo sapiens
ucgcccucucaacccagcuuuu

SEQ ID NO: 29438 - RNA, 22 nt, Homo sapiens
uugcccucucaacccagcuuuu

SEQ ID NO: 29439 - RNA, 20 nt, Homo sapiens
acccucucaacccagcuuuu

SEQ ID NO: 29440 - RNA, 19 nt, Homo sapiens
uccucucaacccagcuuuu

SEQ ID NO: 29441 - RNA, 22 nt, Homo sapiens
cucggggcagcucaguacagga

SEQ ID NO: 29442 - RNA, 24 nt, Homo sapiens
cugaucaguuacacaucacuucag

SEQ ID NO: 29443 - RNA, 25 nt, Homo sapiens
aaggagcucagaagcccugcccagc

SEQ ID NO: 29444 - RNA, 22 nt, Homo sapiens
ugcuguuagcccuagccccgca

SEQ ID NO: 29445 - RNA, 20 nt, Homo sapiens
uacugcuuccacagcucccc

SEQ ID NO: 29446 - RNA, 22 nt, Homo sapiens
ggcagagagucagagcgcggau

SEQ ID NO: 29447 - RNA, 21 nt, Homo sapiens
cugaggagagaggaggugggg

SEQ ID NO: 29448 - RNA, 23 nt, Homo sapiens
gggagugaagacacggagccaga

SEQ ID NO: 29449 - RNA, 22 nt, Homo sapiens
acccuuaucaguucuccgucca

SEQ ID NO: 29450 - RNA, 21 nt, Homo sapiens
gaccaaucgccguccccgccg

SEQ ID NO: 29451 - RNA, 23 nt, Homo sapiens
acaccaaugcccuaggggaugcg

SEQ ID NO: 29452 - RNA, 23 nt, Homo sapiens
acggcuaguggaccaggugaagu

SEQ ID NO: 29453 - RNA, 23 nt, Homo sapiens
aaagucucgcucucugccccuca

SEQ ID NO: 29454 - RNA, 23 nt, Homo sapiens
ugcgaacucaccacggacaaccu

SEQ ID NO: 29455 - RNA, 22 nt, Homo sapiens
ccucauggaaggguuccccacu

SEQ ID NO: 29456 - RNA, 22 nt, Homo sapiens
gcggucccgcggcgccccgccu

SEQ ID NO: 29457 - RNA, 23 nt, Homo sapiens
cuccagccccuccagggcuuccu

SEQ ID NO: 29458 - RNA, 22 nt, Homo sapiens
ugcuguuagcccuagccccgca

SEQ ID NO: 29459 - RNA, 21 nt, Homo sapiens
ugacugacagcuuuuugagua

SEQ ID NO: 29460 - RNA, 20 nt, Homo sapiens
uacugcuuccacagcucccc

SEQ ID NO: 29461 - RNA, 21 nt, Homo sapiens
ccccucccagccucccugcca

SEQ ID NO: 29462 - RNA, 22 nt, Homo sapiens
cugggggcggcacaggggcuca

SEQ ID NO: 29463 - RNA, 18 nt, Homo sapiens
cagcagccuccuucucaa

SEQ ID NO: 29464 - RNA, 23 nt, Homo sapiens
aggaacagcagcagcccgggccg

SEQ ID NO: 29465 - RNA, 22 nt, Homo sapiens
ucaggaacugccuuucucucca

SEQ ID NO: 29466 - RNA, 22 nt, Homo sapiens
agcccaaaaggagaauucuuug

SEQ ID NO: 29467 - RNA, 21 nt, Homo sapiens
gaccaaucgccguccccgccg

SEQ ID NO: 29468 - RNA, 22 nt, Homo sapiens
cuguuccugcugaacugagcca

SEQ ID NO: 29469 - RNA, 22 nt, Homo sapiens
uacagauggauaccgugcaauu

SEQ ID NO: 29470 - RNA, 23 nt, Homo sapiens
aaagucucgcucucugccccuca

SEQ ID NO: 29471 - RNA, 21 nt, Homo sapiens
gaaggaagugagugcagccac

SEQ ID NO: 29472 - RNA, 22 nt, Homo sapiens
gcggucccgcggcgccccgccu

SEQ ID NO: 29473 - RNA, 22 nt, Homo sapiens
ugcuguuagcccuagccccgca

SEQ ID NO: 29474 - RNA, 22 nt, Homo sapiens
gcugaggcuguggggcuggagu

SEQ ID NO: 29475 - RNA, 21 nt, Homo sapiens
ggucagaacccaucauucacu

SEQ ID NO: 29476 - RNA, 22 nt, Homo sapiens
ccaucuuuaccagacaguguua

SEQ ID NO: 29477 - RNA, 23 nt, Homo sapiens
acucaccgacagcguugaauguu

SEQ ID NO: 29478 - RNA, 23 nt, Homo sapiens
acccaccgacagcaaugaauguu

SEQ ID NO: 29479 - RNA, 22 nt, Homo sapiens
acucaccgacagguugaauguu

SEQ ID NO: 29480 - RNA, 23 nt, Homo sapiens
acccaccgacaacaaugaauguu

SEQ ID NO: 29481 - RNA, 22 nt, Homo sapiens
cuacccacagacguaccaauca

SEQ ID NO: 29482 - RNA, 22 nt, Homo sapiens
gguaaaacucgcaauuacuuuu

SEQ ID NO: 29483 - RNA, 22 nt, Homo sapiens
ggccaaaaccacaauuacuuuu

SEQ ID NO: 29484 - RNA, 22 nt, Homo sapiens
ggcaaaaaccgcaauuacuuuu

SEQ ID NO: 29485 - RNA, 22 nt, Homo sapiens
ggcaaaaaccacaauuacuuuu

SEQ ID NO: 29486 - RNA, 22 nt, Homo sapiens
gacaaaaaccgcgauuacuuuu

SEQ ID NO: 29487 - RNA, 22 nt, Homo sapiens
ggcaaaauccgcaauuacuuuu

SEQ ID NO: 29488 - RNA, 22 nt, Homo sapiens
accaaagaccgcaauuacuuuu

SEQ ID NO: 29489 - RNA, 22 nt, Homo sapiens
gacaaaacccgcaaauacuuuu

SEQ ID NO: 29490 - RNA, 22 nt, Homo sapiens
acaaaauccacaauuacuuuug

SEQ ID NO: 29491 - RNA, 21 nt, Homo sapiens
uuuuggugcauauuuacuuua

SEQ ID NO: 29492 - RNA, 22 nt, Homo sapiens
auacauacuucuuuacauucca

SEQ ID NO: 29493 - RNA, 21 nt, Homo sapiens
gagcugcauccuggcuccggg

SEQ ID NO: 29494 - RNA, 21 nt, Homo sapiens
cugaggagagaggaggugggg

SEQ ID NO: 29495 - RNA, 20 nt, Homo sapiens
ggggcagacagacgaggaag

SEQ ID NO: 29496 - RNA, 18 nt, Homo sapiens
uggcgccugaacagggac

SEQ ID NO: 29497 - RNA, 23 nt, Homo sapiens
aaaaugcagauuccuggacucca

SEQ ID NO: 29498 - RNA, 23 nt, Homo sapiens
uccaucaucaaaacaaauggagu

SEQ ID NO: 29499 - RNA, 23 nt, Homo sapiens
accccuaucacgauuagcauuaa

SEQ ID NO: 29500 - RNA, 22 nt, Homo sapiens
ccacacacuuccuuacauucca

SEQ ID NO: 29501 - RNA, 22 nt, Homo sapiens
cucauauuacaaugagcucauc

SEQ ID NO: 29502 - RNA, 20 nt, Homo sapiens
ggcaaagaaggaacauuccu

SEQ ID NO: 29503 - RNA, 18 nt, Homo sapiens
gaaaugagggccagcuga

SEQ ID NO: 29504 - RNA, 21 nt, Homo sapiens
ugcaggcugaucuucuucucu

SEQ ID NO: 29505 - RNA, 22 nt, Homo sapiens
cacugguacaaggguugggaga

SEQ ID NO: 29506 - RNA, 22 nt, Homo sapiens
ucaggaacugccuuucucucca

SEQ ID NO: 29507 - RNA, 22 nt, Homo sapiens
ucaucucgcccgcaaagaccca

SEQ ID NO: 29508 - RNA, 22 nt, Homo sapiens
ugagccacugugccuggccuga

SEQ ID NO: 29509 - RNA, 22 nt, Homo sapiens
acaaaaguugccuuugugugau

SEQ ID NO: 29510 - RNA, 23 nt, Homo sapiens
gaaagugcccucaaggcugagug

SEQ ID NO: 29511 - RNA, 22 nt, Homo sapiens
ugcaagccuugggugugggagg

SEQ ID NO: 29512 - RNA, 21 nt, Homo sapiens
ucccagcacacauuuagcuca

SEQ ID NO: 29513 - RNA, 23 nt, Homo sapiens
ucauacagcuagauaaccaaaga

SEQ ID NO: 29514 - RNA, 20 nt, Homo sapiens
uacugcuuccacagcucccc

SEQ ID NO: 29515 - RNA, 22 nt, Homo sapiens
cacucuaaagggaggcacuuug

SEQ ID NO: 29516 - RNA, 21 nt, Homo sapiens
aaaggccacauccagcaccgu

SEQ ID NO: 29517 - RNA, 23 nt, Homo sapiens
gggagugaagacacggagccaga

SEQ ID NO: 29518 - RNA, 22 nt, Homo sapiens
gcgaacgcgccacggaccaccu

SEQ ID NO: 29519 - RNA, 25 nt, Homo sapiens
acggagcugucccaacaccaccccu

SEQ ID NO: 29520 - RNA, 20 nt, Homo sapiens
uacugcuuccacagcucccc

SEQ ID NO: 29521 - RNA, 22 nt, Homo sapiens
caaacaccauugucacacucca

SEQ ID NO: 29522 - RNA, 22 nt, Homo sapiens
gcacaaaucuccagaccaccca

SEQ ID NO: 29523 - RNA, 22 nt, Homo sapiens
cacgaccgacgccacgccgagu

SEQ ID NO: 29524 - RNA, 22 nt, Homo sapiens
ggagcccgcgccccgcgccgag

SEQ ID NO: 29525 - RNA, 21 nt, Homo sapiens
gaccaaucgccguccccgccg

SEQ ID NO: 29526 - RNA, 22 nt, Homo sapiens
ugagccacugugccuggccuga

SEQ ID NO: 29527 - RNA, 21 nt, Homo sapiens
aagugucagacacgguggugg

SEQ ID NO: 29528 - RNA, 22 nt, Homo sapiens
ucagaccgagacaagugcaaug

SEQ ID NO: 29529 - RNA, 23 nt, Homo sapiens
aguaacugguugaacaacuguaa

SEQ ID NO: 29530 - RNA, 22 nt, Homo sapiens
gcggucccgcggcgccccgccu

SEQ ID NO: 29531 - RNA, 22 nt, Homo sapiens
ugcuguuagcccuagccccgca

SEQ ID NO: 29532 - RNA, 22 nt, Homo sapiens
uaaaugaauucaauuuccuucu

SEQ ID NO: 29533 - RNA, 24 nt, Homo sapiens
ucacagguuaaagggucucaggga

SEQ ID NO: 29534 - RNA, 22 nt, Homo sapiens
ucacaaguuagggucucaggga

SEQ ID NO: 29535 - RNA, 23 nt, Homo sapiens
agcccuguucuacagcccugagg

SEQ ID NO: 29536 - RNA, 24 nt, Homo sapiens
acugcuggucuucagucagggcca

SEQ ID NO: 29537 - RNA, 20 nt, Homo sapiens
acagcaaggagggcaggagg

SEQ ID NO: 29538 - RNA, 21 nt, Homo sapiens
gcggaacuuagccacugugaa

SEQ ID NO: 29539 - RNA, 21 nt, Homo sapiens
gcagaacuuagccacugugaa

SEQ ID NO: 29540 - RNA, 23 nt, Homo sapiens
cgugagcuccuggaggacaggga

SEQ ID NO: 29541 - RNA, 22 nt, Homo sapiens
ccucauggaaggguuccccacu

SEQ ID NO: 29542 - RNA, 22 nt, Homo sapiens
ccuaaugauucaucauucucaa

SEQ ID NO: 29543 - RNA, 25 nt, Homo sapiens
acggagcugucccaacaccaccccu

SEQ ID NO: 29544 - RNA, 21 nt, Homo sapiens
caucaccuuccuucuccucca

SEQ ID NO: 29545 - RNA, 20 nt, Homo sapiens
uacugcuuccacagcucccc

SEQ ID NO: 29546 - RNA, 18 nt, Homo sapiens
gaaaugagggccagcuga

SEQ ID NO: 29547 - RNA, 22 nt, Homo sapiens
caaacaccauugucacacucca

SEQ ID NO: 29548 - RNA, 21 nt, Homo sapiens
gaccaaucgccguccccgccg

SEQ ID NO: 29549 - RNA, 23 nt, Homo sapiens
cccaacagacauggcgguacuca

SEQ ID NO: 29550 - RNA, 22 nt, Homo sapiens
uucacacugcaugcucugggua

SEQ ID NO: 29551 - RNA, 22 nt, Homo sapiens
cuuccagucgaggauguuuaca

SEQ ID NO: 29552 - RNA, 22 nt, Homo sapiens
agcugaguguaggauguuuaca

SEQ ID NO: 29553 - RNA, 23 nt, Homo sapiens
gcugagaguguaggauguuuaca

SEQ ID NO: 29554 - RNA, 22 nt, Homo sapiens
cuuccagucggggauguuuaca

SEQ ID NO: 29555 - RNA, 22 nt, Homo sapiens
cuuccagucaaggauguuuaca

SEQ ID NO: 29556 - RNA, 22 nt, Homo sapiens
agccacaaucaccuucugaucu

SEQ ID NO: 29557 - RNA, 22 nt, Homo sapiens
gcacacaauaaauguuugcuga

SEQ ID NO: 29558 - RNA, 19 nt, Homo sapiens
guccugaauuccgcagccu

SEQ ID NO: 29559 - RNA, 21 nt, Homo sapiens
gaaggaagugagugcagccac

SEQ ID NO: 29560 - RNA, 22 nt, Homo sapiens
gcggucccgcggcgccccgccu

SEQ ID NO: 29561 - RNA, 21 nt, Homo sapiens
cuggaggacggcaacagucag

SEQ ID NO: 29562 - RNA, 22 nt, Homo sapiens
caaacaccauugucacacucca

SEQ ID NO: 29563 - RNA, 21 nt, Homo sapiens
gaccaaucgccguccccgccg

SEQ ID NO: 29564 - RNA, 20 nt, Homo sapiens
acauuacuguuaucaaaaca

SEQ ID NO: 29565 - RNA, 22 nt, Homo sapiens
ucaacaucagucugauaagcua

SEQ ID NO: 29566 - RNA, 22 nt, Homo sapiens
aguccagauucugugcccacca

SEQ ID NO: 29567 - RNA, 22 nt, Homo sapiens
aagagggagacccaggcucgga

SEQ ID NO: 29568 - RNA, 22 nt, Homo sapiens
gcacauguucugcggcccacca

SEQ ID NO: 29569 - RNA, 22 nt, Homo sapiens
gcggucccgcggcgccccgccu

SEQ ID NO: 29570 - RNA, 24 nt, Homo sapiens
cacccccagagccucagcucccca

SEQ ID NO: 29571 - RNA, 22 nt, Homo sapiens
cugggggcggcacaggggcuca

SEQ ID NO: 29572 - RNA, 21 nt, Homo sapiens
gagcuacagugcuucaucuca

SEQ ID NO: 29573 - RNA, 22 nt, Homo sapiens
ccagaacugaguccacagggca

SEQ ID NO: 29574 - RNA, 22 nt, Homo sapiens
acaaaguucuguagugcacuga

SEQ ID NO: 29575 - RNA, 22 nt, Homo sapiens
acaaaguucugugaugcacuga

SEQ ID NO: 29576 - RNA, 21 nt, Homo sapiens
ccaaguucugucaugcacuga

SEQ ID NO: 29577 - RNA, 23 nt, Homo sapiens
aggaacagcagcagcccgggccg

SEQ ID NO: 29578 - RNA, 22 nt, Homo sapiens
cagaagugggccgggcacaggg

SEQ ID NO: 29579 - RNA, 23 nt, Homo sapiens
cgugagcuccuggaggacaggga

SEQ ID NO: 29580 - RNA, 22 nt, Homo sapiens
acaaccagcuaagacacugcca

SEQ ID NO: 29581 - RNA, 23 nt, Homo sapiens
gcaaucagcuaacuacacugccu

SEQ ID NO: 29582 - RNA, 23 nt, Homo sapiens
acacucaaaagauggcggcacuu

SEQ ID NO: 29583 - RNA, 22 nt, Homo sapiens
accagcuaacaauacacugcca

SEQ ID NO: 29584 - RNA, 22 nt, Homo sapiens
gccagcuaacaauacacugccu

SEQ ID NO: 29585 - RNA, 19 nt, Homo sapiens
gccugcugacaccgugccu

SEQ ID NO: 29586 - RNA, 19 nt, Homo sapiens
agaaaccccagcagagaca

SEQ ID NO: 29587 - RNA, 25 nt, Homo sapiens
acggagcugucccaacaccaccccu

SEQ ID NO: 29588 - RNA, 22 nt, Homo sapiens
aagagggagacccaggcucgga

SEQ ID NO: 29589 - RNA, 24 nt, Homo sapiens
acgcgcaggccagagacccaggca

SEQ ID NO: 29590 - RNA, 22 nt, Homo sapiens
agcucagaacccagaggucuca

SEQ ID NO: 29591 - RNA, 22 nt, Homo sapiens
ucggucccucgggccagggcag

SEQ ID NO: 29592 - RNA, 20 nt, Homo sapiens
uacugcuuccacagcucccc

SEQ ID NO: 29593 - RNA, 22 nt, Homo sapiens
cuagugguccuaaacauuucac

SEQ ID NO: 29594 - RNA, 22 nt, Homo sapiens
cacucagcggccguuuccccaa

SEQ ID NO: 29595 - RNA, 22 nt, Homo sapiens
cacucagcaccaggauauuguu

SEQ ID NO: 29596 - RNA, 22 nt, Homo sapiens
uacagauggauaccgugcaauu

SEQ ID NO: 29597 - RNA, 22 nt, Homo sapiens
ccucauggaaggguuccccacu

SEQ ID NO: 29598 - RNA, 20 nt, Homo sapiens
gcaaaugguacagcuacuuu

SEQ ID NO: 29599 - RNA, 25 nt, Homo sapiens
acggagcugucccaacaccaccccu

SEQ ID NO: 29600 - RNA, 20 nt, Homo sapiens
uacugcuuccacagcucccc

SEQ ID NO: 29601 - RNA, 17 nt, Homo sapiens
gggagaggaggaggcga

SEQ ID NO: 29602 - RNA, 21 nt, Homo sapiens
agggcucaucuugguccugca

SEQ ID NO: 29603 - RNA, 24 nt, Homo sapiens
gaagucacucccaggcagcugcaa

SEQ ID NO: 29604 - RNA, 23 nt, Homo sapiens
gggagugaagacacggagccaga

SEQ ID NO: 29605 - RNA, 22 nt, Homo sapiens
ucaggaacugccuuucucucca

SEQ ID NO: 29606 - RNA, 21 nt, Homo sapiens
gaccaaucgccguccccgccg

SEQ ID NO: 29607 - RNA, 23 nt, Homo sapiens
gaaacccagcagacaauguagcu

SEQ ID NO: 29608 - RNA, 21 nt, Homo sapiens
acaggauugagggggggcccu

SEQ ID NO: 29609 - RNA, 23 nt, Homo sapiens
aaaucagaaucacaccuggggga

SEQ ID NO: 29610 - RNA, 23 nt, Homo sapiens
acacucaaaagauggcggcacuu

SEQ ID NO: 29611 - RNA, 21 nt, Homo sapiens
ccuucugacuccaaguccagu

SEQ ID NO: 29612 - RNA, 22 nt, Homo sapiens
gcugccguauaugugaugucac

SEQ ID NO: 29613 - RNA, 24 nt, Homo sapiens
acgcagagcccgaaagcccccagu

SEQ ID NO: 29614 - RNA, 22 nt, Homo sapiens
gcggucccgcggcgccccgccu

SEQ ID NO: 29615 - RNA, 17 nt, Homo sapiens
gggagaggaggaggcga

SEQ ID NO: 29616 - RNA, 18 nt, Homo sapiens
aucacauucaccucccug

SEQ ID NO: 29617 - RNA, 23 nt, Homo sapiens
gggagugaagacacggagccaga

SEQ ID NO: 29618 - RNA, 21 nt, Homo sapiens
gaccaaucgccguccccgccg

SEQ ID NO: 29619 - RNA, 22 nt, Homo sapiens
ucagaccgagacaagugcaaug

SEQ ID NO: 29620 - RNA, 22 nt, Homo sapiens
gcggucccgcggcgccccgccu

SEQ ID NO: 29621 - RNA, 20 nt, Homo sapiens
aggggccucagccuccuggu

SEQ ID NO: 29622 - RNA, 22 nt, Homo sapiens
ugcuguuagcccuagccccgca

SEQ ID NO: 29623 - RNA, 21 nt, Homo sapiens
caucaccuuccuucuccucca

SEQ ID NO: 29624 - RNA, 22 nt, Homo sapiens
uauccacuacaccccgcugccu

SEQ ID NO: 29625 - RNA, 22 nt, Homo sapiens
ggcagagagucagagcgcggau

SEQ ID NO: 29626 - RNA, 22 nt, Homo sapiens
cacaagaucggaucuacggguu

SEQ ID NO: 29627 - RNA, 22 nt, Homo sapiens
cgcaaggucgguucuacgggug

SEQ ID NO: 29628 - RNA, 22 nt, Homo sapiens
acaacuguaacuagacgguuuu

SEQ ID NO: 29629 - RNA, 22 nt, Homo sapiens
cacaaaccauuaugugcugcua

SEQ ID NO: 29630 - RNA, 22 nt, Homo sapiens
uguaaaccaugaugugcugcua

SEQ ID NO: 29631 - RNA, 22 nt, Homo sapiens
cgccaauauuuacgugcugcua

SEQ ID NO: 29632 - RNA, 21 nt, Homo sapiens
cccuccaccaugcaagggaug

SEQ ID NO: 29633 - RNA, 21 nt, Homo sapiens
gccaauauuucugugcugcua

SEQ ID NO: 29634 - RNA, 22 nt, Homo sapiens
cagacuccgguggaaugaagga

SEQ ID NO: 29635 - RNA, 22 nt, Homo sapiens
auguaugugggacgguaaacca

SEQ ID NO: 29636 - RNA, 22 nt, Homo sapiens
uucaaaacaugaauugcugcug

SEQ ID NO: 29637 - RNA, 22 nt, Homo sapiens
augggacauccuacauaugcaa

SEQ ID NO: 29638 - RNA, 21 nt, Homo sapiens
acaaaccacagugugcugcug

SEQ ID NO: 29639 - RNA, 18 nt, Homo sapiens
acccucugaaaggaagca

SEQ ID NO: 29640 - RNA, 22 nt, Homo sapiens
aaagugcuucuuaccuccagau

SEQ ID NO: 29641 - RNA, 22 nt, Homo sapiens
cucagucccaggcaaaccauaa

SEQ ID NO: 29642 - RNA, 22 nt, Homo sapiens
ccucuaguaaauaugucagcau

SEQ ID NO: 29643 - RNA, 19 nt, Homo sapiens
gccucagaggcagcugcuu

SEQ ID NO: 29644 - RNA, 23 nt, Homo sapiens
uguaggcuggggauaaaugaaua

SEQ ID NO: 29645 - RNA, 22 nt, Homo sapiens
uggugauucacaaagaaaucca

SEQ ID NO: 29646 - RNA, 22 nt, Homo sapiens
gggagaggucucccugcgcaca

SEQ ID NO: 29647 - RNA, 23 nt, Homo sapiens
aggaacagcagcagcccgggccg

SEQ ID NO: 29648 - RNA, 23 nt, Homo sapiens
aggaacagcagcagcccgggccg

SEQ ID NO: 29649 - RNA, 21 nt, Homo sapiens
acaggauugagggggggcccu

SEQ ID NO: 29650 - RNA, 23 nt, Homo sapiens
cuccagccccuccagggcuuccu

SEQ ID NO: 29651 - RNA, 20 nt, Homo sapiens
gcagcuguccgcccagacac

SEQ ID NO: 29652 - RNA, 21 nt, Homo sapiens
aguagugcuuucuacuuuaug

SEQ ID NO: 29653 - RNA, 22 nt, Homo sapiens
ucaggaacugccuuucucucca

SEQ ID NO: 29654 - RNA, 22 nt, Homo sapiens
auggcaguggaguuagugauug

SEQ ID NO: 29655 - RNA, 21 nt, Homo sapiens
ugcaggcugaucuucuucucu

SEQ ID NO: 29656 - RNA, 24 nt, Homo sapiens
acugcuggucuucagucagggcca

SEQ ID NO: 29657 - RNA, 22 nt, Homo sapiens
gcacaaaucuccagaccaccca

SEQ ID NO: 29658 - RNA, 23 nt, Homo sapiens
agggauuccugggaaaacuggac

SEQ ID NO: 29659 - RNA, 23 nt, Homo sapiens
gggagugaagacacggagccaga

SEQ ID NO: 29660 - RNA, 22 nt, Homo sapiens
agccacaaucaccuucugaucu

SEQ ID NO: 29661 - RNA, 21 nt, Homo sapiens
acaaaccacagugugcugcug

SEQ ID NO: 29662 - RNA, 22 nt, Homo sapiens
caagacacauuuggagagggac

SEQ ID NO: 29663 - RNA, 23 nt, Homo sapiens
acaacaaaaucacuagucuucca

SEQ ID NO: 29664 - RNA, 20 nt, Homo sapiens
uccccacagacccagagccg

SEQ ID NO: 29665 - RNA, 22 nt, Homo sapiens
aagcgguuuaccaucccacaua

SEQ ID NO: 29666 - RNA, 22 nt, Homo sapiens
ucgcccucucaacccagcuuuu

SEQ ID NO: 29667 - RNA, 22 nt, Homo sapiens
uugcccucucaacccagcuuuu

SEQ ID NO: 29668 - RNA, 20 nt, Homo sapiens
acccucucaacccagcuuuu

SEQ ID NO: 29669 - RNA, 19 nt, Homo sapiens
uccucucaacccagcuuuu

SEQ ID NO: 29670 - RNA, 22 nt, Homo sapiens
uauucaggaacauauugcaaaa

SEQ ID NO: 29671 - RNA, 22 nt, Homo sapiens
uauucaggaacauauugcaaaa

SEQ ID NO: 29672 - RNA, 22 nt, Homo sapiens
aucgggaggggacugagccuga

SEQ ID NO: 29673 - RNA, 23 nt, Homo sapiens
gaaagugcccucaaggcugagug

SEQ ID NO: 29674 - RNA, 22 nt, Homo sapiens
acaguggucaucgagugacaca

SEQ ID NO: 29675 - RNA, 23 nt, Homo sapiens
ucauacagcuagauaaccaaaga

SEQ ID NO: 29676 - RNA, 23 nt, Homo sapiens
gucacaucccucccaagacccuc

SEQ ID NO: 29677 - RNA, 22 nt, Homo sapiens
agccaagcucagacggauccga

SEQ ID NO: 29678 - RNA, 22 nt, Homo sapiens
agccaagcucagacggauccga

SEQ ID NO: 29679 - RNA, 17 nt, Homo sapiens
gggagaggaggaggcga

SEQ ID NO: 29680 - RNA, 22 nt, Homo sapiens
ucccucacacagaauuccagaa

SEQ ID NO: 29681 - RNA, 22 nt, Homo sapiens
uauggaugcaaaaugaucccaa

SEQ ID NO: 29682 - RNA, 19 nt, Homo sapiens
gccugcugacaccgugccu

SEQ ID NO: 29683 - RNA, 21 nt, Homo sapiens
guuauagaucuggauuugaac

SEQ ID NO: 29684 - RNA, 23 nt, Homo sapiens
aaccaagaccccggagaucccag

SEQ ID NO: 29685 - RNA, 21 nt, Homo sapiens
gagcugcauccuggcuccggg

SEQ ID NO: 29686 - RNA, 24 nt, Homo sapiens
acugcuggucuucagucagggcca

SEQ ID NO: 29687 - RNA, 23 nt, Homo sapiens
gggagugaagacacggagccaga

SEQ ID NO: 29688 - RNA, 22 nt, Homo sapiens
cacugguacaaggguugggaga

SEQ ID NO: 29689 - RNA, 23 nt, Homo sapiens
aggaacagcagcagcccgggccg

SEQ ID NO: 29690 - RNA, 22 nt, Homo sapiens
ucaggaacugccuuucucucca

SEQ ID NO: 29691 - RNA, 22 nt, Homo sapiens
agcugaguguaggauguuuaca

SEQ ID NO: 29692 - RNA, 22 nt, Homo sapiens
acaaccagcuaagacacugcca

SEQ ID NO: 29693 - RNA, 23 nt, Homo sapiens
gcaaucagcuaacuacacugccu

SEQ ID NO: 29694 - RNA, 22 nt, Homo sapiens
accagcuaacaauacacugcca

SEQ ID NO: 29695 - RNA, 22 nt, Homo sapiens
gccagcuaacaauacacugccu

SEQ ID NO: 29696 - RNA, 22 nt, Homo sapiens
aggaaaccagcaaguguugacg

SEQ ID NO: 29697 - RNA, 22 nt, Homo sapiens
ccucaggcacggccgggccacc

SEQ ID NO: 29698 - RNA, 23 nt, Homo sapiens
cuccagccccuccagggcuuccu

SEQ ID NO: 29699 - RNA, 22 nt, Homo sapiens
gaggcucagaauggcucaggag

SEQ ID NO: 29700 - RNA, 21 nt, Homo sapiens
cugggggacggagcagaagga

SEQ ID NO: 29701 - RNA, 17 nt, Homo sapiens
gggagaggaggaggcga

SEQ ID NO: 29702 - RNA, 22 nt, Homo sapiens
cgggacguccagacucaacucu

SEQ ID NO: 29703 - RNA, 24 nt, Homo sapiens
ugggagaaccucccugcuucugcu

SEQ ID NO: 29704 - RNA, 18 nt, Homo sapiens
acccucugaaaggaagca

SEQ ID NO: 29705 - RNA, 22 nt, Homo sapiens
aaagugcuucuuaccuccagau

SEQ ID NO: 29706 - RNA, 22 nt, Homo sapiens
cugcucaaacccuccaaugacu

SEQ ID NO: 29707 - RNA, 22 nt, Homo sapiens
uggggacccucccugaaccaag

SEQ ID NO: 29708 - RNA, 22 nt, Homo sapiens
ggcagagagucagagcgcggau

SEQ ID NO: 29709 - RNA, 21 nt, Homo sapiens
ccccucccagccucccugcca

SEQ ID NO: 29710 - RNA, 22 nt, Homo sapiens
cagcugguugaaggggaccaaa

SEQ ID NO: 29711 - RNA, 22 nt, Homo sapiens
cacaaaccauuaugugcugcua

SEQ ID NO: 29712 - RNA, 22 nt, Homo sapiens
uguaaaccaugaugugcugcua

SEQ ID NO: 29713 - RNA, 22 nt, Homo sapiens
cgccaauauuuacgugcugcua

SEQ ID NO: 29714 - RNA, 24 nt, Homo sapiens
agugugaguucuaccauugccaaa

SEQ ID NO: 29715 - RNA, 21 nt, Homo sapiens
gccaauauuucugugcugcua

SEQ ID NO: 29716 - RNA, 21 nt, Homo sapiens
agcuaugccagcaucuugccu

SEQ ID NO: 29717 - RNA, 22 nt, Homo sapiens
ucgcccucucaacccagcuuuu

SEQ ID NO: 29718 - RNA, 22 nt, Homo sapiens
uugcccucucaacccagcuuuu

SEQ ID NO: 29719 - RNA, 20 nt, Homo sapiens
acccucucaacccagcuuuu

SEQ ID NO: 29720 - RNA, 19 nt, Homo sapiens
uccucucaacccagcuuuu

SEQ ID NO: 29721 - RNA, 22 nt, Homo sapiens
aaucagucucauugcuuuauaa

SEQ ID NO: 29722 - RNA, 22 nt, Homo sapiens
cacuuagcagguuguauuauau

SEQ ID NO: 29723 - RNA, 22 nt, Homo sapiens
uucaaaacaugaauugcugcug

SEQ ID NO: 29724 - RNA, 21 nt, Homo sapiens
acaaaccacagugugcugcug

SEQ ID NO: 29725 - RNA, 22 nt, Homo sapiens
auaaaugacaccuccuugugaa

SEQ ID NO: 29726 - RNA, 22 nt, Homo sapiens
gcacacaauaaauguuugcuga

SEQ ID NO: 29727 - RNA, 21 nt, Homo sapiens
guaaugggaccuuccucuuug

SEQ ID NO: 29728 - RNA, 21 nt, Homo sapiens
ggggagcgggggcccugccuu

SEQ ID NO: 29729 - RNA, 21 nt, Homo sapiens
cuggaggacggcaacagucag

SEQ ID NO: 29730 - RNA, 21 nt, Homo sapiens
cggggugcacgggcggagggc

SEQ ID NO: 29731 - RNA, 23 nt, Homo sapiens
gggagugaagacacggagccaga

SEQ ID NO: 29732 - RNA, 21 nt, Homo sapiens
gaccaaucgccguccccgccg

SEQ ID NO: 29733 - RNA, 23 nt, Homo sapiens
aaaucagaaucacaccuggggga

SEQ ID NO: 29734 - RNA, 23 nt, Homo sapiens
aaagucucgcucucugccccuca

SEQ ID NO: 29735 - RNA, 22 nt, Homo sapiens
uccagcaaagggaagcgcuuuc

SEQ ID NO: 29736 - RNA, 22 nt, Homo sapiens
accucuaaaggggagcgcuuug

SEQ ID NO: 29737 - RNA, 23 nt, Homo sapiens
acacucuaaagagaagcgcuuug

SEQ ID NO: 29738 - RNA, 21 nt, Homo sapiens
gcuccaaagggaagcgcuuug

SEQ ID NO: 29739 - RNA, 21 nt, Homo sapiens
cacucugaagggaagcgcuuu

SEQ ID NO: 29740 - RNA, 21 nt, Homo sapiens
ccucuaaagagaagcgcuuuc

SEQ ID NO: 29741 - RNA, 24 nt, Homo sapiens
acgcagagcccgaaagcccccagu

SEQ ID NO: 29742 - RNA, 24 nt, Homo sapiens
acgcgcaggccagagacccaggca

SEQ ID NO: 29743 - RNA, 22 nt, Homo sapiens
gcggucccgcggcgccccgccu

SEQ ID NO: 29744 - RNA, 23 nt, Homo sapiens
cacugugggcccucuccgcacca

SEQ ID NO: 29745 - RNA, 22 nt, Homo sapiens
ugcuguuagcccuagccccgca

SEQ ID NO: 29746 - RNA, 22 nt, Homo sapiens
ugcuguuagcccuagccccgca

SEQ ID NO: 29747 - RNA, 21 nt, Homo sapiens
cacaaccucaguguuuccagg

SEQ ID NO: 29748 - RNA, 22 nt, Homo sapiens
caaacaccauugucacacucca

SEQ ID NO: 29749 - RNA, 17 nt, Homo sapiens
ggguggcagcgguggga

SEQ ID NO: 29750 - RNA, 21 nt, Homo sapiens
gaccaaucgccguccccgccg

SEQ ID NO: 29751 - RNA, 22 nt, Homo sapiens
aguccagauucugugcccacca

SEQ ID NO: 29752 - RNA, 22 nt, Homo sapiens
gcacauguucugcggcccacca

SEQ ID NO: 29753 - RNA, 22 nt, Homo sapiens
gcggucccgcggcgccccgccu

SEQ ID NO: 29754 - RNA, 21 nt, Homo sapiens
caucaccuuccuucuccucca

SEQ ID NO: 29755 - RNA, 21 nt, Homo sapiens
gaccaaucgccguccccgccg

SEQ ID NO: 29756 - RNA, 23 nt, Homo sapiens
aaagucucgcucucugccccuca

SEQ ID NO: 29757 - RNA, 22 nt, Homo sapiens
gcggucccgcggcgccccgccu

SEQ ID NO: 29758 - RNA, 24 nt, Homo sapiens
cacccccagagccucagcucccca

SEQ ID NO: 29759 - RNA, 22 nt, Homo sapiens
aacuauacaaccuacuaccuca

SEQ ID NO: 29760 - RNA, 22 nt, Homo sapiens
aaccacacaaccuacuaccuca

SEQ ID NO: 29761 - RNA, 19 nt, Homo sapiens
agaaaccccagcagagaca

SEQ ID NO: 29762 - RNA, 22 nt, Homo sapiens
gaaaagccagggucuguauaga

SEQ ID NO: 29763 - RNA, 22 nt, Homo sapiens
agagagagucugcccuuguaua

SEQ ID NO: 29764 - RNA, 22 nt, Homo sapiens
acagagagcuugcccuuguaua

SEQ ID NO: 29765 - RNA, 19 nt, Homo sapiens
gcuccuguccaacuggcuc

SEQ ID NO: 29766 - RNA, 22 nt, Homo sapiens
caagacacauuuggagagggac

SEQ ID NO: 29767 - RNA, 22 nt, Homo sapiens
cuaccugagcuagcauacaagu

SEQ ID NO: 29768 - RNA, 17 nt, Homo sapiens
uggaggccccagcgaga

SEQ ID NO: 29769 - RNA, 22 nt, Homo sapiens
ucuacccagaaaggagccagug

SEQ ID NO: 29770 - RNA, 20 nt, Homo sapiens
uacugcuuccacagcucccc

SEQ ID NO: 29771 - RNA, 22 nt, Homo sapiens
ccccccacugggccguacccac

SEQ ID NO: 29772 - RNA, 18 nt, Homo sapiens
aucacauucaccucccug

SEQ ID NO: 29773 - RNA, 22 nt, Homo sapiens
acugccugucugugccugcugu

SEQ ID NO: 29774 - RNA, 22 nt, Homo sapiens
acggaagggcagagagggccag

SEQ ID NO: 29775 - RNA, 22 nt, Homo sapiens
accagguuccaccccagcaggc

SEQ ID NO: 29776 - RNA, 22 nt, Homo sapiens
aucgggaggggacugagccuga

SEQ ID NO: 29777 - RNA, 22 nt, Homo sapiens
aggaaaccagcaaguguugacg

SEQ ID NO: 29778 - RNA, 21 nt, Homo sapiens
cccgaggagccgggcaggcuu

SEQ ID NO: 29779 - RNA, 21 nt, Homo sapiens
caucaccuuccuucuccucca

SEQ ID NO: 29780 - RNA, 22 nt, Homo sapiens
ccaucuuuaccagacaguguua

SEQ ID NO: 29781 - RNA, 21 nt, Homo sapiens
cagcgaaacaggcaaacggag

SEQ ID NO: 29782 - RNA, 22 nt, Homo sapiens
acaucguuaccagacaguguua

SEQ ID NO: 29783 - RNA, 22 nt, Homo sapiens
cuuccagucgaggauguuuaca

SEQ ID NO: 29784 - RNA, 22 nt, Homo sapiens
agcugaguguaggauguuuaca

SEQ ID NO: 29785 - RNA, 23 nt, Homo sapiens
gcugagaguguaggauguuuaca

SEQ ID NO: 29786 - RNA, 22 nt, Homo sapiens
cuuccagucggggauguuuaca

SEQ ID NO: 29787 - RNA, 22 nt, Homo sapiens
cuuccagucaaggauguuuaca

SEQ ID NO: 29788 - RNA, 23 nt, Homo sapiens
cggcucugucgucgaggcgcuca

SEQ ID NO: 29789 - RNA, 21 nt, Homo sapiens
aagggucaguaagcacccgcg

SEQ ID NO: 29790 - RNA, 23 nt, Homo sapiens
gggagugaagacacggagccaga

SEQ ID NO: 29791 - RNA, 22 nt, Homo sapiens
ucaggaacugccuuucucucca

SEQ ID NO: 29792 - RNA, 21 nt, Homo sapiens
gcggaacuuagccacugugaa

SEQ ID NO: 29793 - RNA, 23 nt, Homo sapiens
cggcucugucgucgaggcgcuca

SEQ ID NO: 29794 - RNA, 23 nt, Homo sapiens
aaagucucgcucucugccccuca

SEQ ID NO: 29795 - RNA, 22 nt, Homo sapiens
aaagugcuucuuaccuccagau

SEQ ID NO: 29796 - RNA, 23 nt, Homo sapiens
acacucuaaagagaagcgcuuug

SEQ ID NO: 29797 - RNA, 21 nt, Homo sapiens
agaaaguacuucccucuggag

SEQ ID NO: 29798 - RNA, 21 nt, Homo sapiens
agaaagugcaucccucuggag

SEQ ID NO: 29799 - RNA, 21 nt, Homo sapiens
caucaccuuccuucuccucca

SEQ ID NO: 29800 - RNA, 22 nt, Homo sapiens
ggaggccgggacgagugcaaua

SEQ ID NO: 29801 - RNA, 26 nt, Homo sapiens
uuucagaauuugcugccaucaucauc

SEQ ID NO: 29802 - RNA, 18 nt, Homo sapiens
gaaaugagggccagcuga

SEQ ID NO: 29803 - RNA, 22 nt, Homo sapiens
cagaagugggccgggcacaggg

SEQ ID NO: 29804 - RNA, 23 nt, Homo sapiens
ucaguuuugcauagauuugcaca

SEQ ID NO: 29805 - RNA, 22 nt, Homo sapiens
cacucagcaccaggauauuguu

SEQ ID NO: 29806 - RNA, 22 nt, Homo sapiens
aacuaugcaaccuacuaccucu

SEQ ID NO: 29807 - RNA, 21 nt, Homo sapiens
caugcacaugcacacauacau

SEQ ID NO: 29808 - RNA, 22 nt, Homo sapiens
uaaccgauuucagauggugcua

SEQ ID NO: 29809 - RNA, 22 nt, Homo sapiens
accagcuaacaauacacugcca

SEQ ID NO: 29810 - RNA, 22 nt, Homo sapiens
gcacacaauaaauguuugcuga

SEQ ID NO: 29811 - RNA, 22 nt, Homo sapiens
gcaaaaguaauugagauuuuug

SEQ ID NO: 29812 - RNA, 22 nt, Homo sapiens
aaaguaacugcaguuuuugcua

SEQ ID NO: 29813 - RNA, 23 nt, Homo sapiens
guucuguccuggaagaacauacu

SEQ ID NO: 29814 - RNA, 22 nt, Homo sapiens
gccaccuucaaaugggaagucu

SEQ ID NO: 29815 - RNA, 21 nt, Homo sapiens
caucaccuuccuucuccucca

SEQ ID NO: 29816 - RNA, 17 nt, Homo sapiens
gggagaggaggaggcga

SEQ ID NO: 29817 - RNA, 22 nt, Homo sapiens
cacaucucacuguagccucaaa

SEQ ID NO: 29818 - RNA, 21 nt, Homo sapiens
gaccaaucgccguccccgccg

SEQ ID NO: 29819 - RNA, 22 nt, Homo sapiens
cuguuccugcugaacugagcca

SEQ ID NO: 29820 - RNA, 22 nt, Homo sapiens
aucgggaggggacugagccuga

SEQ ID NO: 29821 - RNA, 23 nt, Homo sapiens
acagaaagugcuucccucaagag

SEQ ID NO: 29822 - RNA, 19 nt, Homo sapiens
gcuccuguccaacuggcuc

SEQ ID NO: 29823 - RNA, 22 nt, Homo sapiens
gauccgagcaccggggaccccc

SEQ ID NO: 29824 - RNA, 23 nt, Homo sapiens
ggacauuguuucagugcccaagu

SEQ ID NO: 29825 - RNA, 22 nt, Homo sapiens
gcggucccgcggcgccccgccu

SEQ ID NO: 29826 - RNA, 22 nt, Homo sapiens
ucuacccagaaaggagccagug

SEQ ID NO: 29827 - RNA, 22 nt, Homo sapiens
ugaagaagggggggaagggcgu

SEQ ID NO: 29828 - RNA, 22 nt, Homo sapiens
ggagauggagccagggcccuaa

SEQ ID NO: 29829 - RNA, 21 nt, Homo sapiens
ugcaaacccugcaugugggag

SEQ ID NO: 29830 - RNA, 22 nt, Homo sapiens
ugagccacugugccuggccuga

SEQ ID NO: 29831 - RNA, 22 nt, Homo sapiens
ugcaagccuugggugugggagg

SEQ ID NO: 29832 - RNA, 22 nt, Homo sapiens
aagagggagacccaggcucgga

SEQ ID NO: 29833 - RNA, 21 nt, Homo sapiens
aucugcacugucagcacuuua

SEQ ID NO: 29834 - RNA, 24 nt, Homo sapiens
ugggagaaccucccugcuucugcu

SEQ ID NO: 29835 - RNA, 22 nt, Homo sapiens
cacucagcaccaggauauuguu

SEQ ID NO: 29836 - RNA, 21 nt, Homo sapiens
acuccaaagggaagcgccuuc

SEQ ID NO: 29837 - RNA, 22 nt, Homo sapiens
cgcucuaaagggaagcgccuuc

SEQ ID NO: 29838 - RNA, 22 nt, Homo sapiens
gaacuugcuaaaaaugcagaau

SEQ ID NO: 29839 - RNA, 22 nt, Homo sapiens
gcugaggcuguggggcuggagu

SEQ ID NO: 29840 - RNA, 21 nt, Homo sapiens
acaaugguuguccgauauuaa

SEQ ID NO: 29841 - RNA, 22 nt, Homo sapiens
ggcucccaagaaccucaccugu

SEQ ID NO: 29842 - RNA, 22 nt, Homo sapiens
cagaaagugcuucccucuagag

SEQ ID NO: 29843 - RNA, 23 nt, Homo sapiens
cugcagaacuguucccgcugcua

SEQ ID NO: 29844 - RNA, 21 nt, Homo sapiens
uugucuaaccagucaccuguu

SEQ ID NO: 29845 - RNA, 23 nt, Homo sapiens
acagcgcucgcaaccgcagcgau

SEQ ID NO: 29846 - RNA, 24 nt, Homo sapiens
acgcgcaggccagagacccaggca

SEQ ID NO: 29847 - RNA, 22 nt, Homo sapiens
ccucaggcacggccgggccacc

SEQ ID NO: 29848 - RNA, 17 nt, Homo sapiens
uggaggccccagcgaga

SEQ ID NO: 29849 - RNA, 22 nt, Homo sapiens
cacauggccaaaacagagaaga

SEQ ID NO: 29850 - RNA, 22 nt, Homo sapiens
cacgaccgacgccacgccgagu

SEQ ID NO: 29851 - RNA, 23 nt, Homo sapiens
gggagugaagacacggagccaga

SEQ ID NO: 29852 - RNA, 18 nt, Homo sapiens
auucaaucuacugccuca

SEQ ID NO: 29853 - RNA, 21 nt, Homo sapiens
gaccaaucgccguccccgccg

SEQ ID NO: 29854 - RNA, 22 nt, Homo sapiens
aaagagguuaaccagguguguu

SEQ ID NO: 29855 - RNA, 22 nt, Homo sapiens
ugaauccuugaauagguguguu

SEQ ID NO: 29856 - RNA, 22 nt, Homo sapiens
aagagggagacccaggcucgga

SEQ ID NO: 29857 - RNA, 22 nt, Homo sapiens
gcggucccgcggcgccccgccu

SEQ ID NO: 29858 - RNA, 24 nt, Homo sapiens
cacccccagagccucagcucccca

SEQ ID NO: 29859 - RNA, 21 nt, Homo sapiens
ccccucccagccucccugcca

SEQ ID NO: 29860 - RNA, 22 nt, Homo sapiens
cggugagcacccggccccugcg

SEQ ID NO: 29861 - RNA, 22 nt, Homo sapiens
agcgggacuuugagggccaguu

SEQ ID NO: 29862 - RNA, 22 nt, Homo sapiens
gcuggguggagaagguggugaa

SEQ ID NO: 29863 - RNA, 21 nt, Homo sapiens
acaggauugagggggggcccu

SEQ ID NO: 29864 - RNA, 22 nt, Homo sapiens
gaauucaucacggccagccucu

SEQ ID NO: 29865 - RNA, 19 nt, Homo sapiens
guccugaauuccgcagccu

SEQ ID NO: 29866 - RNA, 22 nt, Homo sapiens
cggugagcacccggccccugcg

SEQ ID NO: 29867 - RNA, 23 nt, Homo sapiens
cagcugcuuuugggauuccguug

SEQ ID NO: 29868 - RNA, 22 nt, Homo sapiens
gaauucaucacggccagccucu

SEQ ID NO: 29869 - RNA, 23 nt, Homo sapiens
cugcagaacuguucccgcugcua

SEQ ID NO: 29870 - RNA, 23 nt, Homo sapiens
gaaagugcuucuuuccucgagaa

SEQ ID NO: 29871 - RNA, 24 nt, Homo sapiens
acgcgcaggccagagacccaggca

SEQ ID NO: 29872 - RNA, 22 nt, Homo sapiens
uggugauucacaaagaaaucca

SEQ ID NO: 29873 - RNA, 23 nt, Homo sapiens
cuaccugcacuguaagcacuuuu

SEQ ID NO: 29874 - RNA, 21 nt, Homo sapiens
aucugcacugucagcacuuua

SEQ ID NO: 29875 - RNA, 22 nt, Homo sapiens
aggucucacuuuguugcccaga

SEQ ID NO: 29876 - RNA, 23 nt, Homo sapiens
cuaccugcacuguaagcacuuug

SEQ ID NO: 29877 - RNA, 18 nt, Homo sapiens
auucaaucuacugccuca

SEQ ID NO: 29878 - RNA, 23 nt, Homo sapiens
cuaccugcacuauaagcacuuua

SEQ ID NO: 29879 - RNA, 23 nt, Homo sapiens
cuaccugcacuaugagcacuuug

SEQ ID NO: 29880 - RNA, 22 nt, Homo sapiens
agucuucacaacagcccugugu

SEQ ID NO: 29881 - RNA, 22 nt, Homo sapiens
agcugaguguaggauguuuaca

SEQ ID NO: 29882 - RNA, 23 nt, Homo sapiens
aagaaucuugucccgcagguccu

SEQ ID NO: 29883 - RNA, 22 nt, Homo sapiens
aggaaaccagcaaguguugacg

SEQ ID NO: 29884 - RNA, 22 nt, Homo sapiens
cacucuaaagggaggcacuuug

SEQ ID NO: 29885 - RNA, 24 nt, Homo sapiens
acacucuaaagggaagcacuuugu

SEQ ID NO: 29886 - RNA, 22 nt, Homo sapiens
acucuaaagggaagcacuuugu

SEQ ID NO: 29887 - RNA, 23 nt, Homo sapiens
acagaaagugcuucccucaagag

SEQ ID NO: 29888 - RNA, 22 nt, Homo sapiens
ugcaagccuugggugugggagg

SEQ ID NO: 29889 - RNA, 21 nt, Homo sapiens
guaaugggaccuuccucuuug

SEQ ID NO: 29890 - RNA, 25 nt, Homo sapiens
aaggagcucagaagcccugcccagc

SEQ ID NO: 29891 - RNA, 21 nt, Homo sapiens
guccugagagcgcugccuccu

SEQ ID NO: 29892 - RNA, 21 nt, Homo sapiens
cugcugggccacaacguggga

SEQ ID NO: 29893 - RNA, 23 nt, Homo sapiens
cuaccugcacgaacagcacuuug

SEQ ID NO: 29894 - RNA, 23 nt, Homo sapiens
aggaacagcagcagcccgggccg

SEQ ID NO: 29895 - RNA, 21 nt, Homo sapiens
gaccaaucgccguccccgccg

SEQ ID NO: 29896 - RNA, 21 nt, Homo sapiens
acaggauugagggggggcccu

SEQ ID NO: 29897 - RNA, 20 nt, Homo sapiens
cuggaggaagggcccagagg

SEQ ID NO: 29898 - RNA, 22 nt, Homo sapiens
gccuaagacacaggcccagaga

SEQ ID NO: 29899 - RNA, 21 nt, Homo sapiens
cacucugaagggaagcgcuuu

SEQ ID NO: 29900 - RNA, 22 nt, Homo sapiens
gccaccuucaaaugggaagucu

SEQ ID NO: 29901 - RNA, 21 nt, Homo sapiens
ggacuauagaacuuucccccu

SEQ ID NO: 29902 - RNA, 22 nt, Homo sapiens
gcggucccgcggcgccccgccu

SEQ ID NO: 29903 - RNA, 22 nt, Homo sapiens
ugcuguuagcccuagccccgca

SEQ ID NO: 29904 - RNA, 21 nt, Homo sapiens
caucaccuuccuucuccucca

SEQ ID NO: 29905 - RNA, 20 nt, Homo sapiens
cucaaagcaaacccugcaga

SEQ ID NO: 29906 - RNA, 18 nt, Homo sapiens
ugguggcagaggugggau

SEQ ID NO: 29907 - RNA, 22 nt, Homo sapiens
gacucgaaccacugauccagca

SEQ ID NO: 29908 - RNA, 22 nt, Homo sapiens
acugccugucugugccugcugu

SEQ ID NO: 29909 - RNA, 21 nt, Homo sapiens
ggaaaucccuggcaaugugau

SEQ ID NO: 29910 - RNA, 21 nt, Homo sapiens
gguaaucccuggcaaugugau

SEQ ID NO: 29911 - RNA, 22 nt, Homo sapiens
gcgaacgcgccacggaccaccu

SEQ ID NO: 29912 - RNA, 23 nt, Homo sapiens
aaaucagaaucacaccuggggga

SEQ ID NO: 29913 - RNA, 22 nt, Homo sapiens
accagguuccaccccagcaggc

SEQ ID NO: 29914 - RNA, 23 nt, Homo sapiens
ccacccaaugaccuacuccaaga

SEQ ID NO: 29915 - RNA, 23 nt, Homo sapiens
ccacccaaugaccuacuccaaga

SEQ ID NO: 29916 - RNA, 25 nt, Homo sapiens
acggagcugucccaacaccaccccu

SEQ ID NO: 29917 - RNA, 24 nt, Homo sapiens
acgcagagcccgaaagcccccagu

SEQ ID NO: 29918 - RNA, 22 nt, Homo sapiens
augcccuuuuaacauugcacug

SEQ ID NO: 29919 - RNA, 22 nt, Homo sapiens
augcccuuucaucauugcacug

SEQ ID NO: 29920 - RNA, 24 nt, Homo sapiens
gaaagugcauagaauucugucugg

SEQ ID NO: 29921 - RNA, 22 nt, Homo sapiens
cacucagcggccguuuccccaa

SEQ ID NO: 29922 - RNA, 22 nt, Homo sapiens
cucaauagacugugagcuccuu

SEQ ID NO: 29923 - RNA, 23 nt, Homo sapiens
gcuuugacaauacuauugcacug

SEQ ID NO: 29924 - RNA, 23 nt, Homo sapiens
gcuuugacaauaucauugcacug

SEQ ID NO: 29925 - RNA, 23 nt, Homo sapiens
acgggugcgauuucugugugaga

SEQ ID NO: 29926 - RNA, 22 nt, Homo sapiens
acaaaaguugccuuugugugau

SEQ ID NO: 29927 - RNA, 21 nt, Homo sapiens
ccuucugacuccaaguccagu

SEQ ID NO: 29928 - RNA, 23 nt, Homo sapiens
acccuauaagcaauauugcacua

SEQ ID NO: 29929 - RNA, 21 nt, Homo sapiens
aagacgggaggagaggaguga

SEQ ID NO: 29930 - RNA, 22 nt, Homo sapiens
ccucauggaaggguuccccacu

SEQ ID NO: 29931 - RNA, 22 nt, Homo sapiens
acacucuaaaaggaugcacuuu

SEQ ID NO: 29932 - RNA, 22 nt, Homo sapiens
aaccucuaaaaggaugcacuuu

SEQ ID NO: 29933 - RNA, 22 nt, Homo sapiens
auccucuaaaaagaugcacuuu

SEQ ID NO: 29934 - RNA, 19 nt, Homo sapiens
auuuugguacagcagcuca

SEQ ID NO: 29935 - RNA, 19 nt, Homo sapiens
guccugaauuccgcagccu

SEQ ID NO: 29936 - RNA, 19 nt, Homo sapiens
aagacauuuucagacagcu

SEQ ID NO: 29937 - RNA, 19 nt, Homo sapiens
ucccacaggaagcagacac

SEQ ID NO: 29938 - RNA, 19 nt, Homo sapiens
gccucagaggcagcugcuu

SEQ ID NO: 29939 - RNA, 23 nt, Homo sapiens
cccagcuagauuguaagcuccuu

SEQ ID NO: 29940 - RNA, 20 nt, Homo sapiens
cucaaagcaaacccugcaga

SEQ ID NO: 29941 - RNA, 17 nt, Homo sapiens
gggagaggaggaggcga

SEQ ID NO: 29942 - RNA, 23 nt, Homo sapiens
cuaccugcacuguaagcacuuug

SEQ ID NO: 29943 - RNA, 22 nt, Homo sapiens
cggugagcacccggccccugcg

SEQ ID NO: 29944 - RNA, 22 nt, Homo sapiens
uccacauggaguugcuguuaca

SEQ ID NO: 29945 - RNA, 22 nt, Homo sapiens
cuguuccugcugaacugagcca

SEQ ID NO: 29946 - RNA, 23 nt, Homo sapiens
aaaucagaaucacaccuggggga

SEQ ID NO: 29947 - RNA, 22 nt, Homo sapiens
caugauugccacgucugcagua

SEQ ID NO: 29948 - RNA, 21 nt, Homo sapiens
ugauugccacugucugcagua

SEQ ID NO: 29949 - RNA, 19 nt, Homo sapiens
guccugaauuccgcagccu

SEQ ID NO: 29950 - RNA, 24 nt, Homo sapiens
acgcagagcccgaaagcccccagu

SEQ ID NO: 29951 - RNA, 21 nt, Homo sapiens
cacaacccuaguggcgccauu

SEQ ID NO: 29952 - RNA, 20 nt, Homo sapiens
aggggccucagccuccuggu

SEQ ID NO: 29953 - RNA, 17 nt, Homo sapiens
gggagaggaggaggcga

SEQ ID NO: 29954 - RNA, 21 nt, Homo sapiens
gaccaaucgccguccccgccg

SEQ ID NO: 29955 - RNA, 22 nt, Homo sapiens
ucagaccgagacaagugcaaug

SEQ ID NO: 29956 - RNA, 22 nt, Homo sapiens
caacaaaaucacugaugcugga

SEQ ID NO: 29957 - RNA, 21 nt, Homo sapiens
acuccaaagggaagcgccuuc

SEQ ID NO: 29958 - RNA, 22 nt, Homo sapiens
cgcucuaaagggaagcgccuuc

SEQ ID NO: 29959 - RNA, 19 nt, Homo sapiens
guugggaucacaggcgccc

SEQ ID NO: 29960 - RNA, 21 nt, Homo sapiens
cccgaggagccgggcaggcuu

SEQ ID NO: 29961 - RNA, 25 nt, Homo sapiens
accaacggaccuacuucccuccgcc

SEQ ID NO: 29962 - RNA, 22 nt, Homo sapiens
gcggucccgcggcgccccgccu

SEQ ID NO: 29963 - RNA, 22 nt, Homo sapiens
ccucaggcacggccgggccacc

SEQ ID NO: 29964 - RNA, 22 nt, Homo sapiens
ugcuguuagcccuagccccgca

SEQ ID NO: 29965 - RNA, 23 nt, Homo sapiens
gaacagguagucugaacacuggg

SEQ ID NO: 29966 - RNA, 23 nt, Homo sapiens
gaacagauagucuaaacacuggg

SEQ ID NO: 29967 - RNA, 22 nt, Homo sapiens
ucagaccgagacaagugcaaug

SEQ ID NO: 29968 - RNA, 22 nt, Homo sapiens
uacagauggauaccgugcaauu

SEQ ID NO: 29969 - RNA, 22 nt, Homo sapiens
auaaggauuuuuaggggcauua

SEQ ID NO: 29970 - RNA, 22 nt, Homo sapiens
cagcauggaguccuccagguug

SEQ ID NO: 29971 - RNA, 22 nt, Homo sapiens
acaaaagcaacugagguucuug

SEQ ID NO: 29972 - RNA, 19 nt, Homo sapiens
gcuccuguccaacuggcuc

SEQ ID NO: 29973 - RNA, 24 nt, Homo sapiens
acugggcacaaacauguccagguc

SEQ ID NO: 29974 - RNA, 21 nt, Homo sapiens
gaaggaagugagugcagccac

SEQ ID NO: 29975 - RNA, 22 nt, Homo sapiens
ucuacccagaaaggagccagug

SEQ ID NO: 29976 - RNA, 23 nt, Homo sapiens
cacaaauucgguucuacagggua

SEQ ID NO: 29977 - RNA, 21 nt, Homo sapiens
ggucagaacccaucauucacu

SEQ ID NO: 29978 - RNA, 20 nt, Homo sapiens
ugucuccacagggcucuuua

SEQ ID NO: 29979 - RNA, 22 nt, Homo sapiens
augcccuuucaucauugcacug

SEQ ID NO: 29980 - RNA, 23 nt, Homo sapiens
acucaccgacagcguugaauguu

SEQ ID NO: 29981 - RNA, 23 nt, Homo sapiens
acccaccgacagcaaugaauguu

SEQ ID NO: 29982 - RNA, 22 nt, Homo sapiens
acucaccgacagguugaauguu

SEQ ID NO: 29983 - RNA, 23 nt, Homo sapiens
acccaccgacaacaaugaauguu

SEQ ID NO: 29984 - RNA, 22 nt, Homo sapiens
cggugagcacccggccccugcg

SEQ ID NO: 29985 - RNA, 22 nt, Homo sapiens
acugccugucugugccugcugu

SEQ ID NO: 29986 - RNA, 22 nt, Homo sapiens
ucaccauugcuaaagugcaauu

SEQ ID NO: 29987 - RNA, 22 nt, Homo sapiens
accagguuccaccccagcaggc

SEQ ID NO: 29988 - RNA, 21 nt, Homo sapiens
guaaugggaccuuccucuuug

SEQ ID NO: 29989 - RNA, 22 nt, Homo sapiens
caagacacauuuggagagggac

SEQ ID NO: 29990 - RNA, 19 nt, Homo sapiens
cagcaucagcagcaucauc

SEQ ID NO: 29991 - RNA, 22 nt, Homo sapiens
agaaaaugccccucaguuuuga

SEQ ID NO: 29992 - RNA, 23 nt, Homo sapiens
ucaguuuugcauagauuugcaca

SEQ ID NO: 29993 - RNA, 22 nt, Homo sapiens
cacucagcaccaggauauuguu

SEQ ID NO: 29994 - RNA, 22 nt, Homo sapiens
aacuaugcaaccuacuaccucu

SEQ ID NO: 29995 - RNA, 22 nt, Homo sapiens
cacucagcggccguuuccccaa

SEQ ID NO: 29996 - RNA, 23 nt, Homo sapiens
ugcgaacucaccacggacaaccu

SEQ ID NO: 29997 - RNA, 22 nt, Homo sapiens
cuacccacagacguaccaauca

SEQ ID NO: 29998 - RNA, 22 nt, Homo sapiens
gacaaaacccgcaaauacuuuu

SEQ ID NO: 29999 - RNA, 22 nt, Homo sapiens
gcaaaaguaacugcaguuuugg

SEQ ID NO: 30000 - RNA, 23 nt, Homo sapiens
cuccagccccuccagggcuuccu

SEQ ID NO: 30001 - RNA, 23 nt, Homo sapiens
uggcccugacacgugguacugga

SEQ ID NO: 30002 - RNA, 21 nt, Homo sapiens
aucugcacugucagcacuuua

SEQ ID NO: 30003 - RNA, 26 nt, Homo sapiens
aaccaucucauacaaaccaacuacuu

SEQ ID NO: 30004 - RNA, 22 nt, Homo sapiens
agcuagugagaagucaaugccu

SEQ ID NO: 30005 - RNA, 22 nt, Homo sapiens
agacaacaaugccaaccucaca

SEQ ID NO: 30006 - RNA, 22 nt, Homo sapiens
ccccucuggucaaccagucaca

SEQ ID NO: 30007 - RNA, 21 nt, Homo sapiens
aguagugcuuucuacuuuaug

SEQ ID NO: 30008 - RNA, 23 nt, Homo sapiens
gggagugaagacacggagccaga

SEQ ID NO: 30009 - RNA, 21 nt, Homo sapiens
gugacagagccaagcacaaau

SEQ ID NO: 30010 - RNA, 21 nt, Homo sapiens
gcggaacuuagccacugugaa

SEQ ID NO: 30011 - RNA, 21 nt, Homo sapiens
gcagaacuuagccacugugaa

SEQ ID NO: 30012 - RNA, 22 nt, Homo sapiens
auaaggauuuuuaggggcauua

SEQ ID NO: 30013 - RNA, 23 nt, Homo sapiens
aaagucucgcucucugccccuca

SEQ ID NO: 30014 - RNA, 22 nt, Homo sapiens
aggaaaccagcaaguguugacg

SEQ ID NO: 30015 - RNA, 22 nt, Homo sapiens
acacucuaaagggaagugcguu

SEQ ID NO: 30016 - RNA, 22 nt, Homo sapiens
acuucaaggaucuuaaacuuug

SEQ ID NO: 30017 - RNA, 20 nt, Homo sapiens
aggggccucagccuccuggu

SEQ ID NO: 30018 - RNA, 23 nt, Homo sapiens
acaaggaugaaucuuuguuacug

SEQ ID NO: 30019 - RNA, 25 nt, Homo sapiens
gaauccugguucugucccucacuag

SEQ ID NO: 30020 - RNA, 22 nt, Homo sapiens
cugggggcggcacaggggcuca

SEQ ID NO: 30021 - RNA, 20 nt, Homo sapiens
aagcagaaaaaggcaaacga

SEQ ID NO: 30022 - RNA, 20 nt, Homo sapiens
uucccaugcccuauaccucu

SEQ ID NO: 30023 - RNA, 22 nt, Homo sapiens
agcugaguguaggauguuuaca

SEQ ID NO: 30024 - RNA, 21 nt, Homo sapiens
ccuucugacuccaaguccagu

SEQ ID NO: 30025 - RNA, 21 nt, Homo sapiens
cucacucagauggccaacuca

SEQ ID NO: 30026 - RNA, 19 nt, Homo sapiens
aagacauuuucagacagcu

SEQ ID NO: 30027 - RNA, 20 nt, Homo sapiens
uccccacagacccagagccg

SEQ ID NO: 30028 - RNA, 22 nt, Homo sapiens
caccugauaaaacugagguaua

SEQ ID NO: 30029 - RNA, 20 nt, Homo sapiens
ggcauucaccgcgugccuua

SEQ ID NO: 30030 - RNA, 23 nt, Homo sapiens
gggagugaagacacggagccaga

SEQ ID NO: 30031 - RNA, 22 nt, Homo sapiens
cggugagcacccggccccugcg

SEQ ID NO: 30032 - RNA, 23 nt, Homo sapiens
gaacagguagucugaacacuggg

SEQ ID NO: 30033 - RNA, 23 nt, Homo sapiens
gaacagauagucuaaacacuggg

SEQ ID NO: 30034 - RNA, 22 nt, Homo sapiens
accagcuaacaauacacugcca

SEQ ID NO: 30035 - RNA, 23 nt, Homo sapiens
aaagucucgcucucugccccuca

SEQ ID NO: 30036 - RNA, 22 nt, Homo sapiens
ccucauggaaggguuccccacu

SEQ ID NO: 30037 - RNA, 21 nt, Homo sapiens
ucuacucagaagggugccuua

SEQ ID NO: 30038 - RNA, 22 nt, Homo sapiens
acacucuaaaaggaugcacuuu

SEQ ID NO: 30039 - RNA, 22 nt, Homo sapiens
aaccucuaaaaggaugcacuuu

SEQ ID NO: 30040 - RNA, 22 nt, Homo sapiens
auccucuaaaaagaugcacuuu

SEQ ID NO: 30041 - RNA, 24 nt, Homo sapiens
cugaucaguuacacaucacuucag

SEQ ID NO: 30042 - RNA, 25 nt, Homo sapiens
acggagcugucccaacaccaccccu

SEQ ID NO: 30043 - RNA, 19 nt, Homo sapiens
accagugcccugcacacuu

SEQ ID NO: 30044 - RNA, 23 nt, Homo sapiens
cacugugggcccucuccgcacca

SEQ ID NO: 30045 - RNA, 20 nt, Homo sapiens
uacugcuuccacagcucccc

SEQ ID NO: 30046 - RNA, 23 nt, Homo sapiens
cacaaauucggaucuacagggua

SEQ ID NO: 30047 - RNA, 23 nt, Homo sapiens
cacaaauucgguucuacagggua

SEQ ID NO: 30048 - RNA, 20 nt, Homo sapiens
gcagcuguccgcccagacac

SEQ ID NO: 30049 - RNA, 17 nt, Homo sapiens
uggcgcccgaacaggga

SEQ ID NO: 30050 - RNA, 23 nt, Homo sapiens
gggagugaagacacggagccaga

SEQ ID NO: 30051 - RNA, 22 nt, Homo sapiens
uagucaagugaagcagugggag

SEQ ID NO: 30052 - RNA, 22 nt, Homo sapiens
cuuccagucgaggauguuuaca

SEQ ID NO: 30053 - RNA, 22 nt, Homo sapiens
agcugaguguaggauguuuaca

SEQ ID NO: 30054 - RNA, 22 nt, Homo sapiens
cuuccagucggggauguuuaca

SEQ ID NO: 30055 - RNA, 22 nt, Homo sapiens
cuuccagucaaggauguuuaca

SEQ ID NO: 30056 - RNA, 21 nt, Homo sapiens
aagacgggaggagaggaguga

SEQ ID NO: 30057 - RNA, 22 nt, Homo sapiens
ucucacccagggacaaaggauu

SEQ ID NO: 30058 - RNA, 22 nt, Homo sapiens
aaagugcuucuuaccuccagau

SEQ ID NO: 30059 - RNA, 22 nt, Homo sapiens
acacucuaaagggaagugcguu

SEQ ID NO: 30060 - RNA, 22 nt, Homo sapiens
cucauauuacaaugagcucauc

SEQ ID NO: 30061 - RNA, 22 nt, Homo sapiens
aaggugauggucagcagacaua

SEQ ID NO: 30062 - RNA, 21 nt, Homo sapiens
gagcuacagugcuucaucuca

SEQ ID NO: 30063 - RNA, 23 nt, Homo sapiens
cuaucugcacuagaugcaccuua

SEQ ID NO: 30064 - RNA, 23 nt, Homo sapiens
cuaacugcacuagaugcaccuua

SEQ ID NO: 30065 - RNA, 23 nt, Homo sapiens
cagcugcuuuugggauuccguug

SEQ ID NO: 30066 - RNA, 22 nt, Homo sapiens
uccacauggaguugcuguuaca

SEQ ID NO: 30067 - RNA, 22 nt, Homo sapiens
uagucaagugaagcagugggag

SEQ ID NO: 30068 - RNA, 21 nt, Homo sapiens
acaugguuagaucaagcacaa

SEQ ID NO: 30069 - RNA, 24 nt, Homo sapiens
ugggagaaccucccugcuucugcu

SEQ ID NO: 30070 - RNA, 22 nt, Homo sapiens
agcugaguguaggauguuuaca

SEQ ID NO: 30071 - RNA, 23 nt, Homo sapiens
acaccaaugcccuaggggaugcg

SEQ ID NO: 30072 - RNA, 22 nt, Homo sapiens
acggaagggcagagagggccag

SEQ ID NO: 30073 - RNA, 22 nt, Homo sapiens
uacagauggauaccgugcaauu

SEQ ID NO: 30074 - RNA, 22 nt, Homo sapiens
ugcaagccuugggugugggagg

SEQ ID NO: 30075 - RNA, 22 nt, Homo sapiens
gaacuugcuaaaaaugcagaau

SEQ ID NO: 30076 - RNA, 24 nt, Homo sapiens
acgcgcaggccagagacccaggca

SEQ ID NO: 30077 - RNA, 23 nt, Homo sapiens
aauaaauuaaauuuauauuacag

SEQ ID NO: 30078 - RNA, 23 nt, Homo sapiens
acauuuuucguuauugcucuuga

SEQ ID NO: 30079 - RNA, 22 nt, Homo sapiens
ccuggcacacaguagaccuuca

SEQ ID NO: 30080 - RNA, 21 nt, Homo sapiens
acaaaccacagugugcugcug

SEQ ID NO: 30081 - RNA, 21 nt, Homo sapiens
uggggauuacacuucaacagg

SEQ ID NO: 30082 - RNA, 22 nt, Homo sapiens
aacccauggaauucaguucuca

SEQ ID NO: 30083 - RNA, 21 nt, Homo sapiens
gugacagagccaagcacaaau

SEQ ID NO: 30084 - RNA, 22 nt, Homo sapiens
ucacaguugccagcugagauua

SEQ ID NO: 30085 - RNA, 22 nt, Homo sapiens
acaaaaguugccuuugugugau

SEQ ID NO: 30086 - RNA, 23 nt, Homo sapiens
gcgcccaauuaaugucuguugau

SEQ ID NO: 30087 - RNA, 22 nt, Homo sapiens
gauagagugcagaccagggucu

SEQ ID NO: 30088 - RNA, 21 nt, Homo sapiens
agguaauaccaauaccuugug

SEQ ID NO: 30089 - RNA, 23 nt, Homo sapiens
ggacauuguuucagugcccaagu

SEQ ID NO: 30090 - RNA, 22 nt, Homo sapiens
cacauggccaaaacagagaaga

SEQ ID NO: 30091 - RNA, 21 nt, Homo sapiens
ccaaccaaugaaagaaugcuu

SEQ ID NO: 30092 - RNA, 23 nt, Homo sapiens
aacaggugcucaaauaagacuug

SEQ ID NO: 30093 - RNA, 23 nt, Homo sapiens
ucacauaggaauaaaaagccaua

SEQ ID NO: 30094 - RNA, 22 nt, Homo sapiens
aacccauggaauucaguucuca

SEQ ID NO: 30095 - RNA, 22 nt, Homo sapiens
cagcauggaguccuccagguug

SEQ ID NO: 30096 - RNA, 19 nt, Homo sapiens
agaaaccccagcagagaca

SEQ ID NO: 30097 - RNA, 20 nt, Homo sapiens
acaaugagaacccauggucu

SEQ ID NO: 30098 - RNA, 22 nt, Homo sapiens
caaacaccauugucacacucca

SEQ ID NO: 30099 - RNA, 23 nt, Homo sapiens
ucauacagcuagauaaccaaaga

SEQ ID NO: 30100 - RNA, 23 nt, Homo sapiens
aacaggugcucaaauaagacuug

SEQ ID NO: 30101 - RNA, 22 nt, Homo sapiens
gaucacuuuugugacuaugcaa

SEQ ID NO: 30102 - RNA, 22 nt, Homo sapiens
auaaggauuuuuaggggcauua

SEQ ID NO: 30103 - RNA, 22 nt, Homo sapiens
gguaaaacucgcaauuacuuuu

SEQ ID NO: 30104 - RNA, 22 nt, Homo sapiens
ggccaaaaccacaauuacuuuu

SEQ ID NO: 30105 - RNA, 22 nt, Homo sapiens
ggcaaaaaccgcaauuacuuuu

SEQ ID NO: 30106 - RNA, 22 nt, Homo sapiens
ggcaaaaaccacaauuacuuuu

SEQ ID NO: 30107 - RNA, 22 nt, Homo sapiens
gacaaaaaccgcgauuacuuuu

SEQ ID NO: 30108 - RNA, 22 nt, Homo sapiens
ggcaaaauccgcaauuacuuuu

SEQ ID NO: 30109 - RNA, 22 nt, Homo sapiens
accaaagaccgcaauuacuuuu

SEQ ID NO: 30110 - RNA, 21 nt, Homo sapiens
uuuuggugcauauuuacuuua

SEQ ID NO: 30111 - RNA, 23 nt, Homo sapiens
guucuguccuggaagaacauacu

SEQ ID NO: 30112 - RNA, 22 nt, Homo sapiens
gaucacuuuugugacuaugcaa

SEQ ID NO: 30113 - RNA, 23 nt, Homo sapiens
uauucucgcacggacuacaacca

SEQ ID NO: 30114 - RNA, 23 nt, Homo sapiens
guucuguccuggaagaacauacu

SEQ ID NO: 30115 - RNA, 23 nt, Homo sapiens
aacaggugcucaaauaagacuug

SEQ ID NO: 30116 - RNA, 23 nt, Homo sapiens
acacagcucuuccauaucuccag

SEQ ID NO: 30117 - RNA, 23 nt, Homo sapiens
cuacgcguauucuuaagcaauaa

SEQ ID NO: 30118 - RNA, 22 nt, Homo sapiens
gaucacuuuugugacuaugcaa

SEQ ID NO: 30119 - RNA, 22 nt, Homo sapiens
ucaguuuccucugcaaacaguu

SEQ ID NO: 30120 - RNA, 21 nt, Homo sapiens
gccaauauuucugugcugcua

SEQ ID NO: 30121 - RNA, 22 nt, Homo sapiens
uauucaggaacauauugcaaaa

SEQ ID NO: 30122 - RNA, 20 nt, Homo sapiens
auuucuauaucuaucuccau

SEQ ID NO: 30123 - RNA, 19 nt, Homo sapiens
ucagcaguaccagccuaga

SEQ ID NO: 30124 - RNA, 23 nt, Homo sapiens
aacaggugcucaaauaagacuug

SEQ ID NO: 30125 - RNA, 22 nt, Homo sapiens
ucagccgcugucacacgcacag

SEQ ID NO: 30126 - RNA, 22 nt, Homo sapiens
auaaggauuuuuaggggcauua

SEQ ID NO: 30127 - RNA, 22 nt, Homo sapiens
gguaaaacucgcaauuacuuuu

SEQ ID NO: 30128 - RNA, 22 nt, Homo sapiens
ggccaaaaccacaauuacuuuu

SEQ ID NO: 30129 - RNA, 22 nt, Homo sapiens
ggcaaaaaccgcaauuacuuuu

SEQ ID NO: 30130 - RNA, 22 nt, Homo sapiens
ggcaaaaaccacaauuacuuuu

SEQ ID NO: 30131 - RNA, 22 nt, Homo sapiens
gacaaaaaccgcgauuacuuuu

SEQ ID NO: 30132 - RNA, 22 nt, Homo sapiens
ggcaaaauccgcaauuacuuuu

SEQ ID NO: 30133 - RNA, 22 nt, Homo sapiens
accaaagaccgcaauuacuuuu

SEQ ID NO: 30134 - RNA, 21 nt, Homo sapiens
uuuuggugcauauuuacuuua

SEQ ID NO: 30135 - RNA, 23 nt, Homo sapiens
guucuguccuggaagaacauacu

SEQ ID NO: 30136 - RNA, 27 nt, Homo sapiens
uuuagcacagugcuuauacaagaaggu

SEQ ID NO: 30137 - RNA, 22 nt, Homo sapiens
ucccucacacagaauuccagaa

SEQ ID NO: 30138 - RNA, 21 nt, Homo sapiens
ccgugguucuacccuguggua

SEQ ID NO: 30139 - RNA, 22 nt, Homo sapiens
aaucagucucauugcuuuauaa

SEQ ID NO: 30140 - RNA, 22 nt, Homo sapiens
gcacacaauaaauguuugcuga

SEQ ID NO: 30141 - RNA, 22 nt, Homo sapiens
gccaccuucaaaugggaagucu

SEQ ID NO: 30142 - RNA, 23 nt, Homo sapiens
acccaacagccccugcaagggau

SEQ ID NO: 30143 - RNA, 22 nt, Homo sapiens
gcuggguggagaagguggugaa

SEQ ID NO: 30144 - RNA, 22 nt, Homo sapiens
acaguucuucaacuggcagcuu

SEQ ID NO: 30145 - RNA, 22 nt, Homo sapiens
agccacaaucaccuucugaucu

SEQ ID NO: 30146 - RNA, 22 nt, Homo sapiens
ucgcccucucaacccagcuuuu

SEQ ID NO: 30147 - RNA, 22 nt, Homo sapiens
uugcccucucaacccagcuuuu

SEQ ID NO: 30148 - RNA, 20 nt, Homo sapiens
acccucucaacccagcuuuu

SEQ ID NO: 30149 - RNA, 19 nt, Homo sapiens
uccucucaacccagcuuuu

SEQ ID NO: 30150 - RNA, 20 nt, Homo sapiens
gcaaugcaacagcaaugcac

SEQ ID NO: 30151 - RNA, 22 nt, Homo sapiens
aacgcuccaaaagaaggcacuc

SEQ ID NO: 30152 - RNA, 22 nt, Homo sapiens
aacacucuaaaaggaggcacuu

SEQ ID NO: 30153 - RNA, 23 nt, Homo sapiens
gggcucuuacucccucaggcacu

SEQ ID NO: 30154 - RNA, 22 nt, Homo sapiens
gauuccaauuuuuccacaucuu

SEQ ID NO: 30155 - RNA, 19 nt, Homo sapiens
agaaaccccagcagagaca

SEQ ID NO: 30156 - RNA, 23 nt, Homo sapiens
ggacauuguuucagugcccaagu

SEQ ID NO: 30157 - RNA, 21 nt, Homo sapiens
cugggggacggagcagaagga

SEQ ID NO: 30158 - RNA, 21 nt, Homo sapiens
ccgugguucuacccuguggua

SEQ ID NO: 30159 - RNA, 22 nt, Homo sapiens
uccacauggaguugcuguuaca

SEQ ID NO: 30160 - RNA, 23 nt, Homo sapiens
gaaacccagcagacaauguagcu

SEQ ID NO: 30161 - RNA, 21 nt, Homo sapiens
acccaguagccagauguagcu

SEQ ID NO: 30162 - RNA, 21 nt, Homo sapiens
ccccucccagccucccugcca

SEQ ID NO: 30163 - RNA, 22 nt, Homo sapiens
agcuagugagaagucaaugccu

SEQ ID NO: 30164 - RNA, 18 nt, Homo sapiens
cccccaccaccacgcccg

SEQ ID NO: 30165 - RNA, 19 nt, Homo sapiens
cagcaucagcagcaucauc

SEQ ID NO: 30166 - RNA, 22 nt, Homo sapiens
cggugagcacccggccccugcg

SEQ ID NO: 30167 - RNA, 25 nt, Homo sapiens
agcuagucaagcgcgguuguggggg

SEQ ID NO: 30168 - RNA, 22 nt, Homo sapiens
uagucaagugaagcagugggag

SEQ ID NO: 30169 - RNA, 21 nt, Homo sapiens
aucugcacugucagcacuuua

SEQ ID NO: 30170 - RNA, 23 nt, Homo sapiens
gcuuugacaauaucauugcacug

SEQ ID NO: 30171 - RNA, 22 nt, Homo sapiens
aaggugauggucagcagacaua

SEQ ID NO: 30172 - RNA, 22 nt, Homo sapiens
agcucagaacccagaggucuca

SEQ ID NO: 30173 - RNA, 23 nt, Homo sapiens
cuaucugcacuagaugcaccuua

SEQ ID NO: 30174 - RNA, 21 nt, Homo sapiens
gaccaaucgccguccccgccg

SEQ ID NO: 30175 - RNA, 22 nt, Homo sapiens
cacucagcggccguuuccccaa

SEQ ID NO: 30176 - RNA, 23 nt, Homo sapiens
acugaggggccucagaccgagcu

SEQ ID NO: 30177 - RNA, 19 nt, Homo sapiens
guccugaauuccgcagccu

SEQ ID NO: 30178 - RNA, 22 nt, Homo sapiens
gcggucccgcggcgccccgccu

SEQ ID NO: 30179 - RNA, 22 nt, Homo sapiens
ugcuguuagcccuagccccgca

SEQ ID NO: 30180 - RNA, 22 nt, Homo sapiens
ucggucccucgggccagggcag

SEQ ID NO: 30181 - RNA, 22 nt, Homo sapiens
uauccacuacaccccgcugccu

SEQ ID NO: 30182 - RNA, 24 nt, Homo sapiens
acugcaggcuccagcuuccaggcu

SEQ ID NO: 30183 - RNA, 21 nt, Homo sapiens
acaggauugagggggggcccu

SEQ ID NO: 30184 - RNA, 20 nt, Homo sapiens
uacugcuuccacagcucccc

SEQ ID NO: 30185 - RNA, 20 nt, Homo sapiens
uacugcuuccacagcucccc

SEQ ID NO: 30186 - RNA, 24 nt, Homo sapiens
cacccccagagccucagcucccca

SEQ ID NO: 30187 - RNA, 22 nt, Homo sapiens
cacgaccgacgccacgccgagu

SEQ ID NO: 30188 - RNA, 22 nt, Homo sapiens
ggagcccgcgccccgcgccgag

SEQ ID NO: 30189 - RNA, 21 nt, Homo sapiens
cggggugcacgggcggagggc

SEQ ID NO: 30190 - RNA, 22 nt, Homo sapiens
uggcagcagcggagggggcaga

SEQ ID NO: 30191 - RNA, 22 nt, Homo sapiens
ucagaccgagacaagugcaaug

SEQ ID NO: 30192 - RNA, 20 nt, Homo sapiens
ccagcagcaccuggggcagu

SEQ ID NO: 30193 - RNA, 21 nt, Homo sapiens
uucuaggauaggcccaggggc

SEQ ID NO: 30194 - RNA, 21 nt, Homo sapiens
auccuguacugagcugccccg

SEQ ID NO: 30195 - RNA, 23 nt, Homo sapiens
acacacucacacacacacacuca

SEQ ID NO: 30196 - RNA, 23 nt, Homo sapiens
ggacauuguuucagugcccaagu

SEQ ID NO: 30197 - RNA, 19 nt, Homo sapiens
accagugcccugcacacuu

SEQ ID NO: 30198 - RNA, 25 nt, Homo sapiens
accaacggaccuacuucccuccgcc

SEQ ID NO: 30199 - RNA, 21 nt, Homo sapiens
gagcugcauccuggcuccggg

SEQ ID NO: 30200 - RNA, 18 nt, Homo sapiens
aucacauucaccucccug

SEQ ID NO: 30201 - RNA, 23 nt, Homo sapiens
gggagugaagacacggagccaga

SEQ ID NO: 30202 - RNA, 21 nt, Homo sapiens
gggcaucugggacgcgcagga

SEQ ID NO: 30203 - RNA, 21 nt, Homo sapiens
gaccaaucgccguccccgccg

SEQ ID NO: 30204 - RNA, 23 nt, Homo sapiens
cccaacagacauggcgguacuca

SEQ ID NO: 30205 - RNA, 20 nt, Homo sapiens
acagcaaggagggcaggagg

SEQ ID NO: 30206 - RNA, 23 nt, Homo sapiens
gggcucuuacucccucaggcacu

SEQ ID NO: 30207 - RNA, 19 nt, Homo sapiens
guccugaauuccgcagccu

SEQ ID NO: 30208 - RNA, 21 nt, Homo sapiens
aagggucaguaagcacccgcg

SEQ ID NO: 30209 - RNA, 21 nt, Homo sapiens
gagcugcauccuggcuccggg

SEQ ID NO: 30210 - RNA, 21 nt, Homo sapiens
ucacccagaucugcggccuaa

SEQ ID NO: 30211 - RNA, 20 nt, Homo sapiens
cccgccgcgucgcccugggg

SEQ ID NO: 30212 - RNA, 22 nt, Homo sapiens
gaauucaucacggccagccucu

SEQ ID NO: 30213 - RNA, 20 nt, Homo sapiens
gcaaaugguacagcuacuuu

SEQ ID NO: 30214 - RNA, 19 nt, Homo sapiens
guugggaucacaggcgccc

SEQ ID NO: 30215 - RNA, 19 nt, Homo sapiens
guccugaauuccgcagccu

SEQ ID NO: 30216 - RNA, 21 nt, Homo sapiens
caacugaugccuuuccaagua

SEQ ID NO: 30217 - RNA, 20 nt, Homo sapiens
uacugcuuccacagcucccc

SEQ ID NO: 30218 - RNA, 21 nt, Homo sapiens
cugaggagagaggaggugggg

SEQ ID NO: 30219 - RNA, 22 nt, Homo sapiens
cugggggcggcacaggggcuca

SEQ ID NO: 30220 - RNA, 20 nt, Homo sapiens
cugcgggaggacagggcuca

SEQ ID NO: 30221 - RNA, 24 nt, Homo sapiens
ucacagguuaaagggucucaggga

SEQ ID NO: 30222 - RNA, 22 nt, Homo sapiens
ucacaaguuagggucucaggga

SEQ ID NO: 30223 - RNA, 23 nt, Homo sapiens
agcccuguucuacagcccugagg

SEQ ID NO: 30224 - RNA, 21 nt, Homo sapiens
acuagacugugagcuccucga

SEQ ID NO: 30225 - RNA, 22 nt, Homo sapiens
aagagggagacccaggcucgga

SEQ ID NO: 30226 - RNA, 21 nt, Homo sapiens
caucaccuuccuucuccucca

SEQ ID NO: 30227 - RNA, 20 nt, Homo sapiens
uacugcuuccacagcucccc

SEQ ID NO: 30228 - RNA, 23 nt, Homo sapiens
ggaagccaucaagucgcugcagg

SEQ ID NO: 30229 - RNA, 20 nt, Homo sapiens
cucaaagcaaacccugcaga

SEQ ID NO: 30230 - RNA, 20 nt, Homo sapiens
gcagaagcauuuccacacac

SEQ ID NO: 30231 - RNA, 21 nt, Homo sapiens
gaccaaucgccguccccgccg

SEQ ID NO: 30232 - RNA, 23 nt, Homo sapiens
aggagaaggcaccaugggauuua

SEQ ID NO: 30233 - RNA, 22 nt, Homo sapiens
gccaccuucaaaugggaagucu

SEQ ID NO: 30234 - RNA, 22 nt, Homo sapiens
gcggucccgcggcgccccgccu

SEQ ID NO: 30235 - RNA, 22 nt, Homo sapiens
ccucaggcacggccgggccacc

SEQ ID NO: 30236 - RNA, 21 nt, Homo sapiens
ugcaggcugaucuucuucucu

SEQ ID NO: 30237 - RNA, 24 nt, Homo sapiens
ucacagguuaaagggucucaggga

SEQ ID NO: 30238 - RNA, 22 nt, Homo sapiens
ucacaaguuagggucucaggga

SEQ ID NO: 30239 - RNA, 23 nt, Homo sapiens
agcccuguucuacagcccugagg

SEQ ID NO: 30240 - RNA, 20 nt, Homo sapiens
cuggaggaagggcccagagg

SEQ ID NO: 30241 - RNA, 22 nt, Homo sapiens
gccuaagacacaggcccagaga

SEQ ID NO: 30242 - RNA, 22 nt, Homo sapiens
uacagauggauaccgugcaauu

SEQ ID NO: 30243 - RNA, 22 nt, Homo sapiens
cacauggccaaaacagagaaga

SEQ ID NO: 30244 - RNA, 18 nt, Homo sapiens
cccccaccaccacgcccg

SEQ ID NO: 30245 - RNA, 17 nt, Homo sapiens
gacagccucucccccac

SEQ ID NO: 30246 - RNA, 22 nt, Homo sapiens
acuccaacagggccgcgucucc

SEQ ID NO: 30247 - RNA, 20 nt, Homo sapiens
cccgccgcgucgcccugggg

SEQ ID NO: 30248 - RNA, 22 nt, Homo sapiens
ucagaccgagacaagugcaaug

SEQ ID NO: 30249 - RNA, 21 nt, Homo sapiens
uucuaggauaggcccaggggc

SEQ ID NO: 30250 - RNA, 23 nt, Homo sapiens
aaaucagaaucacaccuggggga

SEQ ID NO: 30251 - RNA, 22 nt, Homo sapiens
ucacgcgagccgaacgaacaaa

SEQ ID NO: 30252 - RNA, 23 nt, Homo sapiens
aaagucucgcucucugccccuca

SEQ ID NO: 30253 - RNA, 22 nt, Homo sapiens
aguccagauucugugcccacca

SEQ ID NO: 30254 - RNA, 24 nt, Homo sapiens
acgcagagcccgaaagcccccagu

SEQ ID NO: 30255 - RNA, 22 nt, Homo sapiens
gcacauguucugcggcccacca

SEQ ID NO: 30256 - RNA, 22 nt, Homo sapiens
agcucagaacccagaggucuca

SEQ ID NO: 30257 - RNA, 22 nt, Homo sapiens
ucuacccagaaaggagccagug

SEQ ID NO: 30258 - RNA, 21 nt, Homo sapiens
cucccccacugcagcuggcac

SEQ ID NO: 30259 - RNA, 21 nt, Homo sapiens
ccccucccagccucccugcca

SEQ ID NO: 30260 - RNA, 22 nt, Homo sapiens
cugggggcggcacaggggcuca

SEQ ID NO: 30261 - RNA, 17 nt, Homo sapiens
uggcgcccgaacaggga

SEQ ID NO: 30262 - RNA, 22 nt, Homo sapiens
ucccucacacagaauuccagaa

SEQ ID NO: 30263 - RNA, 22 nt, Homo sapiens
augcuuuuugggguaagggcuu

SEQ ID NO: 30264 - RNA, 18 nt, Homo sapiens
aucacauucaccucccug

SEQ ID NO: 30265 - RNA, 23 nt, Homo sapiens
cuaucugcacuagaugcaccuua

SEQ ID NO: 30266 - RNA, 22 nt, Homo sapiens
cggugagcacccggccccugcg

SEQ ID NO: 30267 - RNA, 22 nt, Homo sapiens
uucacacugcaugcucugggua

SEQ ID NO: 30268 - RNA, 20 nt, Homo sapiens
cccgccgcgucgcccugggg

SEQ ID NO: 30269 - RNA, 22 nt, Homo sapiens
acugccugucugugccugcugu

SEQ ID NO: 30270 - RNA, 22 nt, Homo sapiens
ucaccauugcuaaagugcaauu

SEQ ID NO: 30271 - RNA, 22 nt, Homo sapiens
accagguuccaccccagcaggc

SEQ ID NO: 30272 - RNA, 25 nt, Homo sapiens
acggagcugucccaacaccaccccu

SEQ ID NO: 30273 - RNA, 22 nt, Homo sapiens
ugcuguuagcccuagccccgca

SEQ ID NO: 30274 - RNA, 20 nt, Homo sapiens
uccccacagacccagagccg

SEQ ID NO: 30275 - RNA, 22 nt, Homo sapiens
ucggucccucgggccagggcag

SEQ ID NO: 30276 - RNA, 20 nt, Homo sapiens
uacugcuuccacagcucccc

SEQ ID NO: 30277 - RNA, 22 nt, Homo sapiens
acuggguucaccuuuaagggca

SEQ ID NO: 30278 - RNA, 24 nt, Homo sapiens
agugugaguucuaccauugccaaa

SEQ ID NO: 30279 - RNA, 21 nt, Homo sapiens
gaccaaucgccguccccgccg

SEQ ID NO: 30280 - RNA, 22 nt, Homo sapiens
cccaacaacaggaaacuaccua

SEQ ID NO: 30281 - RNA, 20 nt, Homo sapiens
uaugaacaauuucuaggaau

SEQ ID NO: 30282 - RNA, 21 nt, Homo sapiens
uggaaaccaagagugggucgc

SEQ ID NO: 30283 - RNA, 21 nt, Homo sapiens
cugaaaccaaguaugggucgc

SEQ ID NO: 30284 - RNA, 24 nt, Homo sapiens
acgcgcaggccagagacccaggca

SEQ ID NO: 30285 - RNA, 22 nt, Homo sapiens
gcggucccgcggcgccccgccu

SEQ ID NO: 30286 - RNA, 22 nt, Homo sapiens
ugcuguuagcccuagccccgca

SEQ ID NO: 30287 - RNA, 23 nt, Homo sapiens
ccgcuugagcuaacuccgacccg

SEQ ID NO: 30288 - RNA, 20 nt, Homo sapiens
aguacaucaucuauacugua

SEQ ID NO: 30289 - RNA, 23 nt, Homo sapiens
cuaccugcacuguaagcacuuug

SEQ ID NO: 30290 - RNA, 22 nt, Homo sapiens
uccacauggaguugcuguuaca

SEQ ID NO: 30291 - RNA, 22 nt, Homo sapiens
uagucaagugaagcagugggag

SEQ ID NO: 30292 - RNA, 21 nt, Homo sapiens
agaggucgaccguguaaugug

SEQ ID NO: 30293 - RNA, 22 nt, Homo sapiens
aagauguggaccauauuacaua

SEQ ID NO: 30294 - RNA, 22 nt, Homo sapiens
gccagcuaacaauacacugccu

SEQ ID NO: 30295 - RNA, 22 nt, Homo sapiens
caugauugccacgucugcagua

SEQ ID NO: 30296 - RNA, 21 nt, Homo sapiens
ugauugccacugucugcagua

SEQ ID NO: 30297 - RNA, 21 nt, Homo sapiens
ugacugcagagcaaaagacac

SEQ ID NO: 30298 - RNA, 24 nt, Homo sapiens
gaggugacucuauccuaugucuuu

SEQ ID NO: 30299 - RNA, 22 nt, Homo sapiens
cugggggcggcacaggggcuca

SEQ ID NO: 30300 - RNA, 26 nt, Homo sapiens
uuucagaauuugcugccaucaucauc

SEQ ID NO: 30301 - RNA, 22 nt, Homo sapiens
gcacaaaucuccagaccaccca

SEQ ID NO: 30302 - RNA, 22 nt, Homo sapiens
ucaggaacugccuuucucucca

SEQ ID NO: 30303 - RNA, 21 nt, Homo sapiens
aagugucagacacgguggugg

SEQ ID NO: 30304 - RNA, 20 nt, Homo sapiens
cuggaggaagggcccagagg

SEQ ID NO: 30305 - RNA, 22 nt, Homo sapiens
gccuaagacacaggcccagaga

SEQ ID NO: 30306 - RNA, 22 nt, Homo sapiens
acaccgaggagcccaucaugau

SEQ ID NO: 30307 - RNA, 18 nt, Homo sapiens
acccucugaaaggaagca

SEQ ID NO: 30308 - RNA, 22 nt, Homo sapiens
aaagugcuucuuaccuccagau

SEQ ID NO: 30309 - RNA, 19 nt, Homo sapiens
gccucagaggcagcugcuu

SEQ ID NO: 30310 - RNA, 22 nt, Homo sapiens
agcuagugagaagucaaugccu

SEQ ID NO: 30311 - RNA, 22 nt, Homo sapiens
agcccaaaaggagaauucuuug

SEQ ID NO: 30312 - RNA, 22 nt, Homo sapiens
uggcagcagcggagggggcaga

SEQ ID NO: 30313 - RNA, 22 nt, Homo sapiens
ucaacaucagucugauaagcua

SEQ ID NO: 30314 - RNA, 22 nt, Homo sapiens
cucaauagacugugagcuccuu

SEQ ID NO: 30315 - RNA, 20 nt, Homo sapiens
ccagcagcaccuggggcagu

SEQ ID NO: 30316 - RNA, 23 nt, Homo sapiens
ucucugcaggccgugugcuuugc

SEQ ID NO: 30317 - RNA, 22 nt, Homo sapiens
auaaggauuuuuaggggcauua

SEQ ID NO: 30318 - RNA, 21 nt, Homo sapiens
auccuguacugagcugccccg

SEQ ID NO: 30319 - RNA, 24 nt, Homo sapiens
acacucuaaagggaagcacuuugu

SEQ ID NO: 30320 - RNA, 22 nt, Homo sapiens
acucuaaagggaagcacuuugu

SEQ ID NO: 30321 - RNA, 21 nt, Homo sapiens
aucagagguucagcuuacccu

SEQ ID NO: 30322 - RNA, 19 nt, Homo sapiens
auuuugguacagcagcuca

SEQ ID NO: 30323 - RNA, 19 nt, Homo sapiens
gccucagaggcagcugcuu

SEQ ID NO: 30324 - RNA, 23 nt, Homo sapiens
cccagcuagauuguaagcuccuu

SEQ ID NO: 30325 - RNA, 22 nt, Homo sapiens
cacauggccaaaacagagaaga

SEQ ID NO: 30326 - RNA, 20 nt, Homo sapiens
cccgccgcgucgcccugggg

SEQ ID NO: 30327 - RNA, 22 nt, Homo sapiens
cacucagcggccguuuccccaa

SEQ ID NO: 30328 - RNA, 21 nt, Homo sapiens
gcggaacuuagccacugugaa

SEQ ID NO: 30329 - RNA, 21 nt, Homo sapiens
ucaaucacagauagcaccccu

SEQ ID NO: 30330 - RNA, 23 nt, Homo sapiens
cacugugggcccucuccgcacca

SEQ ID NO: 30331 - RNA, 21 nt, Homo sapiens
caucaccuuccuucuccucca

SEQ ID NO: 30332 - RNA, 22 nt, Homo sapiens
cugggggcggcacaggggcuca

SEQ ID NO: 30333 - RNA, 22 nt, Homo sapiens
cuggagagacaaggggaagagg

SEQ ID NO: 30334 - RNA, 24 nt, Homo sapiens
ucacagguuaaagggucucaggga

SEQ ID NO: 30335 - RNA, 22 nt, Homo sapiens
ucacaaguuagggucucaggga

SEQ ID NO: 30336 - RNA, 22 nt, Homo sapiens
acucaguaugccaggguaccau

SEQ ID NO: 30337 - RNA, 22 nt, Homo sapiens
acucaguaugccaggguaccau

SEQ ID NO: 30338 - RNA, 23 nt, Homo sapiens
agcccuguucuacagcccugagg

SEQ ID NO: 30339 - RNA, 23 nt, Homo sapiens
ucacauaggaaugaaaagccaua

SEQ ID NO: 30340 - RNA, 20 nt, Homo sapiens
uaugaacaauuucuaggaau

SEQ ID NO: 30341 - RNA, 22 nt, Homo sapiens
gaacuugcuaaaaaugcagaau

SEQ ID NO: 30342 - RNA, 21 nt, Homo sapiens
cugaggagagaggaggugggg

SEQ ID NO: 30343 - RNA, 22 nt, Homo sapiens
acuccaacagggccgcgucucc

SEQ ID NO: 30344 - RNA, 21 nt, Homo sapiens
gaccaaucgccguccccgccg

SEQ ID NO: 30345 - RNA, 21 nt, Homo sapiens
ucaaucacagauagcaccccu

SEQ ID NO: 30346 - RNA, 22 nt, Homo sapiens
gcggucccgcggcgccccgccu

SEQ ID NO: 30347 - RNA, 17 nt, Homo sapiens
uggaggccccagcgaga

SEQ ID NO: 30348 - RNA, 22 nt, Homo sapiens
ugcuguuagcccuagccccgca

SEQ ID NO: 30349 - RNA, 21 nt, Homo sapiens
uuccacgaccuaauccuaacu

SEQ ID NO: 30350 - RNA, 23 nt, Homo sapiens
aacaggugcucaaauaagacuug

SEQ ID NO: 30351 - RNA, 21 nt, Homo sapiens
aguagugcuuucuacuuuaug

SEQ ID NO: 30352 - RNA, 23 nt, Homo sapiens
uauucucgcacggacuacaacca

SEQ ID NO: 30353 - RNA, 21 nt, Homo sapiens
ggaaaucccuggcaaugugau

SEQ ID NO: 30354 - RNA, 21 nt, Homo sapiens
gguaaucccuggcaaugugau

SEQ ID NO: 30355 - RNA, 22 nt, Homo sapiens
aaucagucucauugcuuuauaa

SEQ ID NO: 30356 - RNA, 21 nt, Homo sapiens
acguggauuuuccucuaugau

SEQ ID NO: 30357 - RNA, 22 nt, Homo sapiens
aacauggauuuuccucuaugau

SEQ ID NO: 30358 - RNA, 22 nt, Homo sapiens
acaaaaguugccuuugugugau

SEQ ID NO: 30359 - RNA, 21 nt, Homo sapiens
aaacaucacugcaagucuuaa

SEQ ID NO: 30360 - RNA, 22 nt, Homo sapiens
gguaaaacucgcaauuacuuuu

SEQ ID NO: 30361 - RNA, 22 nt, Homo sapiens
ggccaaaaccacaauuacuuuu

SEQ ID NO: 30362 - RNA, 22 nt, Homo sapiens
ggcaaaaaccgcaauuacuuuu

SEQ ID NO: 30363 - RNA, 22 nt, Homo sapiens
ggcaaaaaccacaauuacuuuu

SEQ ID NO: 30364 - RNA, 22 nt, Homo sapiens
gacaaaaaccgcgauuacuuuu

SEQ ID NO: 30365 - RNA, 22 nt, Homo sapiens
ggcaaaauccgcaauuacuuuu

SEQ ID NO: 30366 - RNA, 22 nt, Homo sapiens
accaaagaccgcaauuacuuuu

SEQ ID NO: 30367 - RNA, 21 nt, Homo sapiens
uuuuggugcauauuuacuuua

SEQ ID NO: 30368 - RNA, 22 nt, Homo sapiens
ccaguagcacggcucaguccag

SEQ ID NO: 30369 - RNA, 19 nt, Homo sapiens
cagcaucagcagcaucauc

SEQ ID NO: 30370 - RNA, 20 nt, Homo sapiens
uucccaugcccuauaccucu

SEQ ID NO: 30371 - RNA, 21 nt, Homo sapiens
ccuucugacuccaaguccagu

SEQ ID NO: 30372 - RNA, 22 nt, Homo sapiens
cgaauccaccacgaacaacuuc

SEQ ID NO: 30373 - RNA, 22 nt, Homo sapiens
gccuucugacccuaaguccagu

SEQ ID NO: 30374 - RNA, 21 nt, Homo sapiens
guguauaugcccauggacugc

SEQ ID NO: 30375 - RNA, 23 nt, Homo sapiens
ucucacccagguagcaaggauua

SEQ ID NO: 30376 - RNA, 22 nt, Homo sapiens
agaauccuugcccgggugcauu

SEQ ID NO: 30377 - RNA, 22 nt, Homo sapiens
ugaauccuugcccaggugcauu

SEQ ID NO: 30378 - RNA, 22 nt, Homo sapiens
uaaaugaauucaauuuccuucu

SEQ ID NO: 30379 - RNA, 22 nt, Homo sapiens
agcuagugagaagucaaugccu

SEQ ID NO: 30380 - RNA, 22 nt, Homo sapiens
aggucucacuuuguugcccaga

SEQ ID NO: 30381 - RNA, 22 nt, Homo sapiens
augcccuuucaucauugcacug

SEQ ID NO: 30382 - RNA, 20 nt, Homo sapiens
gcagaagcauuuccacacac

SEQ ID NO: 30383 - RNA, 20 nt, Homo sapiens
cccgccgcgucgcccugggg

SEQ ID NO: 30384 - RNA, 21 nt, Homo sapiens
guaaugggaccuuccucuuug

SEQ ID NO: 30385 - RNA, 22 nt, Homo sapiens
ggaccuaaaaauacaaugcaua

SEQ ID NO: 30386 - RNA, 25 nt, Homo sapiens
aaggagcucagaagcccugcccagc

SEQ ID NO: 30387 - RNA, 22 nt, Homo sapiens
cugcucaaacccuccaaugacu

SEQ ID NO: 30388 - RNA, 19 nt, Homo sapiens
gcucuaagaaagccacacu

SEQ ID NO: 30389 - RNA, 24 nt, Homo sapiens
acugcuggucuucagucagggcca

SEQ ID NO: 30390 - RNA, 25 nt, Homo sapiens
cagcgucugccggaacccguuccca

SEQ ID NO: 30391 - RNA, 21 nt, Homo sapiens
cggggugcacgggcggagggc

SEQ ID NO: 30392 - RNA, 21 nt, Homo sapiens
gggcaucugggacgcgcagga

SEQ ID NO: 30393 - RNA, 21 nt, Homo sapiens
gaccaaucgccguccccgccg

SEQ ID NO: 30394 - RNA, 23 nt, Homo sapiens
aaagucucgcucucugccccuca

SEQ ID NO: 30395 - RNA, 19 nt, Homo sapiens
auuuugguacagcagcuca

SEQ ID NO: 30396 - RNA, 19 nt, Homo sapiens
gccugcugacaccgugccu

SEQ ID NO: 30397 - RNA, 20 nt, Homo sapiens
ugggccaccgccgagcggac

SEQ ID NO: 30398 - RNA, 25 nt, Homo sapiens
accaacggaccuacuucccuccgcc

SEQ ID NO: 30399 - RNA, 22 nt, Homo sapiens
gcggucccgcggcgccccgccu

SEQ ID NO: 30400 - RNA, 22 nt, Homo sapiens
ugcuguuagcccuagccccgca

SEQ ID NO: 30401 - RNA, 21 nt, Homo sapiens
ccccucccagccucccugcca

SEQ ID NO: 30402 - RNA, 20 nt, Homo sapiens
gcagcuguccgcccagacac

SEQ ID NO: 30403 - RNA, 22 nt, Homo sapiens
uccggggacgaacgggacgggu

SEQ ID NO: 30404 - RNA, 18 nt, Homo sapiens
uggcgccugaacagggac

SEQ ID NO: 30405 - RNA, 18 nt, Homo sapiens
aucacauucaccucccug

SEQ ID NO: 30406 - RNA, 21 nt, Homo sapiens
acuagacugugagcuccucga

SEQ ID NO: 30407 - RNA, 22 nt, Homo sapiens
ccggcugcaacacaagacacga

SEQ ID NO: 30408 - RNA, 23 nt, Homo sapiens
cuaucugcacuagaugcaccuua

SEQ ID NO: 30409 - RNA, 22 nt, Homo sapiens
uggcagcagcggagggggcaga

SEQ ID NO: 30410 - RNA, 22 nt, Homo sapiens
agucuucacaacagcccugugu

SEQ ID NO: 30411 - RNA, 22 nt, Homo sapiens
cucaauagacugugagcuccuu

SEQ ID NO: 30412 - RNA, 20 nt, Homo sapiens
ccagcagcaccuggggcagu

SEQ ID NO: 30413 - RNA, 23 nt, Homo sapiens
aaaucagaaucacaccuggggga

SEQ ID NO: 30414 - RNA, 23 nt, Homo sapiens
aaagucucgcucucugccccuca

SEQ ID NO: 30415 - RNA, 21 nt, Homo sapiens
auccuguacugagcugccccg

SEQ ID NO: 30416 - RNA, 24 nt, Homo sapiens
acgcagagcccgaaagcccccagu

SEQ ID NO: 30417 - RNA, 22 nt, Homo sapiens
caagacacauuuggagagggac

SEQ ID NO: 30418 - RNA, 23 nt, Homo sapiens
cccagcuagauuguaagcuccuu

SEQ ID NO: 30419 - RNA, 21 nt, Homo sapiens
caucaccuuccuucuccucca

SEQ ID NO: 30420 - RNA, 22 nt, Homo sapiens
ggaggccgggacgagugcaaua

SEQ ID NO: 30421 - RNA, 21 nt, Homo sapiens
gagcugcauccuggcuccggg

SEQ ID NO: 30422 - RNA, 20 nt, Homo sapiens
cugcgggaggacagggcuca

SEQ ID NO: 30423 - RNA, 22 nt, Homo sapiens
uagcagaagcauuuccgcacac

SEQ ID NO: 30424 - RNA, 23 nt, Homo sapiens
aggaacagcagcagcccgggccg

SEQ ID NO: 30425 - RNA, 21 nt, Homo sapiens
gugacagagccaagcacaaau

SEQ ID NO: 30426 - RNA, 22 nt, Homo sapiens
aagagggagacccaggcucgga

SEQ ID NO: 30427 - RNA, 21 nt, Homo sapiens
gaaggaagugagugcagccac

SEQ ID NO: 30428 - RNA, 22 nt, Homo sapiens
acuccaacagggccgcgucucc

SEQ ID NO: 30429 - RNA, 21 nt, Homo sapiens
acuagacugugagcuccucga

SEQ ID NO: 30430 - RNA, 21 nt, Homo sapiens
gaccaaucgccguccccgccg

SEQ ID NO: 30431 - RNA, 22 nt, Homo sapiens
uggcagcagcggagggggcaga

SEQ ID NO: 30432 - RNA, 22 nt, Homo sapiens
ucagaccgagacaagugcaaug

SEQ ID NO: 30433 - RNA, 20 nt, Homo sapiens
ccagcagcaccuggggcagu

SEQ ID NO: 30434 - RNA, 20 nt, Homo sapiens
cuggaggaagggcccagagg

SEQ ID NO: 30435 - RNA, 22 nt, Homo sapiens
gccuaagacacaggcccagaga

SEQ ID NO: 30436 - RNA, 23 nt, Homo sapiens
aaaucagaaucacaccuggggga

SEQ ID NO: 30437 - RNA, 21 nt, Homo sapiens
auccuguacugagcugccccg

SEQ ID NO: 30438 - RNA, 24 nt, Homo sapiens
acgcagagcccgaaagcccccagu

SEQ ID NO: 30439 - RNA, 22 nt, Homo sapiens
gcggucccgcggcgccccgccu

SEQ ID NO: 30440 - RNA, 23 nt, Homo sapiens
cacugugggcccucuccgcacca

SEQ ID NO: 30441 - RNA, 22 nt, Homo sapiens
ugcuguuagcccuagccccgca

SEQ ID NO: 30442 - RNA, 22 nt, Homo sapiens
cuagggaacacagggcugguga

SEQ ID NO: 30443 - RNA, 20 nt, Homo sapiens
gcagcuguccgcccagacac

SEQ ID NO: 30444 - RNA, 21 nt, Homo sapiens
agcgccuuuggcagcuagagu

SEQ ID NO: 30445 - RNA, 24 nt, Homo sapiens
gaagucacucccaggcagcugcaa

SEQ ID NO: 30446 - RNA, 24 nt, Homo sapiens
gaaagugcauagaauucugucugg

SEQ ID NO: 30447 - RNA, 23 nt, Homo sapiens
cggccugauucacaacaccagcu

SEQ ID NO: 30448 - RNA, 23 nt, Homo sapiens
gggagugaagacacggagccaga

SEQ ID NO: 30449 - RNA, 22 nt, Homo sapiens
ccggcugcaacacaagacacga

SEQ ID NO: 30450 - RNA, 22 nt, Homo sapiens
aggcauaggaugacaaagggaa

SEQ ID NO: 30451 - RNA, 22 nt, Homo sapiens
aggcgaaggaugacaaagggaa

SEQ ID NO: 30452 - RNA, 22 nt, Homo sapiens
aaagugcuucuuaccuccagau

SEQ ID NO: 30453 - RNA, 21 nt, Homo sapiens
gcuccaaccucagcagacugu

SEQ ID NO: 30454 - RNA, 21 nt, Homo sapiens
gaccaaucgccguccccgccg

SEQ ID NO: 30455 - RNA, 22 nt, Homo sapiens
ucagaccgagacaagugcaaug

SEQ ID NO: 30456 - RNA, 23 nt, Homo sapiens
aagaaucuugucccgcagguccu

SEQ ID NO: 30457 - RNA, 20 nt, Homo sapiens
ggcauucaccgcgugccuua

SEQ ID NO: 30458 - RNA, 22 nt, Homo sapiens
cagaaagugcuucccucuagag

SEQ ID NO: 30459 - RNA, 21 nt, Homo sapiens
cacucugaagggaagcgcuuu

SEQ ID NO: 30460 - RNA, 21 nt, Homo sapiens
ccucuaaagagaagcgcuuuc

SEQ ID NO: 30461 - RNA, 22 nt, Homo sapiens
acacucuaaaaggaugcacuuu

SEQ ID NO: 30462 - RNA, 22 nt, Homo sapiens
cagaaagcgcuucccucuagag

SEQ ID NO: 30463 - RNA, 22 nt, Homo sapiens
cagaaagcgcuucccucuagag

SEQ ID NO: 30464 - RNA, 22 nt, Homo sapiens
cagaaagugcuucccucuagag

SEQ ID NO: 30465 - RNA, 22 nt, Homo sapiens
acacucuaaagggaaccauuuu

SEQ ID NO: 30466 - RNA, 23 nt, Homo sapiens
acccucuauagggaagcgcguuc

SEQ ID NO: 30467 - RNA, 22 nt, Homo sapiens
cagaaagugcuucccucuagag

SEQ ID NO: 30468 - RNA, 23 nt, Homo sapiens
ucucgugacaugaugauccccga

SEQ ID NO: 30469 - RNA, 22 nt, Homo sapiens
cuccuccaacaauccuagacca

SEQ ID NO: 30470 - RNA, 23 nt, Homo sapiens
gucagaccccgagggguccucgc

SEQ ID NO: 30471 - RNA, 22 nt, Homo sapiens
gcggucccgcggcgccccgccu

SEQ ID NO: 30472 - RNA, 22 nt, Homo sapiens
ugcuguuagcccuagccccgca

SEQ ID NO: 30473 - RNA, 20 nt, Homo sapiens
cucaaagcaaacccugcaga

SEQ ID NO: 30474 - RNA, 22 nt, Homo sapiens
gugggguggguggucaggccga

SEQ ID NO: 30475 - RNA, 22 nt, Homo sapiens
uagcagaagcauuuccgcacac

SEQ ID NO: 30476 - RNA, 23 nt, Homo sapiens
aggaacagcagcagcccgggccg

SEQ ID NO: 30477 - RNA, 23 nt, Homo sapiens
cuaccugcacuguaagcacuuug

SEQ ID NO: 30478 - RNA, 22 nt, Homo sapiens
aaagagguuaaccagguguguu

SEQ ID NO: 30479 - RNA, 21 nt, Homo sapiens
ucaaucacagauagcaccccu

SEQ ID NO: 30480 - RNA, 22 nt, Homo sapiens
ugaauccuugaauagguguguu

SEQ ID NO: 30481 - RNA, 23 nt, Homo sapiens
cugcagaacuguucccgcugcua

SEQ ID NO: 30482 - RNA, 22 nt, Homo sapiens
caugauugccacgucugcagua

SEQ ID NO: 30483 - RNA, 21 nt, Homo sapiens
ugauugccacugucugcagua

SEQ ID NO: 30484 - RNA, 19 nt, Homo sapiens
guccugaauuccgcagccu

SEQ ID NO: 30485 - RNA, 23 nt, Homo sapiens
acagcgcucgcaaccgcagcgau

SEQ ID NO: 30486 - RNA, 21 nt, Homo sapiens
uuccacgaccuaauccuaacu

SEQ ID NO: 30487 - RNA, 22 nt, Homo sapiens
cacaaaccauuaugugcugcua

SEQ ID NO: 30488 - RNA, 23 nt, Homo sapiens
ucuacuccaaaaggcuacaauca

SEQ ID NO: 30489 - RNA, 23 nt, Homo sapiens
cccagcuagauuguaagcuccuu

SEQ ID NO: 30490 - RNA, 23 nt, Homo sapiens
cugugggagggcaguggugagag

SEQ ID NO: 30491 - RNA, 24 nt, Homo sapiens
acugcaggcuccagcuuccaggcu

SEQ ID NO: 30492 - RNA, 24 nt, Homo sapiens
gaagucacucccaggcagcugcaa

SEQ ID NO: 30493 - RNA, 22 nt, Homo sapiens
ucgcccucucaacccagcuuuu

SEQ ID NO: 30494 - RNA, 22 nt, Homo sapiens
uugcccucucaacccagcuuuu

SEQ ID NO: 30495 - RNA, 20 nt, Homo sapiens
acccucucaacccagcuuuu

SEQ ID NO: 30496 - RNA, 19 nt, Homo sapiens
uccucucaacccagcuuuu

SEQ ID NO: 30497 - RNA, 22 nt, Homo sapiens
acuucaaggaucuuaaacuuug

SEQ ID NO: 30498 - RNA, 17 nt, Homo sapiens
gggagaggaggaggcga

SEQ ID NO: 30499 - RNA, 23 nt, Homo sapiens
aggaacagcagcagcccgggccg

SEQ ID NO: 30500 - RNA, 23 nt, Homo sapiens
cagcugcuuuugggauuccguug

SEQ ID NO: 30501 - RNA, 23 nt, Homo sapiens
cuccagccccuccagggcuuccu

SEQ ID NO: 30502 - RNA, 22 nt, Homo sapiens
ggcagagagucagagcgcggau

SEQ ID NO: 30503 - RNA, 21 nt, Homo sapiens
uucaguuaucacaguacugua

SEQ ID NO: 30504 - RNA, 21 nt, Homo sapiens
ucacccagaucugcggccuaa

SEQ ID NO: 30505 - RNA, 22 nt, Homo sapiens
ucucucccauuagaguugaaaa

SEQ ID NO: 30506 - RNA, 21 nt, Homo sapiens
acaugguuagaucaagcacaa

SEQ ID NO: 30507 - RNA, 22 nt, Homo sapiens
ggagagccuccacccaacccuc

SEQ ID NO: 30508 - RNA, 23 nt, Homo sapiens
acggcuaguggaccaggugaagu

SEQ ID NO: 30509 - RNA, 21 nt, Homo sapiens
caguagagauuguuucaacac

SEQ ID NO: 30510 - RNA, 22 nt, Homo sapiens
cacauggccaaaacagagaaga

SEQ ID NO: 30511 - RNA, 17 nt, Homo sapiens
gacagccucucccccac

SEQ ID NO: 30512 - RNA, 17 nt, Homo sapiens
ggguggcagcgguggga

SEQ ID NO: 30513 - RNA, 21 nt, Homo sapiens
ucuccagaucagggcagucca

SEQ ID NO: 30514 - RNA, 25 nt, Homo sapiens
cagcgucugccggaacccguuccca

SEQ ID NO: 30515 - RNA, 22 nt, Homo sapiens
auggcaguggaguuagugauug

SEQ ID NO: 30516 - RNA, 22 nt, Homo sapiens
auaaggauuuuuaggggcauua

SEQ ID NO: 30517 - RNA, 19 nt, Homo sapiens
auuuugguacagcagcuca

SEQ ID NO: 30518 - RNA, 22 nt, Homo sapiens
gauccgagcaccggggaccccc

SEQ ID NO: 30519 - RNA, 20 nt, Homo sapiens
uacugcuuccacagcucccc

SEQ ID NO: 30520 - RNA, 21 nt, Homo sapiens
gagcugcauccuggcuccggg

SEQ ID NO: 30521 - RNA, 18 nt, Homo sapiens
gaaaugagggccagcuga

SEQ ID NO: 30522 - RNA, 17 nt, Homo sapiens
gacagccucucccccac

SEQ ID NO: 30523 - RNA, 23 nt, Homo sapiens
aaaaugcagauuccuggacucca

SEQ ID NO: 30524 - RNA, 22 nt, Homo sapiens
ccaucuuuaccagacaguguua

SEQ ID NO: 30525 - RNA, 23 nt, Homo sapiens
gggagugaagacacggagccaga

SEQ ID NO: 30526 - RNA, 21 nt, Homo sapiens
gaccaaucgccguccccgccg

SEQ ID NO: 30527 - RNA, 22 nt, Homo sapiens
acaucguuaccagacaguguua

SEQ ID NO: 30528 - RNA, 22 nt, Homo sapiens
acaguucuucaacuggcagcuu

SEQ ID NO: 30529 - RNA, 23 nt, Homo sapiens
aaaucagaaucacaccuggggga

SEQ ID NO: 30530 - RNA, 19 nt, Homo sapiens
guugggaucacaggcgccc

SEQ ID NO: 30531 - RNA, 24 nt, Homo sapiens
acgcagagcccgaaagcccccagu

SEQ ID NO: 30532 - RNA, 24 nt, Homo sapiens
acgcgcaggccagagacccaggca

SEQ ID NO: 30533 - RNA, 22 nt, Homo sapiens
gcggucccgcggcgccccgccu

SEQ ID NO: 30534 - RNA, 22 nt, Homo sapiens
gaggcucagaauggcucaggag

SEQ ID NO: 30535 - RNA, 21 nt, Homo sapiens
gagcugcauccuggcuccggg

SEQ ID NO: 30536 - RNA, 22 nt, Homo sapiens
cacgaccgacgccacgccgagu

SEQ ID NO: 30537 - RNA, 22 nt, Homo sapiens
ggagcccgcgccccgcgccgag

SEQ ID NO: 30538 - RNA, 23 nt, Homo sapiens
cggcucugucgucgaggcgcuca

SEQ ID NO: 30539 - RNA, 23 nt, Homo sapiens
acgggugcgauuucugugugaga

SEQ ID NO: 30540 - RNA, 22 nt, Homo sapiens
acaaaaguugccuuugugugau

SEQ ID NO: 30541 - RNA, 23 nt, Homo sapiens
aaagucucgcucucugccccuca

SEQ ID NO: 30542 - RNA, 19 nt, Homo sapiens
auuuugguacagcagcuca

SEQ ID NO: 30543 - RNA, 19 nt, Homo sapiens
gccucagaggcagcugcuu

SEQ ID NO: 30544 - RNA, 21 nt, Homo sapiens
caucaccuuccuucuccucca

SEQ ID NO: 30545 - RNA, 22 nt, Homo sapiens
aaccauacaaccuacuaccuca

SEQ ID NO: 30546 - RNA, 21 nt, Homo sapiens
gagcugcauccuggcuccggg

SEQ ID NO: 30547 - RNA, 22 nt, Homo sapiens
aacccauggaauucaguucuca

SEQ ID NO: 30548 - RNA, 20 nt, Homo sapiens
gcagaagcauuuccacacac

SEQ ID NO: 30549 - RNA, 23 nt, Homo sapiens
cggcucugucgucgaggcgcuca

SEQ ID NO: 30550 - RNA, 23 nt, Homo sapiens
aagaaucuugucccgcagguccu

SEQ ID NO: 30551 - RNA, 22 nt, Homo sapiens
aggaaaccagcaaguguugacg

SEQ ID NO: 30552 - RNA, 23 nt, Homo sapiens
acacacucacacacacacacuca

SEQ ID NO: 30553 - RNA, 22 nt, Homo sapiens
gcaaaaguaauugcagugugug

SEQ ID NO: 30554 - RNA, 21 nt, Homo sapiens
gcugaggucugggccaggucu

SEQ ID NO: 30555 - RNA, 22 nt, Homo sapiens
caaacaccauugucacacucca

SEQ ID NO: 30556 - RNA, 22 nt, Homo sapiens
agucuucacaacagcccugugu

SEQ ID NO: 30557 - RNA, 23 nt, Homo sapiens
aaaucagaaucacaccuggggga

SEQ ID NO: 30558 - RNA, 22 nt, Homo sapiens
gaauucaucacggccagccucu

SEQ ID NO: 30559 - RNA, 23 nt, Homo sapiens
gaaagugcccucaaggcugagug

SEQ ID NO: 30560 - RNA, 18 nt, Homo sapiens
augacaccucccugugaa

SEQ ID NO: 30561 - RNA, 23 nt, Homo sapiens
acacucuaaagagaagcgcuuug

SEQ ID NO: 30562 - RNA, 21 nt, Homo sapiens
agaaaguacuucccucuggag

SEQ ID NO: 30563 - RNA, 21 nt, Homo sapiens
agaaagugcaucccucuggag

SEQ ID NO: 30564 - RNA, 24 nt, Homo sapiens
acgcagagcccgaaagcccccagu

SEQ ID NO: 30565 - RNA, 20 nt, Homo sapiens
cccugcgccaucuccucuac

SEQ ID NO: 30566 - RNA, 22 nt, Homo sapiens
acacacccacgcgagccggaaa

SEQ ID NO: 30567 - RNA, 22 nt, Homo sapiens
cuagggaacacagggcugguga

SEQ ID NO: 30568 - RNA, 21 nt, Homo sapiens
aaaggccacauccagcaccgu

SEQ ID NO: 30569 - RNA, 23 nt, Homo sapiens
cggccugauucacaacaccagcu

SEQ ID NO: 30570 - RNA, 22 nt, Homo sapiens
acuccaacagggccgcgucucc

SEQ ID NO: 30571 - RNA, 22 nt, Homo sapiens
accagcuaacaauacacugcca

SEQ ID NO: 30572 - RNA, 20 nt, Homo sapiens
agugcccccacaguuugagu

SEQ ID NO: 30573 - RNA, 22 nt, Homo sapiens
uaaccgauuucagauggugcua

SEQ ID NO: 30574 - RNA, 21 nt, Homo sapiens
agcuaugccagcaucuugccu

SEQ ID NO: 30575 - RNA, 22 nt, Homo sapiens
gaagaaaggcaucauauaggag

SEQ ID NO: 30576 - RNA, 22 nt, Homo sapiens
guagaagggaaucuugcauaag

SEQ ID NO: 30577 - RNA, 23 nt, Homo sapiens
ucucacccagguagcaaggauua

SEQ ID NO: 30578 - RNA, 22 nt, Homo sapiens
cugggggcggcacaggggcuca

SEQ ID NO: 30579 - RNA, 23 nt, Homo sapiens
gaaacccagcagacaauguagcu

SEQ ID NO: 30580 - RNA, 22 nt, Homo sapiens
gaauucaucacggccagccucu

SEQ ID NO: 30581 - RNA, 19 nt, Homo sapiens
aagacauuuucagacagcu

SEQ ID NO: 30582 - RNA, 20 nt, Homo sapiens
aggggccucagccuccuggu

SEQ ID NO: 30583 - RNA, 22 nt, Homo sapiens
ugcuguuagcccuagccccgca

SEQ ID NO: 30584 - RNA, 20 nt, Homo sapiens
uccccacagacccagagccg

SEQ ID NO: 30585 - RNA, 23 nt, Homo sapiens
ggaagccaucaagucgcugcagg

SEQ ID NO: 30586 - RNA, 27 nt, Homo sapiens
uuuagcacagugcuuauacaagaaggu

SEQ ID NO: 30587 - RNA, 24 nt, Homo sapiens
gaagucacucccaggcagcugcaa

SEQ ID NO: 30588 - RNA, 24 nt, Homo sapiens
gaagucacucccaggcagcugcaa

SEQ ID NO: 30589 - RNA, 22 nt, Homo sapiens
cgaccauggcuguagacuguua

SEQ ID NO: 30590 - RNA, 23 nt, Homo sapiens
agggauuccugggaaaacuggac

SEQ ID NO: 30591 - RNA, 22 nt, Homo sapiens
ccagaacugaguccacagggca

SEQ ID NO: 30592 - RNA, 22 nt, Homo sapiens
agcccaaaaggagaauucuuug

SEQ ID NO: 30593 - RNA, 21 nt, Homo sapiens
cccuccaccaugcaagggaug

SEQ ID NO: 30594 - RNA, 21 nt, Homo sapiens
gaccaaucgccguccccgccg

SEQ ID NO: 30595 - RNA, 21 nt, Homo sapiens
ggccgugacuggagacuguua

SEQ ID NO: 30596 - RNA, 22 nt, Homo sapiens
agucuucacaacagcccugugu

SEQ ID NO: 30597 - RNA, 21 nt, Homo sapiens
acaggauugagggggggcccu

SEQ ID NO: 30598 - RNA, 22 nt, Homo sapiens
aaucagucucauugcuuuauaa

SEQ ID NO: 30599 - RNA, 22 nt, Homo sapiens
aucgggaggggacugagccuga

SEQ ID NO: 30600 - RNA, 21 nt, Homo sapiens
acaaaccacagugugcugcug

SEQ ID NO: 30601 - RNA, 18 nt, Homo sapiens
augacaccucccugugaa

SEQ ID NO: 30602 - RNA, 22 nt, Homo sapiens
gcggucccgcggcgccccgccu

SEQ ID NO: 30603 - RNA, 22 nt, Homo sapiens
ugcuguuagcccuagccccgca

SEQ ID NO: 30604 - RNA, 22 nt, Homo sapiens
acacacccacgcgagccggaaa

SEQ ID NO: 30605 - RNA, 22 nt, Homo sapiens
cugggggcggcacaggggcuca

SEQ ID NO: 30606 - RNA, 22 nt, Homo sapiens
cacgaccgacgccacgccgagu

SEQ ID NO: 30607 - RNA, 22 nt, Homo sapiens
ggagcccgcgccccgcgccgag

SEQ ID NO: 30608 - RNA, 22 nt, Homo sapiens
ucaggaacugccuuucucucca

SEQ ID NO: 30609 - RNA, 21 nt, Homo sapiens
gaccaaucgccguccccgccg

SEQ ID NO: 30610 - RNA, 21 nt, Homo sapiens
ucaaucacagauagcaccccu

SEQ ID NO: 30611 - RNA, 22 nt, Homo sapiens
uccagcaaagggaagcgcuuuc

SEQ ID NO: 30612 - RNA, 22 nt, Homo sapiens
accucuaaaggggagcgcuuug

SEQ ID NO: 30613 - RNA, 23 nt, Homo sapiens
acacucuaaagagaagcgcuuug

SEQ ID NO: 30614 - RNA, 21 nt, Homo sapiens
gcuccaaagggaagcgcuuug

SEQ ID NO: 30615 - RNA, 21 nt, Homo sapiens
ccucuaaagagaagcgcuuuc

SEQ ID NO: 30616 - RNA, 22 nt, Homo sapiens
aagagggagacccaggcucgga

SEQ ID NO: 30617 - RNA, 22 nt, Homo sapiens
gcggucccgcggcgccccgccu

SEQ ID NO: 30618 - RNA, 22 nt, Homo sapiens
ccucaggcacggccgggccacc

SEQ ID NO: 30619 - RNA, 22 nt, Homo sapiens
ugcuguuagcccuagccccgca

SEQ ID NO: 30620 - RNA, 21 nt, Homo sapiens
gagcugcauccuggcuccggg

SEQ ID NO: 30621 - RNA, 23 nt, Homo sapiens
gggagugaagacacggagccaga

SEQ ID NO: 30622 - RNA, 21 nt, Homo sapiens
gaccaaucgccguccccgccg

SEQ ID NO: 30623 - RNA, 22 nt, Homo sapiens
uucacacugcaugcucugggua

SEQ ID NO: 30624 - RNA, 22 nt, Homo sapiens
cagaagugggccgggcacaggg

SEQ ID NO: 30625 - RNA, 22 nt, Homo sapiens
ucagaccgagacaagugcaaug

SEQ ID NO: 30626 - RNA, 22 nt, Homo sapiens
agcugaguguaggauguuuaca

SEQ ID NO: 30627 - RNA, 22 nt, Homo sapiens
gcggucccgcggcgccccgccu

SEQ ID NO: 30628 - RNA, 22 nt, Homo sapiens
ugcuguuagcccuagccccgca

SEQ ID NO: 30629 - RNA, 20 nt, Homo sapiens
uacugcuuccacagcucccc

SEQ ID NO: 30630 - RNA, 24 nt, Homo sapiens
cacccccagagccucagcucccca

SEQ ID NO: 30631 - RNA, 24 nt, Homo sapiens
cacccccagagccucagcucccca

SEQ ID NO: 30632 - RNA, 22 nt, Homo sapiens
cuuccagucgaggauguuuaca

SEQ ID NO: 30633 - RNA, 22 nt, Homo sapiens
cuuccagucggggauguuuaca

SEQ ID NO: 30634 - RNA, 22 nt, Homo sapiens
cuuccagucaaggauguuuaca

SEQ ID NO: 30635 - RNA, 19 nt, Homo sapiens
accagugcccugcacacuu

SEQ ID NO: 30636 - RNA, 22 nt, Homo sapiens
uauccacuacaccccgcugccu

SEQ ID NO: 30637 - RNA, 20 nt, Homo sapiens
uacugcuuccacagcucccc

SEQ ID NO: 30638 - RNA, 20 nt, Homo sapiens
uacugcuuccacagcucccc

SEQ ID NO: 30639 - RNA, 21 nt, Homo sapiens
agggcucaucuugguccugca

SEQ ID NO: 30640 - RNA, 25 nt, Homo sapiens
cagcgucugccggaacccguuccca

SEQ ID NO: 30641 - RNA, 22 nt, Homo sapiens
cagcugguugaaggggaccaaa

SEQ ID NO: 30642 - RNA, 22 nt, Homo sapiens
uagcugguugaaggggaccaaa

SEQ ID NO: 30643 - RNA, 23 nt, Homo sapiens
cuaucugcacuagaugcaccuua

SEQ ID NO: 30644 - RNA, 23 nt, Homo sapiens
cuaacugcacuagaugcaccuua

SEQ ID NO: 30645 - RNA, 22 nt, Homo sapiens
uggcagcagcggagggggcaga

SEQ ID NO: 30646 - RNA, 20 nt, Homo sapiens
ccagcagcaccuggggcagu

SEQ ID NO: 30647 - RNA, 21 nt, Homo sapiens
auccuguacugagcugccccg

SEQ ID NO: 30648 - RNA, 17 nt, Homo sapiens
gggagaggaggaggcga

SEQ ID NO: 30649 - RNA, 23 nt, Homo sapiens
gggagugaagacacggagccaga

SEQ ID NO: 30650 - RNA, 21 nt, Homo sapiens
gaccaaucgccguccccgccg

SEQ ID NO: 30651 - RNA, 21 nt, Homo sapiens
gaccaaucgccguccccgccg

SEQ ID NO: 30652 - RNA, 23 nt, Homo sapiens
aaagucucgcucucugccccuca

SEQ ID NO: 30653 - RNA, 22 nt, Homo sapiens
gcggucccgcggcgccccgccu

SEQ ID NO: 30654 - RNA, 22 nt, Homo sapiens
gcggucccgcggcgccccgccu

SEQ ID NO: 30655 - RNA, 20 nt, Homo sapiens
cucaaagcaaacccugcaga

SEQ ID NO: 30656 - RNA, 18 nt, Homo sapiens
gaaaugagggccagcuga

SEQ ID NO: 30657 - RNA, 17 nt, Homo sapiens
gacagccucucccccac

SEQ ID NO: 30658 - RNA, 22 nt, Homo sapiens
agcccaaaaggagaauucuuug

SEQ ID NO: 30659 - RNA, 21 nt, Homo sapiens
aucugcacugucagcacuuua

SEQ ID NO: 30660 - RNA, 23 nt, Homo sapiens
gcuuugacaauaucauugcacug

SEQ ID NO: 30661 - RNA, 23 nt, Homo sapiens
acgggugcgauuucugugugaga

SEQ ID NO: 30662 - RNA, 24 nt, Homo sapiens
acacucuaaagggaagcacuuugu

SEQ ID NO: 30663 - RNA, 22 nt, Homo sapiens
acucuaaagggaagcacuuugu

SEQ ID NO: 30664 - RNA, 21 nt, Homo sapiens
ggacuauagaacuuucccccu

SEQ ID NO: 30665 - RNA, 21 nt, Homo sapiens
aguucucccaacguaaaccca

SEQ ID NO: 30666 - RNA, 23 nt, Homo sapiens
cuccagccccuccagggcuuccu

SEQ ID NO: 30667 - RNA, 17 nt, Homo sapiens
gggagaggaggaggcga

SEQ ID NO: 30668 - RNA, 21 nt, Homo sapiens
agggcucaucuugguccugca

SEQ ID NO: 30669 - RNA, 21 nt, Homo sapiens
acuagacugugagcuccucga

SEQ ID NO: 30670 - RNA, 23 nt, Homo sapiens
aggaacagcagcagcccgggccg

SEQ ID NO: 30671 - RNA, 21 nt, Homo sapiens
gggcaucugggacgcgcagga

SEQ ID NO: 30672 - RNA, 22 nt, Homo sapiens
acccuuaucaguucuccgucca

SEQ ID NO: 30673 - RNA, 21 nt, Homo sapiens
gaccaaucgccguccccgccg

SEQ ID NO: 30674 - RNA, 22 nt, Homo sapiens
gauagagugcagaccagggucu

SEQ ID NO: 30675 - RNA, 21 nt, Homo sapiens
acuccaaagggaagcgccuuc

SEQ ID NO: 30676 - RNA, 22 nt, Homo sapiens
cgcucuaaagggaagcgccuuc

SEQ ID NO: 30677 - RNA, 19 nt, Homo sapiens
guugggaucacaggcgccc

SEQ ID NO: 30678 - RNA, 22 nt, Homo sapiens
gcggucccgcggcgccccgccu

SEQ ID NO: 30679 - RNA, 22 nt, Homo sapiens
ugcuguuagcccuagccccgca

SEQ ID NO: 30680 - RNA, 17 nt, Homo sapiens
gggagaggaggaggcga

SEQ ID NO: 30681 - RNA, 22 nt, Homo sapiens
acaccuggcuccacacgcgggc

SEQ ID NO: 30682 - RNA, 23 nt, Homo sapiens
gggagugaagacacggagccaga

SEQ ID NO: 30683 - RNA, 21 nt, Homo sapiens
acuagacugugagcuccucga

SEQ ID NO: 30684 - RNA, 21 nt, Homo sapiens
gggcaucugggacgcgcagga

SEQ ID NO: 30685 - RNA, 21 nt, Homo sapiens
gaccaaucgccguccccgccg

SEQ ID NO: 30686 - RNA, 22 nt, Homo sapiens
cucaauagacugugagcuccuu

SEQ ID NO: 30687 - RNA, 23 nt, Homo sapiens
gggcucuuacucccucaggcacu

SEQ ID NO: 30688 - RNA, 22 nt, Homo sapiens
gcggucccgcggcgccccgccu

SEQ ID NO: 30689 - RNA, 23 nt, Homo sapiens
cccagcuagauuguaagcuccuu

SEQ ID NO: 30690 - RNA, 20 nt, Homo sapiens
uccccacagacccagagccg

SEQ ID NO: 30691 - RNA, 21 nt, Homo sapiens
caucaccuuccuucuccucca

SEQ ID NO: 30692 - RNA, 18 nt, Homo sapiens
cccccaccaccacgcccg

SEQ ID NO: 30693 - RNA, 22 nt, Homo sapiens
ggagcccgcgccccgcgccgag

SEQ ID NO: 30694 - RNA, 22 nt, Homo sapiens
uacagauggauaccgugcaauu

SEQ ID NO: 30695 - RNA, 22 nt, Homo sapiens
gccagcuaacaauacacugccu

SEQ ID NO: 30696 - RNA, 22 nt, Homo sapiens
aggaaaccagcaaguguugacg

SEQ ID NO: 30697 - RNA, 25 nt, Homo sapiens
acggagcugucccaacaccaccccu

SEQ ID NO: 30698 - RNA, 22 nt, Homo sapiens
cuagugguccuaaacauuucac

SEQ ID NO: 30699 - RNA, 22 nt, Homo sapiens
uaaccgauuucagauggugcua

SEQ ID NO: 30700 - RNA, 23 nt, Homo sapiens
cggcucugucgucgaggcgcuca

SEQ ID NO: 30701 - RNA, 18 nt, Homo sapiens
augacaccucccugugaa

SEQ ID NO: 30702 - RNA, 21 nt, Homo sapiens
guaaugggaccuuccucuuug

SEQ ID NO: 30703 - RNA, 22 nt, Homo sapiens
caacuccgauaugcaaugggua

SEQ ID NO: 30704 - RNA, 20 nt, Homo sapiens
ugucuccacagggcucuuua

SEQ ID NO: 30705 - RNA, 17 nt, Homo sapiens
gggagaggaggaggcga

SEQ ID NO: 30706 - RNA, 21 nt, Homo sapiens
gcaagcccagaccgcaaaaag

SEQ ID NO: 30707 - RNA, 19 nt, Homo sapiens
cagcaucagcagcaucauc

SEQ ID NO: 30708 - RNA, 23 nt, Homo sapiens
uccaucaucaaaacaaauggagu

SEQ ID NO: 30709 - RNA, 23 nt, Homo sapiens
cuacgcguauucuuaagcaauaa

SEQ ID NO: 30710 - RNA, 22 nt, Homo sapiens
gagcccuggacuaggagucagc

SEQ ID NO: 30711 - RNA, 22 nt, Homo sapiens
cacuuaucagguuguauuauaa

SEQ ID NO: 30712 - RNA, 23 nt, Homo sapiens
cugcagaacuguucccgcugcua

SEQ ID NO: 30713 - RNA, 22 nt, Homo sapiens
aaaguaacugcaguuuuugcua

SEQ ID NO: 30714 - RNA, 23 nt, Homo sapiens
aaucgcgguuuauaccaaaugaa

SEQ ID NO: 30715 - RNA, 25 nt, Homo sapiens
accaacggaccuacuucccuccgcc

SEQ ID NO: 30716 - RNA, 23 nt, Homo sapiens
cacaaauucgguucuacagggua

SEQ ID NO: 30717 - RNA, 21 nt, Homo sapiens
agaaguagaccauguguccua

SEQ ID NO: 30718 - RNA, 18 nt, Homo sapiens
ugguggcagaggugggau

SEQ ID NO: 30719 - RNA, 17 nt, Homo sapiens
ggguggcagcgguggga

SEQ ID NO: 30720 - RNA, 22 nt, Homo sapiens
aacccauggaauucaguucuca

SEQ ID NO: 30721 - RNA, 22 nt, Homo sapiens
ugcaacuuaguaaugugcaaua

SEQ ID NO: 30722 - RNA, 23 nt, Homo sapiens
acccucuauagggaagcgcguuc

SEQ ID NO: 30723 - RNA, 23 nt, Homo sapiens
ccuagagagggugagaaccugcc

SEQ ID NO: 30724 - RNA, 20 nt, Homo sapiens
cucaaagcaaacccugcaga

SEQ ID NO: 30725 - RNA, 24 nt, Homo sapiens
ucacagguuaaagggucucaggga

SEQ ID NO: 30726 - RNA, 22 nt, Homo sapiens
ucacaaguuagggucucaggga

SEQ ID NO: 30727 - RNA, 23 nt, Homo sapiens
agcccuguucuacagcccugagg

SEQ ID NO: 30728 - RNA, 22 nt, Homo sapiens
ggagcccgcgccccgcgccgag

SEQ ID NO: 30729 - RNA, 22 nt, Homo sapiens
ucaggaacugccuuucucucca

SEQ ID NO: 30730 - RNA, 23 nt, Homo sapiens
cuaucugcacuagaugcaccuua

SEQ ID NO: 30731 - RNA, 22 nt, Homo sapiens
ccucauggaaggguuccccacu

SEQ ID NO: 30732 - RNA, 21 nt, Homo sapiens
acuccaaagggaagcgccuuc

SEQ ID NO: 30733 - RNA, 22 nt, Homo sapiens
cgcucuaaagggaagcgccuuc

SEQ ID NO: 30734 - RNA, 19 nt, Homo sapiens
guugggaucacaggcgccc

SEQ ID NO: 30735 - RNA, 23 nt, Homo sapiens
gggccgcagcugucgcccguguc

SEQ ID NO: 30736 - RNA, 25 nt, Homo sapiens
acggagcugucccaacaccaccccu

SEQ ID NO: 30737 - RNA, 22 nt, Homo sapiens
gcggucccgcggcgccccgccu

SEQ ID NO: 30738 - RNA, 22 nt, Homo sapiens
ugcuguuagcccuagccccgca

SEQ ID NO: 30739 - RNA, 22 nt, Homo sapiens
ucggucccucgggccagggcag

SEQ ID NO: 30740 - RNA, 20 nt, Homo sapiens
uacugcuuccacagcucccc

SEQ ID NO: 30741 - RNA, 22 nt, Homo sapiens
gcacaaaucuccagaccaccca

SEQ ID NO: 30742 - RNA, 21 nt, Homo sapiens
ccgugguucuacccuguggua

SEQ ID NO: 30743 - RNA, 23 nt, Homo sapiens
accccuaucacgauuagcauuaa

SEQ ID NO: 30744 - RNA, 23 nt, Homo sapiens
cuaccugcacuguaagcacuuug

SEQ ID NO: 30745 - RNA, 22 nt, Homo sapiens
auguaugugggacgguaaacca

SEQ ID NO: 30746 - RNA, 22 nt, Homo sapiens
caacaaaaucacugaugcugga

SEQ ID NO: 30747 - RNA, 22 nt, Homo sapiens
agccacaaucaccuucugaucu

SEQ ID NO: 30748 - RNA, 21 nt, Homo sapiens
acaaaccacagugugcugcug

SEQ ID NO: 30749 - RNA, 21 nt, Homo sapiens
uagcacccagauagcaaggau

SEQ ID NO: 30750 - RNA, 22 nt, Homo sapiens
caugauugccacgucugcagua

SEQ ID NO: 30751 - RNA, 21 nt, Homo sapiens
ugauugccacugucugcagua

SEQ ID NO: 30752 - RNA, 22 nt, Homo sapiens
caacuccgauaugcaaugggua

SEQ ID NO: 30753 - RNA, 22 nt, Homo sapiens
gcugaggcuguggggcuggagu

SEQ ID NO: 30754 - RNA, 18 nt, Homo sapiens
aucacauucaccucccug

SEQ ID NO: 30755 - RNA, 22 nt, Homo sapiens
gcugccguauaugugaugucac

SEQ ID NO: 30756 - RNA, 21 nt, Homo sapiens
aaacaucacugcaagucuuaa

SEQ ID NO: 30757 - RNA, 22 nt, Homo sapiens
cuacccacagacguaccaauca

SEQ ID NO: 30758 - RNA, 21 nt, Homo sapiens
caucaccuuccuucuccucca

SEQ ID NO: 30759 - RNA, 24 nt, Homo sapiens
agugugaguucuaccauugccaaa

SEQ ID NO: 30760 - RNA, 22 nt, Homo sapiens
uggcagcagcggagggggcaga

SEQ ID NO: 30761 - RNA, 20 nt, Homo sapiens
cuggaggaagggcccagagg

SEQ ID NO: 30762 - RNA, 22 nt, Homo sapiens
gccuaagacacaggcccagaga

SEQ ID NO: 30763 - RNA, 23 nt, Homo sapiens
aaaucagaaucacaccuggggga

SEQ ID NO: 30764 - RNA, 21 nt, Homo sapiens
ugacugcagagcaaaagacac

SEQ ID NO: 30765 - RNA, 19 nt, Homo sapiens
auuuugguacagcagcuca

SEQ ID NO: 30766 - RNA, 24 nt, Homo sapiens
acgcagagcccgaaagcccccagu

SEQ ID NO: 30767 - RNA, 21 nt, Homo sapiens
caucaccuuccuucuccucca

SEQ ID NO: 30768 - RNA, 18 nt, Homo sapiens
gaaaugagggccagcuga

SEQ ID NO: 30769 - RNA, 25 nt, Homo sapiens
agcuagucaagcgcgguuguggggg

SEQ ID NO: 30770 - RNA, 22 nt, Homo sapiens
cacucagcggccguuuccccaa

SEQ ID NO: 30771 - RNA, 22 nt, Homo sapiens
acaaccagcuaagacacugcca

SEQ ID NO: 30772 - RNA, 23 nt, Homo sapiens
gcaaucagcuaacuacacugccu

SEQ ID NO: 30773 - RNA, 22 nt, Homo sapiens
accagcuaacaauacacugcca

SEQ ID NO: 30774 - RNA, 22 nt, Homo sapiens
gccagcuaacaauacacugccu

SEQ ID NO: 30775 - RNA, 19 nt, Homo sapiens
agaaaccccagcagagaca

SEQ ID NO: 30776 - RNA, 23 nt, Homo sapiens
uguaggcuggggauaaaugaaua

SEQ ID NO: 30777 - RNA, 21 nt, Homo sapiens
cggggugcacgggcggagggc

SEQ ID NO: 30778 - RNA, 21 nt, Homo sapiens
gaccaaucgccguccccgccg

SEQ ID NO: 30779 - RNA, 22 nt, Homo sapiens
uggcagcagcggagggggcaga

SEQ ID NO: 30780 - RNA, 22 nt, Homo sapiens
ucagaccgagacaagugcaaug

SEQ ID NO: 30781 - RNA, 20 nt, Homo sapiens
ccagcagcaccuggggcagu

SEQ ID NO: 30782 - RNA, 20 nt, Homo sapiens
cuggaggaagggcccagagg

SEQ ID NO: 30783 - RNA, 22 nt, Homo sapiens
gccuaagacacaggcccagaga

SEQ ID NO: 30784 - RNA, 21 nt, Homo sapiens
auccuguacugagcugccccg

SEQ ID NO: 30785 - RNA, 19 nt, Homo sapiens
guccugaauuccgcagccu

SEQ ID NO: 30786 - RNA, 22 nt, Homo sapiens
gcggucccgcggcgccccgccu

SEQ ID NO: 30787 - RNA, 22 nt, Homo sapiens
ugcuguuagcccuagccccgca

SEQ ID NO: 30788 - RNA, 20 nt, Homo sapiens
uacugcuuccacagcucccc

SEQ ID NO: 30789 - RNA, 22 nt, Homo sapiens
caaacaccauugucacacucca

SEQ ID NO: 30790 - RNA, 21 nt, Homo sapiens
agcgccuuuggcagcuagagu

SEQ ID NO: 30791 - RNA, 21 nt, Homo sapiens
gaccaaucgccguccccgccg

SEQ ID NO: 30792 - RNA, 23 nt, Homo sapiens
aaagucucgcucucugccccuca

SEQ ID NO: 30793 - RNA, 22 nt, Homo sapiens
gcggucccgcggcgccccgccu

SEQ ID NO: 30794 - RNA, 22 nt, Homo sapiens
gguuaguggaccaggucacaaa

SEQ ID NO: 30795 - RNA, 21 nt, Homo sapiens
aucugcacugucagcacuuua

SEQ ID NO: 30796 - RNA, 18 nt, Homo sapiens
ggagaggagggcacugga

SEQ ID NO: 30797 - RNA, 19 nt, Homo sapiens
auuuugguacagcagcuca

SEQ ID NO: 30798 - RNA, 21 nt, Homo sapiens
aguucucccaacguaaaccca

SEQ ID NO: 30799 - RNA, 22 nt, Homo sapiens
ggcagagagucagagcgcggau

SEQ ID NO: 30800 - RNA, 24 nt, Homo sapiens
cacccccagagccucagcucccca

SEQ ID NO: 30801 - RNA, 22 nt, Homo sapiens
caaacaccauugucacacucca

SEQ ID NO: 30802 - RNA, 23 nt, Homo sapiens
gggagugaagacacggagccaga

SEQ ID NO: 30803 - RNA, 23 nt, Homo sapiens
aggaacagcagcagcccgggccg

SEQ ID NO: 30804 - RNA, 21 nt, Homo sapiens
gaccaaucgccguccccgccg

SEQ ID NO: 30805 - RNA, 21 nt, Homo sapiens
acaggauugagggggggcccu

SEQ ID NO: 30806 - RNA, 22 nt, Homo sapiens
auaaggauuuuuaggggcauua

SEQ ID NO: 30807 - RNA, 22 nt, Homo sapiens
gcggucccgcggcgccccgccu

SEQ ID NO: 30808 - RNA, 22 nt, Homo sapiens
ugcuguuagcccuagccccgca

SEQ ID NO: 30809 - RNA, 21 nt, Homo sapiens
ccccucccagccucccugcca

SEQ ID NO: 30810 - RNA, 19 nt, Homo sapiens
ccaccucccgaguccucac

SEQ ID NO: 30811 - RNA, 17 nt, Homo sapiens
gggagaggaggaggcga

SEQ ID NO: 30812 - RNA, 22 nt, Homo sapiens
ucaggaacugccuuucucucca

SEQ ID NO: 30813 - RNA, 21 nt, Homo sapiens
gaccaaucgccguccccgccg

SEQ ID NO: 30814 - RNA, 22 nt, Homo sapiens
cggugagcacccggccccugcg

SEQ ID NO: 30815 - RNA, 21 nt, Homo sapiens
acaggauugagggggggcccu

SEQ ID NO: 30816 - RNA, 20 nt, Homo sapiens
cuggaggaagggcccagagg

SEQ ID NO: 30817 - RNA, 22 nt, Homo sapiens
gccuaagacacaggcccagaga

SEQ ID NO: 30818 - RNA, 22 nt, Homo sapiens
aaucagucucauugcuuuauaa

SEQ ID NO: 30819 - RNA, 23 nt, Homo sapiens
aaaucagaaucacaccuggggga

SEQ ID NO: 30820 - RNA, 22 nt, Homo sapiens
gaauucaucacggccagccucu

SEQ ID NO: 30821 - RNA, 24 nt, Homo sapiens
acgcagagcccgaaagcccccagu

SEQ ID NO: 30822 - RNA, 22 nt, Homo sapiens
gcggucccgcggcgccccgccu

SEQ ID NO: 30823 - RNA, 22 nt, Homo sapiens
caaacaccauugucacacucca

SEQ ID NO: 30824 - RNA, 21 nt, Homo sapiens
cggggugcacgggcggagggc

SEQ ID NO: 30825 - RNA, 21 nt, Homo sapiens
gaccaaucgccguccccgccg

SEQ ID NO: 30826 - RNA, 22 nt, Homo sapiens
aguccagauucugugcccacca

SEQ ID NO: 30827 - RNA, 22 nt, Homo sapiens
gcacauguucugcggcccacca

SEQ ID NO: 30828 - RNA, 25 nt, Homo sapiens
accaacggaccuacuucccuccgcc

SEQ ID NO: 30829 - RNA, 23 nt, Homo sapiens
cacugugggcccucuccgcacca

SEQ ID NO: 30830 - RNA, 22 nt, Homo sapiens
ugcuguuagcccuagccccgca

SEQ ID NO: 30831 - RNA, 23 nt, Homo sapiens
gcacaugugcacacagccgggug

SEQ ID NO: 30832 - RNA, 21 nt, Homo sapiens
cucccccacugcagcuggcac

SEQ ID NO: 30833 - RNA, 22 nt, Homo sapiens
cugggggcggcacaggggcuca

SEQ ID NO: 30834 - RNA, 22 nt, Homo sapiens
caaacaccauugucacacucca

SEQ ID NO: 30835 - RNA, 22 nt, Homo sapiens
ugagugcuugcuaggugccaag

SEQ ID NO: 30836 - RNA, 17 nt, Homo sapiens
gggagaggaggaggcga

SEQ ID NO: 30837 - RNA, 18 nt, Homo sapiens
aucacauucaccucccug

SEQ ID NO: 30838 - RNA, 23 nt, Homo sapiens
gggagugaagacacggagccaga

SEQ ID NO: 30839 - RNA, 23 nt, Homo sapiens
aggaacagcagcagcccgggccg

SEQ ID NO: 30840 - RNA, 22 nt, Homo sapiens
ucaggaacugccuuucucucca

SEQ ID NO: 30841 - RNA, 21 nt, Homo sapiens
gaccaaucgccguccccgccg

SEQ ID NO: 30842 - RNA, 22 nt, Homo sapiens
ucagaccgagacaagugcaaug

SEQ ID NO: 30843 - RNA, 23 nt, Homo sapiens
aaucgcgguuuauaccaaaugaa

SEQ ID NO: 30844 - RNA, 24 nt, Homo sapiens
acgcgcaggccagagacccaggca

SEQ ID NO: 30845 - RNA, 22 nt, Homo sapiens
gcggucccgcggcgccccgccu

SEQ ID NO: 30846 - RNA, 22 nt, Homo sapiens
ugcuguuagcccuagccccgca

SEQ ID NO: 30847 - RNA, 23 nt, Homo sapiens
agcaaaaaugugcuagugccaaa

SEQ ID NO: 30848 - RNA, 22 nt, Homo sapiens
cugggggcggcacaggggcuca

SEQ ID NO: 30849 - RNA, 17 nt, Homo sapiens
gacagccucucccccac

SEQ ID NO: 30850 - RNA, 17 nt, Homo sapiens
gggagaggaggaggcga

SEQ ID NO: 30851 - RNA, 21 nt, Homo sapiens
ugcaaacccugcaugugggag

SEQ ID NO: 30852 - RNA, 21 nt, Homo sapiens
gaccaaucgccguccccgccg

SEQ ID NO: 30853 - RNA, 22 nt, Homo sapiens
agcgggacuuugagggccaguu

SEQ ID NO: 30854 - RNA, 22 nt, Homo sapiens
cuagugguccuaaacauuucac

SEQ ID NO: 30855 - RNA, 22 nt, Homo sapiens
cagacuccgguggaaugaagga

SEQ ID NO: 30856 - RNA, 22 nt, Homo sapiens
acugccugucugugccugcugu

SEQ ID NO: 30857 - RNA, 23 nt, Homo sapiens
gaaacccagcagacaauguagcu

SEQ ID NO: 30858 - RNA, 23 nt, Homo sapiens
cggcucugucgucgaggcgcuca

SEQ ID NO: 30859 - RNA, 22 nt, Homo sapiens
accagguuccaccccagcaggc

SEQ ID NO: 30860 - RNA, 21 nt, Homo sapiens
acuccaaagggaagcgccuuc

SEQ ID NO: 30861 - RNA, 22 nt, Homo sapiens
cgcucuaaagggaagcgccuuc

SEQ ID NO: 30862 - RNA, 22 nt, Homo sapiens
ugcaagccuugggugugggagg

SEQ ID NO: 30863 - RNA, 23 nt, Homo sapiens
ccaccuggcaagaacaggcguuc

SEQ ID NO: 30864 - RNA, 22 nt, Homo sapiens
gcggucccgcggcgccccgccu

SEQ ID NO: 30865 - RNA, 22 nt, Homo sapiens
cacucuaaagggaggcacuuug

SEQ ID NO: 30866 - RNA, 22 nt, Homo sapiens
gggagaggucucccugcgcaca

SEQ ID NO: 30867 - RNA, 23 nt, Homo sapiens
aggaacagcagcagcccgggccg

SEQ ID NO: 30868 - RNA, 18 nt, Homo sapiens
ggagaggagggcacugga

SEQ ID NO: 30869 - RNA, 23 nt, Homo sapiens
acacucaaaagauggcggcacuu

SEQ ID NO: 30870 - RNA, 22 nt, Homo sapiens
aagagggagacccaggcucgga

SEQ ID NO: 30871 - RNA, 21 nt, Homo sapiens
caucaccuuccuucuccucca

SEQ ID NO: 30872 - RNA, 23 nt, Homo sapiens
gggagugaagacacggagccaga

SEQ ID NO: 30873 - RNA, 22 nt, Homo sapiens
aggaaaccagcaaguguugacg

SEQ ID NO: 30874 - RNA, 20 nt, Homo sapiens
ggggcagacagacgaggaag

SEQ ID NO: 30875 - RNA, 22 nt, Homo sapiens
cacgaccgacgccacgccgagu

SEQ ID NO: 30876 - RNA, 22 nt, Homo sapiens
ggagcccgcgccccgcgccgag

SEQ ID NO: 30877 - RNA, 21 nt, Homo sapiens
acuagacugugagcuccucga

SEQ ID NO: 30878 - RNA, 21 nt, Homo sapiens
gaccaaucgccguccccgccg

SEQ ID NO: 30879 - RNA, 21 nt, Homo sapiens
agagcucauccauaguuguca

SEQ ID NO: 30880 - RNA, 23 nt, Homo sapiens
aaaucagaaucacaccuggggga

SEQ ID NO: 30881 - RNA, 22 nt, Homo sapiens
cuacccacagacguaccaauca

SEQ ID NO: 30882 - RNA, 21 nt, Homo sapiens
agacacaccacggcacacuuc

SEQ ID NO: 30883 - RNA, 24 nt, Homo sapiens
acgcagagcccgaaagcccccagu

SEQ ID NO: 30884 - RNA, 19 nt, Homo sapiens
accagugcccugcacacuu

SEQ ID NO: 30885 - RNA, 22 nt, Homo sapiens
uggggacccucccugaaccaag

SEQ ID NO: 30886 - RNA, 22 nt, Homo sapiens
gcggucccgcggcgccccgccu

SEQ ID NO: 30887 - RNA, 22 nt, Homo sapiens
ugcuguuagcccuagccccgca

SEQ ID NO: 30888 - RNA, 26 nt, Homo sapiens
uuucagaauuugcugccaucaucauc

SEQ ID NO: 30889 - RNA, 24 nt, Homo sapiens
gaagucacucccaggcagcugcaa

SEQ ID NO: 30890 - RNA, 23 nt, Homo sapiens
ucacauaggaauaaaaagccaua

SEQ ID NO: 30891 - RNA, 23 nt, Homo sapiens
ucacauaggaaugaaaagccaua

SEQ ID NO: 30892 - RNA, 23 nt, Homo sapiens
ccacugaaacauggaagcacuua

SEQ ID NO: 30893 - RNA, 22 nt, Homo sapiens
ucaguuuccucugcaaacaguu

SEQ ID NO: 30894 - RNA, 21 nt, Homo sapiens
acuagcuuauacauaaaauua

SEQ ID NO: 30895 - RNA, 22 nt, Homo sapiens
cacgaccgacgccacgccgagu

SEQ ID NO: 30896 - RNA, 22 nt, Homo sapiens
uagucaagugaagcagugggag

SEQ ID NO: 30897 - RNA, 22 nt, Homo sapiens
ucagaccgagacaagugcaaug

SEQ ID NO: 30898 - RNA, 23 nt, Homo sapiens
acaccaaugcccuaggggaugcg

SEQ ID NO: 30899 - RNA, 22 nt, Homo sapiens
ucaguuuccucugcaaacaguu

SEQ ID NO: 30900 - RNA, 23 nt, Homo sapiens
ugcgaacucaccacggacaaccu

SEQ ID NO: 30901 - RNA, 22 nt, Homo sapiens
uccagcaaagggaagcgcuuuc

SEQ ID NO: 30902 - RNA, 22 nt, Homo sapiens
accucuaaaggggagcgcuuug

SEQ ID NO: 30903 - RNA, 23 nt, Homo sapiens
acacucuaaagagaagcgcuuug

SEQ ID NO: 30904 - RNA, 21 nt, Homo sapiens
gcuccaaagggaagcgcuuug

SEQ ID NO: 30905 - RNA, 21 nt, Homo sapiens
ccucuaaagagaagcgcuuuc

SEQ ID NO: 30906 - RNA, 19 nt, Homo sapiens
ucccacaggaagcagacac

SEQ ID NO: 30907 - RNA, 22 nt, Homo sapiens
gugggguggguggucaggccga

SEQ ID NO: 30908 - RNA, 22 nt, Homo sapiens
agacaacaaugccaaccucaca

SEQ ID NO: 30909 - RNA, 22 nt, Homo sapiens
ucaggaacugccuuucucucca

SEQ ID NO: 30910 - RNA, 22 nt, Homo sapiens
ugagccacugugccuggccuga

SEQ ID NO: 30911 - RNA, 23 nt, Homo sapiens
gaaacccagcagacaauguagcu

SEQ ID NO: 30912 - RNA, 21 nt, Homo sapiens
uucuaggauaggcccaggggc

SEQ ID NO: 30913 - RNA, 22 nt, Homo sapiens
cugcucaaacccuccaaugacu

SEQ ID NO: 30914 - RNA, 23 nt, Homo sapiens
agcaaaaaugugcuagugccaaa

SEQ ID NO: 30915 - RNA, 23 nt, Homo sapiens
ggaagccaucaagucgcugcagg

SEQ ID NO: 30916 - RNA, 20 nt, Homo sapiens
cucaaagcaaacccugcaga

SEQ ID NO: 30917 - RNA, 24 nt, Homo sapiens
gaagucacucccaggcagcugcaa

SEQ ID NO: 30918 - RNA, 23 nt, Homo sapiens
uccauaaaguaggaaacacuaca

SEQ ID NO: 30919 - RNA, 22 nt, Homo sapiens
aacccauggaauucaguucuca

SEQ ID NO: 30920 - RNA, 22 nt, Homo sapiens
gaucacuuuugugacuaugcaa

SEQ ID NO: 30921 - RNA, 21 nt, Homo sapiens
caugcacaugcacacauacau

SEQ ID NO: 30922 - RNA, 21 nt, Homo sapiens
gaccaagaaauagccuuucaa

SEQ ID NO: 30923 - RNA, 19 nt, Homo sapiens
auuuugguacagcagcuca

SEQ ID NO: 30924 - RNA, 23 nt, Homo sapiens
gggccgcagcugucgcccguguc

SEQ ID NO: 30925 - RNA, 23 nt, Homo sapiens
cuaacugcacuagaugcaccuua

SEQ ID NO: 30926 - RNA, 22 nt, Homo sapiens
uuaacagcuaagcacccuaauc

SEQ ID NO: 30927 - RNA, 22 nt, Homo sapiens
aagauguggaccauauuacaua

SEQ ID NO: 30928 - RNA, 23 nt, Homo sapiens
aaucgcgguuuauaccaaaugaa

SEQ ID NO: 30929 - RNA, 21 nt, Homo sapiens
cugggggacggagcagaagga

SEQ ID NO: 30930 - RNA, 21 nt, Homo sapiens
aaaggccacauccagcaccgu

SEQ ID NO: 30931 - RNA, 22 nt, Homo sapiens
cagcugguugaaggggaccaaa

SEQ ID NO: 30932 - RNA, 22 nt, Homo sapiens
uagcugguugaaggggaccaaa

SEQ ID NO: 30933 - RNA, 23 nt, Homo sapiens
gaaacccagcagacaauguagcu

SEQ ID NO: 30934 - RNA, 22 nt, Homo sapiens
ucagaccgagacaagugcaaug

SEQ ID NO: 30935 - RNA, 24 nt, Homo sapiens
ugggagaaccucccugcuucugcu

SEQ ID NO: 30936 - RNA, 23 nt, Homo sapiens
ucaccaaaacauggaagcacuua

SEQ ID NO: 30937 - RNA, 23 nt, Homo sapiens
cuacuaaaacauggaagcacuua

SEQ ID NO: 30938 - RNA, 23 nt, Homo sapiens
ccacugaaacauggaagcacuua

SEQ ID NO: 30939 - RNA, 23 nt, Homo sapiens
acacucaaacauggaagcacuua

SEQ ID NO: 30940 - RNA, 17 nt, Homo sapiens
aagcauggaagcacuua

SEQ ID NO: 30941 - RNA, 21 nt, Homo sapiens
uucuaggauaggcccaggggc

SEQ ID NO: 30942 - RNA, 22 nt, Homo sapiens
acaaccagcuaagacacugcca

SEQ ID NO: 30943 - RNA, 23 nt, Homo sapiens
acgcucaaaugucgcagcacuuu

SEQ ID NO: 30944 - RNA, 23 nt, Homo sapiens
acaccccaaaaucgaagcacuuc

SEQ ID NO: 30945 - RNA, 22 nt, Homo sapiens
cuacccacagacguaccaauca

SEQ ID NO: 30946 - RNA, 22 nt, Homo sapiens
acaguccaaagggaagcacuuu

SEQ ID NO: 30947 - RNA, 21 nt, Homo sapiens
cccucuaaaaggaagcacuuu

SEQ ID NO: 30948 - RNA, 22 nt, Homo sapiens
acccucuaaaaggaagcacuuu

SEQ ID NO: 30949 - RNA, 22 nt, Homo sapiens
acccaccaaagagaagcacuuu

SEQ ID NO: 30950 - RNA, 21 nt, Homo sapiens
cccucaaaaaggaagcacuuu

SEQ ID NO: 30951 - RNA, 22 nt, Homo sapiens
aacccucuaaaaggaagcacuu

SEQ ID NO: 30952 - RNA, 23 nt, Homo sapiens
ugcgggcgggacgagcaagcaca

SEQ ID NO: 30953 - RNA, 22 nt, Homo sapiens
ccucaggcacggccgggccacc

SEQ ID NO: 30954 - RNA, 21 nt, Homo sapiens
caucaccuuccuucuccucca

SEQ ID NO: 30955 - RNA, 22 nt, Homo sapiens
gaggcucagaauggcucaggag

SEQ ID NO: 30956 - RNA, 20 nt, Homo sapiens
cuggggaaaaggguggcacg

SEQ ID NO: 30957 - RNA, 22 nt, Homo sapiens
cuggagagacaaggggaagagg

SEQ ID NO: 30958 - RNA, 22 nt, Homo sapiens
uccggggacgaacgggacgggu

SEQ ID NO: 30959 - RNA, 22 nt, Homo sapiens
agcuagugagaagucaaugccu

SEQ ID NO: 30960 - RNA, 21 nt, Homo sapiens
ugcaaacccugcaugugggag

SEQ ID NO: 30961 - RNA, 22 nt, Homo sapiens
cuguuccugcugaacugagcca

SEQ ID NO: 30962 - RNA, 22 nt, Homo sapiens
ucagaccgagacaagugcaaug

SEQ ID NO: 30963 - RNA, 22 nt, Homo sapiens
ugcaacuuaguaaugugcaaua

SEQ ID NO: 30964 - RNA, 22 nt, Homo sapiens
uacagauggauaccgugcaauu

SEQ ID NO: 30965 - RNA, 22 nt, Homo sapiens
ucaccauugcuaaagugcaauu

SEQ ID NO: 30966 - RNA, 22 nt, Homo sapiens
ccucauggaaggguuccccacu

SEQ ID NO: 30967 - RNA, 25 nt, Homo sapiens
acggagcugucccaacaccaccccu

SEQ ID NO: 30968 - RNA, 22 nt, Homo sapiens
acaggccgggacaagugcaaua

SEQ ID NO: 30969 - RNA, 20 nt, Homo sapiens
uacugcuuccacagcucccc

SEQ ID NO: 30970 - RNA, 22 nt, Homo sapiens
ggaggccgggacgagugcaaua

SEQ ID NO: 30971 - RNA, 22 nt, Homo sapiens
ggaggccgggacgagugcaaua

SEQ ID NO: 30972 - RNA, 22 nt, Homo sapiens
cacauggccaaaacagagaaga

SEQ ID NO: 30973 - RNA, 21 nt, Homo sapiens
cucccccacugcagcuggcac

SEQ ID NO: 30974 - RNA, 23 nt, Homo sapiens
cugugggagggcaguggugagag

SEQ ID NO: 30975 - RNA, 20 nt, Homo sapiens
ggcauucaccgcgugccuua

SEQ ID NO: 30976 - RNA, 22 nt, Homo sapiens
uaaaugaauucaauuuccuucu

SEQ ID NO: 30977 - RNA, 22 nt, Homo sapiens
aggucucacuuuguugcccaga

SEQ ID NO: 30978 - RNA, 24 nt, Homo sapiens
acugcuggucuucagucagggcca

SEQ ID NO: 30979 - RNA, 22 nt, Homo sapiens
agacaacaaugccaaccucaca

SEQ ID NO: 30980 - RNA, 18 nt, Homo sapiens
cagcagccuccuucucaa

SEQ ID NO: 30981 - RNA, 22 nt, Homo sapiens
cucaauagacugugagcuccuu

SEQ ID NO: 30982 - RNA, 21 nt, Homo sapiens
acaggauugagggggggcccu

SEQ ID NO: 30983 - RNA, 21 nt, Homo sapiens
ucuacucagaagggugccuua

SEQ ID NO: 30984 - RNA, 23 nt, Homo sapiens
caugagugacgcccucuggagua

SEQ ID NO: 30985 - RNA, 25 nt, Homo sapiens
aaggagcucagaagcccugcccagc

SEQ ID NO: 30986 - RNA, 19 nt, Homo sapiens
gccucagaggcagcugcuu

SEQ ID NO: 30987 - RNA, 23 nt, Homo sapiens
cccagcuagauuguaagcuccuu

SEQ ID NO: 30988 - RNA, 22 nt, Homo sapiens
gcugaggcuguggggcuggagu

SEQ ID NO: 30989 - RNA, 22 nt, Homo sapiens
cacauggccaaaacagagaaga

SEQ ID NO: 30990 - RNA, 23 nt, Homo sapiens
cuaccugcacuguaagcacuuuu

SEQ ID NO: 30991 - RNA, 22 nt, Homo sapiens
agcuagugagaagucaaugccu

SEQ ID NO: 30992 - RNA, 17 nt, Homo sapiens
caccugaauuacuugaa

SEQ ID NO: 30993 - RNA, 22 nt, Homo sapiens
agugaauucuaccagugccaua

SEQ ID NO: 30994 - RNA, 21 nt, Homo sapiens
acccaguagccagauguagcu

SEQ ID NO: 30995 - RNA, 22 nt, Homo sapiens
ucagaccgagacaagugcaaug

SEQ ID NO: 30996 - RNA, 21 nt, Homo sapiens
accuauccugaauuacuugaa

SEQ ID NO: 30997 - RNA, 22 nt, Homo sapiens
ugcaacuuaguaaugugcaaua

SEQ ID NO: 30998 - RNA, 22 nt, Homo sapiens
uacagauggauaccgugcaauu

SEQ ID NO: 30999 - RNA, 22 nt, Homo sapiens
ucaccauugcuaaagugcaauu

SEQ ID NO: 31000 - RNA, 20 nt, Homo sapiens
gaaagggcuucccuuugcag

SEQ ID NO: 31001 - RNA, 20 nt, Homo sapiens
gaaagggcuucccuuugcag

SEQ ID NO: 31002 - RNA, 21 nt, Homo sapiens
guaaugggaccuuccucuuug

SEQ ID NO: 31003 - RNA, 22 nt, Homo sapiens
gccaccuucaaaugggaagucu

SEQ ID NO: 31004 - RNA, 22 nt, Homo sapiens
acaggccgggacaagugcaaua

SEQ ID NO: 31005 - RNA, 22 nt, Homo sapiens
ggaggccgggacgagugcaaua

SEQ ID NO: 31006 - RNA, 22 nt, Homo sapiens
cugcgauuccucccucuacugu

SEQ ID NO: 31007 - RNA, 21 nt, Homo sapiens
cugaggagagaggaggugggg

SEQ ID NO: 31008 - RNA, 20 nt, Homo sapiens
cuggggaaaaggguggcacg

SEQ ID NO: 31009 - RNA, 24 nt, Homo sapiens
acugcaggcuccagcuuccaggcu

SEQ ID NO: 31010 - RNA, 18 nt, Homo sapiens
ugguggcagaggugggau

SEQ ID NO: 31011 - RNA, 23 nt, Homo sapiens
cggccugauucacaacaccagcu

SEQ ID NO: 31012 - RNA, 22 nt, Homo sapiens
cacugguacaaggguugggaga

SEQ ID NO: 31013 - RNA, 22 nt, Homo sapiens
accuaauauaucaaacauauca

SEQ ID NO: 31014 - RNA, 24 nt, Homo sapiens
ugggagaaccucccugcuucugcu

SEQ ID NO: 31015 - RNA, 22 nt, Homo sapiens
agcugaguguaggauguuuaca

SEQ ID NO: 31016 - RNA, 23 nt, Homo sapiens
ucaacgggagugaucgugucauu

SEQ ID NO: 31017 - RNA, 22 nt, Homo sapiens
aucgggaggggacugagccuga

SEQ ID NO: 31018 - RNA, 21 nt, Homo sapiens
guucuaacccauuguggccaa

SEQ ID NO: 31019 - RNA, 22 nt, Homo sapiens
gccaccuucaaaugggaagucu

SEQ ID NO: 31020 - RNA, 23 nt, Homo sapiens
uguaggcuggggauaaaugaaua

SEQ ID NO: 31021 - RNA, 21 nt, Homo sapiens
gggcaucugggacgcgcagga

SEQ ID NO: 31022 - RNA, 22 nt, Homo sapiens
cggugagcacccggccccugcg

SEQ ID NO: 31023 - RNA, 22 nt, Homo sapiens
cagaagugggccgggcacaggg

SEQ ID NO: 31024 - RNA, 22 nt, Homo sapiens
agucuucacaacagcccugugu

SEQ ID NO: 31025 - RNA, 22 nt, Homo sapiens
ugcuguuagcccuagccccgca

SEQ ID NO: 31026 - RNA, 22 nt, Homo sapiens
gggagaggucucccugcgcaca

SEQ ID NO: 31027 - RNA, 22 nt, Homo sapiens
cacaagaucggaucuacggguu

SEQ ID NO: 31028 - RNA, 22 nt, Homo sapiens
cgcaaggucgguucuacgggug

SEQ ID NO: 31029 - RNA, 22 nt, Homo sapiens
cuggagagacaaggggaagagg

SEQ ID NO: 31030 - RNA, 25 nt, Homo sapiens
cagcgucugccggaacccguuccca

SEQ ID NO: 31031 - RNA, 23 nt, Homo sapiens
augcaaaguugcucggguaaccu

SEQ ID NO: 31032 - RNA, 22 nt, Homo sapiens
cuacccacagacguaccaauca

SEQ ID NO: 31033 - RNA, 22 nt, Homo sapiens
gguaaaacucgcaauuacuuuu

SEQ ID NO: 31034 - RNA, 22 nt, Homo sapiens
ggccaaaaccacaauuacuuuu

SEQ ID NO: 31035 - RNA, 22 nt, Homo sapiens
ggcaaaaaccgcaauuacuuuu

SEQ ID NO: 31036 - RNA, 22 nt, Homo sapiens
ggcaaaaaccacaauuacuuuu

SEQ ID NO: 31037 - RNA, 22 nt, Homo sapiens
gacaaaaaccgcgauuacuuuu

SEQ ID NO: 31038 - RNA, 22 nt, Homo sapiens
ggcaaaauccgcaauuacuuuu

SEQ ID NO: 31039 - RNA, 22 nt, Homo sapiens
accaaagaccgcaauuacuuuu

SEQ ID NO: 31040 - RNA, 21 nt, Homo sapiens
uuuuggugcauauuuacuuua

SEQ ID NO: 31041 - RNA, 21 nt, Homo sapiens
guucuaacccauuguggccaa

SEQ ID NO: 31042 - RNA, 20 nt, Homo sapiens
cccugcgccaucuccucuac

SEQ ID NO: 31043 - RNA, 23 nt, Homo sapiens
gucacaucccucccaagacccuc

SEQ ID NO: 31044 - RNA, 23 nt, Homo sapiens
aaucuacuuucuuugcucauccu

SEQ ID NO: 31045 - RNA, 22 nt, Homo sapiens
aaccacuuucuuugcucauccg

SEQ ID NO: 31046 - RNA, 18 nt, Homo sapiens
ugguggcagaggugggau

SEQ ID NO: 31047 - RNA, 24 nt, Homo sapiens
acugcuggucuucagucagggcca

SEQ ID NO: 31048 - RNA, 25 nt, Homo sapiens
cagcgucugccggaacccguuccca

SEQ ID NO: 31049 - RNA, 21 nt, Homo sapiens
cggggugcacgggcggagggc

SEQ ID NO: 31050 - RNA, 22 nt, Homo sapiens
cggugagcacccggccccugcg

SEQ ID NO: 31051 - RNA, 22 nt, Homo sapiens
acugggacuuuguaggccaguu

SEQ ID NO: 31052 - RNA, 22 nt, Homo sapiens
agcgggacuuugagggccaguu

SEQ ID NO: 31053 - RNA, 22 nt, Homo sapiens
acugccugucugugccugcugu

SEQ ID NO: 31054 - RNA, 21 nt, Homo sapiens
acaggauugagggggggcccu

SEQ ID NO: 31055 - RNA, 22 nt, Homo sapiens
ucgcccucucaacccagcuuuu

SEQ ID NO: 31056 - RNA, 22 nt, Homo sapiens
uugcccucucaacccagcuuuu

SEQ ID NO: 31057 - RNA, 20 nt, Homo sapiens
acccucucaacccagcuuuu

SEQ ID NO: 31058 - RNA, 19 nt, Homo sapiens
uccucucaacccagcuuuu

SEQ ID NO: 31059 - RNA, 22 nt, Homo sapiens
accagguuccaccccagcaggc

SEQ ID NO: 31060 - RNA, 22 nt, Homo sapiens
auaaacgacaccuccuugagaa

SEQ ID NO: 31061 - RNA, 23 nt, Homo sapiens
acagaaagugcuucccucaagag

SEQ ID NO: 31062 - RNA, 21 nt, Homo sapiens
ggacuauagaacuuucccccu

SEQ ID NO: 31063 - RNA, 20 nt, Homo sapiens
uacugcuuccacagcucccc

SEQ ID NO: 31064 - RNA, 21 nt, Homo sapiens
ccgugguucuacccuguggua

SEQ ID NO: 31065 - RNA, 23 nt, Homo sapiens
gaacagguagucugaacacuggg

SEQ ID NO: 31066 - RNA, 23 nt, Homo sapiens
gaacagauagucuaaacacuggg

SEQ ID NO: 31067 - RNA, 22 nt, Homo sapiens
uccggggacgaacgggacgggu

SEQ ID NO: 31068 - RNA, 22 nt, Homo sapiens
auccuucuacaaauucacccau

SEQ ID NO: 31069 - RNA, 22 nt, Homo sapiens
ggagauggagccagggcccuaa

SEQ ID NO: 31070 - RNA, 21 nt, Homo sapiens
gaccaaucgccguccccgccg

SEQ ID NO: 31071 - RNA, 22 nt, Homo sapiens
ucagaccgagacaagugcaaug

SEQ ID NO: 31072 - RNA, 25 nt, Homo sapiens
accaacggaccuacuucccuccgcc

SEQ ID NO: 31073 - RNA, 22 nt, Homo sapiens
gcggucccgcggcgccccgccu

SEQ ID NO: 31074 - RNA, 21 nt, Homo sapiens
caucaccuuccuucuccucca

SEQ ID NO: 31075 - RNA, 21 nt, Homo sapiens
aagggucaguaagcacccgcg

SEQ ID NO: 31076 - RNA, 21 nt, Homo sapiens
aagggucaguaagcacccgcg

SEQ ID NO: 31077 - RNA, 22 nt, Homo sapiens
ggaggccgggacgagugcaaua

SEQ ID NO: 31078 - RNA, 24 nt, Homo sapiens
cacccccagagccucagcucccca

SEQ ID NO: 31079 - RNA, 19 nt, Homo sapiens
ucccacaggaagcagacac

SEQ ID NO: 31080 - RNA, 22 nt, Homo sapiens
gcggucccgcggcgccccgccu

SEQ ID NO: 31081 - RNA, 24 nt, Homo sapiens
ucacagguuaaagggucucaggga

SEQ ID NO: 31082 - RNA, 22 nt, Homo sapiens
ucacaaguuagggucucaggga

SEQ ID NO: 31083 - RNA, 18 nt, Homo sapiens
ugguggcagaggugggau

SEQ ID NO: 31084 - RNA, 23 nt, Homo sapiens
agcccuguucuacagcccugagg

SEQ ID NO: 31085 - RNA, 23 nt, Homo sapiens
acacagcucuuccauaucuccag

SEQ ID NO: 31086 - RNA, 22 nt, Homo sapiens
cagcugguugaaggggaccaaa

SEQ ID NO: 31087 - RNA, 22 nt, Homo sapiens
uagcugguugaaggggaccaaa

SEQ ID NO: 31088 - RNA, 23 nt, Homo sapiens
uccaucaucaaaacaaauggagu

SEQ ID NO: 31089 - RNA, 23 nt, Homo sapiens
gggagugaagacacggagccaga

SEQ ID NO: 31090 - RNA, 21 nt, Homo sapiens
gggcaucugggacgcgcagga

SEQ ID NO: 31091 - RNA, 21 nt, Homo sapiens
gaccaaucgccguccccgccg

SEQ ID NO: 31092 - RNA, 22 nt, Homo sapiens
cccaacaacaggaaacuaccua

SEQ ID NO: 31093 - RNA, 22 nt, Homo sapiens
gaaccuaucuccccucuggacc

SEQ ID NO: 31094 - RNA, 22 nt, Homo sapiens
agcugaguguaggauguuuaca

SEQ ID NO: 31095 - RNA, 23 nt, Homo sapiens
acacucuaaagagaagcgcuuug

SEQ ID NO: 31096 - RNA, 21 nt, Homo sapiens
agaaaguacuucccucuggag

SEQ ID NO: 31097 - RNA, 21 nt, Homo sapiens
agaaagugcaucccucuggag

SEQ ID NO: 31098 - RNA, 22 nt, Homo sapiens
ugcaagccuugggugugggagg

SEQ ID NO: 31099 - RNA, 20 nt, Homo sapiens
auuucuauaucuaucuccau

SEQ ID NO: 31100 - RNA, 22 nt, Homo sapiens
gcggucccgcggcgccccgccu

SEQ ID NO: 31101 - RNA, 22 nt, Homo sapiens
ugcuguuagcccuagccccgca

SEQ ID NO: 31102 - RNA, 22 nt, Homo sapiens
ccaguagcacggcucaguccag

SEQ ID NO: 31103 - RNA, 23 nt, Homo sapiens
gggagugaagacacggagccaga

SEQ ID NO: 31104 - RNA, 21 nt, Homo sapiens
gaccaaucgccguccccgccg

SEQ ID NO: 31105 - RNA, 22 nt, Homo sapiens
cagaagugggccgggcacaggg

SEQ ID NO: 31106 - RNA, 21 nt, Homo sapiens
agcuaugccagcaucuugccu

SEQ ID NO: 31107 - RNA, 23 nt, Homo sapiens
aaaucagaaucacaccuggggga

SEQ ID NO: 31108 - RNA, 21 nt, Homo sapiens
guguauaugcccauggacugc

SEQ ID NO: 31109 - RNA, 22 nt, Homo sapiens
acaaaagcaacugagguucuug

SEQ ID NO: 31110 - RNA, 25 nt, Homo sapiens
acggagcugucccaacaccaccccu

SEQ ID NO: 31111 - RNA, 22 nt, Homo sapiens
gauccgagcaccggggaccccc

SEQ ID NO: 31112 - RNA, 24 nt, Homo sapiens
acgcagagcccgaaagcccccagu

SEQ ID NO: 31113 - RNA, 22 nt, Homo sapiens
gcggucccgcggcgccccgccu

SEQ ID NO: 31114 - RNA, 20 nt, Homo sapiens
uacugcuuccacagcucccc

SEQ ID NO: 31115 - RNA, 22 nt, Homo sapiens
caaacaccauugucacacucca

SEQ ID NO: 31116 - RNA, 18 nt, Homo sapiens
aucacauucaccucccug

SEQ ID NO: 31117 - RNA, 23 nt, Homo sapiens
gggagugaagacacggagccaga

SEQ ID NO: 31118 - RNA, 21 nt, Homo sapiens
gaccaaucgccguccccgccg

SEQ ID NO: 31119 - RNA, 19 nt, Homo sapiens
uaugcuaccuuugcacggu

SEQ ID NO: 31120 - RNA, 23 nt, Homo sapiens
aaaucagaaucacaccuggggga

SEQ ID NO: 31121 - RNA, 20 nt, Homo sapiens
ugggccaccgccgagcggac

SEQ ID NO: 31122 - RNA, 22 nt, Homo sapiens
gcggucccgcggcgccccgccu

SEQ ID NO: 31123 - RNA, 20 nt, Homo sapiens
aggggccucagccuccuggu

SEQ ID NO: 31124 - RNA, 21 nt, Homo sapiens
ccccucccagccucccugcca

SEQ ID NO: 31125 - RNA, 24 nt, Homo sapiens
acugcuggucuucagucagggcca

SEQ ID NO: 31126 - RNA, 22 nt, Homo sapiens
gcacaaaucuccagaccaccca

SEQ ID NO: 31127 - RNA, 22 nt, Homo sapiens
acggaagggcagagagggccag

SEQ ID NO: 31128 - RNA, 21 nt, Homo sapiens
ugacugcagagcaaaagacac

SEQ ID NO: 31129 - RNA, 18 nt, Homo sapiens
acccucugaaaggaagca

SEQ ID NO: 31130 - RNA, 22 nt, Homo sapiens
aaagugcuucuuaccuccagau

SEQ ID NO: 31131 - RNA, 22 nt, Homo sapiens
uuucaguuaucaaucugucaca

SEQ ID NO: 31132 - RNA, 22 nt, Homo sapiens
gguuaguggaccaggucacaaa

SEQ ID NO: 31133 - RNA, 23 nt, Homo sapiens
ucauacagcuagauaaccaaaga

SEQ ID NO: 31134 - RNA, 21 nt, Homo sapiens
ggggagcgggggcccugccuu

SEQ ID NO: 31135 - RNA, 18 nt, Homo sapiens
cccccaccaccacgcccg

SEQ ID NO: 31136 - RNA, 17 nt, Homo sapiens
gggagaggaggaggcga

SEQ ID NO: 31137 - RNA, 23 nt, Homo sapiens
aggaacagcagcagcccgggccg

SEQ ID NO: 31138 - RNA, 21 nt, Homo sapiens
gaccaaucgccguccccgccg

SEQ ID NO: 31139 - RNA, 21 nt, Homo sapiens
ccuucugacuccaaguccagu

SEQ ID NO: 31140 - RNA, 23 nt, Homo sapiens
aaagucucgcucucugccccuca

SEQ ID NO: 31141 - RNA, 21 nt, Homo sapiens
aucagagguucagcuuacccu

SEQ ID NO: 31142 - RNA, 22 nt, Homo sapiens
gcggucccgcggcgccccgccu

SEQ ID NO: 31143 - RNA, 20 nt, Homo sapiens
uccccacagacccagagccg

SEQ ID NO: 31144 - RNA, 21 nt, Homo sapiens
ccccucccagccucccugcca

SEQ ID NO: 31145 - RNA, 22 nt, Homo sapiens
cuagggaacacagggcugguga

SEQ ID NO: 31146 - RNA, 21 nt, Homo sapiens
cugggggacggagcagaagga

SEQ ID NO: 31147 - RNA, 22 nt, Homo sapiens
aggucucacuuuguugcccaga

SEQ ID NO: 31148 - RNA, 21 nt, Homo sapiens
agggcucaucuugguccugca

SEQ ID NO: 31149 - RNA, 18 nt, Homo sapiens
aucacauucaccucccug

SEQ ID NO: 31150 - RNA, 23 nt, Homo sapiens
cggccugauucacaacaccagcu

SEQ ID NO: 31151 - RNA, 21 nt, Homo sapiens
ccgugguucuacccuguggua

SEQ ID NO: 31152 - RNA, 23 nt, Homo sapiens
gggagugaagacacggagccaga

SEQ ID NO: 31153 - RNA, 22 nt, Homo sapiens
ucaggaacugccuuucucucca

SEQ ID NO: 31154 - RNA, 22 nt, Homo sapiens
agcccaaaaggagaauucuuug

SEQ ID NO: 31155 - RNA, 22 nt, Homo sapiens
cagaagugggccgggcacaggg

SEQ ID NO: 31156 - RNA, 22 nt, Homo sapiens
ugagccacugugccuggccuga

SEQ ID NO: 31157 - RNA, 22 nt, Homo sapiens
cucaauagacugugagcuccuu

SEQ ID NO: 31158 - RNA, 20 nt, Homo sapiens
cuggaggaagggcccagagg

SEQ ID NO: 31159 - RNA, 22 nt, Homo sapiens
gccuaagacacaggcccagaga

SEQ ID NO: 31160 - RNA, 23 nt, Homo sapiens
aaagucucgcucucugccccuca

SEQ ID NO: 31161 - RNA, 21 nt, Homo sapiens
ugacugcagagcaaaagacac

SEQ ID NO: 31162 - RNA, 22 nt, Homo sapiens
gaacuugcuaaaaaugcagaau

SEQ ID NO: 31163 - RNA, 25 nt, Homo sapiens
aaggagcucagaagcccugcccagc

SEQ ID NO: 31164 - RNA, 22 nt, Homo sapiens
gauccgagcaccggggaccccc

SEQ ID NO: 31165 - RNA, 19 nt, Homo sapiens
aagacauuuucagacagcu

SEQ ID NO: 31166 - RNA, 23 nt, Homo sapiens
cccagcuagauuguaagcuccuu

SEQ ID NO: 31167 - RNA, 22 nt, Homo sapiens
cacucuaaagggaggcacuuug

SEQ ID NO: 31168 - RNA, 20 nt, Homo sapiens
uacugcuuccacagcucccc

SEQ ID NO: 31169 - RNA, 22 nt, Homo sapiens
gugggguggguggucaggccga

SEQ ID NO: 31170 - RNA, 17 nt, Homo sapiens
gggagaggaggaggcga

SEQ ID NO: 31171 - RNA, 22 nt, Homo sapiens
cacgaccgacgccacgccgagu

SEQ ID NO: 31172 - RNA, 22 nt, Homo sapiens
uaaccgauuucagauggugcua

SEQ ID NO: 31173 - RNA, 23 nt, Homo sapiens
aacacugauuucaaauggugcua

SEQ ID NO: 31174 - RNA, 22 nt, Homo sapiens
uaaccgauuucaaauggugcua

SEQ ID NO: 31175 - RNA, 22 nt, Homo sapiens
cuacccacagacguaccaauca

SEQ ID NO: 31176 - RNA, 19 nt, Homo sapiens
auuuugguacagcagcuca

SEQ ID NO: 31177 - RNA, 19 nt, Homo sapiens
guccugaauuccgcagccu

SEQ ID NO: 31178 - RNA, 21 nt, Homo sapiens
cucccccacugcagcuggcac

SEQ ID NO: 31179 - RNA, 22 nt, Homo sapiens
ggagcccgcgccccgcgccgag

SEQ ID NO: 31180 - RNA, 23 nt, Homo sapiens
cuaucugcacuagaugcaccuua

SEQ ID NO: 31181 - RNA, 22 nt, Homo sapiens
ucacauuugccugcagagauuu

SEQ ID NO: 31182 - RNA, 23 nt, Homo sapiens
cggcucugucgucgaggcgcuca

SEQ ID NO: 31183 - RNA, 23 nt, Homo sapiens
agaggcaggcaugcgggcagaca

SEQ ID NO: 31184 - RNA, 19 nt, Homo sapiens
agaaaccccagcagagaca

SEQ ID NO: 31185 - RNA, 21 nt, Homo sapiens
gaaggaagugagugcagccac

SEQ ID NO: 31186 - RNA, 20 nt, Homo sapiens
uccccacagacccagagccg

SEQ ID NO: 31187 - RNA, 22 nt, Homo sapiens
ucggucccucgggccagggcag

SEQ ID NO: 31188 - RNA, 22 nt, Homo sapiens
caaacaccauugucacacucca

SEQ ID NO: 31189 - RNA, 21 nt, Homo sapiens
agcgccuuuggcagcuagagu

SEQ ID NO: 31190 - RNA, 21 nt, Homo sapiens
aacggaaccacuagugacuug

SEQ ID NO: 31191 - RNA, 22 nt, Homo sapiens
auaaggauuuuuaggggcauua

SEQ ID NO: 31192 - RNA, 23 nt, Homo sapiens
aaagucucgcucucugccccuca

SEQ ID NO: 31193 - RNA, 22 nt, Homo sapiens
ccuggcacacaguagaccuuca

SEQ ID NO: 31194 - RNA, 23 nt, Homo sapiens
acagcgcucgcaaccgcagcgau

SEQ ID NO: 31195 - RNA, 20 nt, Homo sapiens
aggggccucagccuccuggu

SEQ ID NO: 31196 - RNA, 21 nt, Homo sapiens
gguggagcccugagaaccgga

SEQ ID NO: 31197 - RNA, 18 nt, Homo sapiens
auucaaucuacugccuca

SEQ ID NO: 31198 - RNA, 22 nt, Homo sapiens
acaaccagcuaagacacugcca

SEQ ID NO: 31199 - RNA, 23 nt, Homo sapiens
cugcagaacuguucccgcugcua

SEQ ID NO: 31200 - RNA, 21 nt, Homo sapiens
guaaugggaccuuccucuuug

SEQ ID NO: 31201 - RNA, 21 nt, Homo sapiens
caucaccuuccuucuccucca

SEQ ID NO: 31202 - RNA, 21 nt, Homo sapiens
ggggagcgggggcccugccuu

SEQ ID NO: 31203 - RNA, 21 nt, Homo sapiens
cucccccacugcagcuggcac

SEQ ID NO: 31204 - RNA, 22 nt, Homo sapiens
caaacaccauugucacacucca

SEQ ID NO: 31205 - RNA, 17 nt, Homo sapiens
gggagaggaggaggcga

SEQ ID NO: 31206 - RNA, 23 nt, Homo sapiens
gggagugaagacacggagccaga

SEQ ID NO: 31207 - RNA, 22 nt, Homo sapiens
ucaggaacugccuuucucucca

SEQ ID NO: 31208 - RNA, 21 nt, Homo sapiens
gaccaaucgccguccccgccg

SEQ ID NO: 31209 - RNA, 21 nt, Homo sapiens
gugacagagccaagcacaaau

SEQ ID NO: 31210 - RNA, 23 nt, Homo sapiens
aaagucucgcucucugccccuca

SEQ ID NO: 31211 - RNA, 22 nt, Homo sapiens
gaauucaucacggccagccucu

SEQ ID NO: 31212 - RNA, 24 nt, Homo sapiens
acgcgcaggccagagacccaggca

SEQ ID NO: 31213 - RNA, 22 nt, Homo sapiens
gcggucccgcggcgccccgccu

SEQ ID NO: 31214 - RNA, 23 nt, Homo sapiens
cuccagccccuccagggcuuccu

SEQ ID NO: 31215 - RNA, 22 nt, Homo sapiens
ugcuguuagcccuagccccgca

SEQ ID NO: 31216 - RNA, 21 nt, Homo sapiens
caucaccuuccuucuccucca

SEQ ID NO: 31217 - RNA, 21 nt, Homo sapiens
aucagagguucagcuuacccu

SEQ ID NO: 31218 - RNA, 21 nt, Homo sapiens
caucaccuuccuucuccucca

SEQ ID NO: 31219 - RNA, 22 nt, Homo sapiens
cuggagagacaaggggaagagg

SEQ ID NO: 31220 - RNA, 20 nt, Homo sapiens
ugucuccacagggcucuuua

SEQ ID NO: 31221 - RNA, 22 nt, Homo sapiens
uacaucuggacagccgaaugaa

SEQ ID NO: 31222 - RNA, 23 nt, Homo sapiens
aaagucucgcucucugccccuca

SEQ ID NO: 31223 - RNA, 22 nt, Homo sapiens
uuucaguuaucaaucugucaca

SEQ ID NO: 31224 - RNA, 21 nt, Homo sapiens
ggacuauagaacuuucccccu

SEQ ID NO: 31225 - RNA, 22 nt, Homo sapiens
gcugaggcuguggggcuggagu

SEQ ID NO: 31226 - RNA, 20 nt, Homo sapiens
cccugcgccaucuccucuac

SEQ ID NO: 31227 - RNA, 20 nt, Homo sapiens
cccugcgccaucuccucuac

SEQ ID NO: 31228 - RNA, 24 nt, Homo sapiens
acugcuggucuucagucagggcca

SEQ ID NO: 31229 - RNA, 24 nt, Homo sapiens
acugcuggucuucagucagggcca

SEQ ID NO: 31230 - RNA, 22 nt, Homo sapiens
ccagaacugaguccacagggca

SEQ ID NO: 31231 - RNA, 23 nt, Homo sapiens
gggagugaagacacggagccaga

SEQ ID NO: 31232 - RNA, 22 nt, Homo sapiens
uggcagcagcggagggggcaga

SEQ ID NO: 31233 - RNA, 21 nt, Homo sapiens
acaggauugagggggggcccu

SEQ ID NO: 31234 - RNA, 20 nt, Homo sapiens
ccagcagcaccuggggcagu

SEQ ID NO: 31235 - RNA, 23 nt, Homo sapiens
cgugagcuccuggaggacaggga

SEQ ID NO: 31236 - RNA, 22 nt, Homo sapiens
uacagauggauaccgugcaauu

SEQ ID NO: 31237 - RNA, 21 nt, Homo sapiens
auccuguacugagcugccccg

SEQ ID NO: 31238 - RNA, 22 nt, Homo sapiens
aggaaaccagcaaguguugacg

SEQ ID NO: 31239 - RNA, 22 nt, Homo sapiens
ugcaagccuugggugugggagg

SEQ ID NO: 31240 - RNA, 25 nt, Homo sapiens
acggagcugucccaacaccaccccu

SEQ ID NO: 31241 - RNA, 21 nt, Homo sapiens
aagggucaguaagcacccgcg

SEQ ID NO: 31242 - RNA, 20 nt, Homo sapiens
uacugcuuccacagcucccc

SEQ ID NO: 31243 - RNA, 22 nt, Homo sapiens
acacacccacgcgagccggaaa

SEQ ID NO: 31244 - RNA, 21 nt, Homo sapiens
auguaggccuuuagaucacuu

SEQ ID NO: 31245 - RNA, 22 nt, Homo sapiens
acacucuaaaaggaugcacgau

SEQ ID NO: 31246 - RNA, 22 nt, Homo sapiens
cagaagugggccgggcacaggg

SEQ ID NO: 31247 - RNA, 22 nt, Homo sapiens
ucaucauuaccaggcaguauua

SEQ ID NO: 31248 - RNA, 23 nt, Homo sapiens
uccaucauuacccggcaguauua

SEQ ID NO: 31249 - RNA, 22 nt, Homo sapiens
agucuucacaacagcccugugu

SEQ ID NO: 31250 - RNA, 22 nt, Homo sapiens
acgguuuuaccagacaguauua

SEQ ID NO: 31251 - RNA, 21 nt, Homo sapiens
acuccaaagggaagcgccuuc

SEQ ID NO: 31252 - RNA, 22 nt, Homo sapiens
cgcucuaaagggaagcgccuuc

SEQ ID NO: 31253 - RNA, 22 nt, Homo sapiens
ucaaugacucagguaaguugca

SEQ ID NO: 31254 - RNA, 22 nt, Homo sapiens
cacaagaucggaucuacggguu

SEQ ID NO: 31255 - RNA, 22 nt, Homo sapiens
cgcaaggucgguucuacgggug

SEQ ID NO: 31256 - RNA, 21 nt, Homo sapiens
agcgccuuuggcagcuagagu

SEQ ID NO: 31257 - RNA, 22 nt, Homo sapiens
gcacaaaucuccagaccaccca

SEQ ID NO: 31258 - RNA, 22 nt, Homo sapiens
acuccaacagggccgcgucucc

SEQ ID NO: 31259 - RNA, 22 nt, Homo sapiens
ugagccacugugccuggccuga

SEQ ID NO: 31260 - RNA, 23 nt, Homo sapiens
aagaaucuugucccgcagguccu

SEQ ID NO: 31261 - RNA, 22 nt, Homo sapiens
cucauauuacaaugagcucauc

SEQ ID NO: 31262 - RNA, 22 nt, Homo sapiens
ugaauuacuuuguaaaccacca

SEQ ID NO: 31263 - RNA, 22 nt, Homo sapiens
agugaauucuaccagugccaua

SEQ ID NO: 31264 - RNA, 22 nt, Homo sapiens
agugaauucuaccagugccaua

SEQ ID NO: 31265 - RNA, 22 nt, Homo sapiens
ucaggaacugccuuucucucca

SEQ ID NO: 31266 - RNA, 22 nt, Homo sapiens
uucacacugcaugcucugggua

SEQ ID NO: 31267 - RNA, 22 nt, Homo sapiens
guagaagggaaucuugcauaag

SEQ ID NO: 31268 - RNA, 22 nt, Homo sapiens
aggucucacuuuguugcccaga

SEQ ID NO: 31269 - RNA, 22 nt, Homo sapiens
agcgggacuuugagggccaguu

SEQ ID NO: 31270 - RNA, 21 nt, Homo sapiens
uagaaaggcuaggaccaaacc

SEQ ID NO: 31271 - RNA, 23 nt, Homo sapiens
ccacccaaugaccuacuccaaga

SEQ ID NO: 31272 - RNA, 24 nt, Homo sapiens
cagaaagugcuuucuuuuggagaa

SEQ ID NO: 31273 - RNA, 22 nt, Homo sapiens
aacacucuaaaaggaggcacuu

SEQ ID NO: 31274 - RNA, 25 nt, Homo sapiens
aaggagcucagaagcccugcccagc

SEQ ID NO: 31275 - RNA, 23 nt, Homo sapiens
ggacauuguuucagugcccaagu

SEQ ID NO: 31276 - RNA, 22 nt, Homo sapiens
caagacacauuuggagagggac

SEQ ID NO: 31277 - RNA, 22 nt, Homo sapiens
ccggcugcaacacaagacacga

SEQ ID NO: 31278 - RNA, 25 nt, Homo sapiens
agcuagucaagcgcgguuguggggg

SEQ ID NO: 31279 - RNA, 22 nt, Homo sapiens
agcugaguguaggauguuuaca

SEQ ID NO: 31280 - RNA, 23 nt, Homo sapiens
acauuuuucguuauugcucuuga

SEQ ID NO: 31281 - RNA, 23 nt, Homo sapiens
gaaaaacgcccccuggcuugaaa

SEQ ID NO: 31282 - RNA, 21 nt, Homo sapiens
ugacugcagagcaaaagacac

SEQ ID NO: 31283 - RNA, 21 nt, Homo sapiens
acuccaaagggaagcgccuuc

SEQ ID NO: 31284 - RNA, 22 nt, Homo sapiens
cgcucuaaagggaagcgccuuc

SEQ ID NO: 31285 - RNA, 25 nt, Homo sapiens
aggccgccacccgcccgcgaucccu

SEQ ID NO: 31286 - RNA, 21 nt, Homo sapiens
ccccucccagccucccugcca

SEQ ID NO: 31287 - RNA, 21 nt, Homo sapiens
gaccaaucgccguccccgccg

SEQ ID NO: 31288 - RNA, 22 nt, Homo sapiens
cggugagcacccggccccugcg

SEQ ID NO: 31289 - RNA, 22 nt, Homo sapiens
uggcagcagcggagggggcaga

SEQ ID NO: 31290 - RNA, 20 nt, Homo sapiens
ccagcagcaccuggggcagu

SEQ ID NO: 31291 - RNA, 21 nt, Homo sapiens
auccuguacugagcugccccg

SEQ ID NO: 31292 - RNA, 22 nt, Homo sapiens
caagacacauuuggagagggac

SEQ ID NO: 31293 - RNA, 22 nt, Homo sapiens
gcggucccgcggcgccccgccu

SEQ ID NO: 31294 - RNA, 22 nt, Homo sapiens
ugcuguuagcccuagccccgca

SEQ ID NO: 31295 - RNA, 23 nt, Homo sapiens
ggaagccaucaagucgcugcagg

SEQ ID NO: 31296 - RNA, 23 nt, Homo sapiens
ggaagccaucaagucgcugcagg

SEQ ID NO: 31297 - RNA, 22 nt, Homo sapiens
ugaagaagggggggaagggcgu

SEQ ID NO: 31298 - RNA, 21 nt, Homo sapiens
gaccaaucgccguccccgccg

SEQ ID NO: 31299 - RNA, 23 nt, Homo sapiens
cagcugcuuuugggauuccguug

SEQ ID NO: 31300 - RNA, 23 nt, Homo sapiens
aaagucucgcucucugccccuca

SEQ ID NO: 31301 - RNA, 21 nt, Homo sapiens
uagcacccagauagcaaggau

SEQ ID NO: 31302 - RNA, 21 nt, Homo sapiens
agguaagcgcuguugcuagcc

SEQ ID NO: 31303 - RNA, 24 nt, Homo sapiens
acgcgcaggccagagacccaggca

SEQ ID NO: 31304 - RNA, 22 nt, Homo sapiens
gcggucccgcggcgccccgccu

SEQ ID NO: 31305 - RNA, 22 nt, Homo sapiens
ugcuguuagcccuagccccgca

SEQ ID NO: 31306 - RNA, 21 nt, Homo sapiens
ccccucccagccucccugcca

SEQ ID NO: 31307 - RNA, 17 nt, Homo sapiens
gggagaggaggaggcga

SEQ ID NO: 31308 - RNA, 18 nt, Homo sapiens
caccaccagagccaacgu

SEQ ID NO: 31309 - RNA, 21 nt, Homo sapiens
gaccaaucgccguccccgccg

SEQ ID NO: 31310 - RNA, 22 nt, Homo sapiens
uggcagcagcggagggggcaga

SEQ ID NO: 31311 - RNA, 22 nt, Homo sapiens
uaaccgauuucagauggugcua

SEQ ID NO: 31312 - RNA, 23 nt, Homo sapiens
aacacugauuucaaauggugcua

SEQ ID NO: 31313 - RNA, 22 nt, Homo sapiens
uaaccgauuucaaauggugcua

SEQ ID NO: 31314 - RNA, 20 nt, Homo sapiens
ccagcagcaccuggggcagu

SEQ ID NO: 31315 - RNA, 22 nt, Homo sapiens
uacagauggauaccgugcaauu

SEQ ID NO: 31316 - RNA, 23 nt, Homo sapiens
aaagucucgcucucugccccuca

SEQ ID NO: 31317 - RNA, 21 nt, Homo sapiens
auccuguacugagcugccccg

SEQ ID NO: 31318 - RNA, 22 nt, Homo sapiens
gcggucccgcggcgccccgccu

SEQ ID NO: 31319 - RNA, 22 nt, Homo sapiens
ugcuguuagcccuagccccgca

SEQ ID NO: 31320 - RNA, 21 nt, Homo sapiens
cugaggagagaggaggugggg

SEQ ID NO: 31321 - RNA, 22 nt, Homo sapiens
caaacaccauugucacacucca

SEQ ID NO: 31322 - RNA, 17 nt, Homo sapiens
ggguggcagcgguggga

SEQ ID NO: 31323 - RNA, 21 nt, Homo sapiens
uuuagcauaaguaugucccaa

SEQ ID NO: 31324 - RNA, 22 nt, Homo sapiens
ucagaccgagacaagugcaaug

SEQ ID NO: 31325 - RNA, 22 nt, Homo sapiens
auaaggauuuuuaggggcauua

SEQ ID NO: 31326 - RNA, 23 nt, Homo sapiens
ccacccaaugaccuacuccaaga

SEQ ID NO: 31327 - RNA, 25 nt, Homo sapiens
accaacggaccuacuucccuccgcc

SEQ ID NO: 31328 - RNA, 20 nt, Homo sapiens
uacugcuuccacagcucccc

SEQ ID NO: 31329 - RNA, 22 nt, Homo sapiens
agacaacaaugccaaccucaca

SEQ ID NO: 31330 - RNA, 18 nt, Homo sapiens
cagcagccuccuucucaa

SEQ ID NO: 31331 - RNA, 22 nt, Homo sapiens
acaaaguucugugaugcacuga

SEQ ID NO: 31332 - RNA, 22 nt, Homo sapiens
cacaaaccauuaugugcugcua

SEQ ID NO: 31333 - RNA, 23 nt, Homo sapiens
cuaucugcacuagaugcaccuua

SEQ ID NO: 31334 - RNA, 22 nt, Homo sapiens
uagucaagugaagcagugggag

SEQ ID NO: 31335 - RNA, 21 nt, Homo sapiens
uucuaggauaggcccaggggc

SEQ ID NO: 31336 - RNA, 23 nt, Homo sapiens
acccucuauagggaagcgcguuc

SEQ ID NO: 31337 - RNA, 22 nt, Homo sapiens
ugcaagccuugggugugggagg

SEQ ID NO: 31338 - RNA, 17 nt, Homo sapiens
uggaggccccagcgaga

SEQ ID NO: 31339 - RNA, 23 nt, Homo sapiens
accacaggagucugagcauuuga

SEQ ID NO: 31340 - RNA, 22 nt, Homo sapiens
caaacaccauugucacacucca

SEQ ID NO: 31341 - RNA, 17 nt, Homo sapiens
ggguggcagcgguggga

SEQ ID NO: 31342 - RNA, 21 nt, Homo sapiens
gggcaucugggacgcgcagga

SEQ ID NO: 31343 - RNA, 21 nt, Homo sapiens
gaccaaucgccguccccgccg

SEQ ID NO: 31344 - RNA, 22 nt, Homo sapiens
cacuuagcagguuguauuauau

SEQ ID NO: 31345 - RNA, 22 nt, Homo sapiens
aguccagauucugugcccacca

SEQ ID NO: 31346 - RNA, 22 nt, Homo sapiens
gcacauguucugcggcccacca

SEQ ID NO: 31347 - RNA, 22 nt, Homo sapiens
gcggucccgcggcgccccgccu

SEQ ID NO: 31348 - RNA, 22 nt, Homo sapiens
ugcuguuagcccuagccccgca

SEQ ID NO: 31349 - RNA, 22 nt, Homo sapiens
agccaagcucagacggauccga

SEQ ID NO: 31350 - RNA, 23 nt, Homo sapiens
gggagugaagacacggagccaga

SEQ ID NO: 31351 - RNA, 20 nt, Homo sapiens
cccgccgcgucgcccugggg

SEQ ID NO: 31352 - RNA, 22 nt, Homo sapiens
cacucagcggccguuuccccaa

SEQ ID NO: 31353 - RNA, 23 nt, Homo sapiens
gaaacccagcagacaauguagcu

SEQ ID NO: 31354 - RNA, 24 nt, Homo sapiens
acucacaccuagguuccaaggauu

SEQ ID NO: 31355 - RNA, 21 nt, Homo sapiens
gaccaagaaauagccuuucaa

SEQ ID NO: 31356 - RNA, 22 nt, Homo sapiens
uccagcaaagggaagcgcuuuc

SEQ ID NO: 31357 - RNA, 22 nt, Homo sapiens
accucuaaaggggagcgcuuug

SEQ ID NO: 31358 - RNA, 23 nt, Homo sapiens
acacucuaaagagaagcgcuuug

SEQ ID NO: 31359 - RNA, 21 nt, Homo sapiens
gcuccaaagggaagcgcuuug

SEQ ID NO: 31360 - RNA, 21 nt, Homo sapiens
cacucugaagggaagcgcuuu

SEQ ID NO: 31361 - RNA, 21 nt, Homo sapiens
ccucuaaagagaagcgcuuuc

SEQ ID NO: 31362 - RNA, 22 nt, Homo sapiens
gcacacaauaaauguuugcuga

SEQ ID NO: 31363 - RNA, 21 nt, Homo sapiens
cagguaccaauauuuuaucua

SEQ ID NO: 31364 - RNA, 20 nt, Homo sapiens
ugucuccacagggcucuuua

SEQ ID NO: 31365 - RNA, 22 nt, Homo sapiens
aggcauaggaugacaaagggaa

SEQ ID NO: 31366 - RNA, 22 nt, Homo sapiens
aggcgaaggaugacaaagggaa

SEQ ID NO: 31367 - RNA, 17 nt, Homo sapiens
aaacauggaagcaauua

SEQ ID NO: 31368 - RNA, 22 nt, Homo sapiens
acuucaaggaucuuaaacuuug

SEQ ID NO: 31369 - RNA, 22 nt, Homo sapiens
caagacacauuuggagagggac

SEQ ID NO: 31370 - RNA, 21 nt, Homo sapiens
cacaaccucaguguuuccagg

SEQ ID NO: 31371 - RNA, 22 nt, Homo sapiens
uaaaugaauucaauuuccuucu

SEQ ID NO: 31372 - RNA, 18 nt, Homo sapiens
cagcagccuccuucucaa

SEQ ID NO: 31373 - RNA, 21 nt, Homo sapiens
gaccaaucgccguccccgccg

SEQ ID NO: 31374 - RNA, 23 nt, Homo sapiens
cggcucugucgucgaggcgcuca

SEQ ID NO: 31375 - RNA, 23 nt, Homo sapiens
aaaucagaaucacaccuggggga

SEQ ID NO: 31376 - RNA, 21 nt, Homo sapiens
acuccaaagggaagcgccuuc

SEQ ID NO: 31377 - RNA, 22 nt, Homo sapiens
cgcucuaaagggaagcgccuuc

SEQ ID NO: 31378 - RNA, 19 nt, Homo sapiens
guugggaucacaggcgccc

SEQ ID NO: 31379 - RNA, 19 nt, Homo sapiens
gcuccuguccaacuggcuc

SEQ ID NO: 31380 - RNA, 25 nt, Homo sapiens
accaacggaccuacuucccuccgcc

SEQ ID NO: 31381 - RNA, 24 nt, Homo sapiens
acgcgcaggccagagacccaggca

SEQ ID NO: 31382 - RNA, 22 nt, Homo sapiens
gcggucccgcggcgccccgccu

SEQ ID NO: 31383 - RNA, 22 nt, Homo sapiens
ugcuguuagcccuagccccgca

SEQ ID NO: 31384 - RNA, 21 nt, Homo sapiens
caucaccuuccuucuccucca

SEQ ID NO: 31385 - RNA, 20 nt, Homo sapiens
cugcgggaggacagggcuca

SEQ ID NO: 31386 - RNA, 22 nt, Homo sapiens
gcacaaaucuccagaccaccca

SEQ ID NO: 31387 - RNA, 22 nt, Homo sapiens
acaacuguaacuagacgguuuu

SEQ ID NO: 31388 - RNA, 21 nt, Homo sapiens
ugcaaacccugcaugugggag

SEQ ID NO: 31389 - RNA, 22 nt, Homo sapiens
gcuggguggagaagguggugaa

SEQ ID NO: 31390 - RNA, 21 nt, Homo sapiens
aagugucagacacgguggugg

SEQ ID NO: 31391 - RNA, 21 nt, Homo sapiens
acaggauugagggggggcccu

SEQ ID NO: 31392 - RNA, 22 nt, Homo sapiens
cacuuaucagguuguauuauaa

SEQ ID NO: 31393 - RNA, 22 nt, Homo sapiens
aacucaguaaugguaacgguuu

SEQ ID NO: 31394 - RNA, 25 nt, Homo sapiens
acggagcugucccaacaccaccccu

SEQ ID NO: 31395 - RNA, 22 nt, Homo sapiens
uggggacccucccugaaccaag

SEQ ID NO: 31396 - RNA, 20 nt, Homo sapiens
uacugcuuccacagcucccc

SEQ ID NO: 31397 - RNA, 23 nt, Homo sapiens
cuaccugcacuguaagcacuuuu

SEQ ID NO: 31398 - RNA, 21 nt, Homo sapiens
aucugcacugucagcacuuua

SEQ ID NO: 31399 - RNA, 19 nt, Homo sapiens
ccaccucccgaguccucac

SEQ ID NO: 31400 - RNA, 22 nt, Homo sapiens
uaaaugaauucaauuuccuucu

SEQ ID NO: 31401 - RNA, 18 nt, Homo sapiens
ugguggcagaggugggau

SEQ ID NO: 31402 - RNA, 22 nt, Homo sapiens
ugagugcuugcuaggugccaag

SEQ ID NO: 31403 - RNA, 18 nt, Homo sapiens
caccaccagagccaacgu

SEQ ID NO: 31404 - RNA, 23 nt, Homo sapiens
cuaccugcacuguaagcacuuug

SEQ ID NO: 31405 - RNA, 18 nt, Homo sapiens
auucaaucuacugccuca

SEQ ID NO: 31406 - RNA, 23 nt, Homo sapiens
cuaccugcacuauaagcacuuua

SEQ ID NO: 31407 - RNA, 23 nt, Homo sapiens
cuaccugcacuaugagcacuuug

SEQ ID NO: 31408 - RNA, 22 nt, Homo sapiens
acaguucuucaacuggcagcuu

SEQ ID NO: 31409 - RNA, 21 nt, Homo sapiens
uucuaggauaggcccaggggc

SEQ ID NO: 31410 - RNA, 22 nt, Homo sapiens
acaaccagcuaagacacugcca

SEQ ID NO: 31411 - RNA, 22 nt, Homo sapiens
auggcaguggaguuagugauug

SEQ ID NO: 31412 - RNA, 23 nt, Homo sapiens
gcaaucagcuaacuacacugccu

SEQ ID NO: 31413 - RNA, 23 nt, Homo sapiens
aaaucagaaucacaccuggggga

SEQ ID NO: 31414 - RNA, 22 nt, Homo sapiens
accagcuaacaauacacugcca

SEQ ID NO: 31415 - RNA, 22 nt, Homo sapiens
gccagcuaacaauacacugccu

SEQ ID NO: 31416 - RNA, 23 nt, Homo sapiens
aagaaucuugucccgcagguccu

SEQ ID NO: 31417 - RNA, 22 nt, Homo sapiens
cacucuaaagggaggcacuuug

SEQ ID NO: 31418 - RNA, 23 nt, Homo sapiens
acagaaagugcuucccucaagag

SEQ ID NO: 31419 - RNA, 19 nt, Homo sapiens
auuuugguacagcagcuca

SEQ ID NO: 31420 - RNA, 25 nt, Homo sapiens
acggagcugucccaacaccaccccu

SEQ ID NO: 31421 - RNA, 21 nt, Homo sapiens
gcugaggucugggccaggucu

SEQ ID NO: 31422 - RNA, 24 nt, Homo sapiens
acgcagagcccgaaagcccccagu

SEQ ID NO: 31423 - RNA, 20 nt, Homo sapiens
uacugcuuccacagcucccc

SEQ ID NO: 31424 - RNA, 23 nt, Homo sapiens
cuaccugcacgaacagcacuuug

SEQ ID NO: 31425 - RNA, 23 nt, Homo sapiens
agcaaaaaugugcuagugccaaa

SEQ ID NO: 31426 - RNA, 21 nt, Homo sapiens
gagcugcauccuggcuccggg

SEQ ID NO: 31427 - RNA, 22 nt, Homo sapiens
uaaaugaauucaauuuccuucu

SEQ ID NO: 31428 - RNA, 19 nt, Homo sapiens
gcuccuguccaacuggcuc

SEQ ID NO: 31429 - RNA, 22 nt, Homo sapiens
ucuacccagaaaggagccagug

SEQ ID NO: 31430 - RNA, 22 nt, Homo sapiens
cacauggccaaaacagagaaga

SEQ ID NO: 31431 - RNA, 22 nt, Homo sapiens
caaacaccauugucacacucca

SEQ ID NO: 31432 - RNA, 23 nt, Homo sapiens
agggauuccugggaaaacuggac

SEQ ID NO: 31433 - RNA, 22 nt, Homo sapiens
ucagaccgagacaagugcaaug

SEQ ID NO: 31434 - RNA, 23 nt, Homo sapiens
cggcucugucgucgaggcgcuca

SEQ ID NO: 31435 - RNA, 22 nt, Homo sapiens
uccagcaaagggaagcgcuuuc

SEQ ID NO: 31436 - RNA, 22 nt, Homo sapiens
accucuaaaggggagcgcuuug

SEQ ID NO: 31437 - RNA, 23 nt, Homo sapiens
acacucuaaagagaagcgcuuug

SEQ ID NO: 31438 - RNA, 21 nt, Homo sapiens
gcuccaaagggaagcgcuuug

SEQ ID NO: 31439 - RNA, 21 nt, Homo sapiens
ccucuaaagagaagcgcuuuc

SEQ ID NO: 31440 - RNA, 21 nt, Homo sapiens
gcuccaaccucagcagacugu

SEQ ID NO: 31441 - RNA, 25 nt, Homo sapiens
accaacggaccuacuucccuccgcc

SEQ ID NO: 31442 - RNA, 21 nt, Homo sapiens
caucaccuuccuucuccucca

SEQ ID NO: 31443 - RNA, 20 nt, Homo sapiens
uacugcuuccacagcucccc

SEQ ID NO: 31444 - RNA, 21 nt, Homo sapiens
acuagacugugagcuccucga

SEQ ID NO: 31445 - RNA, 21 nt, Homo sapiens
gaccaaucgccguccccgccg

SEQ ID NO: 31446 - RNA, 21 nt, Homo sapiens
uucuaggauaggcccaggggc

SEQ ID NO: 31447 - RNA, 22 nt, Homo sapiens
aagauguggaccauauuacaua

SEQ ID NO: 31448 - RNA, 23 nt, Homo sapiens
acccucuauagggaagcgcguuc

SEQ ID NO: 31449 - RNA, 22 nt, Homo sapiens
gcggucccgcggcgccccgccu

SEQ ID NO: 31450 - RNA, 22 nt, Homo sapiens
ugcuguuagcccuagccccgca

SEQ ID NO: 31451 - RNA, 22 nt, Homo sapiens
gugggguggguggucaggccga

SEQ ID NO: 31452 - RNA, 21 nt, Homo sapiens
cugggggacggagcagaagga

SEQ ID NO: 31453 - RNA, 22 nt, Homo sapiens
aggcauaggaugacaaagggaa

SEQ ID NO: 31454 - RNA, 22 nt, Homo sapiens
aggcgaaggaugacaaagggaa

SEQ ID NO: 31455 - RNA, 21 nt, Homo sapiens
ucaaucacagauagcaccccu

SEQ ID NO: 31456 - RNA, 20 nt, Homo sapiens
uaugaacaauuucuaggaau

SEQ ID NO: 31457 - RNA, 22 nt, Homo sapiens
aaaguaacugcaguuuuugcua

SEQ ID NO: 31458 - RNA, 21 nt, Homo sapiens
acuggcugagucaggacuagc

SEQ ID NO: 31459 - RNA, 23 nt, Homo sapiens
cacugugggcccucuccgcacca

SEQ ID NO: 31460 - RNA, 22 nt, Homo sapiens
ggcagagagucagagcgcggau

SEQ ID NO: 31461 - RNA, 22 nt, Homo sapiens
cacaagaucggaucuacggguu

SEQ ID NO: 31462 - RNA, 22 nt, Homo sapiens
cgcaaggucgguucuacgggug

SEQ ID NO: 31463 - RNA, 21 nt, Homo sapiens
cggcucggguggcggcgacgg

SEQ ID NO: 31464 - RNA, 22 nt, Homo sapiens
augcccuuucaucauugcacug

SEQ ID NO: 31465 - RNA, 21 nt, Homo sapiens
gggcaucugggacgcgcagga

SEQ ID NO: 31466 - RNA, 18 nt, Homo sapiens
auucaaucuacugccuca

SEQ ID NO: 31467 - RNA, 22 nt, Homo sapiens
ggagagccuccacccaacccuc

SEQ ID NO: 31468 - RNA, 21 nt, Homo sapiens
guaaugggaccuuccucuuug

SEQ ID NO: 31469 - RNA, 17 nt, Homo sapiens
uggaggccccagcgaga

SEQ ID NO: 31470 - RNA, 22 nt, Homo sapiens
cuggagagacaaggggaagagg

SEQ ID NO: 31471 - RNA, 17 nt, Homo sapiens
gggagaggaggaggcga

SEQ ID NO: 31472 - RNA, 21 nt, Homo sapiens
gaccaaucgccguccccgccg

SEQ ID NO: 31473 - RNA, 22 nt, Homo sapiens
cggugagcacccggccccugcg

SEQ ID NO: 31474 - RNA, 22 nt, Homo sapiens
agcugaguguaggauguuuaca

SEQ ID NO: 31475 - RNA, 22 nt, Homo sapiens
auaaggauuuuuaggggcauua

SEQ ID NO: 31476 - RNA, 24 nt, Homo sapiens
cagaaagugcuuucuuuuggagaa

SEQ ID NO: 31477 - RNA, 22 nt, Homo sapiens
uccagcaaagggaagcgcuuuc

SEQ ID NO: 31478 - RNA, 22 nt, Homo sapiens
accucuaaaggggagcgcuuug

SEQ ID NO: 31479 - RNA, 23 nt, Homo sapiens
acacucuaaagagaagcgcuuug

SEQ ID NO: 31480 - RNA, 21 nt, Homo sapiens
gcuccaaagggaagcgcuuug

SEQ ID NO: 31481 - RNA, 21 nt, Homo sapiens
cacucugaagggaagcgcuuu

SEQ ID NO: 31482 - RNA, 21 nt, Homo sapiens
ccucuaaagagaagcgcuuuc

SEQ ID NO: 31483 - RNA, 22 nt, Homo sapiens
aacacucuaaaaggaggcacuu

SEQ ID NO: 31484 - RNA, 19 nt, Homo sapiens
guugggaucacaggcgccc

SEQ ID NO: 31485 - RNA, 22 nt, Homo sapiens
gcggucccgcggcgccccgccu

SEQ ID NO: 31486 - RNA, 21 nt, Homo sapiens
caucaccuuccuucuccucca

SEQ ID NO: 31487 - RNA, 20 nt, Homo sapiens
cccugcgccaucuccucuac

SEQ ID NO: 31488 - RNA, 21 nt, Homo sapiens
cugaggagagaggaggugggg

SEQ ID NO: 31489 - RNA, 18 nt, Homo sapiens
cagcagccuccuucucaa

SEQ ID NO: 31490 - RNA, 22 nt, Homo sapiens
ccaucuuuaccagacaguguua

SEQ ID NO: 31491 - RNA, 22 nt, Homo sapiens
acaucguuaccagacaguguua

SEQ ID NO: 31492 - RNA, 20 nt, Homo sapiens
acauuacuguuaucaaaaca

SEQ ID NO: 31493 - RNA, 22 nt, Homo sapiens
agucuucacaacagcccugugu

SEQ ID NO: 31494 - RNA, 23 nt, Homo sapiens
acaccccaaaaucgaagcacuuc

SEQ ID NO: 31495 - RNA, 18 nt, Homo sapiens
augacaccucccugugaa

SEQ ID NO: 31496 - RNA, 22 nt, Homo sapiens
aguccagauucugugcccacca

SEQ ID NO: 31497 - RNA, 22 nt, Homo sapiens
cugcucaaacccuccaaugacu

SEQ ID NO: 31498 - RNA, 22 nt, Homo sapiens
gcacauguucugcggcccacca

SEQ ID NO: 31499 - RNA, 21 nt, Homo sapiens
cacaaccucaguguuuccagg

SEQ ID NO: 31500 - RNA, 19 nt, Homo sapiens
ucccugauccaaaaaucca

SEQ ID NO: 31501 - RNA, 18 nt, Homo sapiens
aucacauucaccucccug

SEQ ID NO: 31502 - RNA, 23 nt, Homo sapiens
gggagugaagacacggagccaga

SEQ ID NO: 31503 - RNA, 18 nt, Homo sapiens
auucaaucuacugccuca

SEQ ID NO: 31504 - RNA, 22 nt, Homo sapiens
agcccaaaaggagaauucuuug

SEQ ID NO: 31505 - RNA, 23 nt, Homo sapiens
ucucugcaggccgugugcuuugc

SEQ ID NO: 31506 - RNA, 21 nt, Homo sapiens
ccuucugacuccaaguccagu

SEQ ID NO: 31507 - RNA, 22 nt, Homo sapiens
gcaaaaguaauugagauuuuug

SEQ ID NO: 31508 - RNA, 19 nt, Homo sapiens
agaaaccccagcagagaca

SEQ ID NO: 31509 - RNA, 25 nt, Homo sapiens
acggagcugucccaacaccaccccu

SEQ ID NO: 31510 - RNA, 23 nt, Homo sapiens
acccaacagccccugcaagggau

SEQ ID NO: 31511 - RNA, 22 nt, Homo sapiens
agcucagaacccagaggucuca

SEQ ID NO: 31512 - RNA, 20 nt, Homo sapiens
uacugcuuccacagcucccc

SEQ ID NO: 31513 - RNA, 23 nt, Homo sapiens
gucacaucccucccaagacccuc

SEQ ID NO: 31514 - RNA, 22 nt, Homo sapiens
auccuucuacaaauucacccau

SEQ ID NO: 31515 - RNA, 22 nt, Homo sapiens
aacaacacuugaccacauccug

SEQ ID NO: 31516 - RNA, 24 nt, Homo sapiens
acugcuggucuucagucagggcca

SEQ ID NO: 31517 - RNA, 24 nt, Homo sapiens
acugcuggucuucagucagggcca

SEQ ID NO: 31518 - RNA, 23 nt, Homo sapiens
gggagugaagacacggagccaga

SEQ ID NO: 31519 - RNA, 23 nt, Homo sapiens
cuaucugcacuagaugcaccuua

SEQ ID NO: 31520 - RNA, 20 nt, Homo sapiens
cccgccgcgucgcccugggg

SEQ ID NO: 31521 - RNA, 25 nt, Homo sapiens
agcuagucaagcgcgguuguggggg

SEQ ID NO: 31522 - RNA, 21 nt, Homo sapiens
aucugcacugucagcacuuua

SEQ ID NO: 31523 - RNA, 23 nt, Homo sapiens
gcuuugacaauaucauugcacug

SEQ ID NO: 31524 - RNA, 22 nt, Homo sapiens
gauagagugcagaccagggucu

SEQ ID NO: 31525 - RNA, 19 nt, Homo sapiens
aagacauuuucagacagcu

SEQ ID NO: 31526 - RNA, 22 nt, Homo sapiens
ccucuaguaaauaugucagcau

SEQ ID NO: 31527 - RNA, 23 nt, Homo sapiens
gacguaguccuauucucugcugc

SEQ ID NO: 31528 - RNA, 22 nt, Homo sapiens
gggagaggucucccugcgcaca

SEQ ID NO: 31529 - RNA, 22 nt, Homo sapiens
acuggguucaccuuuaagggca

SEQ ID NO: 31530 - RNA, 21 nt, Homo sapiens
ggggagcgggggcccugccuu

SEQ ID NO: 31531 - RNA, 22 nt, Homo sapiens
aucagagcccucugagcuucag

SEQ ID NO: 31532 - RNA, 22 nt, Homo sapiens
ucaggaacugccuuucucucca

SEQ ID NO: 31533 - RNA, 21 nt, Homo sapiens
gaccaaucgccguccccgccg

SEQ ID NO: 31534 - RNA, 22 nt, Homo sapiens
aggcauaggaugacaaagggaa

SEQ ID NO: 31535 - RNA, 22 nt, Homo sapiens
aggcgaaggaugacaaagggaa

SEQ ID NO: 31536 - RNA, 22 nt, Homo sapiens
aaucagucucauugcuuuauaa

SEQ ID NO: 31537 - RNA, 23 nt, Homo sapiens
cugcagaacuguucccgcugcua

SEQ ID NO: 31538 - RNA, 23 nt, Homo sapiens
acagcgcucgcaaccgcagcgau

SEQ ID NO: 31539 - RNA, 19 nt, Homo sapiens
gcucuaagaaagccacacu

SEQ ID NO: 31540 - RNA, 25 nt, Homo sapiens
accaacggaccuacuucccuccgcc

SEQ ID NO: 31541 - RNA, 22 nt, Homo sapiens
gcggucccgcggcgccccgccu

SEQ ID NO: 31542 - RNA, 17 nt, Homo sapiens
uggaggccccagcgaga

SEQ ID NO: 31543 - RNA, 20 nt, Homo sapiens
gcaagacaucacaagacucu

SEQ ID NO: 31544 - RNA, 22 nt, Homo sapiens
ggcagagagucagagcgcggau

SEQ ID NO: 31545 - RNA, 18 nt, Homo sapiens
cccccaccaccacgcccg

SEQ ID NO: 31546 - RNA, 19 nt, Homo sapiens
ucccugauccaaaaaucca

SEQ ID NO: 31547 - RNA, 21 nt, Homo sapiens
gcaagcccagaccgcaaaaag

SEQ ID NO: 31548 - RNA, 22 nt, Homo sapiens
cacgaccgacgccacgccgagu

SEQ ID NO: 31549 - RNA, 22 nt, Homo sapiens
acuccaacagggccgcgucucc

SEQ ID NO: 31550 - RNA, 22 nt, Homo sapiens
acaguucuucaacuggcagcuu

SEQ ID NO: 31551 - RNA, 21 nt, Homo sapiens
accuauccugaauuacuugaa

SEQ ID NO: 31552 - RNA, 22 nt, Homo sapiens
agcugaguguaggauguuuaca

SEQ ID NO: 31553 - RNA, 22 nt, Homo sapiens
gcaaaaguaauugagauuuuug

SEQ ID NO: 31554 - RNA, 21 nt, Homo sapiens
aguucucccaacguaaaccca

SEQ ID NO: 31555 - RNA, 19 nt, Homo sapiens
gccucagaggcagcugcuu

SEQ ID NO: 31556 - RNA, 22 nt, Homo sapiens
acaaaguucuguagugcacuga

SEQ ID NO: 31557 - RNA, 22 nt, Homo sapiens
acaaaguucugugaugcacuga

SEQ ID NO: 31558 - RNA, 21 nt, Homo sapiens
ccaaguucugucaugcacuga

SEQ ID NO: 31559 - RNA, 21 nt, Homo sapiens
acccaguagccagauguagcu

SEQ ID NO: 31560 - RNA, 23 nt, Homo sapiens
gaaacccagcagacaauguagcu

SEQ ID NO: 31561 - RNA, 23 nt, Homo sapiens
ucuacuccaaaaggcuacaauca

SEQ ID NO: 31562 - RNA, 22 nt, Homo sapiens
cugcucaaacccuccaaugacu

SEQ ID NO: 31563 - RNA, 17 nt, Homo sapiens
ggguggcagcgguggga

SEQ ID NO: 31564 - RNA, 21 nt, Homo sapiens
gcaagcccagaccgcaaaaag

SEQ ID NO: 31565 - RNA, 22 nt, Homo sapiens
ccccucuggucaaccagucaca

SEQ ID NO: 31566 - RNA, 21 nt, Homo sapiens
gaccaaucgccguccccgccg

SEQ ID NO: 31567 - RNA, 21 nt, Homo sapiens
ggaaaucccuggcaaugugau

SEQ ID NO: 31568 - RNA, 21 nt, Homo sapiens
gguaaucccuggcaaugugau

SEQ ID NO: 31569 - RNA, 20 nt, Homo sapiens
cuggaggaagggcccagagg

SEQ ID NO: 31570 - RNA, 22 nt, Homo sapiens
gccuaagacacaggcccagaga

SEQ ID NO: 31571 - RNA, 22 nt, Homo sapiens
ccucauggaaggguuccccacu

SEQ ID NO: 31572 - RNA, 22 nt, Homo sapiens
gcaaaagaaacugugguuuuug

SEQ ID NO: 31573 - RNA, 22 nt, Homo sapiens
caagacacauuuggagagggac

SEQ ID NO: 31574 - RNA, 21 nt, Homo sapiens
cugcugggccacaacguggga

SEQ ID NO: 31575 - RNA, 22 nt, Homo sapiens
gcggucccgcggcgccccgccu

SEQ ID NO: 31576 - RNA, 22 nt, Homo sapiens
ugcuguuagcccuagccccgca

SEQ ID NO: 31577 - RNA, 20 nt, Homo sapiens
uacugcuuccacagcucccc

SEQ ID NO: 31578 - RNA, 22 nt, Homo sapiens
cacgaccgacgccacgccgagu

SEQ ID NO: 31579 - RNA, 23 nt, Homo sapiens
cccaacagacauggcgguacuca

SEQ ID NO: 31580 - RNA, 21 nt, Homo sapiens
aagacgggaggagaggaguga

SEQ ID NO: 31581 - RNA, 22 nt, Homo sapiens
gaauucaucacggccagccucu

SEQ ID NO: 31582 - RNA, 19 nt, Homo sapiens
auuuugguacagcagcuca

SEQ ID NO: 31583 - RNA, 21 nt, Homo sapiens
gcugaggucugggccaggucu

SEQ ID NO: 31584 - RNA, 22 nt, Homo sapiens
uauccacuacaccccgcugccu

SEQ ID NO: 31585 - RNA, 24 nt, Homo sapiens
cacccccagagccucagcucccca

SEQ ID NO: 31586 - RNA, 17 nt, Homo sapiens
gggagaggaggaggcga

SEQ ID NO: 31587 - RNA, 23 nt, Homo sapiens
gggagugaagacacggagccaga

SEQ ID NO: 31588 - RNA, 21 nt, Homo sapiens
acuagacugugagcuccucga

SEQ ID NO: 31589 - RNA, 21 nt, Homo sapiens
gaccaaucgccguccccgccg

SEQ ID NO: 31590 - RNA, 22 nt, Homo sapiens
uggcagcagcggagggggcaga

SEQ ID NO: 31591 - RNA, 21 nt, Homo sapiens
acaggauugagggggggcccu

SEQ ID NO: 31592 - RNA, 20 nt, Homo sapiens
ccagcagcaccuggggcagu

SEQ ID NO: 31593 - RNA, 21 nt, Homo sapiens
auccuguacugagcugccccg

SEQ ID NO: 31594 - RNA, 19 nt, Homo sapiens
gccugcugacaccgugccu

SEQ ID NO: 31595 - RNA, 19 nt, Homo sapiens
guugggaucacaggcgccc

SEQ ID NO: 31596 - RNA, 23 nt, Homo sapiens
ggacauuguuucagugcccaagu

SEQ ID NO: 31597 - RNA, 22 nt, Homo sapiens
gcggucccgcggcgccccgccu

SEQ ID NO: 31598 - RNA, 22 nt, Homo sapiens
ugcuguuagcccuagccccgca

SEQ ID NO: 31599 - RNA, 21 nt, Homo sapiens
uuccacgaccuaauccuaacu

SEQ ID NO: 31600 - RNA, 22 nt, Homo sapiens
cacgaccgacgccacgccgagu

SEQ ID NO: 31601 - RNA, 22 nt, Homo sapiens
augcccuuucaucauugcacug

SEQ ID NO: 31602 - RNA, 23 nt, Homo sapiens
gggagugaagacacggagccaga

SEQ ID NO: 31603 - RNA, 21 nt, Homo sapiens
gaccaaucgccguccccgccg

SEQ ID NO: 31604 - RNA, 21 nt, Homo sapiens
aggcggcaggcacaggacugg

SEQ ID NO: 31605 - RNA, 22 nt, Homo sapiens
uccacauggaguugcuguuaca

SEQ ID NO: 31606 - RNA, 22 nt, Homo sapiens
uagucaagugaagcagugggag

SEQ ID NO: 31607 - RNA, 22 nt, Homo sapiens
agcugaguguaggauguuuaca

SEQ ID NO: 31608 - RNA, 22 nt, Homo sapiens
acaaccagcuaagacacugcca

SEQ ID NO: 31609 - RNA, 23 nt, Homo sapiens
gcaaucagcuaacuacacugccu

SEQ ID NO: 31610 - RNA, 22 nt, Homo sapiens
accagcuaacaauacacugcca

SEQ ID NO: 31611 - RNA, 22 nt, Homo sapiens
gccagcuaacaauacacugccu

SEQ ID NO: 31612 - RNA, 22 nt, Homo sapiens
ugcaagccuugggugugggagg

SEQ ID NO: 31613 - RNA, 21 nt, Homo sapiens
guaaugggaccuuccucuuug

SEQ ID NO: 31614 - RNA, 22 nt, Homo sapiens
gauccgagcaccggggaccccc

SEQ ID NO: 31615 - RNA, 22 nt, Homo sapiens
gcggucccgcggcgccccgccu

SEQ ID NO: 31616 - RNA, 23 nt, Homo sapiens
cuaccugcacuguaagcacuuuu

SEQ ID NO: 31617 - RNA, 21 nt, Homo sapiens
aucugcacugucagcacuuua

SEQ ID NO: 31618 - RNA, 22 nt, Homo sapiens
aacccauggaauucaguucuca

SEQ ID NO: 31619 - RNA, 23 nt, Homo sapiens
cuaccugcacuguaagcacuuug

SEQ ID NO: 31620 - RNA, 21 nt, Homo sapiens
aggcggcaggcacaggacugg

SEQ ID NO: 31621 - RNA, 23 nt, Homo sapiens
cuaccugcacuauaagcacuuua

SEQ ID NO: 31622 - RNA, 23 nt, Homo sapiens
cuaccugcacuaugagcacuuug

SEQ ID NO: 31623 - RNA, 21 nt, Homo sapiens
gcggaacuuagccacugugaa

SEQ ID NO: 31624 - RNA, 21 nt, Homo sapiens
gcagaacuuagccacugugaa

SEQ ID NO: 31625 - RNA, 23 nt, Homo sapiens
ucaccaaaacauggaagcacuua

SEQ ID NO: 31626 - RNA, 23 nt, Homo sapiens
cuacuaaaacauggaagcacuua

SEQ ID NO: 31627 - RNA, 23 nt, Homo sapiens
ccacugaaacauggaagcacuua

SEQ ID NO: 31628 - RNA, 23 nt, Homo sapiens
acacucaaacauggaagcacuua

SEQ ID NO: 31629 - RNA, 17 nt, Homo sapiens
aagcauggaagcacuua

SEQ ID NO: 31630 - RNA, 23 nt, Homo sapiens
acgcucaaaugucgcagcacuuu

SEQ ID NO: 31631 - RNA, 23 nt, Homo sapiens
acaccccaaaaucgaagcacuuc

SEQ ID NO: 31632 - RNA, 22 nt, Homo sapiens
cacucuaaagggaggcacuuug

SEQ ID NO: 31633 - RNA, 22 nt, Homo sapiens
acaguccaaagggaagcacuuu

SEQ ID NO: 31634 - RNA, 21 nt, Homo sapiens
cccucuaaaaggaagcacuuu

SEQ ID NO: 31635 - RNA, 22 nt, Homo sapiens
acccucuaaaaggaagcacuuu

SEQ ID NO: 31636 - RNA, 22 nt, Homo sapiens
acccaccaaagagaagcacuuu

SEQ ID NO: 31637 - RNA, 21 nt, Homo sapiens
cccucaaaaaggaagcacuuu

SEQ ID NO: 31638 - RNA, 24 nt, Homo sapiens
acacucuaaagggaagcacuuugu

SEQ ID NO: 31639 - RNA, 22 nt, Homo sapiens
acucuaaagggaagcacuuugu

SEQ ID NO: 31640 - RNA, 23 nt, Homo sapiens
acagaaagugcuucccucaagag

SEQ ID NO: 31641 - RNA, 22 nt, Homo sapiens
guccaaaguuggggugcugguu

SEQ ID NO: 31642 - RNA, 23 nt, Homo sapiens
cuaccugcacgaacagcacuuug

SEQ ID NO: 31643 - RNA, 20 nt, Homo sapiens
cucaaagcaaacccugcaga

SEQ ID NO: 31644 - RNA, 23 nt, Homo sapiens
cuaccugcacuguaagcacuuug

SEQ ID NO: 31645 - RNA, 22 nt, Homo sapiens
uggcagcagcggagggggcaga

SEQ ID NO: 31646 - RNA, 22 nt, Homo sapiens
uccacauggaguugcuguuaca

SEQ ID NO: 31647 - RNA, 20 nt, Homo sapiens
ccagcagcaccuggggcagu

SEQ ID NO: 31648 - RNA, 22 nt, Homo sapiens
uacagauggauaccgugcaauu

SEQ ID NO: 31649 - RNA, 21 nt, Homo sapiens
ugcaugacggccugcaagaca

SEQ ID NO: 31650 - RNA, 21 nt, Homo sapiens
auccuguacugagcugccccg

SEQ ID NO: 31651 - RNA, 22 nt, Homo sapiens
caugauugccacgucugcagua

SEQ ID NO: 31652 - RNA, 21 nt, Homo sapiens
ugauugccacugucugcagua

SEQ ID NO: 31653 - RNA, 22 nt, Homo sapiens
uccagcaaagggaagcgcuuuc

SEQ ID NO: 31654 - RNA, 22 nt, Homo sapiens
accucuaaaggggagcgcuuug

SEQ ID NO: 31655 - RNA, 23 nt, Homo sapiens
acacucuaaagagaagcgcuuug

SEQ ID NO: 31656 - RNA, 21 nt, Homo sapiens
gcuccaaagggaagcgcuuug

SEQ ID NO: 31657 - RNA, 21 nt, Homo sapiens
cacucugaagggaagcgcuuu

SEQ ID NO: 31658 - RNA, 21 nt, Homo sapiens
ccucuaaagagaagcgcuuuc

SEQ ID NO: 31659 - RNA, 25 nt, Homo sapiens
acggagcugucccaacaccaccccu

SEQ ID NO: 31660 - RNA, 20 nt, Homo sapiens
acaaugagaacccauggucu

SEQ ID NO: 31661 - RNA, 22 nt, Homo sapiens
caaacaccauugucacacucca

SEQ ID NO: 31662 - RNA, 22 nt, Homo sapiens
cugggggcggcacaggggcuca

SEQ ID NO: 31663 - RNA, 23 nt, Homo sapiens
acacagcucuuccauaucuccag

SEQ ID NO: 31664 - RNA, 17 nt, Homo sapiens
gggagaggaggaggcga

SEQ ID NO: 31665 - RNA, 23 nt, Homo sapiens
uccaucaucaaaacaaauggagu

SEQ ID NO: 31666 - RNA, 22 nt, Homo sapiens
cggugagcacccggccccugcg

SEQ ID NO: 31667 - RNA, 22 nt, Homo sapiens
acugccugucugugccugcugu

SEQ ID NO: 31668 - RNA, 22 nt, Homo sapiens
cuguuccugcugaacugagcca

SEQ ID NO: 31669 - RNA, 22 nt, Homo sapiens
accagguuccaccccagcaggc

SEQ ID NO: 31670 - RNA, 23 nt, Homo sapiens
aaagucucgcucucugccccuca

SEQ ID NO: 31671 - RNA, 22 nt, Homo sapiens
ccucauggaaggguuccccacu

SEQ ID NO: 31672 - RNA, 21 nt, Homo sapiens
uagcacccagauagcaaggau

SEQ ID NO: 31673 - RNA, 25 nt, Homo sapiens
acggagcugucccaacaccaccccu

SEQ ID NO: 31674 - RNA, 20 nt, Homo sapiens
auuucuauaucuaucuccau

SEQ ID NO: 31675 - RNA, 21 nt, Homo sapiens
caucaccuuccuucuccucca

SEQ ID NO: 31676 - RNA, 21 nt, Homo sapiens
ugacugacagcuuuuugagua

SEQ ID NO: 31677 - RNA, 20 nt, Homo sapiens
uacugcuuccacagcucccc

SEQ ID NO: 31678 - RNA, 22 nt, Homo sapiens
gggagaggucucccugcgcaca

SEQ ID NO: 31679 - RNA, 22 nt, Homo sapiens
aaaauacauauauaucuacgua

SEQ ID NO: 31680 - RNA, 21 nt, Homo sapiens
cggggugcacgggcggagggc

SEQ ID NO: 31681 - RNA, 21 nt, Homo sapiens
accuauccugaauuacuugaa

SEQ ID NO: 31682 - RNA, 23 nt, Homo sapiens
aaagucucgcucucugccccuca

SEQ ID NO: 31683 - RNA, 22 nt, Homo sapiens
gcacacaauaaauguuugcuga

SEQ ID NO: 31684 - RNA, 22 nt, Homo sapiens
aaaguaacugcaguuuuugcua

SEQ ID NO: 31685 - RNA, 21 nt, Homo sapiens
cccgaggagccgggcaggcuu

SEQ ID NO: 31686 - RNA, 23 nt, Homo sapiens
ccaccuggcaagaacaggcguuc

SEQ ID NO: 31687 - RNA, 21 nt, Homo sapiens
gguggagcccugagaaccgga

SEQ ID NO: 31688 - RNA, 20 nt, Homo sapiens
uacugcuuccacagcucccc

SEQ ID NO: 31689 - RNA, 22 nt, Homo sapiens
ugaagaagggggggaagggcgu

SEQ ID NO: 31690 - RNA, 21 nt, Homo sapiens
gggcaucugggacgcgcagga

SEQ ID NO: 31691 - RNA, 21 nt, Homo sapiens
aaagugucagauacggugugg

SEQ ID NO: 31692 - RNA, 23 nt, Homo sapiens
ucaccaaaacauggaagcacuua

SEQ ID NO: 31693 - RNA, 22 nt, Homo sapiens
aagauguggaccauauuacaua

SEQ ID NO: 31694 - RNA, 22 nt, Homo sapiens
aagaagugcaccauguuuguuu

SEQ ID NO: 31695 - RNA, 22 nt, Homo sapiens
aggaaaccagcaaguguugacg

SEQ ID NO: 31696 - RNA, 22 nt, Homo sapiens
cuacccacagacguaccaauca

SEQ ID NO: 31697 - RNA, 22 nt, Homo sapiens
acaaaagcaacugagguucuug

SEQ ID NO: 31698 - RNA, 19 nt, Homo sapiens
gggaaacguaugucaaccu

SEQ ID NO: 31699 - RNA, 22 nt, Homo sapiens
acuggguucaccuuuaagggca

SEQ ID NO: 31700 - RNA, 22 nt, Homo sapiens
caaacaccauugucacacucca

SEQ ID NO: 31701 - RNA, 17 nt, Homo sapiens
gacagccucucccccac

SEQ ID NO: 31702 - RNA, 18 nt, Homo sapiens
aucacauucaccucccug

SEQ ID NO: 31703 - RNA, 23 nt, Homo sapiens
gggagugaagacacggagccaga

SEQ ID NO: 31704 - RNA, 22 nt, Homo sapiens
ucaggaacugccuuucucucca

SEQ ID NO: 31705 - RNA, 21 nt, Homo sapiens
gaccaaucgccguccccgccg

SEQ ID NO: 31706 - RNA, 20 nt, Homo sapiens
acagcaaggagggcaggagg

SEQ ID NO: 31707 - RNA, 22 nt, Homo sapiens
ggagagccuccacccaacccuc

SEQ ID NO: 31708 - RNA, 23 nt, Homo sapiens
agaggcaggcaugcgggcagaca

SEQ ID NO: 31709 - RNA, 21 nt, Homo sapiens
ccuacguuccauagucuacca

SEQ ID NO: 31710 - RNA, 22 nt, Homo sapiens
gaauucaucacggccagccucu

SEQ ID NO: 31711 - RNA, 19 nt, Homo sapiens
aagacauuuucagacagcu

SEQ ID NO: 31712 - RNA, 22 nt, Homo sapiens
gcggucccgcggcgccccgccu

SEQ ID NO: 31713 - RNA, 22 nt, Homo sapiens
cacucuaaagggaggcacuuug

SEQ ID NO: 31714 - RNA, 21 nt, Homo sapiens
ggggagcgggggcccugccuu

SEQ ID NO: 31715 - RNA, 24 nt, Homo sapiens
cacccccagagccucagcucccca

SEQ ID NO: 31716 - RNA, 23 nt, Homo sapiens
gcacaugugcacacagccgggug

SEQ ID NO: 31717 - RNA, 22 nt, Homo sapiens
cugggggcggcacaggggcuca

SEQ ID NO: 31718 - RNA, 21 nt, Homo sapiens
aguagugcuuucuacuuuaug

SEQ ID NO: 31719 - RNA, 23 nt, Homo sapiens
gggagugaagacacggagccaga

SEQ ID NO: 31720 - RNA, 22 nt, Homo sapiens
uggcagcagcggagggggcaga

SEQ ID NO: 31721 - RNA, 25 nt, Homo sapiens
agcuagucaagcgcgguuguggggg

SEQ ID NO: 31722 - RNA, 22 nt, Homo sapiens
acaguucuucaacuggcagcuu

SEQ ID NO: 31723 - RNA, 22 nt, Homo sapiens
agcugaguguaggauguuuaca

SEQ ID NO: 31724 - RNA, 20 nt, Homo sapiens
ccagcagcaccuggggcagu

SEQ ID NO: 31725 - RNA, 22 nt, Homo sapiens
ccucauggaaggguuccccacu

SEQ ID NO: 31726 - RNA, 22 nt, Homo sapiens
gcaaagguaauugcuguuuucg

SEQ ID NO: 31727 - RNA, 21 nt, Homo sapiens
caucaccuuccuucuccucca

SEQ ID NO: 31728 - RNA, 20 nt, Homo sapiens
uacugcuuccacagcucccc

SEQ ID NO: 31729 - RNA, 23 nt, Homo sapiens
cacaaauucgguucuacagggua

SEQ ID NO: 31730 - RNA, 18 nt, Homo sapiens
gaaaugagggccagcuga

SEQ ID NO: 31731 - RNA, 22 nt, Homo sapiens
cuagggaacacagggcugguga

SEQ ID NO: 31732 - RNA, 17 nt, Homo sapiens
ggguggcagcgguggga

SEQ ID NO: 31733 - RNA, 23 nt, Homo sapiens
cggccugauucacaacaccagcu

SEQ ID NO: 31734 - RNA, 21 nt, Homo sapiens
cggggugcacgggcggagggc

SEQ ID NO: 31735 - RNA, 22 nt, Homo sapiens
cggugagcacccggccccugcg

SEQ ID NO: 31736 - RNA, 23 nt, Homo sapiens
cagcugcuuuugggauuccguug

SEQ ID NO: 31737 - RNA, 22 nt, Homo sapiens
acaguucuucaacuggcagcuu

SEQ ID NO: 31738 - RNA, 22 nt, Homo sapiens
ucagaccgagacaagugcaaug

SEQ ID NO: 31739 - RNA, 23 nt, Homo sapiens
gucagaccccgagggguccucgc

SEQ ID NO: 31740 - RNA, 22 nt, Homo sapiens
gauccgagcaccggggaccccc

SEQ ID NO: 31741 - RNA, 21 nt, Homo sapiens
gaaggaagugagugcagccac

SEQ ID NO: 31742 - RNA, 25 nt, Homo sapiens
accaacggaccuacuucccuccgcc

SEQ ID NO: 31743 - RNA, 20 nt, Homo sapiens
aggggccucagccuccuggu

SEQ ID NO: 31744 - RNA, 22 nt, Homo sapiens
ugcuguuagcccuagccccgca

SEQ ID NO: 31745 - RNA, 21 nt, Homo sapiens
cggggugcacgggcggagggc

SEQ ID NO: 31746 - RNA, 22 nt, Homo sapiens
cacugguacaaggguugggaga

SEQ ID NO: 31747 - RNA, 22 nt, Homo sapiens
cagaaagugcuucccucuagag

SEQ ID NO: 31748 - RNA, 22 nt, Homo sapiens
cacucagcggccguuuccccaa

SEQ ID NO: 31749 - RNA, 22 nt, Homo sapiens
ucagaccgagacaagugcaaug

SEQ ID NO: 31750 - RNA, 22 nt, Homo sapiens
agcugaguguaggauguuuaca

SEQ ID NO: 31751 - RNA, 22 nt, Homo sapiens
uacagauggauaccgugcaauu

SEQ ID NO: 31752 - RNA, 23 nt, Homo sapiens
ccacccaaugaccuacuccaaga

SEQ ID NO: 31753 - RNA, 19 nt, Homo sapiens
gccugcugacaccgugccu

SEQ ID NO: 31754 - RNA, 21 nt, Homo sapiens
cccgaggagccgggcaggcuu

SEQ ID NO: 31755 - RNA, 25 nt, Homo sapiens
accaacggaccuacuucccuccgcc

SEQ ID NO: 31756 - RNA, 20 nt, Homo sapiens
uccccacagacccagagccg

SEQ ID NO: 31757 - RNA, 21 nt, Homo sapiens
cggcucggguggcggcgacgg

SEQ ID NO: 31758 - RNA, 21 nt, Homo sapiens
ccccucccagccucccugcca

SEQ ID NO: 31759 - RNA, 22 nt, Homo sapiens
ggagcccgcgccccgcgccgag

SEQ ID NO: 31760 - RNA, 21 nt, Homo sapiens
gggcaucugggacgcgcagga

SEQ ID NO: 31761 - RNA, 22 nt, Homo sapiens
ucaggaacugccuuucucucca

SEQ ID NO: 31762 - RNA, 22 nt, Homo sapiens
cggugagcacccggccccugcg

SEQ ID NO: 31763 - RNA, 19 nt, Homo sapiens
auuuugguacagcagcuca

SEQ ID NO: 31764 - RNA, 22 nt, Homo sapiens
aagagggagacccaggcucgga

SEQ ID NO: 31765 - RNA, 22 nt, Homo sapiens
ugcuguuagcccuagccccgca

SEQ ID NO: 31766 - RNA, 21 nt, Homo sapiens
aaagagaccgguucacuguga

SEQ ID NO: 31767 - RNA, 22 nt, Homo sapiens
cacgaccgacgccacgccgagu

SEQ ID NO: 31768 - RNA, 22 nt, Homo sapiens
ccccucuggucaaccagucaca

SEQ ID NO: 31769 - RNA, 23 nt, Homo sapiens
ucaguuuugcauagauuugcaca

SEQ ID NO: 31770 - RNA, 22 nt, Homo sapiens
cacucagcaccaggauauuguu

SEQ ID NO: 31771 - RNA, 22 nt, Homo sapiens
aacuaugcaaccuacuaccucu

SEQ ID NO: 31772 - RNA, 23 nt, Homo sapiens
gggcucuuacucccucaggcacu

SEQ ID NO: 31773 - RNA, 23 nt, Homo sapiens
guagugggccgagccgagugaca

SEQ ID NO: 31774 - RNA, 23 nt, Homo sapiens
acaaggaugaaucuuuguuacug

SEQ ID NO: 31775 - RNA, 20 nt, Homo sapiens
cugcgggaggacagggcuca

SEQ ID NO: 31776 - RNA, 22 nt, Homo sapiens
gugggguggguggucaggccga

SEQ ID NO: 31777 - RNA, 20 nt, Homo sapiens
ggggcagacagacgaggaag

SEQ ID NO: 31778 - RNA, 22 nt, Homo sapiens
cacgaccgacgccacgccgagu

SEQ ID NO: 31779 - RNA, 22 nt, Homo sapiens
cacgaccgacgccacgccgagu

SEQ ID NO: 31780 - RNA, 21 nt, Homo sapiens
cggggugcacgggcggagggc

SEQ ID NO: 31781 - RNA, 22 nt, Homo sapiens
ucagaccgagacaagugcaaug

SEQ ID NO: 31782 - RNA, 19 nt, Homo sapiens
gccugcugacaccgugccu

SEQ ID NO: 31783 - RNA, 22 nt, Homo sapiens
aagagggagacccaggcucgga

SEQ ID NO: 31784 - RNA, 22 nt, Homo sapiens
gccaccuucaaaugggaagucu

SEQ ID NO: 31785 - RNA, 25 nt, Homo sapiens
accaacggaccuacuucccuccgcc

SEQ ID NO: 31786 - RNA, 22 nt, Homo sapiens
ucggucccucgggccagggcag

SEQ ID NO: 31787 - RNA, 18 nt, Homo sapiens
gaaaugagggccagcuga

SEQ ID NO: 31788 - RNA, 21 nt, Homo sapiens
ccgugguucuacccuguggua

SEQ ID NO: 31789 - RNA, 21 nt, Homo sapiens
gaccaaucgccguccccgccg

SEQ ID NO: 31790 - RNA, 23 nt, Homo sapiens
cccaacagacauggcgguacuca

SEQ ID NO: 31791 - RNA, 22 nt, Homo sapiens
cuguuccugcugaacugagcca

SEQ ID NO: 31792 - RNA, 18 nt, Homo sapiens
acccucugaaaggaagca

SEQ ID NO: 31793 - RNA, 22 nt, Homo sapiens
aaagugcuucuuaccuccagau

SEQ ID NO: 31794 - RNA, 22 nt, Homo sapiens
gcggucccgcggcgccccgccu

SEQ ID NO: 31795 - RNA, 22 nt, Homo sapiens
ugcuguuagcccuagccccgca

SEQ ID NO: 31796 - RNA, 22 nt, Homo sapiens
gugggguggguggucaggccga

SEQ ID NO: 31797 - RNA, 23 nt, Homo sapiens
gggagugaagacacggagccaga

SEQ ID NO: 31798 - RNA, 22 nt, Homo sapiens
cacugguacaaggguugggaga

SEQ ID NO: 31799 - RNA, 21 nt, Homo sapiens
acuagacugugagcuccucga

SEQ ID NO: 31800 - RNA, 21 nt, Homo sapiens
gaccaaucgccguccccgccg

SEQ ID NO: 31801 - RNA, 22 nt, Homo sapiens
agcugaguguaggauguuuaca

SEQ ID NO: 31802 - RNA, 23 nt, Homo sapiens
aaaucagaaucacaccuggggga

SEQ ID NO: 31803 - RNA, 23 nt, Homo sapiens
acccucuauagggaagcgcguuc

SEQ ID NO: 31804 - RNA, 25 nt, Homo sapiens
acggagcugucccaacaccaccccu

SEQ ID NO: 31805 - RNA, 21 nt, Homo sapiens
ggacuauagaacuuucccccu

SEQ ID NO: 31806 - RNA, 24 nt, Homo sapiens
acgcagagcccgaaagcccccagu

SEQ ID NO: 31807 - RNA, 24 nt, Homo sapiens
acgcgcaggccagagacccaggca

SEQ ID NO: 31808 - RNA, 22 nt, Homo sapiens
gcggucccgcggcgccccgccu

SEQ ID NO: 31809 - RNA, 22 nt, Homo sapiens
cacucuaaagggaggcacuuug

SEQ ID NO: 31810 - RNA, 22 nt, Homo sapiens
caaacaccauugucacacucca

SEQ ID NO: 31811 - RNA, 22 nt, Homo sapiens
cacugguacaaggguugggaga

SEQ ID NO: 31812 - RNA, 22 nt, Homo sapiens
cagaaagugcuucccucuagag

SEQ ID NO: 31813 - RNA, 18 nt, Homo sapiens
ggagaggagggcacugga

SEQ ID NO: 31814 - RNA, 20 nt, Homo sapiens
acagcaaggagggcaggagg

SEQ ID NO: 31815 - RNA, 22 nt, Homo sapiens
ggagagccuccacccaacccuc

SEQ ID NO: 31816 - RNA, 22 nt, Homo sapiens
agcugaguguaggauguuuaca

SEQ ID NO: 31817 - RNA, 23 nt, Homo sapiens
ucucugcaggccgugugcuuugc

SEQ ID NO: 31818 - RNA, 22 nt, Homo sapiens
aggaaaccagcaaguguugacg

SEQ ID NO: 31819 - RNA, 22 nt, Homo sapiens
aacccucuaaaaggaagcacuu

SEQ ID NO: 31820 - RNA, 20 nt, Homo sapiens
agagaugagagaaacacccu

SEQ ID NO: 31821 - RNA, 21 nt, Homo sapiens
caucaccuuccuucuccucca

SEQ ID NO: 31822 - RNA, 21 nt, Homo sapiens
aagggucaguaagcacccgcg

SEQ ID NO: 31823 - RNA, 22 nt, Homo sapiens
cacucuaaagggaggcacuuug

SEQ ID NO: 31824 - RNA, 21 nt, Homo sapiens
ggggagcgggggcccugccuu

SEQ ID NO: 31825 - RNA, 23 nt, Homo sapiens
cacaaauucggaucuacagggua

SEQ ID NO: 31826 - RNA, 23 nt, Homo sapiens
cacaaauucgguucuacagggua

SEQ ID NO: 31827 - RNA, 17 nt, Homo sapiens
uggcgcccgaacaggga

SEQ ID NO: 31828 - RNA, 23 nt, Homo sapiens
gggagugaagacacggagccaga

SEQ ID NO: 31829 - RNA, 23 nt, Homo sapiens
cuaucugcacuagaugcaccuua

SEQ ID NO: 31830 - RNA, 22 nt, Homo sapiens
acugccugucugugccugcugu

SEQ ID NO: 31831 - RNA, 22 nt, Homo sapiens
auaaggauuuuuaggggcauua

SEQ ID NO: 31832 - RNA, 23 nt, Homo sapiens
ucaacgggagugaucgugucauu

SEQ ID NO: 31833 - RNA, 22 nt, Homo sapiens
ccucauggaaggguuccccacu

SEQ ID NO: 31834 - RNA, 22 nt, Homo sapiens
gauagagugcagaccagggucu

SEQ ID NO: 31835 - RNA, 22 nt, Homo sapiens
aaagugcuucuuaccuccagau

SEQ ID NO: 31836 - RNA, 21 nt, Homo sapiens
gaaggaagugagugcagccac

SEQ ID NO: 31837 - RNA, 21 nt, Homo sapiens
caucaccuuccuucuccucca

SEQ ID NO: 31838 - RNA, 21 nt, Homo sapiens
aggagacucacaaguuccugc

SEQ ID NO: 31839 - RNA, 22 nt, Homo sapiens
ucggucccucgggccagggcag

SEQ ID NO: 31840 - RNA, 20 nt, Homo sapiens
uacugcuuccacagcucccc

SEQ ID NO: 31841 - RNA, 20 nt, Homo sapiens
cuggaggaagggcccagagg

SEQ ID NO: 31842 - RNA, 22 nt, Homo sapiens
gccuaagacacaggcccagaga

SEQ ID NO: 31843 - RNA, 22 nt, Homo sapiens
uucaaaacaugaauugcugcug

SEQ ID NO: 31844 - RNA, 22 nt, Homo sapiens
gguuaguggaccaggucacaaa

SEQ ID NO: 31845 - RNA, 21 nt, Homo sapiens
uuuagcauaaguaugucccaa

SEQ ID NO: 31846 - RNA, 21 nt, Homo sapiens
aagugucagacacgguggugg

SEQ ID NO: 31847 - RNA, 22 nt, Homo sapiens
agagagagucugcccuuguaua

SEQ ID NO: 31848 - RNA, 22 nt, Homo sapiens
acagagagcuugcccuuguaua

SEQ ID NO: 31849 - RNA, 21 nt, Homo sapiens
ggacuauagaacuuucccccu

SEQ ID NO: 31850 - RNA, 22 nt, Homo sapiens
cuaccugagcuagcauacaagu

SEQ ID NO: 31851 - RNA, 21 nt, Homo sapiens
ccccucccagccucccugcca

SEQ ID NO: 31852 - RNA, 24 nt, Homo sapiens
acugcuggucuucagucagggcca

SEQ ID NO: 31853 - RNA, 22 nt, Homo sapiens
agagcaagaccccgucucuaaa

SEQ ID NO: 31854 - RNA, 23 nt, Homo sapiens
gaaacccagcagacaauguagcu

SEQ ID NO: 31855 - RNA, 21 nt, Homo sapiens
acaggauugagggggggcccu

SEQ ID NO: 31856 - RNA, 22 nt, Homo sapiens
acggaagggcagagagggccag

SEQ ID NO: 31857 - RNA, 20 nt, Homo sapiens
agugcccccacaguuugagu

SEQ ID NO: 31858 - RNA, 23 nt, Homo sapiens
cuccagccccuccagggcuuccu

SEQ ID NO: 31859 - RNA, 21 nt, Homo sapiens
ugacugacagcuuuuugagua

SEQ ID NO: 31860 - RNA, 21 nt, Homo sapiens
ccgugguucuacccuguggua

SEQ ID NO: 31861 - RNA, 22 nt, Homo sapiens
uucacacugcaugcucugggua

SEQ ID NO: 31862 - RNA, 22 nt, Homo sapiens
ucaacaucagucugauaagcua

SEQ ID NO: 31863 - RNA, 22 nt, Homo sapiens
aagaagugcaccauguuuguuu

SEQ ID NO: 31864 - RNA, 21 nt, Homo sapiens
acaaaccacagugugcugcug

SEQ ID NO: 31865 - RNA, 23 nt, Homo sapiens
gggcucuuacucccucaggcacu

SEQ ID NO: 31866 - RNA, 19 nt, Homo sapiens
guccugaauuccgcagccu

SEQ ID NO: 31867 - RNA, 22 nt, Homo sapiens
ggcagagagucagagcgcggau

SEQ ID NO: 31868 - RNA, 22 nt, Homo sapiens
ugaagaagggggggaagggcgu

SEQ ID NO: 31869 - RNA, 22 nt, Homo sapiens
uaaaugaauucaauuuccuucu

SEQ ID NO: 31870 - RNA, 21 nt, Homo sapiens
gaccaaucgccguccccgccg

SEQ ID NO: 31871 - RNA, 23 nt, Homo sapiens
cagcugcuuuugggauuccguug

SEQ ID NO: 31872 - RNA, 21 nt, Homo sapiens
ucaaucacagauagcaccccu

SEQ ID NO: 31873 - RNA, 22 nt, Homo sapiens
gcggucccgcggcgccccgccu

SEQ ID NO: 31874 - RNA, 22 nt, Homo sapiens
ucggucccucgggccagggcag

SEQ ID NO: 31875 - RNA, 22 nt, Homo sapiens
gaggcucagaauggcucaggag

SEQ ID NO: 31876 - RNA, 21 nt, Homo sapiens
cggggugcacgggcggagggc

SEQ ID NO: 31877 - RNA, 22 nt, Homo sapiens
ucaggaacugccuuucucucca

SEQ ID NO: 31878 - RNA, 22 nt, Homo sapiens
ucagaccgagacaagugcaaug

SEQ ID NO: 31879 - RNA, 23 nt, Homo sapiens
acaccccaaaaucgaagcacuuc

SEQ ID NO: 31880 - RNA, 21 nt, Homo sapiens
guaaugggaccuuccucuuug

SEQ ID NO: 31881 - RNA, 22 nt, Homo sapiens
ugacgaugacaacgaugacgua

SEQ ID NO: 31882 - RNA, 22 nt, Homo sapiens
cugcucaaacccuccaaugacu

SEQ ID NO: 31883 - RNA, 22 nt, Homo sapiens
gaggcucagaauggcucaggag

SEQ ID NO: 31884 - RNA, 22 nt, Homo sapiens
ucaggaacugccuuucucucca

SEQ ID NO: 31885 - RNA, 21 nt, Homo sapiens
ugcaaacccugcaugugggag

SEQ ID NO: 31886 - RNA, 22 nt, Homo sapiens
cggugagcacccggccccugcg

SEQ ID NO: 31887 - RNA, 22 nt, Homo sapiens
uggcagcagcggagggggcaga

SEQ ID NO: 31888 - RNA, 20 nt, Homo sapiens
cccgccgcgucgcccugggg

SEQ ID NO: 31889 - RNA, 20 nt, Homo sapiens
ccagcagcaccuggggcagu

SEQ ID NO: 31890 - RNA, 20 nt, Homo sapiens
cuggaggaagggcccagagg

SEQ ID NO: 31891 - RNA, 22 nt, Homo sapiens
gccuaagacacaggcccagaga

SEQ ID NO: 31892 - RNA, 21 nt, Homo sapiens
uucuaggauaggcccaggggc

SEQ ID NO: 31893 - RNA, 22 nt, Homo sapiens
auaaggauuuuuaggggcauua

SEQ ID NO: 31894 - RNA, 22 nt, Homo sapiens
gccagcuaacaauacacugccu

SEQ ID NO: 31895 - RNA, 21 nt, Homo sapiens
auccuguacugagcugccccg

SEQ ID NO: 31896 - RNA, 22 nt, Homo sapiens
gauuccaauuuuuccacaucuu

SEQ ID NO: 31897 - RNA, 22 nt, Homo sapiens
aagagggagacccaggcucgga

SEQ ID NO: 31898 - RNA, 22 nt, Homo sapiens
gccaccuucaaaugggaagucu

SEQ ID NO: 31899 - RNA, 22 nt, Homo sapiens
agcucagaacccagaggucuca

SEQ ID NO: 31900 - RNA, 22 nt, Homo sapiens
cacauggccaaaacagagaaga

SEQ ID NO: 31901 - RNA, 26 nt, Homo sapiens
aaccaucucauacaaaccaacuacuu

SEQ ID NO: 31902 - RNA, 21 nt, Homo sapiens
gcaagcccagaccgcaaaaag

SEQ ID NO: 31903 - RNA, 23 nt, Homo sapiens
agggauuccugggaaaacuggac

SEQ ID NO: 31904 - RNA, 22 nt, Homo sapiens
ccagaacugaguccacagggca

SEQ ID NO: 31905 - RNA, 22 nt, Homo sapiens
ucgcccucucaacccagcuuuu

SEQ ID NO: 31906 - RNA, 22 nt, Homo sapiens
uugcccucucaacccagcuuuu

SEQ ID NO: 31907 - RNA, 20 nt, Homo sapiens
acccucucaacccagcuuuu

SEQ ID NO: 31908 - RNA, 19 nt, Homo sapiens
uccucucaacccagcuuuu

SEQ ID NO: 31909 - RNA, 22 nt, Homo sapiens
caacaaaaucacugaugcugga

SEQ ID NO: 31910 - RNA, 22 nt, Homo sapiens
cucauauuacaaugagcucauc

SEQ ID NO: 31911 - RNA, 23 nt, Homo sapiens
aaucgcgguuuauaccaaaugaa

SEQ ID NO: 31912 - RNA, 22 nt, Homo sapiens
guccaaaguuggggugcugguu

SEQ ID NO: 31913 - RNA, 22 nt, Homo sapiens
agaggcaggguaguguaaugga

SEQ ID NO: 31914 - RNA, 21 nt, Homo sapiens
ccccucccagccucccugcca

SEQ ID NO: 31915 - RNA, 20 nt, Homo sapiens
ggggcagacagacgaggaag

SEQ ID NO: 31916 - RNA, 18 nt, Homo sapiens
ugguggcagaggugggau

SEQ ID NO: 31917 - RNA, 17 nt, Homo sapiens
gggagaggaggaggcga

SEQ ID NO: 31918 - RNA, 18 nt, Homo sapiens
aucacauucaccucccug

SEQ ID NO: 31919 - RNA, 22 nt, Homo sapiens
cggugagcacccggccccugcg

SEQ ID NO: 31920 - RNA, 23 nt, Homo sapiens
cccaacagacauggcgguacuca

SEQ ID NO: 31921 - RNA, 22 nt, Homo sapiens
cagaagugggccgggcacaggg

SEQ ID NO: 31922 - RNA, 22 nt, Homo sapiens
agcugaguguaggauguuuaca

SEQ ID NO: 31923 - RNA, 20 nt, Homo sapiens
cuggaggaagggcccagagg

SEQ ID NO: 31924 - RNA, 22 nt, Homo sapiens
gccuaagacacaggcccagaga

SEQ ID NO: 31925 - RNA, 21 nt, Homo sapiens
ugcaugacggccugcaagaca

SEQ ID NO: 31926 - RNA, 22 nt, Homo sapiens
uauucaggaacauauugcaaaa

SEQ ID NO: 31927 - RNA, 22 nt, Homo sapiens
acuucaaggaucuuaaacuuug

SEQ ID NO: 31928 - RNA, 19 nt, Homo sapiens
agaaaccccagcagagaca

SEQ ID NO: 31929 - RNA, 25 nt, Homo sapiens
acggagcugucccaacaccaccccu

SEQ ID NO: 31930 - RNA, 20 nt, Homo sapiens
uccccacagacccagagccg

SEQ ID NO: 31931 - RNA, 23 nt, Homo sapiens
acacagcucuuccauaucuccag

SEQ ID NO: 31932 - RNA, 22 nt, Homo sapiens
acaaaguucuguagugcacuga

SEQ ID NO: 31933 - RNA, 22 nt, Homo sapiens
acaaaguucugugaugcacuga

SEQ ID NO: 31934 - RNA, 21 nt, Homo sapiens
ccaaguucugucaugcacuga

SEQ ID NO: 31935 - RNA, 21 nt, Homo sapiens
aaagugucagauacggugugg

SEQ ID NO: 31936 - RNA, 23 nt, Homo sapiens
gcgcccaauuaaugucuguugau

SEQ ID NO: 31937 - RNA, 21 nt, Homo sapiens
ccuucugacuccaaguccagu

SEQ ID NO: 31938 - RNA, 22 nt, Homo sapiens
gccuucugacccuaaguccagu

SEQ ID NO: 31939 - RNA, 23 nt, Homo sapiens
ccacccaaugaccuacuccaaga

SEQ ID NO: 31940 - RNA, 23 nt, Homo sapiens
caugagugacgcccucuggagua

SEQ ID NO: 31941 - RNA, 24 nt, Homo sapiens
cagaaagugcuuucuuuuggagaa

SEQ ID NO: 31942 - RNA, 22 nt, Homo sapiens
aacacucuaaaaggaggcacuu

SEQ ID NO: 31943 - RNA, 22 nt, Homo sapiens
acgguccuacacucaaggcaug

SEQ ID NO: 31944 - RNA, 22 nt, Homo sapiens
gaacuugcuaaaaaugcagaau

SEQ ID NO: 31945 - RNA, 20 nt, Homo sapiens
auuucuauaucuaucuccau

SEQ ID NO: 31946 - RNA, 22 nt, Homo sapiens
gcugaggcuguggggcuggagu

SEQ ID NO: 31947 - RNA, 21 nt, Homo sapiens
ugacugacagcuuuuugagua

SEQ ID NO: 31948 - RNA, 21 nt, Homo sapiens
caacugaugccuuuccaagua

SEQ ID NO: 31949 - RNA, 21 nt, Homo sapiens
cugggggacggagcagaagga

SEQ ID NO: 31950 - RNA, 22 nt, Homo sapiens
aggucucacuuuguugcccaga

SEQ ID NO: 31951 - RNA, 24 nt, Homo sapiens
ugggagaaccucccugcuucugcu

SEQ ID NO: 31952 - RNA, 22 nt, Homo sapiens
acggaagggcagagagggccag

SEQ ID NO: 31953 - RNA, 21 nt, Homo sapiens
acguggauuuuccucuaugau

SEQ ID NO: 31954 - RNA, 22 nt, Homo sapiens
aacauggauuuuccucuaugau

SEQ ID NO: 31955 - RNA, 22 nt, Homo sapiens
ucucacccagggacaaaggauu

SEQ ID NO: 31956 - RNA, 20 nt, Homo sapiens
acaaugagaacccauggucu

SEQ ID NO: 31957 - RNA, 25 nt, Homo sapiens
aaggagcucagaagcccugcccagc

SEQ ID NO: 31958 - RNA, 21 nt, Homo sapiens
agaggcagguuccuggaucau

SEQ ID NO: 31959 - RNA, 22 nt, Homo sapiens
ccucaggcacggccgggccacc

SEQ ID NO: 31960 - RNA, 22 nt, Homo sapiens
gcugaggcuguggggcuggagu

SEQ ID NO: 31961 - RNA, 23 nt, Homo sapiens
gacguaguccuauucucugcugc

SEQ ID NO: 31962 - RNA, 18 nt, Homo sapiens
gaaaugagggccagcuga

SEQ ID NO: 31963 - RNA, 22 nt, Homo sapiens
caaacaccauugucacacucca

SEQ ID NO: 31964 - RNA, 23 nt, Homo sapiens
cugcagaacuguucccgcugcua

SEQ ID NO: 31965 - RNA, 21 nt, Homo sapiens
caucaccuuccuucuccucca

SEQ ID NO: 31966 - RNA, 21 nt, Homo sapiens
cacaaccucaguguuuccagg

SEQ ID NO: 31967 - RNA, 24 nt, Homo sapiens
cacccccagagccucagcucccca

SEQ ID NO: 31968 - RNA, 21 nt, Homo sapiens
cccuccaccaugcaagggaug

SEQ ID NO: 31969 - RNA, 22 nt, Homo sapiens
accagcuaacaauacacugcca

SEQ ID NO: 31970 - RNA, 21 nt, Homo sapiens
agaggucgaccguguaaugug

SEQ ID NO: 31971 - RNA, 21 nt, Homo sapiens
ccuacguuccauagucuacca

SEQ ID NO: 31972 - RNA, 21 nt, Homo sapiens
cguacgcuauacggucuacua

SEQ ID NO: 31973 - RNA, 22 nt, Homo sapiens
gccagcuaacaauacacugccu

SEQ ID NO: 31974 - RNA, 22 nt, Homo sapiens
aggaaaccagcaaguguugacg

SEQ ID NO: 31975 - RNA, 21 nt, Homo sapiens
ucuacucacagaagugucaau

SEQ ID NO: 31976 - RNA, 22 nt, Homo sapiens
gcaaaagaaacugugguuuuug

SEQ ID NO: 31977 - RNA, 22 nt, Homo sapiens
acaucaucgcauauugacacaa

SEQ ID NO: 31978 - RNA, 23 nt, Homo sapiens
acccaacagccccugcaagggau

SEQ ID NO: 31979 - RNA, 20 nt, Homo sapiens
uccccacagacccagagccg

SEQ ID NO: 31980 - RNA, 21 nt, Homo sapiens
auaauggagaccaggccacga

SEQ ID NO: 31981 - RNA, 22 nt, Homo sapiens
ucagaccgagacaagugcaaug

SEQ ID NO: 31982 - RNA, 22 nt, Homo sapiens
gaauucaucacggccagccucu

SEQ ID NO: 31983 - RNA, 22 nt, Homo sapiens
ccucaggcacggccgggccacc

SEQ ID NO: 31984 - RNA, 27 nt, Homo sapiens
uuuagcacagugcuuauacaagaaggu

SEQ ID NO: 31985 - RNA, 23 nt, Homo sapiens
agggauuccugggaaaacuggac

SEQ ID NO: 31986 - RNA, 21 nt, Homo sapiens
gaccaaucgccguccccgccg

SEQ ID NO: 31987 - RNA, 21 nt, Homo sapiens
agaggucgaccguguaaugug

SEQ ID NO: 31988 - RNA, 21 nt, Homo sapiens
ugcaaugcaacuacaaugcac

SEQ ID NO: 31989 - RNA, 21 nt, Homo sapiens
acaauccuagagcacaagaag

SEQ ID NO: 31990 - RNA, 22 nt, Homo sapiens
gcggucccgcggcgccccgccu

SEQ ID NO: 31991 - RNA, 22 nt, Homo sapiens
ugcuguuagcccuagccccgca

SEQ ID NO: 31992 - RNA, 20 nt, Homo sapiens
ugucuccacagggcucuuua

SEQ ID NO: 31993 - RNA, 23 nt, Homo sapiens
cuacgcguauucuuaagcaauaa

SEQ ID NO: 31994 - RNA, 21 nt, Homo sapiens
ccucaaggagcuucagucuag

SEQ ID NO: 31995 - RNA, 23 nt, Homo sapiens
acucaccgacagcguugaauguu

SEQ ID NO: 31996 - RNA, 23 nt, Homo sapiens
acccaccgacagcaaugaauguu

SEQ ID NO: 31997 - RNA, 22 nt, Homo sapiens
acucaccgacagguugaauguu

SEQ ID NO: 31998 - RNA, 23 nt, Homo sapiens
acccaccgacaacaaugaauguu

SEQ ID NO: 31999 - RNA, 21 nt, Homo sapiens
uagaaaggcuaggaccaaacc

SEQ ID NO: 32000 - RNA, 23 nt, Homo sapiens
gaacagguagucugaacacuggg

SEQ ID NO: 32001 - RNA, 23 nt, Homo sapiens
gaacagauagucuaaacacuggg

SEQ ID NO: 32002 - RNA, 22 nt, Homo sapiens
acugccugucugugccugcugu

SEQ ID NO: 32003 - RNA, 22 nt, Homo sapiens
ggagagccuccacccaacccuc

SEQ ID NO: 32004 - RNA, 21 nt, Homo sapiens
ugcaaugcaacuacaaugcac

SEQ ID NO: 32005 - RNA, 22 nt, Homo sapiens
auggcaguggaguuagugauug

SEQ ID NO: 32006 - RNA, 22 nt, Homo sapiens
accagguuccaccccagcaggc

SEQ ID NO: 32007 - RNA, 21 nt, Homo sapiens
cguacgcuauacggucuacua

SEQ ID NO: 32008 - RNA, 22 nt, Homo sapiens
aggaaaccagcaaguguugacg

SEQ ID NO: 32009 - RNA, 22 nt, Homo sapiens
aagaagugcaccgcgaauguuu

SEQ ID NO: 32010 - RNA, 19 nt, Homo sapiens
accagugcccugcacacuu

SEQ ID NO: 32011 - RNA, 22 nt, Homo sapiens
ccagugucuccaguaguagaca

SEQ ID NO: 32012 - RNA, 21 nt, Homo sapiens
ggggagcgggggcccugccuu

SEQ ID NO: 32013 - RNA, 21 nt, Homo sapiens
gagcugcauccuggcuccggg

SEQ ID NO: 32014 - RNA, 18 nt, Homo sapiens
gaaaugagggccagcuga

SEQ ID NO: 32015 - RNA, 20 nt, Homo sapiens
cugcgggaggacagggcuca

SEQ ID NO: 32016 - RNA, 17 nt, Homo sapiens
gggagaggaggaggcga

SEQ ID NO: 32017 - RNA, 23 nt, Homo sapiens
cccaacagacauggcgguacuca

SEQ ID NO: 32018 - RNA, 19 nt, Homo sapiens
guugggaucacaggcgccc

SEQ ID NO: 32019 - RNA, 20 nt, Homo sapiens
aggggccucagccuccuggu

SEQ ID NO: 32020 - RNA, 17 nt, Homo sapiens
uggaggccccagcgaga

SEQ ID NO: 32021 - RNA, 21 nt, Homo sapiens
uuuagcauaaguaugucccaa

SEQ ID NO: 32022 - RNA, 21 nt, Homo sapiens
cggggugcacgggcggagggc

SEQ ID NO: 32023 - RNA, 21 nt, Homo sapiens
gaccaaucgccguccccgccg

SEQ ID NO: 32024 - RNA, 20 nt, Homo sapiens
cccgccgcgucgcccugggg

SEQ ID NO: 32025 - RNA, 21 nt, Homo sapiens
ucaaucacagauagcaccccu

SEQ ID NO: 32026 - RNA, 23 nt, Homo sapiens
aagaaucuugucccgcagguccu

SEQ ID NO: 32027 - RNA, 23 nt, Homo sapiens
aggagaaggcaccaugggauuua

SEQ ID NO: 32028 - RNA, 21 nt, Homo sapiens
agguaauaccaauaccuugug

SEQ ID NO: 32029 - RNA, 21 nt, Homo sapiens
gcugaggucugggccaggucu

SEQ ID NO: 32030 - RNA, 25 nt, Homo sapiens
accaacggaccuacuucccuccgcc

SEQ ID NO: 32031 - RNA, 22 nt, Homo sapiens
gcggucccgcggcgccccgccu

SEQ ID NO: 32032 - RNA, 23 nt, Homo sapiens
cacugugggcccucuccgcacca

SEQ ID NO: 32033 - RNA, 22 nt, Homo sapiens
cuggagagacaaggggaagagg

SEQ ID NO: 32034 - RNA, 22 nt, Homo sapiens
agcuagugagaagucaaugccu

SEQ ID NO: 32035 - RNA, 22 nt, Homo sapiens
cacugguacaaggguugggaga

SEQ ID NO: 32036 - RNA, 23 nt, Homo sapiens
cuaacugcacuagaugcaccuua

SEQ ID NO: 32037 - RNA, 22 nt, Homo sapiens
cacucagcggccguuuccccaa

SEQ ID NO: 32038 - RNA, 23 nt, Homo sapiens
acauuuuucguuauugcucuuga

SEQ ID NO: 32039 - RNA, 22 nt, Homo sapiens
auaaggauuuuuaggggcauua

SEQ ID NO: 32040 - RNA, 23 nt, Homo sapiens
gaaagugcccucaaggcugagug

SEQ ID NO: 32041 - RNA, 20 nt, Homo sapiens
cccugcgccaucuccucuac

SEQ ID NO: 32042 - RNA, 23 nt, Homo sapiens
gacguaguccuauucucugcugc

SEQ ID NO: 32043 - RNA, 22 nt, Homo sapiens
aggucucacuuuguugcccaga

SEQ ID NO: 32044 - RNA, 22 nt, Homo sapiens
agagcaagaccccgucucuaaa

SEQ ID NO: 32045 - RNA, 23 nt, Homo sapiens
gaaacccagcagacaauguagcu

SEQ ID NO: 32046 - RNA, 22 nt, Homo sapiens
cuuccagucgaggauguuuaca

SEQ ID NO: 32047 - RNA, 22 nt, Homo sapiens
cuuccagucggggauguuuaca

SEQ ID NO: 32048 - RNA, 22 nt, Homo sapiens
cuuccagucaaggauguuuaca

SEQ ID NO: 32049 - RNA, 22 nt, Homo sapiens
auaaggauuuuuaggggcauua

SEQ ID NO: 32050 - RNA, 23 nt, Homo sapiens
ccacccaaugaccuacuccaaga

SEQ ID NO: 32051 - RNA, 22 nt, Homo sapiens
cagcauggaguccuccagguug

SEQ ID NO: 32052 - RNA, 24 nt, Homo sapiens
cagaaagugcuuucuuuuggagaa

SEQ ID NO: 32053 - RNA, 22 nt, Homo sapiens
aacacucuaaaaggaggcacuu

SEQ ID NO: 32054 - RNA, 21 nt, Homo sapiens
uugucuaaccagucaccuguu

SEQ ID NO: 32055 - RNA, 25 nt, Homo sapiens
aaggagcucagaagcccugcccagc

SEQ ID NO: 32056 - RNA, 22 nt, Homo sapiens
caagacacauuuggagagggac

SEQ ID NO: 32057 - RNA, 18 nt, Homo sapiens
gaaaugagggccagcuga

SEQ ID NO: 32058 - RNA, 18 nt, Homo sapiens
gaaaugagggccagcuga

SEQ ID NO: 32059 - RNA, 22 nt, Homo sapiens
caaacaccauugucacacucca

SEQ ID NO: 32060 - RNA, 17 nt, Homo sapiens
gggagaggaggaggcga

SEQ ID NO: 32061 - RNA, 23 nt, Homo sapiens
aggaacagcagcagcccgggccg

SEQ ID NO: 32062 - RNA, 21 nt, Homo sapiens
gaccaaucgccguccccgccg

SEQ ID NO: 32063 - RNA, 21 nt, Homo sapiens
gaccaaucgccguccccgccg

SEQ ID NO: 32064 - RNA, 22 nt, Homo sapiens
ucagaccgagacaagugcaaug

SEQ ID NO: 32065 - RNA, 25 nt, Homo sapiens
acggagcugucccaacaccaccccu

SEQ ID NO: 32066 - RNA, 25 nt, Homo sapiens
accaacggaccuacuucccuccgcc

SEQ ID NO: 32067 - RNA, 22 nt, Homo sapiens
gcggucccgcggcgccccgccu

SEQ ID NO: 32068 - RNA, 22 nt, Homo sapiens
gcggucccgcggcgccccgccu

SEQ ID NO: 32069 - RNA, 22 nt, Homo sapiens
ugcuguuagcccuagccccgca

SEQ ID NO: 32070 - RNA, 22 nt, Homo sapiens
cgcauuauuacucacgguacga

SEQ ID NO: 32071 - RNA, 22 nt, Homo sapiens
uguaaaccaugaugugcugcua

SEQ ID NO: 32072 - RNA, 23 nt, Homo sapiens
acauuuuucguuauugcucuuga

SEQ ID NO: 32073 - RNA, 23 nt, Homo sapiens
ucaacgggagugaucgugucauu

SEQ ID NO: 32074 - RNA, 22 nt, Homo sapiens
acaccgaggagcccaucaugau

SEQ ID NO: 32075 - RNA, 23 nt, Homo sapiens
ccuucucagaaaggugaaauuua

SEQ ID NO: 32076 - RNA, 23 nt, Homo sapiens
agaaaccaugggguaugagcaga

SEQ ID NO: 32077 - RNA, 22 nt, Homo sapiens
cucauccgauguacaauaauuu

SEQ ID NO: 32078 - RNA, 22 nt, Homo sapiens
cacgaccgacgccacgccgagu

SEQ ID NO: 32079 - RNA, 21 nt, Homo sapiens
gaccaaucgccguccccgccg

SEQ ID NO: 32080 - RNA, 22 nt, Homo sapiens
gaauucaucacggccagccucu

SEQ ID NO: 32081 - RNA, 21 nt, Homo sapiens
ucuacucacagaagugucaau

SEQ ID NO: 32082 - RNA, 22 nt, Homo sapiens
gcggucccgcggcgccccgccu

SEQ ID NO: 32083 - RNA, 22 nt, Homo sapiens
ugcuguuagcccuagccccgca

SEQ ID NO: 32084 - RNA, 21 nt, Homo sapiens
caucaccuuccuucuccucca

SEQ ID NO: 32085 - RNA, 22 nt, Homo sapiens
acacacccacgcgagccggaaa

SEQ ID NO: 32086 - RNA, 22 nt, Homo sapiens
ucccucacacagaauuccagaa

SEQ ID NO: 32087 - RNA, 22 nt, Homo sapiens
augcuuuuugggguaagggcuu

SEQ ID NO: 32088 - RNA, 22 nt, Homo sapiens
cagcugguugaaggggaccaaa

SEQ ID NO: 32089 - RNA, 22 nt, Homo sapiens
uagcugguugaaggggaccaaa

SEQ ID NO: 32090 - RNA, 23 nt, Homo sapiens
aggaacagcagcagcccgggccg

SEQ ID NO: 32091 - RNA, 23 nt, Homo sapiens
aggaacagcagcagcccgggccg

SEQ ID NO: 32092 - RNA, 21 nt, Homo sapiens
ggaaaucccuggcaaugugau

SEQ ID NO: 32093 - RNA, 21 nt, Homo sapiens
gguaaucccuggcaaugugau

SEQ ID NO: 32094 - RNA, 23 nt, Homo sapiens
aaagucucgcucucugccccuca

SEQ ID NO: 32095 - RNA, 22 nt, Homo sapiens
auaaacgacaccuccuugagaa

SEQ ID NO: 32096 - RNA, 21 nt, Homo sapiens
gugacucaucaccuauggaaa

SEQ ID NO: 32097 - RNA, 22 nt, Homo sapiens
aagagggagacccaggcucgga

SEQ ID NO: 32098 - RNA, 23 nt, Homo sapiens
acccaacagccccugcaagggau

SEQ ID NO: 32099 - RNA, 22 nt, Homo sapiens
ugcuguuagcccuagccccgca

SEQ ID NO: 32100 - RNA, 22 nt, Homo sapiens
gguuaguggaccaggucacaaa

SEQ ID NO: 32101 - RNA, 21 nt, Homo sapiens
auaauggagaccaggccacga

SEQ ID NO: 32102 - RNA, 22 nt, Homo sapiens
caaacaccauugucacacucca

SEQ ID NO: 32103 - RNA, 21 nt, Homo sapiens
ucacccagaucugcggccuaa

SEQ ID NO: 32104 - RNA, 22 nt, Homo sapiens
ggagcccgcgccccgcgccgag

SEQ ID NO: 32105 - RNA, 22 nt, Homo sapiens
ugagccacugugccuggccuga

SEQ ID NO: 32106 - RNA, 23 nt, Homo sapiens
ucucgugacaugaugauccccga

SEQ ID NO: 32107 - RNA, 19 nt, Homo sapiens
guccugaauuccgcagccu

SEQ ID NO: 32108 - RNA, 22 nt, Homo sapiens
caagacacauuuggagagggac

SEQ ID NO: 32109 - RNA, 21 nt, Homo sapiens
gaaggaagugagugcagccac

SEQ ID NO: 32110 - RNA, 24 nt, Homo sapiens
acgcgcaggccagagacccaggca

SEQ ID NO: 32111 - RNA, 22 nt, Homo sapiens
gacucgaaccacugauccagca

SEQ ID NO: 32112 - RNA, 21 nt, Homo sapiens
gggcaucugggacgcgcagga

SEQ ID NO: 32113 - RNA, 21 nt, Homo sapiens
gaccaaucgccguccccgccg

SEQ ID NO: 32114 - RNA, 22 nt, Homo sapiens
cggugagcacccggccccugcg

SEQ ID NO: 32115 - RNA, 23 nt, Homo sapiens
cagcugcuuuugggauuccguug

SEQ ID NO: 32116 - RNA, 23 nt, Homo sapiens
cccaacagacauggcgguacuca

SEQ ID NO: 32117 - RNA, 19 nt, Homo sapiens
uaugcuaccuuugcacggu

SEQ ID NO: 32118 - RNA, 22 nt, Homo sapiens
ggagagccuccacccaacccuc

SEQ ID NO: 32119 - RNA, 22 nt, Homo sapiens
cagcauggaguccuccagguug

SEQ ID NO: 32120 - RNA, 22 nt, Homo sapiens
gaacuugcuaaaaaugcagaau

SEQ ID NO: 32121 - RNA, 24 nt, Homo sapiens
acugggcacaaacauguccagguc

SEQ ID NO: 32122 - RNA, 22 nt, Homo sapiens
gcggucccgcggcgccccgccu

SEQ ID NO: 32123 - RNA, 22 nt, Homo sapiens
ugcuguuagcccuagccccgca

SEQ ID NO: 32124 - RNA, 22 nt, Homo sapiens
ucaaugacucagguaaguugca

SEQ ID NO: 32125 - RNA, 21 nt, Homo sapiens
gagcugcauccuggcuccggg

SEQ ID NO: 32126 - RNA, 22 nt, Homo sapiens
ugaagaagggggggaagggcgu

SEQ ID NO: 32127 - RNA, 21 nt, Homo sapiens
gggcaucugggacgcgcagga

SEQ ID NO: 32128 - RNA, 22 nt, Homo sapiens
cggugagcacccggccccugcg

SEQ ID NO: 32129 - RNA, 23 nt, Homo sapiens
cccaacagacauggcgguacuca

SEQ ID NO: 32130 - RNA, 22 nt, Homo sapiens
agcgggacuuugagggccaguu

SEQ ID NO: 32131 - RNA, 22 nt, Homo sapiens
uacagauggauaccgugcaauu

SEQ ID NO: 32132 - RNA, 25 nt, Homo sapiens
acggagcugucccaacaccaccccu

SEQ ID NO: 32133 - RNA, 22 nt, Homo sapiens
acuggguucaccuuuaagggca

SEQ ID NO: 32134 - RNA, 19 nt, Homo sapiens
ccaccucccgaguccucac

SEQ ID NO: 32135 - RNA, 22 nt, Homo sapiens
agcccaaaaggagaauucuuug

SEQ ID NO: 32136 - RNA, 22 nt, Homo sapiens
ucaucucgcccgcaaagaccca

SEQ ID NO: 32137 - RNA, 23 nt, Homo sapiens
gaacagguagucugaacacuggg

SEQ ID NO: 32138 - RNA, 23 nt, Homo sapiens
gaacagauagucuaaacacuggg

SEQ ID NO: 32139 - RNA, 23 nt, Homo sapiens
ucaguuuugcauagauuugcaca

SEQ ID NO: 32140 - RNA, 22 nt, Homo sapiens
cacucagcaccaggauauuguu

SEQ ID NO: 32141 - RNA, 22 nt, Homo sapiens
aacuaugcaaccuacuaccucu

SEQ ID NO: 32142 - RNA, 22 nt, Homo sapiens
ugcaacuuaguaaugugcaaua

SEQ ID NO: 32143 - RNA, 23 nt, Homo sapiens
acggcuaguggaccaggugaagu

SEQ ID NO: 32144 - RNA, 22 nt, Homo sapiens
uucaaaacaugaauugcugcug

SEQ ID NO: 32145 - RNA, 23 nt, Homo sapiens
ccuucucagaaaggugaaauuua

SEQ ID NO: 32146 - RNA, 24 nt, Homo sapiens
cugaucaguuacacaucacuucag

SEQ ID NO: 32147 - RNA, 21 nt, Homo sapiens
guccugagagcgcugccuccu

SEQ ID NO: 32148 - RNA, 21 nt, Homo sapiens
uucaguuaucacaguacugua

SEQ ID NO: 32149 - RNA, 18 nt, Homo sapiens
gaaaugagggccagcuga

SEQ ID NO: 32150 - RNA, 19 nt, Homo sapiens
ccaccucccgaguccucac

SEQ ID NO: 32151 - RNA, 17 nt, Homo sapiens
gggagaggaggaggcga

SEQ ID NO: 32152 - RNA, 18 nt, Homo sapiens
aucacauucaccucccug

SEQ ID NO: 32153 - RNA, 23 nt, Homo sapiens
gggagugaagacacggagccaga

SEQ ID NO: 32154 - RNA, 21 nt, Homo sapiens
gggcaucugggacgcgcagga

SEQ ID NO: 32155 - RNA, 21 nt, Homo sapiens
gaccaaucgccguccccgccg

SEQ ID NO: 32156 - RNA, 22 nt, Homo sapiens
cucaauagacugugagcuccuu

SEQ ID NO: 32157 - RNA, 22 nt, Homo sapiens
gcggucccgcggcgccccgccu

SEQ ID NO: 32158 - RNA, 23 nt, Homo sapiens
cccagcuagauuguaagcuccuu

SEQ ID NO: 32159 - RNA, 24 nt, Homo sapiens
cacccccagagccucagcucccca

SEQ ID NO: 32160 - RNA, 22 nt, Homo sapiens
ccccucuggucaaccagucaca

SEQ ID NO: 32161 - RNA, 23 nt, Homo sapiens
gggagugaagacacggagccaga

SEQ ID NO: 32162 - RNA, 23 nt, Homo sapiens
gggagugaagacacggagccaga

SEQ ID NO: 32163 - RNA, 21 nt, Homo sapiens
acuagacugugagcuccucga

SEQ ID NO: 32164 - RNA, 23 nt, Homo sapiens
cccaacagacauggcgguacuca

SEQ ID NO: 32165 - RNA, 22 nt, Homo sapiens
cuguuccugcugaacugagcca

SEQ ID NO: 32166 - RNA, 22 nt, Homo sapiens
agcugaguguaggauguuuaca

SEQ ID NO: 32167 - RNA, 20 nt, Homo sapiens
cuggaggaagggcccagagg

SEQ ID NO: 32168 - RNA, 22 nt, Homo sapiens
gccuaagacacaggcccagaga

SEQ ID NO: 32169 - RNA, 23 nt, Homo sapiens
acugaggggccucagaccgagcu

SEQ ID NO: 32170 - RNA, 22 nt, Homo sapiens
aucgggaggggacugagccuga

SEQ ID NO: 32171 - RNA, 22 nt, Homo sapiens
gaauucaucacggccagccucu

SEQ ID NO: 32172 - RNA, 22 nt, Homo sapiens
aggaaaccagcaaguguugacg

SEQ ID NO: 32173 - RNA, 20 nt, Homo sapiens
uccccacagacccagagccg

SEQ ID NO: 32174 - RNA, 21 nt, Homo sapiens
caucaccuuccuucuccucca

SEQ ID NO: 32175 - RNA, 20 nt, Homo sapiens
acagcaaggagggcaggagg

SEQ ID NO: 32176 - RNA, 22 nt, Homo sapiens
acugccugucugugccugcugu

SEQ ID NO: 32177 - RNA, 21 nt, Homo sapiens
gcggaacuuagccacugugaa

SEQ ID NO: 32178 - RNA, 22 nt, Homo sapiens
cucaauagacugugagcuccuu

SEQ ID NO: 32179 - RNA, 22 nt, Homo sapiens
aaucagucucauugcuuuauaa

SEQ ID NO: 32180 - RNA, 22 nt, Homo sapiens
acaaccagcuaagacacugcca

SEQ ID NO: 32181 - RNA, 22 nt, Homo sapiens
accagguuccaccccagcaggc

SEQ ID NO: 32182 - RNA, 22 nt, Homo sapiens
auaaacgacaccuccuugagaa

SEQ ID NO: 32183 - RNA, 23 nt, Homo sapiens
acagaaagugcuucccucaagag

SEQ ID NO: 32184 - RNA, 23 nt, Homo sapiens
cccagcuagauuguaagcuccuu

SEQ ID NO: 32185 - RNA, 22 nt, Homo sapiens
gggagaggucucccugcgcaca

SEQ ID NO: 32186 - RNA, 22 nt, Homo sapiens
cgcauuauuacucacgguacga

SEQ ID NO: 32187 - RNA, 22 nt, Homo sapiens
ucaggaacugccuuucucucca

SEQ ID NO: 32188 - RNA, 22 nt, Homo sapiens
agcccaaaaggagaauucuuug

SEQ ID NO: 32189 - RNA, 23 nt, Homo sapiens
ucaguuuugcauagauuugcaca

SEQ ID NO: 32190 - RNA, 22 nt, Homo sapiens
cacucagcaccaggauauuguu

SEQ ID NO: 32191 - RNA, 22 nt, Homo sapiens
aacuaugcaaccuacuaccucu

SEQ ID NO: 32192 - RNA, 21 nt, Homo sapiens
ugcaaugcaacuacaaugcac

SEQ ID NO: 32193 - RNA, 22 nt, Homo sapiens
uauucaggaacauauugcaaaa

SEQ ID NO: 32194 - RNA, 22 nt, Homo sapiens
uauucaggaacauauugcaaaa

SEQ ID NO: 32195 - RNA, 22 nt, Homo sapiens
ucaguuuccucugcaaacaguu

SEQ ID NO: 32196 - RNA, 20 nt, Homo sapiens
acaaugagaacccauggucu

SEQ ID NO: 32197 - RNA, 22 nt, Homo sapiens
caaacaccauugucacacucca

SEQ ID NO: 32198 - RNA, 22 nt, Homo sapiens
ucaaugacucagguaaguugca

SEQ ID NO: 32199 - RNA, 22 nt, Homo sapiens
cucauccgauguacaauaauuu

SEQ ID NO: 32200 - RNA, 22 nt, Homo sapiens
gaggcucagaauggcucaggag

SEQ ID NO: 32201 - RNA, 22 nt, Homo sapiens
gacucgaaccacugauccagca

SEQ ID NO: 32202 - RNA, 23 nt, Homo sapiens
acucaccgacagcguugaauguu

SEQ ID NO: 32203 - RNA, 22 nt, Homo sapiens
uggcagcagcggagggggcaga

SEQ ID NO: 32204 - RNA, 22 nt, Homo sapiens
agucuucacaacagcccugugu

SEQ ID NO: 32205 - RNA, 21 nt, Homo sapiens
ggaaaucccuggcaaugugau

SEQ ID NO: 32206 - RNA, 21 nt, Homo sapiens
gguaaucccuggcaaugugau

SEQ ID NO: 32207 - RNA, 20 nt, Homo sapiens
ccagcagcaccuggggcagu

SEQ ID NO: 32208 - RNA, 23 nt, Homo sapiens
aaaucagaaucacaccuggggga

SEQ ID NO: 32209 - RNA, 23 nt, Homo sapiens
ccacccaaugaccuacuccaaga

SEQ ID NO: 32210 - RNA, 22 nt, Homo sapiens
gaauucaucacggccagccucu

SEQ ID NO: 32211 - RNA, 21 nt, Homo sapiens
auccuguacugagcugccccg

SEQ ID NO: 32212 - RNA, 23 nt, Homo sapiens
aagaaucuugucccgcagguccu

SEQ ID NO: 32213 - RNA, 21 nt, Homo sapiens
gcugaggucugggccaggucu

SEQ ID NO: 32214 - RNA, 24 nt, Homo sapiens
acgcagagcccgaaagcccccagu

SEQ ID NO: 32215 - RNA, 21 nt, Homo sapiens
guccugagagcgcugccuccu

SEQ ID NO: 32216 - RNA, 21 nt, Homo sapiens
aggagacucacaaguuccugc

SEQ ID NO: 32217 - RNA, 22 nt, Homo sapiens
cacaaaccauuaugugcugcua

SEQ ID NO: 32218 - RNA, 22 nt, Homo sapiens
uucacacugcaugcucugggua

SEQ ID NO: 32219 - RNA, 22 nt, Homo sapiens
ugagccacugugccuggccuga

SEQ ID NO: 32220 - RNA, 20 nt, Homo sapiens
cuggaggaagggcccagagg

SEQ ID NO: 32221 - RNA, 22 nt, Homo sapiens
gccuaagacacaggcccagaga

SEQ ID NO: 32222 - RNA, 22 nt, Homo sapiens
gagcccuggacuaggagucagc

SEQ ID NO: 32223 - RNA, 20 nt, Homo sapiens
agugcccccacaguuugagu

SEQ ID NO: 32224 - RNA, 22 nt, Homo sapiens
gauccgagcaccggggaccccc

SEQ ID NO: 32225 - RNA, 19 nt, Homo sapiens
ucagcaguaccagccuaga

SEQ ID NO: 32226 - RNA, 22 nt, Homo sapiens
gcggucccgcggcgccccgccu

SEQ ID NO: 32227 - RNA, 22 nt, Homo sapiens
ccucaggcacggccgggccacc

SEQ ID NO: 32228 - RNA, 24 nt, Homo sapiens
cacccccagagccucagcucccca

SEQ ID NO: 32229 - RNA, 26 nt, Homo sapiens
uuucagaauuugcugccaucaucauc

SEQ ID NO: 32230 - RNA, 20 nt, Homo sapiens
cucaaagcaaacccugcaga

SEQ ID NO: 32231 - RNA, 23 nt, Homo sapiens
cuaucugcacuagaugcaccuua

SEQ ID NO: 32232 - RNA, 23 nt, Homo sapiens
gaacagguagucugaacacuggg

SEQ ID NO: 32233 - RNA, 23 nt, Homo sapiens
gaacagauagucuaaacacuggg

SEQ ID NO: 32234 - RNA, 21 nt, Homo sapiens
acaugguuagaucaagcacaa

SEQ ID NO: 32235 - RNA, 22 nt, Homo sapiens
ugggguauuugacaaacugaca

SEQ ID NO: 32236 - RNA, 24 nt, Homo sapiens
ugggagaaccucccugcuucugcu

SEQ ID NO: 32237 - RNA, 23 nt, Homo sapiens
acaccccaaaaucgaagcacuuc

SEQ ID NO: 32238 - RNA, 22 nt, Homo sapiens
cagcauggaguccuccagguug

SEQ ID NO: 32239 - RNA, 22 nt, Homo sapiens
cucauauuacaaugagcucauc

SEQ ID NO: 32240 - RNA, 22 nt, Homo sapiens
cugcucaaacccuccaaugacu

SEQ ID NO: 32241 - RNA, 21 nt, Homo sapiens
aguucucccaacguaaaccca

SEQ ID NO: 32242 - RNA, 22 nt, Homo sapiens
accuucccugguacagaauacu

SEQ ID NO: 32243 - RNA, 19 nt, Homo sapiens
ucagcaguaccagccuaga

SEQ ID NO: 32244 - RNA, 22 nt, Homo sapiens
gguuaguggaccaggucacaaa

SEQ ID NO: 32245 - RNA, 21 nt, Homo sapiens
ugacugacagcuuuuugagua

SEQ ID NO: 32246 - RNA, 24 nt, Homo sapiens
ucacagguuaaagggucucaggga

SEQ ID NO: 32247 - RNA, 22 nt, Homo sapiens
ucacaaguuagggucucaggga

SEQ ID NO: 32248 - RNA, 23 nt, Homo sapiens
agcccuguucuacagcccugagg

SEQ ID NO: 32249 - RNA, 24 nt, Homo sapiens
acugcuggucuucagucagggcca

SEQ ID NO: 32250 - RNA, 21 nt, Homo sapiens
aguagugcuuucuacuuuaug

SEQ ID NO: 32251 - RNA, 21 nt, Homo sapiens
acaggauugagggggggcccu

SEQ ID NO: 32252 - RNA, 22 nt, Homo sapiens
ggaucccugggaccauaccuag

SEQ ID NO: 32253 - RNA, 21 nt, Homo sapiens
gaccaagaaauagccuuucaa

SEQ ID NO: 32254 - RNA, 22 nt, Homo sapiens
gugauugccacucuccugagua

SEQ ID NO: 32255 - RNA, 23 nt, Homo sapiens
aaucgcgguuuauaccaaaugaa

SEQ ID NO: 32256 - RNA, 20 nt, Homo sapiens
acaaugagaacccauggucu

SEQ ID NO: 32257 - RNA, 22 nt, Homo sapiens
caaacaccauugucacacucca

SEQ ID NO: 32258 - RNA, 17 nt, Homo sapiens
ggguggcagcgguggga

SEQ ID NO: 32259 - RNA, 21 nt, Homo sapiens
cggggugcacgggcggagggc

SEQ ID NO: 32260 - RNA, 23 nt, Homo sapiens
aggaacagcagcagcccgggccg

SEQ ID NO: 32261 - RNA, 22 nt, Homo sapiens
ucagaccgagacaagugcaaug

SEQ ID NO: 32262 - RNA, 19 nt, Homo sapiens
guugggaucacaggcgccc

SEQ ID NO: 32263 - RNA, 25 nt, Homo sapiens
accaacggaccuacuucccuccgcc

SEQ ID NO: 32264 - RNA, 20 nt, Homo sapiens
uacugcuuccacagcucccc

SEQ ID NO: 32265 - RNA, 20 nt, Homo sapiens
cugcgggaggacagggcuca

SEQ ID NO: 32266 - RNA, 22 nt, Homo sapiens
aucagagcccucugagcuucag

SEQ ID NO: 32267 - RNA, 22 nt, Homo sapiens
ucccucacacagaauuccagaa

SEQ ID NO: 32268 - RNA, 22 nt, Homo sapiens
augcuuuuugggguaagggcuu

SEQ ID NO: 32269 - RNA, 22 nt, Homo sapiens
ucaguuuccucugcaaacaguu

SEQ ID NO: 32270 - RNA, 21 nt, Homo sapiens
gccaauauuucugugcugcua

SEQ ID NO: 32271 - RNA, 22 nt, Homo sapiens
cucaauagacugugagcuccuu

SEQ ID NO: 32272 - RNA, 23 nt, Homo sapiens
acauuuuucguuauugcucuuga

SEQ ID NO: 32273 - RNA, 22 nt, Homo sapiens
cacucagcaccaggauauuguu

SEQ ID NO: 32274 - RNA, 22 nt, Homo sapiens
gacaaaacccgcaaauacuuuu

SEQ ID NO: 32275 - RNA, 22 nt, Homo sapiens
gcaaagguaauugcuguuuucg

SEQ ID NO: 32276 - RNA, 19 nt, Homo sapiens
ucccacaggaagcagacac

SEQ ID NO: 32277 - RNA, 23 nt, Homo sapiens
cccagcuagauuguaagcuccuu

SEQ ID NO: 32278 - RNA, 22 nt, Homo sapiens
ucaaugacucagguaaguugca

SEQ ID NO: 32279 - RNA, 22 nt, Homo sapiens
acuggguucaccuuuaagggca

SEQ ID NO: 32280 - RNA, 21 nt, Homo sapiens
cuagggaagaacagugagcaa

SEQ ID NO: 32281 - RNA, 26 nt, Homo sapiens
aaccaucucauacaaaccaacuacuu

SEQ ID NO: 32282 - RNA, 22 nt, Homo sapiens
agaaaaugccccucaguuuuga

SEQ ID NO: 32283 - RNA, 22 nt, Homo sapiens
ucaguuuccucugcaaacaguu

SEQ ID NO: 32284 - RNA, 21 nt, Homo sapiens
gccaauauuucugugcugcua

SEQ ID NO: 32285 - RNA, 23 nt, Homo sapiens
ccacugaaacauggaagcacuua

SEQ ID NO: 32286 - RNA, 21 nt, Homo sapiens
aaagaucaaccauguauuauu

SEQ ID NO: 32287 - RNA, 21 nt, Homo sapiens
ugacugcagagcaaaagacac

SEQ ID NO: 32288 - RNA, 22 nt, Homo sapiens
gcaaaaguaacugcaguuuugg

SEQ ID NO: 32289 - RNA, 21 nt, Homo sapiens
ugcaggcugaucuucuucucu

SEQ ID NO: 32290 - RNA, 20 nt, Homo sapiens
ugucuccacagggcucuuua

SEQ ID NO: 32291 - RNA, 18 nt, Homo sapiens
cagcagccuccuucucaa

SEQ ID NO: 32292 - RNA, 22 nt, Homo sapiens
uccacauggaguugcuguuaca

SEQ ID NO: 32293 - RNA, 20 nt, Homo sapiens
acauuacuguuaucaaaaca

SEQ ID NO: 32294 - RNA, 22 nt, Homo sapiens
auaaggauuuuuaggggcauua

SEQ ID NO: 32295 - RNA, 22 nt, Homo sapiens
gcugccguauaugugaugucac

SEQ ID NO: 32296 - RNA, 21 nt, Homo sapiens
cugaaaccaaguaugggucgc

SEQ ID NO: 32297 - RNA, 21 nt, Homo sapiens
cggggugcacgggcggagggc

SEQ ID NO: 32298 - RNA, 22 nt, Homo sapiens
ucagaccgagacaagugcaaug

SEQ ID NO: 32299 - RNA, 23 nt, Homo sapiens
cugcagaacuguucccgcugcua

SEQ ID NO: 32300 - RNA, 21 nt, Homo sapiens
gguggagcccugagaaccgga

SEQ ID NO: 32301 - RNA, 20 nt, Homo sapiens
uccccacagacccagagccg

SEQ ID NO: 32302 - RNA, 23 nt, Homo sapiens
cacaaauucgguucuacagggua

SEQ ID NO: 32303 - RNA, 21 nt, Homo sapiens
cggcucggguggcggcgacgg

SEQ ID NO: 32304 - RNA, 21 nt, Homo sapiens
guuauagaucuggauuugaac

SEQ ID NO: 32305 - RNA, 22 nt, Homo sapiens
cacaagaucggaucuacggguu

SEQ ID NO: 32306 - RNA, 22 nt, Homo sapiens
cgcaaggucgguucuacgggug

SEQ ID NO: 32307 - RNA, 23 nt, Homo sapiens
gggagugaagacacggagccaga

SEQ ID NO: 32308 - RNA, 21 nt, Homo sapiens
gggcaucugggacgcgcagga

SEQ ID NO: 32309 - RNA, 21 nt, Homo sapiens
gaccaaucgccguccccgccg

SEQ ID NO: 32310 - RNA, 21 nt, Homo sapiens
ggaaaucccuggcaaugugau

SEQ ID NO: 32311 - RNA, 21 nt, Homo sapiens
gguaaucccuggcaaugugau

SEQ ID NO: 32312 - RNA, 23 nt, Homo sapiens
aaagucucgcucucugccccuca

SEQ ID NO: 32313 - RNA, 22 nt, Homo sapiens
gcggucccgcggcgccccgccu

SEQ ID NO: 32314 - RNA, 22 nt, Homo sapiens
ugcuguuagcccuagccccgca

SEQ ID NO: 32315 - RNA, 26 nt, Homo sapiens
uuucagaauuugcugccaucaucauc

SEQ ID NO: 32316 - RNA, 17 nt, Homo sapiens
gggagaggaggaggcga

SEQ ID NO: 32317 - RNA, 22 nt, Homo sapiens
uccacauggaguugcuguuaca

SEQ ID NO: 32318 - RNA, 22 nt, Homo sapiens
ucagaccgagacaagugcaaug

SEQ ID NO: 32319 - RNA, 23 nt, Homo sapiens
cggcucugucgucgaggcgcuca

SEQ ID NO: 32320 - RNA, 22 nt, Homo sapiens
uacagauggauaccgugcaauu

SEQ ID NO: 32321 - RNA, 25 nt, Homo sapiens
acggagcugucccaacaccaccccu

SEQ ID NO: 32322 - RNA, 21 nt, Homo sapiens
agguaagcgcuguugcuagcc

SEQ ID NO: 32323 - RNA, 22 nt, Homo sapiens
caagacacauuuggagagggac

SEQ ID NO: 32324 - RNA, 22 nt, Homo sapiens
gcugaggcuguggggcuggagu

SEQ ID NO: 32325 - RNA, 20 nt, Homo sapiens
uacugcuuccacagcucccc

SEQ ID NO: 32326 - RNA, 21 nt, Homo sapiens
cggggugcacgggcggagggc

SEQ ID NO: 32327 - RNA, 23 nt, Homo sapiens
cccaacagacauggcgguacuca

SEQ ID NO: 32328 - RNA, 22 nt, Homo sapiens
ucagaccgagacaagugcaaug

SEQ ID NO: 32329 - RNA, 19 nt, Homo sapiens
guccugaauuccgcagccu

SEQ ID NO: 32330 - RNA, 25 nt, Homo sapiens
accaacggaccuacuucccuccgcc

SEQ ID NO: 32331 - RNA, 21 nt, Homo sapiens
cugcugggccacaacguggga

SEQ ID NO: 32332 - RNA, 20 nt, Homo sapiens
aggggccucagccuccuggu

SEQ ID NO: 32333 - RNA, 23 nt, Homo sapiens
ccgcuugagcuaacuccgacccg

SEQ ID NO: 32334 - RNA, 22 nt, Homo sapiens
ggcagagagucagagcgcggau

SEQ ID NO: 32335 - RNA, 21 nt, Homo sapiens
ccccucccagccucccugcca

SEQ ID NO: 32336 - RNA, 22 nt, Homo sapiens
caaacaccauugucacacucca

SEQ ID NO: 32337 - RNA, 21 nt, Homo sapiens
gggcaucugggacgcgcagga

SEQ ID NO: 32338 - RNA, 18 nt, Homo sapiens
ggagaggagggcacugga

SEQ ID NO: 32339 - RNA, 23 nt, Homo sapiens
cccaacagacauggcgguacuca

SEQ ID NO: 32340 - RNA, 22 nt, Homo sapiens
ucagaccgagacaagugcaaug

SEQ ID NO: 32341 - RNA, 22 nt, Homo sapiens
ucagaccgagacaagugcaaug

SEQ ID NO: 32342 - RNA, 23 nt, Homo sapiens
aaaucagaaucacaccuggggga

SEQ ID NO: 32343 - RNA, 25 nt, Homo sapiens
accaacggaccuacuucccuccgcc

SEQ ID NO: 32344 - RNA, 25 nt, Homo sapiens
accaacggaccuacuucccuccgcc

SEQ ID NO: 32345 - RNA, 23 nt, Homo sapiens
cuccagccccuccagggcuuccu

SEQ ID NO: 32346 - RNA, 21 nt, Homo sapiens
ggggagcgggggcccugccuu

SEQ ID NO: 32347 - RNA, 18 nt, Homo sapiens
cagcagccuccuucucaa

SEQ ID NO: 32348 - RNA, 21 nt, Homo sapiens
ccgugguucuacccuguggua

SEQ ID NO: 32349 - RNA, 21 nt, Homo sapiens
agagcucauccauaguuguca

SEQ ID NO: 32350 - RNA, 22 nt, Homo sapiens
auggcaguggaguuagugauug

SEQ ID NO: 32351 - RNA, 21 nt, Homo sapiens
acuagcuuauacauaaaauua

SEQ ID NO: 32352 - RNA, 21 nt, Homo sapiens
acuagcuuauacauaaaauua

SEQ ID NO: 32353 - RNA, 17 nt, Homo sapiens
uggaggccccagcgaga

SEQ ID NO: 32354 - RNA, 23 nt, Homo sapiens
accacaggagucugagcauuuga

SEQ ID NO: 32355 - RNA, 20 nt, Homo sapiens
cugcgggaggacagggcuca

SEQ ID NO: 32356 - RNA, 18 nt, Homo sapiens
aucacauucaccucccug

SEQ ID NO: 32357 - RNA, 21 nt, Homo sapiens
cggggugcacgggcggagggc

SEQ ID NO: 32358 - RNA, 22 nt, Homo sapiens
acccuuaucaguucuccgucca

SEQ ID NO: 32359 - RNA, 21 nt, Homo sapiens
acccaguagccagauguagcu

SEQ ID NO: 32360 - RNA, 23 nt, Homo sapiens
agaggcaggcaugcgggcagaca

SEQ ID NO: 32361 - RNA, 19 nt, Homo sapiens
agaaaccccagcagagaca

SEQ ID NO: 32362 - RNA, 20 nt, Homo sapiens
cucaaagcaaacccugcaga

SEQ ID NO: 32363 - RNA, 17 nt, Homo sapiens
caccugaauuacuugaa

SEQ ID NO: 32364 - RNA, 22 nt, Homo sapiens
agccuauccuggauuacuugaa

SEQ ID NO: 32365 - RNA, 21 nt, Homo sapiens
accuauccugaauuacuugaa

SEQ ID NO: 32366 - RNA, 22 nt, Homo sapiens
cuacccacagacguaccaauca

SEQ ID NO: 32367 - RNA, 23 nt, Homo sapiens
aggagaaggcaccaugggauuua

SEQ ID NO: 32368 - RNA, 22 nt, Homo sapiens
aaggugauggucagcagacaua

SEQ ID NO: 32369 - RNA, 23 nt, Homo sapiens
uguaggcuggggauaaaugaaua

SEQ ID NO: 32370 - RNA, 20 nt, Homo sapiens
acaaugagaacccauggucu

SEQ ID NO: 32371 - RNA, 22 nt, Homo sapiens
caaacaccauugucacacucca

SEQ ID NO: 32372 - RNA, 22 nt, Homo sapiens
cucauccgauguacaauaauuu

SEQ ID NO: 32373 - RNA, 23 nt, Homo sapiens
ggaagccaucaagucgcugcagg

SEQ ID NO: 32374 - RNA, 20 nt, Homo sapiens
cucaaagcaaacccugcaga

SEQ ID NO: 32375 - RNA, 21 nt, Homo sapiens
cugggggacggagcagaagga

SEQ ID NO: 32376 - RNA, 17 nt, Homo sapiens
gggagaggaggaggcga

SEQ ID NO: 32377 - RNA, 20 nt, Homo sapiens
acagcaaggagggcaggagg

SEQ ID NO: 32378 - RNA, 22 nt, Homo sapiens
ucagaccgagacaagugcaaug

SEQ ID NO: 32379 - RNA, 21 nt, Homo sapiens
ccuucugacuccaaguccagu

SEQ ID NO: 32380 - RNA, 22 nt, Homo sapiens
gccuucugacccuaaguccagu

SEQ ID NO: 32381 - RNA, 22 nt, Homo sapiens
gccagcuaacaauacacugccu

SEQ ID NO: 32382 - RNA, 23 nt, Homo sapiens
ccuagagagggugagaaccugcc

SEQ ID NO: 32383 - RNA, 21 nt, Homo sapiens
caucaccuuccuucuccucca

SEQ ID NO: 32384 - RNA, 23 nt, Homo sapiens
gacguaguccuauucucugcugc

SEQ ID NO: 32385 - RNA, 22 nt, Homo sapiens
caaacaccauugucacacucca

SEQ ID NO: 32386 - RNA, 22 nt, Homo sapiens
ucccucacacagaauuccagaa

SEQ ID NO: 32387 - RNA, 22 nt, Homo sapiens
augcuuuuugggguaagggcuu

SEQ ID NO: 32388 - RNA, 23 nt, Homo sapiens
gggagugaagacacggagccaga

SEQ ID NO: 32389 - RNA, 21 nt, Homo sapiens
gaccaaucgccguccccgccg

SEQ ID NO: 32390 - RNA, 23 nt, Homo sapiens
cccaacagacauggcgguacuca

SEQ ID NO: 32391 - RNA, 22 nt, Homo sapiens
uagucaagugaagcagugggag

SEQ ID NO: 32392 - RNA, 22 nt, Homo sapiens
ucagaccgagacaagugcaaug

SEQ ID NO: 32393 - RNA, 23 nt, Homo sapiens
aaaucagaaucacaccuggggga

SEQ ID NO: 32394 - RNA, 21 nt, Homo sapiens
aagacgggaggagaggaguga

SEQ ID NO: 32395 - RNA, 22 nt, Homo sapiens
aggaaaccagcaaguguugacg

SEQ ID NO: 32396 - RNA, 24 nt, Homo sapiens
acgcagagcccgaaagcccccagu

SEQ ID NO: 32397 - RNA, 22 nt, Homo sapiens
gcggucccgcggcgccccgccu

SEQ ID NO: 32398 - RNA, 22 nt, Homo sapiens
ugcuguuagcccuagccccgca

SEQ ID NO: 32399 - RNA, 21 nt, Homo sapiens
caucaccuuccuucuccucca

SEQ ID NO: 32400 - RNA, 20 nt, Homo sapiens
uacugcuuccacagcucccc

SEQ ID NO: 32401 - RNA, 18 nt, Homo sapiens
cccccaccaccacgcccg

SEQ ID NO: 32402 - RNA, 21 nt, Homo sapiens
auguaggccuuuagaucacuu

SEQ ID NO: 32403 - RNA, 25 nt, Homo sapiens
agcuagucaagcgcgguuguggggg

SEQ ID NO: 32404 - RNA, 22 nt, Homo sapiens
ccucauggaaggguuccccacu

SEQ ID NO: 32405 - RNA, 22 nt, Homo sapiens
acaguggucaucgagugacaca

SEQ ID NO: 32406 - RNA, 25 nt, Homo sapiens
acggagcugucccaacaccaccccu

SEQ ID NO: 32407 - RNA, 23 nt, Homo sapiens
agaaaccaugggguaugagcaga

SEQ ID NO: 32408 - RNA, 20 nt, Homo sapiens
uacugcuuccacagcucccc

SEQ ID NO: 32409 - RNA, 23 nt, Homo sapiens
aggaacagcagcagcccgggccg

SEQ ID NO: 32410 - RNA, 22 nt, Homo sapiens
gaaccuaucuccccucuggacc

SEQ ID NO: 32411 - RNA, 22 nt, Homo sapiens
aagauguggaccauauuacaua

SEQ ID NO: 32412 - RNA, 23 nt, Homo sapiens
acacucuaaagagaagcgcuuug

SEQ ID NO: 32413 - RNA, 21 nt, Homo sapiens
agaaaguacuucccucuggag

SEQ ID NO: 32414 - RNA, 21 nt, Homo sapiens
agaaagugcaucccucuggag

SEQ ID NO: 32415 - RNA, 19 nt, Homo sapiens
gggaaacguaugucaaccu

SEQ ID NO: 32416 - RNA, 21 nt, Homo sapiens
gcugaggucugggccaggucu

SEQ ID NO: 32417 - RNA, 23 nt, Homo sapiens
ggacauuguuucagugcccaagu

SEQ ID NO: 32418 - RNA, 22 nt, Homo sapiens
gcggucccgcggcgccccgccu

SEQ ID NO: 32419 - RNA, 23 nt, Homo sapiens
guagugggccgagccgagugaca

SEQ ID NO: 32420 - RNA, 23 nt, Homo sapiens
gcacaugugcacacagccgggug

SEQ ID NO: 32421 - RNA, 21 nt, Homo sapiens
auaauggagaccaggccacga

SEQ ID NO: 32422 - RNA, 22 nt, Homo sapiens
cugggggcggcacaggggcuca

SEQ ID NO: 32423 - RNA, 18 nt, Homo sapiens
auucaaucuacugccuca

SEQ ID NO: 32424 - RNA, 22 nt, Homo sapiens
uggcagcagcggagggggcaga

SEQ ID NO: 32425 - RNA, 20 nt, Homo sapiens
ccagcagcaccuggggcagu

SEQ ID NO: 32426 - RNA, 21 nt, Homo sapiens
auccuguacugagcugccccg

SEQ ID NO: 32427 - RNA, 23 nt, Homo sapiens
cacugugggcccucuccgcacca

SEQ ID NO: 32428 - RNA, 22 nt, Homo sapiens
ugcuguuagcccuagccccgca

SEQ ID NO: 32429 - RNA, 22 nt, Homo sapiens
uauccacuacaccccgcugccu

SEQ ID NO: 32430 - RNA, 21 nt, Homo sapiens
ggggagcgggggcccugccuu

SEQ ID NO: 32431 - RNA, 23 nt, Homo sapiens
gcacaugugcacacagccgggug

SEQ ID NO: 32432 - RNA, 24 nt, Homo sapiens
acugcaggcuccagcuuccaggcu

SEQ ID NO: 32433 - RNA, 23 nt, Homo sapiens
gggagugaagacacggagccaga

SEQ ID NO: 32434 - RNA, 22 nt, Homo sapiens
ugagccacugugccuggccuga

SEQ ID NO: 32435 - RNA, 21 nt, Homo sapiens
ccuucugacuccaaguccagu

SEQ ID NO: 32436 - RNA, 23 nt, Homo sapiens
caugagugacgcccucuggagua

SEQ ID NO: 32437 - RNA, 25 nt, Homo sapiens
acggagcugucccaacaccaccccu

SEQ ID NO: 32438 - RNA, 22 nt, Homo sapiens
ccucaggcacggccgggccacc

SEQ ID NO: 32439 - RNA, 22 nt, Homo sapiens
aacccauggaauucaguucuca

SEQ ID NO: 32440 - RNA, 22 nt, Homo sapiens
accagcuaacaauacacugcca

SEQ ID NO: 32441 - RNA, 22 nt, Homo sapiens
cacuuagcagguuguauuauau

SEQ ID NO: 32442 - RNA, 21 nt, Homo sapiens
cccgaggagccgggcaggcuu

SEQ ID NO: 32443 - RNA, 22 nt, Homo sapiens
uauccacuacaccccgcugccu

SEQ ID NO: 32444 - RNA, 21 nt, Homo sapiens
ccccucccagccucccugcca

SEQ ID NO: 32445 - RNA, 22 nt, Homo sapiens
ucccucacacagaauuccagaa

SEQ ID NO: 32446 - RNA, 22 nt, Homo sapiens
augcuuuuugggguaagggcuu

SEQ ID NO: 32447 - RNA, 22 nt, Homo sapiens
cggugagcacccggccccugcg

SEQ ID NO: 32448 - RNA, 22 nt, Homo sapiens
cugcucaaacccuccaaugacu

SEQ ID NO: 32449 - RNA, 21 nt, Homo sapiens
aagggucaguaagcacccgcg

SEQ ID NO: 32450 - RNA, 21 nt, Homo sapiens
cggggugcacgggcggagggc

SEQ ID NO: 32451 - RNA, 21 nt, Homo sapiens
gaccaaucgccguccccgccg

SEQ ID NO: 32452 - RNA, 22 nt, Homo sapiens
acaguucuucaacuggcagcuu

SEQ ID NO: 32453 - RNA, 22 nt, Homo sapiens
aaucagucucauugcuuuauaa

SEQ ID NO: 32454 - RNA, 23 nt, Homo sapiens
gaaagugcuucuuuccucgagaa

SEQ ID NO: 32455 - RNA, 25 nt, Homo sapiens
accaacggaccuacuucccuccgcc

SEQ ID NO: 32456 - RNA, 22 nt, Homo sapiens
gcggucccgcggcgccccgccu

SEQ ID NO: 32457 - RNA, 22 nt, Homo sapiens
ugcuguuagcccuagccccgca

SEQ ID NO: 32458 - RNA, 21 nt, Homo sapiens
agaaguagaccauguguccua

SEQ ID NO: 32459 - RNA, 18 nt, Homo sapiens
cagcagccuccuucucaa

SEQ ID NO: 32460 - RNA, 18 nt, Homo sapiens
ccacugaaccacccaugc

SEQ ID NO: 32461 - RNA, 23 nt, Homo sapiens
gggagugaagacacggagccaga

SEQ ID NO: 32462 - RNA, 18 nt, Homo sapiens
auucaaucuacugccuca

SEQ ID NO: 32463 - RNA, 23 nt, Homo sapiens
cuaucugcacuagaugcaccuua

SEQ ID NO: 32464 - RNA, 20 nt, Homo sapiens
acagcaaggagggcaggagg

SEQ ID NO: 32465 - RNA, 21 nt, Homo sapiens
cugcugggccacaacguggga

SEQ ID NO: 32466 - RNA, 21 nt, Homo sapiens
cggcucggguggcggcgacgg

SEQ ID NO: 32467 - RNA, 22 nt, Homo sapiens
gugggguggguggucaggccga

SEQ ID NO: 32468 - RNA, 23 nt, Homo sapiens
aggaacagcagcagcccgggccg

SEQ ID NO: 32469 - RNA, 22 nt, Homo sapiens
ucgcccucucaacccagcuuuu

SEQ ID NO: 32470 - RNA, 22 nt, Homo sapiens
uugcccucucaacccagcuuuu

SEQ ID NO: 32471 - RNA, 20 nt, Homo sapiens
acccucucaacccagcuuuu

SEQ ID NO: 32472 - RNA, 19 nt, Homo sapiens
uccucucaacccagcuuuu

SEQ ID NO: 32473 - RNA, 19 nt, Homo sapiens
guccugaauuccgcagccu

SEQ ID NO: 32474 - RNA, 23 nt, Homo sapiens
gcacaugugcacacagccgggug

SEQ ID NO: 32475 - RNA, 23 nt, Homo sapiens
gggagugaagacacggagccaga

SEQ ID NO: 32476 - RNA, 22 nt, Homo sapiens
ucagaccgagacaagugcaaug

SEQ ID NO: 32477 - RNA, 21 nt, Homo sapiens
acaggauugagggggggcccu

SEQ ID NO: 32478 - RNA, 22 nt, Homo sapiens
gaauucaucacggccagccucu

SEQ ID NO: 32479 - RNA, 23 nt, Homo sapiens
cugcagaacuguucccgcugcua

SEQ ID NO: 32480 - RNA, 19 nt, Homo sapiens
guccugaauuccgcagccu

SEQ ID NO: 32481 - RNA, 21 nt, Homo sapiens
ccccucccagccucccugcca

SEQ ID NO: 32482 - RNA, 22 nt, Homo sapiens
ucaggaacugccuuucucucca

SEQ ID NO: 32483 - RNA, 21 nt, Homo sapiens
gaccaaucgccguccccgccg

SEQ ID NO: 32484 - RNA, 23 nt, Homo sapiens
cggcucugucgucgaggcgcuca

SEQ ID NO: 32485 - RNA, 19 nt, Homo sapiens
guccugaauuccgcagccu

SEQ ID NO: 32486 - RNA, 22 nt, Homo sapiens
gcggucccgcggcgccccgccu

SEQ ID NO: 32487 - RNA, 22 nt, Homo sapiens
ugcuguuagcccuagccccgca

SEQ ID NO: 32488 - RNA, 22 nt, Homo sapiens
cacucuaaagggaggcacuuug

SEQ ID NO: 32489 - RNA, 24 nt, Homo sapiens
cacccccagagccucagcucccca

SEQ ID NO: 32490 - RNA, 21 nt, Homo sapiens
cggcucggguggcggcgacgg

SEQ ID NO: 32491 - RNA, 22 nt, Homo sapiens
acccuuaucaguucuccgucca

SEQ ID NO: 32492 - RNA, 21 nt, Homo sapiens
ggaaaucccuggcaaugugau

SEQ ID NO: 32493 - RNA, 21 nt, Homo sapiens
gguaaucccuggcaaugugau

SEQ ID NO: 32494 - RNA, 22 nt, Homo sapiens
ccuggcacacaguagaccuuca

SEQ ID NO: 32495 - RNA, 19 nt, Homo sapiens
auuuugguacagcagcuca

SEQ ID NO: 32496 - RNA, 19 nt, Homo sapiens
gccucagaggcagcugcuu

SEQ ID NO: 32497 - RNA, 22 nt, Homo sapiens
ggaggccgggacgagugcaaua

SEQ ID NO: 32498 - RNA, 17 nt, Homo sapiens
gacagccucucccccac

SEQ ID NO: 32499 - RNA, 18 nt, Homo sapiens
aucacauucaccucccug

SEQ ID NO: 32500 - RNA, 21 nt, Homo sapiens
cggggugcacgggcggagggc

SEQ ID NO: 32501 - RNA, 21 nt, Homo sapiens
gaccaaucgccguccccgccg

SEQ ID NO: 32502 - RNA, 20 nt, Homo sapiens
ugggccaccgccgagcggac

SEQ ID NO: 32503 - RNA, 22 nt, Homo sapiens
caagacacauuuggagagggac

SEQ ID NO: 32504 - RNA, 22 nt, Homo sapiens
gcggucccgcggcgccccgccu

SEQ ID NO: 32505 - RNA, 24 nt, Homo sapiens
cacccccagagccucagcucccca

SEQ ID NO: 32506 - RNA, 18 nt, Homo sapiens
cccccaccaccacgcccg

SEQ ID NO: 32507 - RNA, 21 nt, Homo sapiens
gggcaucugggacgcgcagga

SEQ ID NO: 32508 - RNA, 21 nt, Homo sapiens
gaccaaucgccguccccgccg

SEQ ID NO: 32509 - RNA, 22 nt, Homo sapiens
cggugagcacccggccccugcg

SEQ ID NO: 32510 - RNA, 22 nt, Homo sapiens
ucagaccgagacaagugcaaug

SEQ ID NO: 32511 - RNA, 22 nt, Homo sapiens
gcggucccgcggcgccccgccu

SEQ ID NO: 32512 - RNA, 22 nt, Homo sapiens
ugcuguuagcccuagccccgca

SEQ ID NO: 32513 - RNA, 22 nt, Homo sapiens
uauccacuacaccccgcugccu

SEQ ID NO: 32514 - RNA, 23 nt, Homo sapiens
cuaacugcacuagaugcaccuua

SEQ ID NO: 32515 - RNA, 21 nt, Homo sapiens
gaccaaucgccguccccgccg

SEQ ID NO: 32516 - RNA, 21 nt, Homo sapiens
aacggaaccacuagugacuug

SEQ ID NO: 32517 - RNA, 22 nt, Homo sapiens
gcggucccgcggcgccccgccu

SEQ ID NO: 32518 - RNA, 23 nt, Homo sapiens
cacugugggcccucuccgcacca

SEQ ID NO: 32519 - RNA, 22 nt, Homo sapiens
ugcuguuagcccuagccccgca

SEQ ID NO: 32520 - RNA, 23 nt, Homo sapiens
agaaaccaugggguaugagcaga

SEQ ID NO: 32521 - RNA, 21 nt, Homo sapiens
aagggucaguaagcacccgcg

SEQ ID NO: 32522 - RNA, 21 nt, Homo sapiens
aucugcacugucagcacuuua

SEQ ID NO: 32523 - RNA, 17 nt, Homo sapiens
ggguggcagcgguggga

SEQ ID NO: 32524 - RNA, 22 nt, Homo sapiens
acugccugucugugccugcugu

SEQ ID NO: 32525 - RNA, 22 nt, Homo sapiens
accagguuccaccccagcaggc

SEQ ID NO: 32526 - RNA, 19 nt, Homo sapiens
guccugaauuccgcagccu

SEQ ID NO: 32527 - RNA, 22 nt, Homo sapiens
gggagaggucucccugcgcaca

SEQ ID NO: 32528 - RNA, 22 nt, Homo sapiens
gggagaggucucccugcgcaca

SEQ ID NO: 32529 - RNA, 18 nt, Homo sapiens
gaaaugagggccagcuga

SEQ ID NO: 32530 - RNA, 22 nt, Homo sapiens
caaacaccauugucacacucca

SEQ ID NO: 32531 - RNA, 20 nt, Homo sapiens
cccgccgcgucgcccugggg

SEQ ID NO: 32532 - RNA, 23 nt, Homo sapiens
acgggugcgauuucugugugaga

SEQ ID NO: 32533 - RNA, 22 nt, Homo sapiens
acaaaaguugccuuugugugau

SEQ ID NO: 32534 - RNA, 22 nt, Homo sapiens
acaaaagcaacugagguucuug

SEQ ID NO: 32535 - RNA, 21 nt, Homo sapiens
acaauccuagagcacaagaag

SEQ ID NO: 32536 - RNA, 21 nt, Homo sapiens
ugcaggcugaucuucuucucu

SEQ ID NO: 32537 - RNA, 18 nt, Homo sapiens
cagcagccuccuucucaa

SEQ ID NO: 32538 - RNA, 22 nt, Homo sapiens
cacugguacaaggguugggaga

SEQ ID NO: 32539 - RNA, 22 nt, Homo sapiens
agcccaaaaggagaauucuuug

SEQ ID NO: 32540 - RNA, 21 nt, Homo sapiens
aacggaaccacuagugacuug

SEQ ID NO: 32541 - RNA, 22 nt, Homo sapiens
agcugaguguaggauguuuaca

SEQ ID NO: 32542 - RNA, 21 nt, Homo sapiens
aagacgggaggagaggaguga

SEQ ID NO: 32543 - RNA, 22 nt, Homo sapiens
aagaagugcaccgcgaauguuu

SEQ ID NO: 32544 - RNA, 23 nt, Homo sapiens
cuccagccccuccagggcuuccu

SEQ ID NO: 32545 - RNA, 21 nt, Homo sapiens
caucaccuuccuucuccucca

SEQ ID NO: 32546 - RNA, 20 nt, Homo sapiens
cccugcgccaucuccucuac

SEQ ID NO: 32547 - RNA, 22 nt, Homo sapiens
ccggcugcaacacaagacacga

SEQ ID NO: 32548 - RNA, 21 nt, Homo sapiens
gaccaaucgccguccccgccg

SEQ ID NO: 32549 - RNA, 22 nt, Homo sapiens
gcggucccgcggcgccccgccu

SEQ ID NO: 32550 - RNA, 22 nt, Homo sapiens
caaacaccauugucacacucca

SEQ ID NO: 32551 - RNA, 18 nt, Homo sapiens
cagcagccuccuucucaa

SEQ ID NO: 32552 - RNA, 21 nt, Homo sapiens
caugcacaugcacacauacau

SEQ ID NO: 32553 - RNA, 24 nt, Homo sapiens
acucacaccuagguuccaaggauu

SEQ ID NO: 32554 - RNA, 23 nt, Homo sapiens
aaucgcgguuuauaccaaaugaa

SEQ ID NO: 32555 - RNA, 23 nt, Homo sapiens
acccaacagccccugcaagggau

SEQ ID NO: 32556 - RNA, 23 nt, Homo sapiens
guagugggccgagccgagugaca

SEQ ID NO: 32557 - RNA, 21 nt, Homo sapiens
cugggggacggagcagaagga

SEQ ID NO: 32558 - RNA, 22 nt, Homo sapiens
uaaaugaauucaauuuccuucu

SEQ ID NO: 32559 - RNA, 18 nt, Homo sapiens
ggagaggagggcacugga

SEQ ID NO: 32560 - RNA, 22 nt, Homo sapiens
ucaggaacugccuuucucucca

SEQ ID NO: 32561 - RNA, 23 nt, Homo sapiens
cagcugcuuuugggauuccguug

SEQ ID NO: 32562 - RNA, 22 nt, Homo sapiens
ucaucucgcccgcaaagaccca

SEQ ID NO: 32563 - RNA, 23 nt, Homo sapiens
uccaucauuacccggcaguauua

SEQ ID NO: 32564 - RNA, 21 nt, Homo sapiens
aagugucagacacgguggugg

SEQ ID NO: 32565 - RNA, 22 nt, Homo sapiens
cuuccagucgaggauguuuaca

SEQ ID NO: 32566 - RNA, 22 nt, Homo sapiens
cuuccagucggggauguuuaca

SEQ ID NO: 32567 - RNA, 22 nt, Homo sapiens
cuuccagucaaggauguuuaca

SEQ ID NO: 32568 - RNA, 23 nt, Homo sapiens
acacucaaaagauggcggcacuu

SEQ ID NO: 32569 - RNA, 21 nt, Homo sapiens
uagcacccagauagcaaggau

SEQ ID NO: 32570 - RNA, 23 nt, Homo sapiens
gggcucuuacucccucaggcacu

SEQ ID NO: 32571 - RNA, 21 nt, Homo sapiens
aucagagguucagcuuacccu

SEQ ID NO: 32572 - RNA, 23 nt, Homo sapiens
guucuguccuggaagaacauacu

SEQ ID NO: 32573 - RNA, 21 nt, Homo sapiens
gaaggaagugagugcagccac

SEQ ID NO: 32574 - RNA, 21 nt, Homo sapiens
cacaaccucaguguuuccagg

SEQ ID NO: 32575 - RNA, 22 nt, Homo sapiens
cuggagagacaaggggaagagg

SEQ ID NO: 32576 - RNA, 23 nt, Homo sapiens
acacagcucuuccauaucuccag

SEQ ID NO: 32577 - RNA, 22 nt, Homo sapiens
auggcaguggaguuagugauug

SEQ ID NO: 32578 - RNA, 22 nt, Homo sapiens
ccuggccgugugguuagugauu

SEQ ID NO: 32579 - RNA, 22 nt, Homo sapiens
ucaguuuccucugcaaacaguu

SEQ ID NO: 32580 - RNA, 21 nt, Homo sapiens
gaccaagaaauagccuuucaa

SEQ ID NO: 32581 - RNA, 20 nt, Homo sapiens
auuucuauaucuaucuccau

SEQ ID NO: 32582 - RNA, 22 nt, Homo sapiens
gcugaggcuguggggcuggagu

SEQ ID NO: 32583 - RNA, 20 nt, Homo sapiens
cccugcgccaucuccucuac

SEQ ID NO: 32584 - RNA, 21 nt, Homo sapiens
aacauacaaaggguauccucu

SEQ ID NO: 32585 - RNA, 22 nt, Homo sapiens
cuggagagacaaggggaagagg

SEQ ID NO: 32586 - RNA, 23 nt, Homo sapiens
aacaggugcucaaauaagacuug

SEQ ID NO: 32587 - RNA, 22 nt, Homo sapiens
gcacaaaucuccagaccaccca

SEQ ID NO: 32588 - RNA, 21 nt, Homo sapiens
ggcugucaauucauaggucag

SEQ ID NO: 32589 - RNA, 21 nt, Homo sapiens
gucugucaauucauaggucau

SEQ ID NO: 32590 - RNA, 24 nt, Homo sapiens
acucacaccuagguuccaaggauu

SEQ ID NO: 32591 - RNA, 21 nt, Homo sapiens
ccuucugacuccaaguccagu

SEQ ID NO: 32592 - RNA, 21 nt, Homo sapiens
uagcacccagauagcaaggau

SEQ ID NO: 32593 - RNA, 20 nt, Homo sapiens
cccugcgccaucuccucuac

SEQ ID NO: 32594 - RNA, 22 nt, Homo sapiens
cuggagagacaaggggaagagg

SEQ ID NO: 32595 - RNA, 22 nt, Homo sapiens
cacgaccgacgccacgccgagu

SEQ ID NO: 32596 - RNA, 18 nt, Homo sapiens
aucacauucaccucccug

SEQ ID NO: 32597 - RNA, 22 nt, Homo sapiens
ggagcccgcgccccgcgccgag

SEQ ID NO: 32598 - RNA, 23 nt, Homo sapiens
gggagugaagacacggagccaga

SEQ ID NO: 32599 - RNA, 22 nt, Homo sapiens
cacucagcggccguuuccccaa

SEQ ID NO: 32600 - RNA, 21 nt, Homo sapiens
uucuaggauaggcccaggggc

SEQ ID NO: 32601 - RNA, 22 nt, Homo sapiens
aucgggaggggacugagccuga

SEQ ID NO: 32602 - RNA, 22 nt, Homo sapiens
ccucauggaaggguuccccacu

SEQ ID NO: 32603 - RNA, 25 nt, Homo sapiens
acggagcugucccaacaccaccccu

SEQ ID NO: 32604 - RNA, 22 nt, Homo sapiens
aagagggagacccaggcucgga

SEQ ID NO: 32605 - RNA, 22 nt, Homo sapiens
caagacacauuuggagagggac

SEQ ID NO: 32606 - RNA, 24 nt, Homo sapiens
acgcgcaggccagagacccaggca

SEQ ID NO: 32607 - RNA, 21 nt, Homo sapiens
caucaccuuccuucuccucca

SEQ ID NO: 32608 - RNA, 20 nt, Homo sapiens
uacugcuuccacagcucccc

SEQ ID NO: 32609 - RNA, 21 nt, Homo sapiens
auaauggagaccaggccacga

SEQ ID NO: 32610 - RNA, 22 nt, Homo sapiens
cugggggcggcacaggggcuca

SEQ ID NO: 32611 - RNA, 18 nt, Homo sapiens
cccccaccaccacgcccg

SEQ ID NO: 32612 - RNA, 24 nt, Homo sapiens
agugugaguucuaccauugccaaa

SEQ ID NO: 32613 - RNA, 21 nt, Homo sapiens
gaccaaucgccguccccgccg

SEQ ID NO: 32614 - RNA, 21 nt, Homo sapiens
gaccaaucgccguccccgccg

SEQ ID NO: 32615 - RNA, 19 nt, Homo sapiens
aagacauuuucagacagcu

SEQ ID NO: 32616 - RNA, 22 nt, Homo sapiens
gcggucccgcggcgccccgccu

SEQ ID NO: 32617 - RNA, 22 nt, Homo sapiens
gcggucccgcggcgccccgccu

SEQ ID NO: 32618 - RNA, 20 nt, Homo sapiens
aggggccucagccuccuggu

SEQ ID NO: 32619 - RNA, 22 nt, Homo sapiens
ugcuguuagcccuagccccgca

SEQ ID NO: 32620 - RNA, 22 nt, Homo sapiens
ugcuguuagcccuagccccgca

SEQ ID NO: 32621 - RNA, 22 nt, Homo sapiens
ucaaugacucagguaaguugca

SEQ ID NO: 32622 - RNA, 22 nt, Homo sapiens
cuggagagacaaggggaagagg

SEQ ID NO: 32623 - RNA, 21 nt, Homo sapiens
cggggugcacgggcggagggc

SEQ ID NO: 32624 - RNA, 23 nt, Homo sapiens
gggagugaagacacggagccaga

SEQ ID NO: 32625 - RNA, 21 nt, Homo sapiens
gaccaaucgccguccccgccg

SEQ ID NO: 32626 - RNA, 19 nt, Homo sapiens
uaugcuaccuuugcacggu

SEQ ID NO: 32627 - RNA, 25 nt, Homo sapiens
accaacggaccuacuucccuccgcc

SEQ ID NO: 32628 - RNA, 22 nt, Homo sapiens
gcggucccgcggcgccccgccu

SEQ ID NO: 32629 - RNA, 22 nt, Homo sapiens
ggcagagagucagagcgcggau

SEQ ID NO: 32630 - RNA, 21 nt, Homo sapiens
cuagggaagaacagugagcaa

SEQ ID NO: 32631 - RNA, 22 nt, Homo sapiens
uaaaugaauucaauuuccuucu

SEQ ID NO: 32632 - RNA, 22 nt, Homo sapiens
ucaggaacugccuuucucucca

SEQ ID NO: 32633 - RNA, 21 nt, Homo sapiens
gaccaaucgccguccccgccg

SEQ ID NO: 32634 - RNA, 22 nt, Homo sapiens
cagaagugggccgggcacaggg

SEQ ID NO: 32635 - RNA, 23 nt, Homo sapiens
ucaccaaaacauggaagcacuua

SEQ ID NO: 32636 - RNA, 23 nt, Homo sapiens
cuacuaaaacauggaagcacuua

SEQ ID NO: 32637 - RNA, 23 nt, Homo sapiens
ccacugaaacauggaagcacuua

SEQ ID NO: 32638 - RNA, 23 nt, Homo sapiens
acacucaaacauggaagcacuua

SEQ ID NO: 32639 - RNA, 17 nt, Homo sapiens
aagcauggaagcacuua

SEQ ID NO: 32640 - RNA, 20 nt, Homo sapiens
cuggaggaagggcccagagg

SEQ ID NO: 32641 - RNA, 22 nt, Homo sapiens
gccuaagacacaggcccagaga

SEQ ID NO: 32642 - RNA, 23 nt, Homo sapiens
aaaucagaaucacaccuggggga

SEQ ID NO: 32643 - RNA, 23 nt, Homo sapiens
acgcucaaaugucgcagcacuuu

SEQ ID NO: 32644 - RNA, 23 nt, Homo sapiens
acaccccaaaaucgaagcacuuc

SEQ ID NO: 32645 - RNA, 23 nt, Homo sapiens
cugcagaacuguucccgcugcua

SEQ ID NO: 32646 - RNA, 22 nt, Homo sapiens
gaccucagcuaugacagcacuu

SEQ ID NO: 32647 - RNA, 22 nt, Homo sapiens
acaguccaaagggaagcacuuu

SEQ ID NO: 32648 - RNA, 21 nt, Homo sapiens
cccucuaaaaggaagcacuuu

SEQ ID NO: 32649 - RNA, 22 nt, Homo sapiens
acccucuaaaaggaagcacuuu

SEQ ID NO: 32650 - RNA, 22 nt, Homo sapiens
acccaccaaagagaagcacuuu

SEQ ID NO: 32651 - RNA, 21 nt, Homo sapiens
cccucaaaaaggaagcacuuu

SEQ ID NO: 32652 - RNA, 25 nt, Homo sapiens
acggagcugucccaacaccaccccu

SEQ ID NO: 32653 - RNA, 24 nt, Homo sapiens
acgcagagcccgaaagcccccagu

SEQ ID NO: 32654 - RNA, 22 nt, Homo sapiens
gcggucccgcggcgccccgccu

SEQ ID NO: 32655 - RNA, 23 nt, Homo sapiens
cuccagccccuccagggcuuccu

SEQ ID NO: 32656 - RNA, 23 nt, Homo sapiens
agaaaccaugggguaugagcaga

SEQ ID NO: 32657 - RNA, 20 nt, Homo sapiens
uacugcuuccacagcucccc

SEQ ID NO: 32658 - RNA, 22 nt, Homo sapiens
cacauggccaaaacagagaaga

SEQ ID NO: 32659 - RNA, 22 nt, Homo sapiens
uccggggacgaacgggacgggu

SEQ ID NO: 32660 - RNA, 17 nt, Homo sapiens
ggguggcagcgguggga

SEQ ID NO: 32661 - RNA, 17 nt, Homo sapiens
gggagaggaggaggcga

SEQ ID NO: 32662 - RNA, 22 nt, Homo sapiens
cacgaccgacgccacgccgagu

SEQ ID NO: 32663 - RNA, 23 nt, Homo sapiens
aggaacagcagcagcccgggccg

SEQ ID NO: 32664 - RNA, 22 nt, Homo sapiens
ucaggaacugccuuucucucca

SEQ ID NO: 32665 - RNA, 21 nt, Homo sapiens
gaccaaucgccguccccgccg

SEQ ID NO: 32666 - RNA, 23 nt, Homo sapiens
ucucgugacaugaugauccccga

SEQ ID NO: 32667 - RNA, 19 nt, Homo sapiens
guugggaucacaggcgccc

SEQ ID NO: 32668 - RNA, 22 nt, Homo sapiens
gcggucccgcggcgccccgccu

SEQ ID NO: 32669 - RNA, 22 nt, Homo sapiens
ugcuguuagcccuagccccgca

SEQ ID NO: 32670 - RNA, 21 nt, Homo sapiens
caucaccuuccuucuccucca

SEQ ID NO: 32671 - RNA, 20 nt, Homo sapiens
uacugcuuccacagcucccc

SEQ ID NO: 32672 - RNA, 22 nt, Homo sapiens
ggaggccgggacgagugcaaua

SEQ ID NO: 32673 - RNA, 21 nt, Homo sapiens
cucccccacugcagcuggcac

SEQ ID NO: 32674 - RNA, 22 nt, Homo sapiens
ucaggaacugccuuucucucca

SEQ ID NO: 32675 - RNA, 22 nt, Homo sapiens
cuguuccugcugaacugagcca

SEQ ID NO: 32676 - RNA, 22 nt, Homo sapiens
ucaccauugcuaaagugcaauu

SEQ ID NO: 32677 - RNA, 22 nt, Homo sapiens
cuacccacagacguaccaauca

SEQ ID NO: 32678 - RNA, 20 nt, Homo sapiens
aggggccucagccuccuggu

SEQ ID NO: 32679 - RNA, 22 nt, Homo sapiens
ugcuguuagcccuagccccgca

SEQ ID NO: 32680 - RNA, 22 nt, Homo sapiens
ugcuguuagcccuagccccgca

SEQ ID NO: 32681 - RNA, 22 nt, Homo sapiens
ggcagagagucagagcgcggau

SEQ ID NO: 32682 - RNA, 23 nt, Homo sapiens
accacaggagucugagcauuuga

SEQ ID NO: 32683 - RNA, 21 nt, Homo sapiens
auguaggccuuuagaucacuu

SEQ ID NO: 32684 - RNA, 21 nt, Homo sapiens
acuagacugugagcuccucga

SEQ ID NO: 32685 - RNA, 22 nt, Homo sapiens
auaaggauuuuuaggggcauua

SEQ ID NO: 32686 - RNA, 20 nt, Homo sapiens
ugggccaccgccgagcggac

SEQ ID NO: 32687 - RNA, 23 nt, Homo sapiens
cacaaauucggaucuacagggua

SEQ ID NO: 32688 - RNA, 22 nt, Homo sapiens
cuggagagacaaggggaagagg

SEQ ID NO: 32689 - RNA, 21 nt, Homo sapiens
cggggugcacgggcggagggc

SEQ ID NO: 32690 - RNA, 22 nt, Homo sapiens
ucaggaacugccuuucucucca

SEQ ID NO: 32691 - RNA, 21 nt, Homo sapiens
gaccaaucgccguccccgccg

SEQ ID NO: 32692 - RNA, 23 nt, Homo sapiens
cagcugcuuuugggauuccguug

SEQ ID NO: 32693 - RNA, 23 nt, Homo sapiens
aaagucucgcucucugccccuca

SEQ ID NO: 32694 - RNA, 22 nt, Homo sapiens
gaauucaucacggccagccucu

SEQ ID NO: 32695 - RNA, 22 nt, Homo sapiens
gaauucaucacggccagccucu

SEQ ID NO: 32696 - RNA, 21 nt, Homo sapiens
uagcacccagauagcaaggau

SEQ ID NO: 32697 - RNA, 20 nt, Homo sapiens
acaaugagaacccauggucu

SEQ ID NO: 32698 - RNA, 19 nt, Homo sapiens
guccugaauuccgcagccu

SEQ ID NO: 32699 - RNA, 22 nt, Homo sapiens
gcggucccgcggcgccccgccu

SEQ ID NO: 32700 - RNA, 22 nt, Homo sapiens
ugcuguuagcccuagccccgca

SEQ ID NO: 32701 - RNA, 22 nt, Homo sapiens
gcugaggcuguggggcuggagu

SEQ ID NO: 32702 - RNA, 20 nt, Homo sapiens
uacugcuuccacagcucccc

SEQ ID NO: 32703 - RNA, 22 nt, Homo sapiens
gggagaggucucccugcgcaca

SEQ ID NO: 32704 - RNA, 22 nt, Homo sapiens
gaaccuaucuccccucuggacc

SEQ ID NO: 32705 - RNA, 21 nt, Homo sapiens
aagugucagacacgguggugg

SEQ ID NO: 32706 - RNA, 21 nt, Homo sapiens
acguggauuuuccucuaugau

SEQ ID NO: 32707 - RNA, 22 nt, Homo sapiens
aacauggauuuuccucuaugau

SEQ ID NO: 32708 - RNA, 19 nt, Homo sapiens
guccugaauuccgcagccu

SEQ ID NO: 32709 - RNA, 25 nt, Homo sapiens
acggagcugucccaacaccaccccu

SEQ ID NO: 32710 - RNA, 23 nt, Homo sapiens
acucagaaggacaaguagaguuu

SEQ ID NO: 32711 - RNA, 21 nt, Homo sapiens
gaaggaagugagugcagccac

SEQ ID NO: 32712 - RNA, 20 nt, Homo sapiens
uacugcuuccacagcucccc

SEQ ID NO: 32713 - RNA, 21 nt, Homo sapiens
ucacccagaucugcggccuaa

SEQ ID NO: 32714 - RNA, 23 nt, Homo sapiens
aaagucucgcucucugccccuca

SEQ ID NO: 32715 - RNA, 23 nt, Homo sapiens
acccucuauagggaagcgcguuc

SEQ ID NO: 32716 - RNA, 19 nt, Homo sapiens
guccugaauuccgcagccu

SEQ ID NO: 32717 - RNA, 22 nt, Homo sapiens
ugaauuacuuuguaaaccacca

SEQ ID NO: 32718 - RNA, 22 nt, Homo sapiens
auccuucuacaaauucacccau

SEQ ID NO: 32719 - RNA, 23 nt, Homo sapiens
ucacauaggaauaaaaagccaua

SEQ ID NO: 32720 - RNA, 23 nt, Homo sapiens
cuaccugcacuguaagcacuuug

SEQ ID NO: 32721 - RNA, 22 nt, Homo sapiens
uucacacugcaugcucugggua

SEQ ID NO: 32722 - RNA, 22 nt, Homo sapiens
cacucagcggccguuuccccaa

SEQ ID NO: 32723 - RNA, 21 nt, Homo sapiens
ucaaucacagauagcaccccu

SEQ ID NO: 32724 - RNA, 23 nt, Homo sapiens
aaaucagaaucacaccuggggga

SEQ ID NO: 32725 - RNA, 22 nt, Homo sapiens
caugauugccacgucugcagua

SEQ ID NO: 32726 - RNA, 21 nt, Homo sapiens
ugauugccacugucugcagua

SEQ ID NO: 32727 - RNA, 22 nt, Homo sapiens
gaccucagcuaugacagcacuu

SEQ ID NO: 32728 - RNA, 21 nt, Homo sapiens
guucuaacccauuguggccaa

SEQ ID NO: 32729 - RNA, 24 nt, Homo sapiens
acgcagagcccgaaagcccccagu

SEQ ID NO: 32730 - RNA, 24 nt, Homo sapiens
acgcgcaggccagagacccaggca

SEQ ID NO: 32731 - RNA, 23 nt, Homo sapiens
agcaaaaaugugcuagugccaaa

SEQ ID NO: 32732 - RNA, 21 nt, Homo sapiens
agggcucaucuugguccugca

SEQ ID NO: 32733 - RNA, 21 nt, Homo sapiens
ucuccagaucagggcagucca

SEQ ID NO: 32734 - RNA, 22 nt, Homo sapiens
cggugagcacccggccccugcg

SEQ ID NO: 32735 - RNA, 22 nt, Homo sapiens
uagucaagugaagcagugggag

SEQ ID NO: 32736 - RNA, 23 nt, Homo sapiens
gaaacccagcagacaauguagcu

SEQ ID NO: 32737 - RNA, 21 nt, Homo sapiens
ucaaucacagauagcaccccu

SEQ ID NO: 32738 - RNA, 22 nt, Homo sapiens
uauggaugcaaaaugaucccaa

SEQ ID NO: 32739 - RNA, 22 nt, Homo sapiens
acacaccaaggauaauuucucc

SEQ ID NO: 32740 - RNA, 21 nt, Homo sapiens
agguaauaccaauaccuugug

SEQ ID NO: 32741 - RNA, 23 nt, Homo sapiens
ccuagagagggugagaaccugcc

SEQ ID NO: 32742 - RNA, 20 nt, Homo sapiens
aggggccucagccuccuggu

SEQ ID NO: 32743 - RNA, 23 nt, Homo sapiens
aaccaagaccccggagaucccag

SEQ ID NO: 32744 - RNA, 22 nt, Homo sapiens
agcucagaacccagaggucuca

SEQ ID NO: 32745 - RNA, 21 nt, Homo sapiens
ggggagcgggggcccugccuu

SEQ ID NO: 32746 - RNA, 23 nt, Homo sapiens
accacaggagucugagcauuuga

SEQ ID NO: 32747 - RNA, 22 nt, Homo sapiens
ccaguagcacggcucaguccag

SEQ ID NO: 32748 - RNA, 23 nt, Homo sapiens
ucacauaggaauaaaaagccaua

SEQ ID NO: 32749 - RNA, 23 nt, Homo sapiens
ucacauaggaaugaaaagccaua

SEQ ID NO: 32750 - RNA, 23 nt, Homo sapiens
guaaauagagguuuaauuaacac

SEQ ID NO: 32751 - RNA, 23 nt, Homo sapiens
ccacugaaacauggaagcacuua

SEQ ID NO: 32752 - RNA, 23 nt, Homo sapiens
ucucugcaggccgugugcuuugc

SEQ ID NO: 32753 - RNA, 21 nt, Homo sapiens
guguauaugcccauggacugc

SEQ ID NO: 32754 - RNA, 21 nt, Homo sapiens
acuuuccaggauucauuaacu

SEQ ID NO: 32755 - RNA, 18 nt, Homo sapiens
uggcgccugaacagggac

SEQ ID NO: 32756 - RNA, 22 nt, Homo sapiens
aucagagcccucugagcuucag

SEQ ID NO: 32757 - RNA, 20 nt, Homo sapiens
ugucuccacagggcucuuua

SEQ ID NO: 32758 - RNA, 18 nt, Homo sapiens
aucacauucaccucccug

SEQ ID NO: 32759 - RNA, 23 nt, Homo sapiens
gggagugaagacacggagccaga

SEQ ID NO: 32760 - RNA, 21 nt, Homo sapiens
gaccaaucgccguccccgccg

SEQ ID NO: 32761 - RNA, 22 nt, Homo sapiens
cagaagugggccgggcacaggg

SEQ ID NO: 32762 - RNA, 22 nt, Homo sapiens
acaguucuucaacuggcagcuu

SEQ ID NO: 32763 - RNA, 22 nt, Homo sapiens
agucuucacaacagcccugugu

SEQ ID NO: 32764 - RNA, 21 nt, Homo sapiens
acaggauugagggggggcccu

SEQ ID NO: 32765 - RNA, 23 nt, Homo sapiens
aaagucucgcucucugccccuca

SEQ ID NO: 32766 - RNA, 22 nt, Homo sapiens
ucaguuuccucugcaaacaguu

SEQ ID NO: 32767 - RNA, 23 nt, Homo sapiens
aagaaucuugucccgcagguccu

SEQ ID NO: 32768 - RNA, 22 nt, Homo sapiens
aggaaaccagcaaguguugacg

SEQ ID NO: 32769 - RNA, 22 nt, Homo sapiens
gcggucccgcggcgccccgccu

SEQ ID NO: 32770 - RNA, 22 nt, Homo sapiens
ugcuguuagcccuagccccgca

SEQ ID NO: 32771 - RNA, 24 nt, Homo sapiens
cacccccagagccucagcucccca

SEQ ID NO: 32772 - RNA, 18 nt, Homo sapiens
cagcagccuccuucucaa

SEQ ID NO: 32773 - RNA, 18 nt, Homo sapiens
caccaccagagccaacgu

SEQ ID NO: 32774 - RNA, 23 nt, Homo sapiens
cuaucugcacuagaugcaccuua

SEQ ID NO: 32775 - RNA, 22 nt, Homo sapiens
acaguucuucaacuggcagcuu

SEQ ID NO: 32776 - RNA, 23 nt, Homo sapiens
cggcucugucgucgaggcgcuca

SEQ ID NO: 32777 - RNA, 21 nt, Homo sapiens
ccuucugacuccaaguccagu

SEQ ID NO: 32778 - RNA, 22 nt, Homo sapiens
gccuucugacccuaaguccagu

SEQ ID NO: 32779 - RNA, 22 nt, Homo sapiens
auaaacgacaccuccuugagaa

SEQ ID NO: 32780 - RNA, 19 nt, Homo sapiens
auuuugguacagcagcuca

SEQ ID NO: 32781 - RNA, 22 nt, Homo sapiens
aagagggagacccaggcucgga

SEQ ID NO: 32782 - RNA, 23 nt, Homo sapiens
acccaacagccccugcaagggau

SEQ ID NO: 32783 - RNA, 20 nt, Homo sapiens
uccccacagacccagagccg

SEQ ID NO: 32784 - RNA, 22 nt, Homo sapiens
ucggucccucgggccagggcag

SEQ ID NO: 32785 - RNA, 22 nt, Homo sapiens
cuggagagacaaggggaagagg

SEQ ID NO: 32786 - RNA, 17 nt, Homo sapiens
ggguggcagcgguggga

SEQ ID NO: 32787 - RNA, 23 nt, Homo sapiens
gggagugaagacacggagccaga

SEQ ID NO: 32788 - RNA, 21 nt, Homo sapiens
gaccaaucgccguccccgccg

SEQ ID NO: 32789 - RNA, 22 nt, Homo sapiens
aguccagauucugugcccacca

SEQ ID NO: 32790 - RNA, 22 nt, Homo sapiens
gcacauguucugcggcccacca

SEQ ID NO: 32791 - RNA, 22 nt, Homo sapiens
gcggucccgcggcgccccgccu

SEQ ID NO: 32792 - RNA, 21 nt, Homo sapiens
caucaccuuccuucuccucca

SEQ ID NO: 32793 - RNA, 20 nt, Homo sapiens
cccugcgccaucuccucuac

SEQ ID NO: 32794 - RNA, 23 nt, Homo sapiens
ccgcuugagcuaacuccgacccg

SEQ ID NO: 32795 - RNA, 21 nt, Homo sapiens
gagcugcauccuggcuccggg

SEQ ID NO: 32796 - RNA, 18 nt, Homo sapiens
cccccaccaccacgcccg

SEQ ID NO: 32797 - RNA, 22 nt, Homo sapiens
gacucgaaccacugauccagca

SEQ ID NO: 32798 - RNA, 22 nt, Homo sapiens
cagacuccgguggaaugaagga

SEQ ID NO: 32799 - RNA, 21 nt, Homo sapiens
acaggauugagggggggcccu

SEQ ID NO: 32800 - RNA, 23 nt, Homo sapiens
cggcucugucgucgaggcgcuca

SEQ ID NO: 32801 - RNA, 22 nt, Homo sapiens
cuacccacagacguaccaauca

SEQ ID NO: 32802 - RNA, 19 nt, Homo sapiens
guugggaucacaggcgccc

SEQ ID NO: 32803 - RNA, 24 nt, Homo sapiens
acgcgcaggccagagacccaggca

SEQ ID NO: 32804 - RNA, 22 nt, Homo sapiens
ugcuguuagcccuagccccgca

SEQ ID NO: 32805 - RNA, 22 nt, Homo sapiens
ugcuguuagcccuagccccgca

SEQ ID NO: 32806 - RNA, 22 nt, Homo sapiens
uauccacuacaccccgcugccu

SEQ ID NO: 32807 - RNA, 21 nt, Homo sapiens
ccgugguucuacccuguggua

SEQ ID NO: 32808 - RNA, 22 nt, Homo sapiens
uagcagaagcauuuccgcacac

SEQ ID NO: 32809 - RNA, 22 nt, Homo sapiens
gaaccuaucuccccucuggacc

SEQ ID NO: 32810 - RNA, 21 nt, Homo sapiens
aaagugucagauacggugugg

SEQ ID NO: 32811 - RNA, 23 nt, Homo sapiens
gcgcccaauuaaugucuguugau

SEQ ID NO: 32812 - RNA, 22 nt, Homo sapiens
accagcuaacaauacacugcca

SEQ ID NO: 32813 - RNA, 22 nt, Homo sapiens
aaagagguuaaccagguguguu

SEQ ID NO: 32814 - RNA, 23 nt, Homo sapiens
acauuuuucguuauugcucuuga

SEQ ID NO: 32815 - RNA, 22 nt, Homo sapiens
ugaauccuugaauagguguguu

SEQ ID NO: 32816 - RNA, 23 nt, Homo sapiens
aaagucucgcucucugccccuca

SEQ ID NO: 32817 - RNA, 23 nt, Homo sapiens
ucaacgggagugaucgugucauu

SEQ ID NO: 32818 - RNA, 23 nt, Homo sapiens
acacucuaaagagaagcgcuuug

SEQ ID NO: 32819 - RNA, 21 nt, Homo sapiens
agaaaguacuucccucuggag

SEQ ID NO: 32820 - RNA, 21 nt, Homo sapiens
agaaagugcaucccucuggag

SEQ ID NO: 32821 - RNA, 21 nt, Homo sapiens
guaaugggaccuuccucuuug

SEQ ID NO: 32822 - RNA, 22 nt, Homo sapiens
acaucaucgcauauugacacaa

SEQ ID NO: 32823 - RNA, 22 nt, Homo sapiens
caaaagucaagcuuauccuaaa

SEQ ID NO: 32824 - RNA, 21 nt, Homo sapiens
ugcaggcugaucuucuucucu

SEQ ID NO: 32825 - RNA, 17 nt, Homo sapiens
gggagaggaggaggcga

SEQ ID NO: 32826 - RNA, 22 nt, Homo sapiens
acaaaguucuguagugcacuga

SEQ ID NO: 32827 - RNA, 22 nt, Homo sapiens
acaaaguucugugaugcacuga

SEQ ID NO: 32828 - RNA, 21 nt, Homo sapiens
ccaaguucugucaugcacuga

SEQ ID NO: 32829 - RNA, 21 nt, Homo sapiens
gggcaucugggacgcgcagga

SEQ ID NO: 32830 - RNA, 20 nt, Homo sapiens
acagcaaggagggcaggagg

SEQ ID NO: 32831 - RNA, 21 nt, Homo sapiens
acccaguagccagauguagcu

SEQ ID NO: 32832 - RNA, 22 nt, Homo sapiens
uauccacuacaccccgcugccu

SEQ ID NO: 32833 - RNA, 22 nt, Homo sapiens
cacauggccaaaacagagaaga

SEQ ID NO: 32834 - RNA, 21 nt, Homo sapiens
ucuccagaucagggcagucca

SEQ ID NO: 32835 - RNA, 21 nt, Homo sapiens
gggcaucugggacgcgcagga

SEQ ID NO: 32836 - RNA, 21 nt, Homo sapiens
aggcggcaggcacaggacugg

SEQ ID NO: 32837 - RNA, 22 nt, Homo sapiens
ucaucucgcccgcaaagaccca

SEQ ID NO: 32838 - RNA, 21 nt, Homo sapiens
ccuucugacuccaaguccagu

SEQ ID NO: 32839 - RNA, 23 nt, Homo sapiens
ccacccaaugaccuacuccaaga

SEQ ID NO: 32840 - RNA, 21 nt, Homo sapiens
gguggagcccugagaaccgga

SEQ ID NO: 32841 - RNA, 23 nt, Homo sapiens
cuccagccccuccagggcuuccu

SEQ ID NO: 32842 - RNA, 21 nt, Homo sapiens
acuagacugugagcuccucga

SEQ ID NO: 32843 - RNA, 23 nt, Homo sapiens
aggaacagcagcagcccgggccg

SEQ ID NO: 32844 - RNA, 23 nt, Homo sapiens
cccaacagacauggcgguacuca

SEQ ID NO: 32845 - RNA, 23 nt, Homo sapiens
cccaacagacauggcgguacuca

SEQ ID NO: 32846 - RNA, 19 nt, Homo sapiens
guccugaauuccgcagccu

SEQ ID NO: 32847 - RNA, 22 nt, Homo sapiens
aagagggagacccaggcucgga

SEQ ID NO: 32848 - RNA, 21 nt, Homo sapiens
uucaguuaucacaguacugua

SEQ ID NO: 32849 - RNA, 18 nt, Homo sapiens
ugguggcagaggugggau

SEQ ID NO: 32850 - RNA, 22 nt, Homo sapiens
cggugagcacccggccccugcg

SEQ ID NO: 32851 - RNA, 21 nt, Homo sapiens
gcagaacuuagccacugugaa

SEQ ID NO: 32852 - RNA, 23 nt, Homo sapiens
ucucugcaggccgugugcuuugc

SEQ ID NO: 32853 - RNA, 22 nt, Homo sapiens
cacuuagcagguuguauuauau

SEQ ID NO: 32854 - RNA, 22 nt, Homo sapiens
ugcaagccuugggugugggagg

SEQ ID NO: 32855 - RNA, 21 nt, Homo sapiens
acuagcuuauacauaaaauua

SEQ ID NO: 32856 - RNA, 24 nt, Homo sapiens
cacccccagagccucagcucccca

SEQ ID NO: 32857 - RNA, 23 nt, Homo sapiens
accacaggagucugagcauuuga

SEQ ID NO: 32858 - RNA, 24 nt, Homo sapiens
agugugaguucuaccauugccaaa

SEQ ID NO: 32859 - RNA, 22 nt, Homo sapiens
agcgggacuuugagggccaguu

SEQ ID NO: 32860 - RNA, 21 nt, Homo sapiens
ugcaaugcaacuacaaugcac

SEQ ID NO: 32861 - RNA, 22 nt, Homo sapiens
gcaaaagaaacugugguuuuug

SEQ ID NO: 32862 - RNA, 22 nt, Homo sapiens
uaaaugaauucaauuuccuucu

SEQ ID NO: 32863 - RNA, 22 nt, Homo sapiens
ccggcugcaacacaagacacga

SEQ ID NO: 32864 - RNA, 22 nt, Homo sapiens
ugagccacugugccuggccuga

SEQ ID NO: 32865 - RNA, 22 nt, Homo sapiens
acugccugucugugccugcugu

SEQ ID NO: 32866 - RNA, 22 nt, Homo sapiens
accagguuccaccccagcaggc

SEQ ID NO: 32867 - RNA, 21 nt, Homo sapiens
ugacugcagagcaaaagacac

SEQ ID NO: 32868 - RNA, 18 nt, Homo sapiens
acccucugaaaggaagca

SEQ ID NO: 32869 - RNA, 22 nt, Homo sapiens
aaagugcuucuuaccuccagau

SEQ ID NO: 32870 - RNA, 21 nt, Homo sapiens
cccgaggagccgggcaggcuu

SEQ ID NO: 32871 - RNA, 23 nt, Homo sapiens
cuccagccccuccagggcuuccu

SEQ ID NO: 32872 - RNA, 22 nt, Homo sapiens
ucaaugacucagguaaguugca

SEQ ID NO: 32873 - RNA, 22 nt, Homo sapiens
cacaaguucggaucuacggguu

SEQ ID NO: 32874 - RNA, 20 nt, Homo sapiens
cucaaagcaaacccugcaga

SEQ ID NO: 32875 - RNA, 22 nt, Homo sapiens
caaacaccauugucacacucca

SEQ ID NO: 32876 - RNA, 21 nt, Homo sapiens
ucuccagaucagggcagucca

SEQ ID NO: 32877 - RNA, 22 nt, Homo sapiens
uggcagcagcggagggggcaga

SEQ ID NO: 32878 - RNA, 24 nt, Homo sapiens
ugggagaaccucccugcuucugcu

SEQ ID NO: 32879 - RNA, 20 nt, Homo sapiens
ccagcagcaccuggggcagu

SEQ ID NO: 32880 - RNA, 21 nt, Homo sapiens
auccuguacugagcugccccg

SEQ ID NO: 32881 - RNA, 22 nt, Homo sapiens
gaacuugcuaaaaaugcagaau

SEQ ID NO: 32882 - RNA, 25 nt, Homo sapiens
accaacggaccuacuucccuccgcc

SEQ ID NO: 32883 - RNA, 22 nt, Homo sapiens
caaacaccauugucacacucca

SEQ ID NO: 32884 - RNA, 24 nt, Homo sapiens
gaagucacucccaggcagcugcaa

SEQ ID NO: 32885 - RNA, 19 nt, Homo sapiens
cagcaucagcagcaucauc

SEQ ID NO: 32886 - RNA, 21 nt, Homo sapiens
acaggccaucuguguuauauu

SEQ ID NO: 32887 - RNA, 22 nt, Homo sapiens
uauucaggaacauauugcaaaa

SEQ ID NO: 32888 - RNA, 22 nt, Homo sapiens
uauucaggaacauauugcaaaa

SEQ ID NO: 32889 - RNA, 22 nt, Homo sapiens
gaauucaucacggccagccucu

SEQ ID NO: 32890 - RNA, 22 nt, Homo sapiens
gagguuucccguguauguuuca

SEQ ID NO: 32891 - RNA, 20 nt, Homo sapiens
gaaagggcuucccuuugcag

SEQ ID NO: 32892 - RNA, 20 nt, Homo sapiens
gaaagggcuucccuuugcag

SEQ ID NO: 32893 - RNA, 20 nt, Homo sapiens
gcagcuguccgcccagacac

SEQ ID NO: 32894 - RNA, 24 nt, Homo sapiens
gaaagugcauagaauucugucugg

SEQ ID NO: 32895 - RNA, 22 nt, Homo sapiens
acaaaguucugugaugcacuga

SEQ ID NO: 32896 - RNA, 18 nt, Homo sapiens
auucaaucuacugccuca

SEQ ID NO: 32897 - RNA, 22 nt, Homo sapiens
acaguucuucaacuggcagcuu

SEQ ID NO: 32898 - RNA, 21 nt, Homo sapiens
cugggggacggagcagaagga

SEQ ID NO: 32899 - RNA, 17 nt, Homo sapiens
gggagaggaggaggcga

SEQ ID NO: 32900 - RNA, 21 nt, Homo sapiens
gggcaucugggacgcgcagga

SEQ ID NO: 32901 - RNA, 21 nt, Homo sapiens
gaccaaucgccguccccgccg

SEQ ID NO: 32902 - RNA, 22 nt, Homo sapiens
cuguuccugcugaacugagcca

SEQ ID NO: 32903 - RNA, 23 nt, Homo sapiens
agaggcaggcaugcgggcagaca

SEQ ID NO: 32904 - RNA, 22 nt, Homo sapiens
auaaggauuuuuaggggcauua

SEQ ID NO: 32905 - RNA, 22 nt, Homo sapiens
cucccuucuuuccucccgucuu

SEQ ID NO: 32906 - RNA, 22 nt, Homo sapiens
gcggucccgcggcgccccgccu

SEQ ID NO: 32907 - RNA, 22 nt, Homo sapiens
ugcuguuagcccuagccccgca

SEQ ID NO: 32908 - RNA, 22 nt, Homo sapiens
agcucagaacccagaggucuca

SEQ ID NO: 32909 - RNA, 22 nt, Homo sapiens
uccggggacgaacgggacgggu

SEQ ID NO: 32910 - RNA, 23 nt, Homo sapiens
gggagugaagacacggagccaga

SEQ ID NO: 32911 - RNA, 21 nt, Homo sapiens
gaccaaucgccguccccgccg

SEQ ID NO: 32912 - RNA, 20 nt, Homo sapiens
cccgccgcgucgcccugggg

SEQ ID NO: 32913 - RNA, 21 nt, Homo sapiens
uucuaggauaggcccaggggc

SEQ ID NO: 32914 - RNA, 22 nt, Homo sapiens
acaaccagcuaagacacugcca

SEQ ID NO: 32915 - RNA, 21 nt, Homo sapiens
uggaaaccaagagugggucgc

SEQ ID NO: 32916 - RNA, 21 nt, Homo sapiens
cugaaaccaaguaugggucgc

SEQ ID NO: 32917 - RNA, 19 nt, Homo sapiens
guccugaauuccgcagccu

SEQ ID NO: 32918 - RNA, 22 nt, Homo sapiens
gcggucccgcggcgccccgccu

SEQ ID NO: 32919 - RNA, 22 nt, Homo sapiens
ugcuguuagcccuagccccgca

SEQ ID NO: 32920 - RNA, 22 nt, Homo sapiens
gcugaggcuguggggcuggagu

SEQ ID NO: 32921 - RNA, 23 nt, Homo sapiens
ccgcuugagcuaacuccgacccg

SEQ ID NO: 32922 - RNA, 22 nt, Homo sapiens
ggaggccgggacgagugcaaua

SEQ ID NO: 32923 - RNA, 18 nt, Homo sapiens
gaaaugagggccagcuga

SEQ ID NO: 32924 - RNA, 24 nt, Homo sapiens
acugcaggcuccagcuuccaggcu

SEQ ID NO: 32925 - RNA, 20 nt, Homo sapiens
aagcagaaaaaggcaaacga

SEQ ID NO: 32926 - RNA, 21 nt, Homo sapiens
uuuagcauaaguaugucccaa

SEQ ID NO: 32927 - RNA, 22 nt, Homo sapiens
ucaggaacugccuuucucucca

SEQ ID NO: 32928 - RNA, 22 nt, Homo sapiens
uggcagcagcggagggggcaga

SEQ ID NO: 32929 - RNA, 20 nt, Homo sapiens
ccagcagcaccuggggcagu

SEQ ID NO: 32930 - RNA, 23 nt, Homo sapiens
aaaucagaaucacaccuggggga

SEQ ID NO: 32931 - RNA, 21 nt, Homo sapiens
auccuguacugagcugccccg

SEQ ID NO: 32932 - RNA, 25 nt, Homo sapiens
acggagcugucccaacaccaccccu

SEQ ID NO: 32933 - RNA, 24 nt, Homo sapiens
acgcagagcccgaaagcccccagu

SEQ ID NO: 32934 - RNA, 24 nt, Homo sapiens
acgcgcaggccagagacccaggca

SEQ ID NO: 32935 - RNA, 20 nt, Homo sapiens
uacugcuuccacagcucccc

SEQ ID NO: 32936 - RNA, 17 nt, Homo sapiens
gacagccucucccccac

SEQ ID NO: 32937 - RNA, 18 nt, Homo sapiens
aucacauucaccucccug

SEQ ID NO: 32938 - RNA, 18 nt, Homo sapiens
auucaaucuacugccuca

SEQ ID NO: 32939 - RNA, 22 nt, Homo sapiens
cagaagugggccgggcacaggg

SEQ ID NO: 32940 - RNA, 22 nt, Homo sapiens
acaaccagcuaagacacugcca

SEQ ID NO: 32941 - RNA, 23 nt, Homo sapiens
gcaaucagcuaacuacacugccu

SEQ ID NO: 32942 - RNA, 23 nt, Homo sapiens
aaaucagaaucacaccuggggga

SEQ ID NO: 32943 - RNA, 22 nt, Homo sapiens
accagcuaacaauacacugcca

SEQ ID NO: 32944 - RNA, 22 nt, Homo sapiens
gccagcuaacaauacacugccu

SEQ ID NO: 32945 - RNA, 22 nt, Homo sapiens
gaccucagcuaugacagcacuu

SEQ ID NO: 32946 - RNA, 22 nt, Homo sapiens
uuucaguuaucaaucugucaca

SEQ ID NO: 32947 - RNA, 24 nt, Homo sapiens
acgcagagcccgaaagcccccagu

SEQ ID NO: 32948 - RNA, 21 nt, Homo sapiens
cugcugggccacaacguggga

SEQ ID NO: 32949 - RNA, 21 nt, Homo sapiens
caucaccuuccuucuccucca

SEQ ID NO: 32950 - RNA, 20 nt, Homo sapiens
cccugcgccaucuccucuac

SEQ ID NO: 32951 - RNA, 21 nt, Homo sapiens
gaccaaucgccguccccgccg

SEQ ID NO: 32952 - RNA, 21 nt, Homo sapiens
gaccaaucgccguccccgccg

SEQ ID NO: 32953 - RNA, 21 nt, Homo sapiens
aaagugucagauacggugugg

SEQ ID NO: 32954 - RNA, 23 nt, Homo sapiens
gcgcccaauuaaugucuguugau

SEQ ID NO: 32955 - RNA, 22 nt, Homo sapiens
gcaaaaguaauugagauuuuug

SEQ ID NO: 32956 - RNA, 22 nt, Homo sapiens
gcggucccgcggcgccccgccu

SEQ ID NO: 32957 - RNA, 22 nt, Homo sapiens
gcggucccgcggcgccccgccu

SEQ ID NO: 32958 - RNA, 22 nt, Homo sapiens
ugcuguuagcccuagccccgca

SEQ ID NO: 32959 - RNA, 22 nt, Homo sapiens
ugcuguuagcccuagccccgca

SEQ ID NO: 32960 - RNA, 21 nt, Homo sapiens
caucaccuuccuucuccucca

SEQ ID NO: 32961 - RNA, 23 nt, Homo sapiens
gggagugaagacacggagccaga

SEQ ID NO: 32962 - RNA, 23 nt, Homo sapiens
aggaacagcagcagcccgggccg

SEQ ID NO: 32963 - RNA, 22 nt, Homo sapiens
agcugaguguaggauguuuaca

SEQ ID NO: 32964 - RNA, 23 nt, Homo sapiens
aaaucagaaucacaccuggggga

SEQ ID NO: 32965 - RNA, 22 nt, Homo sapiens
aagagggagacccaggcucgga

SEQ ID NO: 32966 - RNA, 24 nt, Homo sapiens
acgcagagcccgaaagcccccagu

SEQ ID NO: 32967 - RNA, 20 nt, Homo sapiens
uacugcuuccacagcucccc

SEQ ID NO: 32968 - RNA, 21 nt, Homo sapiens
cggcucggguggcggcgacgg

SEQ ID NO: 32969 - RNA, 22 nt, Homo sapiens
ucaggaacugccuuucucucca

SEQ ID NO: 32970 - RNA, 23 nt, Homo sapiens
cuaacugcacuagaugcaccuua

SEQ ID NO: 32971 - RNA, 21 nt, Homo sapiens
gaccaaucgccguccccgccg

SEQ ID NO: 32972 - RNA, 23 nt, Homo sapiens
aaaucagaaucacaccuggggga

SEQ ID NO: 32973 - RNA, 24 nt, Homo sapiens
acgcagagcccgaaagcccccagu

SEQ ID NO: 32974 - RNA, 24 nt, Homo sapiens
acgcgcaggccagagacccaggca

SEQ ID NO: 32975 - RNA, 23 nt, Homo sapiens
cuccagccccuccagggcuuccu

SEQ ID NO: 32976 - RNA, 22 nt, Homo sapiens
ugcuguuagcccuagccccgca

SEQ ID NO: 32977 - RNA, 23 nt, Homo sapiens
gcacaugugcacacagccgggug

SEQ ID NO: 32978 - RNA, 17 nt, Homo sapiens
gggagaggaggaggcga

SEQ ID NO: 32979 - RNA, 22 nt, Homo sapiens
cacgaccgacgccacgccgagu

SEQ ID NO: 32980 - RNA, 22 nt, Homo sapiens
ggagcccgcgccccgcgccgag

SEQ ID NO: 32981 - RNA, 22 nt, Homo sapiens
cacugguacaaggguugggaga

SEQ ID NO: 32982 - RNA, 22 nt, Homo sapiens
ucaggaacugccuuucucucca

SEQ ID NO: 32983 - RNA, 22 nt, Homo sapiens
agcccaaaaggagaauucuuug

SEQ ID NO: 32984 - RNA, 22 nt, Homo sapiens
agcccaaaaggagaauucuuug

SEQ ID NO: 32985 - RNA, 22 nt, Homo sapiens
aaucagucucauugcuuuauaa

SEQ ID NO: 32986 - RNA, 23 nt, Homo sapiens
agaggcaggcaugcgggcagaca

SEQ ID NO: 32987 - RNA, 22 nt, Homo sapiens
gguaaaacucgcaauuacuuuu

SEQ ID NO: 32988 - RNA, 22 nt, Homo sapiens
ggccaaaaccacaauuacuuuu

SEQ ID NO: 32989 - RNA, 22 nt, Homo sapiens
ggcaaaaaccgcaauuacuuuu

SEQ ID NO: 32990 - RNA, 22 nt, Homo sapiens
ggcaaaaaccacaauuacuuuu

SEQ ID NO: 32991 - RNA, 22 nt, Homo sapiens
gacaaaaaccgcgauuacuuuu

SEQ ID NO: 32992 - RNA, 22 nt, Homo sapiens
ggcaaaauccgcaauuacuuuu

SEQ ID NO: 32993 - RNA, 22 nt, Homo sapiens
accaaagaccgcaauuacuuuu

SEQ ID NO: 32994 - RNA, 21 nt, Homo sapiens
uuuuggugcauauuuacuuua

SEQ ID NO: 32995 - RNA, 19 nt, Homo sapiens
guccugaauuccgcagccu

SEQ ID NO: 32996 - RNA, 21 nt, Homo sapiens
cugaggagagaggaggugggg

SEQ ID NO: 32997 - RNA, 21 nt, Homo sapiens
gaccaaucgccguccccgccg

SEQ ID NO: 32998 - RNA, 22 nt, Homo sapiens
ucacgcgagccgaacgaacaaa

SEQ ID NO: 32999 - RNA, 22 nt, Homo sapiens
aguccagauucugugcccacca

SEQ ID NO: 33000 - RNA, 21 nt, Homo sapiens
ggacuauagaacuuucccccu

SEQ ID NO: 33001 - RNA, 22 nt, Homo sapiens
gcacauguucugcggcccacca

SEQ ID NO: 33002 - RNA, 22 nt, Homo sapiens
gcggucccgcggcgccccgccu

SEQ ID NO: 33003 - RNA, 23 nt, Homo sapiens
cuccagccccuccagggcuuccu

SEQ ID NO: 33004 - RNA, 23 nt, Homo sapiens
cacugugggcccucuccgcacca

SEQ ID NO: 33005 - RNA, 22 nt, Homo sapiens
ugcuguuagcccuagccccgca

SEQ ID NO: 33006 - RNA, 23 nt, Homo sapiens
ggaagccaucaagucgcugcagg

SEQ ID NO: 33007 - RNA, 20 nt, Homo sapiens
ggggggcgaggcagguguga

SEQ ID NO: 33008 - RNA, 21 nt, Homo sapiens
ucuccagaucagggcagucca

SEQ ID NO: 33009 - RNA, 24 nt, Homo sapiens
gaagucacucccaggcagcugcaa

SEQ ID NO: 33010 - RNA, 23 nt, Homo sapiens
cuaccugcacuguaagcacuuug

SEQ ID NO: 33011 - RNA, 22 nt, Homo sapiens
ucaggaacugccuuucucucca

SEQ ID NO: 33012 - RNA, 21 nt, Homo sapiens
aggcggcaggcacaggacugg

SEQ ID NO: 33013 - RNA, 22 nt, Homo sapiens
ucaacaucagucugauaagcua

SEQ ID NO: 33014 - RNA, 22 nt, Homo sapiens
aaagagguuaaccagguguguu

SEQ ID NO: 33015 - RNA, 22 nt, Homo sapiens
ugaauccuugaauagguguguu

SEQ ID NO: 33016 - RNA, 21 nt, Homo sapiens
gaccaagaaauagccuuucaa

SEQ ID NO: 33017 - RNA, 22 nt, Homo sapiens
caugauugccacgucugcagua

SEQ ID NO: 33018 - RNA, 21 nt, Homo sapiens
ugauugccacugucugcagua

SEQ ID NO: 33019 - RNA, 19 nt, Homo sapiens
gccucagaggcagcugcuu

SEQ ID NO: 33020 - RNA, 20 nt, Homo sapiens
aggggccucagccuccuggu

SEQ ID NO: 33021 - RNA, 22 nt, Homo sapiens
cuggagagacaaggggaagagg

SEQ ID NO: 33022 - RNA, 18 nt, Homo sapiens
cagcagccuccuucucaa

SEQ ID NO: 33023 - RNA, 22 nt, Homo sapiens
cacgaccgacgccacgccgagu

SEQ ID NO: 33024 - RNA, 22 nt, Homo sapiens
ggagcccgcgccccgcgccgag

SEQ ID NO: 33025 - RNA, 23 nt, Homo sapiens
gggagugaagacacggagccaga

SEQ ID NO: 33026 - RNA, 21 nt, Homo sapiens
acuagacugugagcuccucga

SEQ ID NO: 33027 - RNA, 22 nt, Homo sapiens
cucaauagacugugagcuccuu

SEQ ID NO: 33028 - RNA, 22 nt, Homo sapiens
uacagauggauaccgugcaauu

SEQ ID NO: 33029 - RNA, 22 nt, Homo sapiens
aagagggagacccaggcucgga

SEQ ID NO: 33030 - RNA, 22 nt, Homo sapiens
caagacacauuuggagagggac

SEQ ID NO: 33031 - RNA, 23 nt, Homo sapiens
cccagcuagauuguaagcuccuu

SEQ ID NO: 33032 - RNA, 21 nt, Homo sapiens
aagggucaguaagcacccgcg

SEQ ID NO: 33033 - RNA, 23 nt, Homo sapiens
gacguaguccuauucucugcugc

SEQ ID NO: 33034 - RNA, 22 nt, Homo sapiens
cacauggccaaaacagagaaga

SEQ ID NO: 33035 - RNA, 22 nt, Homo sapiens
cacaaguucggaucuacggguu

SEQ ID NO: 33036 - RNA, 22 nt, Homo sapiens
cacaaguucggaucuacggguu

SEQ ID NO: 33037 - RNA, 22 nt, Homo sapiens
acacacccacgcgagccggaaa

SEQ ID NO: 33038 - RNA, 21 nt, Homo sapiens
acccaguagccagauguagcu

SEQ ID NO: 33039 - RNA, 18 nt, Homo sapiens
acccucugaaaggaagca

SEQ ID NO: 33040 - RNA, 22 nt, Homo sapiens
aaagugcuucuuaccuccagau

SEQ ID NO: 33041 - RNA, 22 nt, Homo sapiens
uccagcaaagggaagcgcuuuc

SEQ ID NO: 33042 - RNA, 22 nt, Homo sapiens
accucuaaaggggagcgcuuug

SEQ ID NO: 33043 - RNA, 23 nt, Homo sapiens
acacucuaaagagaagcgcuuug

SEQ ID NO: 33044 - RNA, 21 nt, Homo sapiens
gcuccaaagggaagcgcuuug

SEQ ID NO: 33045 - RNA, 21 nt, Homo sapiens
ccucuaaagagaagcgcuuuc

SEQ ID NO: 33046 - RNA, 23 nt, Homo sapiens
cuccagccccuccagggcuuccu

SEQ ID NO: 33047 - RNA, 23 nt, Homo sapiens
ucauacagcuagauaaccaaaga

SEQ ID NO: 33048 - RNA, 24 nt, Homo sapiens
cacccccagagccucagcucccca

SEQ ID NO: 33049 - RNA, 17 nt, Homo sapiens
gacagccucucccccac

SEQ ID NO: 33050 - RNA, 22 nt, Homo sapiens
cacgaccgacgccacgccgagu

SEQ ID NO: 33051 - RNA, 21 nt, Homo sapiens
gaccaaucgccguccccgccg

SEQ ID NO: 33052 - RNA, 21 nt, Homo sapiens
acaggauugagggggggcccu

SEQ ID NO: 33053 - RNA, 23 nt, Homo sapiens
aaaucagaaucacaccuggggga

SEQ ID NO: 33054 - RNA, 22 nt, Homo sapiens
aucgggaggggacugagccuga

SEQ ID NO: 33055 - RNA, 20 nt, Homo sapiens
gaaagggcuucccuuuguag

SEQ ID NO: 33056 - RNA, 22 nt, Homo sapiens
gagaaagugcuucccuuuguag

SEQ ID NO: 33057 - RNA, 21 nt, Homo sapiens
agagcucauccauaguuguca

SEQ ID NO: 33058 - RNA, 21 nt, Homo sapiens
ggacuauagaacuuucccccu

SEQ ID NO: 33059 - RNA, 24 nt, Homo sapiens
acgcagagcccgaaagcccccagu

SEQ ID NO: 33060 - RNA, 24 nt, Homo sapiens
acgcgcaggccagagacccaggca

SEQ ID NO: 33061 - RNA, 22 nt, Homo sapiens
gcggucccgcggcgccccgccu

SEQ ID NO: 33062 - RNA, 21 nt, Homo sapiens
aggagacucacaaguuccugc

SEQ ID NO: 33063 - RNA, 21 nt, Homo sapiens
gagcugcauccuggcuccggg

SEQ ID NO: 33064 - RNA, 23 nt, Homo sapiens
acacagcucuuccauaucuccag

SEQ ID NO: 33065 - RNA, 21 nt, Homo sapiens
acuagacugugagcuccucga

SEQ ID NO: 33066 - RNA, 21 nt, Homo sapiens
gaccaaucgccguccccgccg

SEQ ID NO: 33067 - RNA, 22 nt, Homo sapiens
acaucaucgcauauugacacaa

SEQ ID NO: 33068 - RNA, 22 nt, Homo sapiens
acaguggucaucgagugacaca

SEQ ID NO: 33069 - RNA, 25 nt, Homo sapiens
acggagcugucccaacaccaccccu

SEQ ID NO: 33070 - RNA, 22 nt, Homo sapiens
gauccgagcaccggggaccccc

SEQ ID NO: 33071 - RNA, 20 nt, Homo sapiens
auuucuauaucuaucuccau

SEQ ID NO: 33072 - RNA, 22 nt, Homo sapiens
gcggucccgcggcgccccgccu

SEQ ID NO: 33073 - RNA, 20 nt, Homo sapiens
cuggggaaaaggguggcacg

SEQ ID NO: 33074 - RNA, 18 nt, Homo sapiens
cccccaccaccacgcccg

SEQ ID NO: 33075 - RNA, 21 nt, Homo sapiens
aaagagaccgguucacuguga

SEQ ID NO: 33076 - RNA, 22 nt, Homo sapiens
ccaucuuuaccagacaguguua

SEQ ID NO: 33077 - RNA, 21 nt, Homo sapiens
cggggugcacgggcggagggc

SEQ ID NO: 33078 - RNA, 23 nt, Homo sapiens
gggagugaagacacggagccaga

SEQ ID NO: 33079 - RNA, 22 nt, Homo sapiens
acaucguuaccagacaguguua

SEQ ID NO: 33080 - RNA, 22 nt, Homo sapiens
cucaauagacugugagcuccuu

SEQ ID NO: 33081 - RNA, 22 nt, Homo sapiens
agcugaguguaggauguuuaca

SEQ ID NO: 33082 - RNA, 23 nt, Homo sapiens
aaagucucgcucucugccccuca

SEQ ID NO: 33083 - RNA, 22 nt, Homo sapiens
aggaaaccagcaaguguugacg

SEQ ID NO: 33084 - RNA, 22 nt, Homo sapiens
gcaaaagaaacugugguuuuug

SEQ ID NO: 33085 - RNA, 23 nt, Homo sapiens
cccagcuagauuguaagcuccuu

SEQ ID NO: 33086 - RNA, 21 nt, Homo sapiens
caucaccuuccuucuccucca

SEQ ID NO: 33087 - RNA, 22 nt, Homo sapiens
ccaucuuuaccagacaguguua

SEQ ID NO: 33088 - RNA, 22 nt, Homo sapiens
acaucguuaccagacaguguua

SEQ ID NO: 33089 - RNA, 22 nt, Homo sapiens
ggcaaaauccgcaauuacuuuu

SEQ ID NO: 33090 - RNA, 21 nt, Homo sapiens
aacggaaccacuagugacuug

SEQ ID NO: 33091 - RNA, 21 nt, Homo sapiens
aacggaaccacuagugacuug

SEQ ID NO: 33092 - RNA, 20 nt, Homo sapiens
uaugaacaauuucuaggaau

SEQ ID NO: 33093 - RNA, 23 nt, Homo sapiens
augcaaaguugcucggguaaccu

SEQ ID NO: 33094 - RNA, 22 nt, Homo sapiens
acacucuaaagggaaccauuuu

SEQ ID NO: 33095 - RNA, 22 nt, Homo sapiens
acacucuaaagggaaccauuuu

SEQ ID NO: 33096 - RNA, 21 nt, Homo sapiens
caaaaaccacaaauaccuuug

SEQ ID NO: 33097 - RNA, 22 nt, Homo sapiens
uggggacccucccugaaccaag

SEQ ID NO: 33098 - RNA, 22 nt, Homo sapiens
acacacccacgcgagccggaaa

SEQ ID NO: 33099 - RNA, 22 nt, Homo sapiens
cagaagugggccgggcacaggg

SEQ ID NO: 33100 - RNA, 21 nt, Homo sapiens
ggaaaucccuggcaaugugau

SEQ ID NO: 33101 - RNA, 21 nt, Homo sapiens
gguaaucccuggcaaugugau

SEQ ID NO: 33102 - RNA, 22 nt, Homo sapiens
cuguuccugcugaacugagcca

SEQ ID NO: 33103 - RNA, 21 nt, Homo sapiens
aucugcacugucagcacuuua

SEQ ID NO: 33104 - RNA, 23 nt, Homo sapiens
gcuuugacaauaucauugcacug

SEQ ID NO: 33105 - RNA, 23 nt, Homo sapiens
acugaggggccucagaccgagcu

SEQ ID NO: 33106 - RNA, 22 nt, Homo sapiens
aagagggagacccaggcucgga

SEQ ID NO: 33107 - RNA, 21 nt, Homo sapiens
ccccucccagccucccugcca

SEQ ID NO: 33108 - RNA, 22 nt, Homo sapiens
cugggggcggcacaggggcuca

SEQ ID NO: 33109 - RNA, 23 nt, Homo sapiens
ucacauaggaauaaaaagccaua

SEQ ID NO: 33110 - RNA, 23 nt, Homo sapiens
gggagugaagacacggagccaga

SEQ ID NO: 33111 - RNA, 22 nt, Homo sapiens
cggugagcacccggccccugcg

SEQ ID NO: 33112 - RNA, 22 nt, Homo sapiens
uggcagcagcggagggggcaga

SEQ ID NO: 33113 - RNA, 20 nt, Homo sapiens
ccagcagcaccuggggcagu

SEQ ID NO: 33114 - RNA, 23 nt, Homo sapiens
aaaucagaaucacaccuggggga

SEQ ID NO: 33115 - RNA, 23 nt, Homo sapiens
aaagucucgcucucugccccuca

SEQ ID NO: 33116 - RNA, 21 nt, Homo sapiens
auccuguacugagcugccccg

SEQ ID NO: 33117 - RNA, 20 nt, Homo sapiens
acaaugagaacccauggucu

SEQ ID NO: 33118 - RNA, 24 nt, Homo sapiens
acgcagagcccgaaagcccccagu

SEQ ID NO: 33119 - RNA, 23 nt, Homo sapiens
acaacaaaaucacuagucuucca

SEQ ID NO: 33120 - RNA, 20 nt, Homo sapiens
uacugcuuccacagcucccc

SEQ ID NO: 33121 - RNA, 17 nt, Homo sapiens
gggagaggaggaggcga

SEQ ID NO: 33122 - RNA, 22 nt, Homo sapiens
ucagaccgagacaagugcaaug

SEQ ID NO: 33123 - RNA, 21 nt, Homo sapiens
cccgaggagccgggcaggcuu

SEQ ID NO: 33124 - RNA, 21 nt, Homo sapiens
auaauggagaccaggccacga

SEQ ID NO: 33125 - RNA, 22 nt, Homo sapiens
caaacaccauugucacacucca

SEQ ID NO: 33126 - RNA, 18 nt, Homo sapiens
cccccaccaccacgcccg

SEQ ID NO: 33127 - RNA, 18 nt, Homo sapiens
cccccaccaccacgcccg

SEQ ID NO: 33128 - RNA, 23 nt, Homo sapiens
gggagugaagacacggagccaga

SEQ ID NO: 33129 - RNA, 21 nt, Homo sapiens
gaccaaucgccguccccgccg

SEQ ID NO: 33130 - RNA, 21 nt, Homo sapiens
aggcggcaggcacaggacugg

SEQ ID NO: 33131 - RNA, 22 nt, Homo sapiens
ugagccacugugccuggccuga

SEQ ID NO: 33132 - RNA, 21 nt, Homo sapiens
agcuaugccagcaucuugccu

SEQ ID NO: 33133 - RNA, 23 nt, Homo sapiens
cggcucugucgucgaggcgcuca

SEQ ID NO: 33134 - RNA, 21 nt, Homo sapiens
ugcaugacggccugcaagaca

SEQ ID NO: 33135 - RNA, 22 nt, Homo sapiens
gcggucccgcggcgccccgccu

SEQ ID NO: 33136 - RNA, 22 nt, Homo sapiens
ugcuguuagcccuagccccgca

SEQ ID NO: 33137 - RNA, 18 nt, Homo sapiens
auucaaucuacugccuca

SEQ ID NO: 33138 - RNA, 22 nt, Homo sapiens
aaucagucucauugcuuuauaa

SEQ ID NO: 33139 - RNA, 21 nt, Homo sapiens
guccugagagcgcugccuccu

SEQ ID NO: 33140 - RNA, 21 nt, Homo sapiens
caucaccuuccuucuccucca

SEQ ID NO: 33141 - RNA, 20 nt, Homo sapiens
cccugcgccaucuccucuac

SEQ ID NO: 33142 - RNA, 22 nt, Homo sapiens
cacaaguucggaucuacggguu

SEQ ID NO: 33143 - RNA, 23 nt, Homo sapiens
ggaagccaucaagucgcugcagg

SEQ ID NO: 33144 - RNA, 17 nt, Homo sapiens
gggagaggaggaggcga

SEQ ID NO: 33145 - RNA, 21 nt, Homo sapiens
gaccaaucgccguccccgccg

SEQ ID NO: 33146 - RNA, 22 nt, Homo sapiens
cggugagcacccggccccugcg

SEQ ID NO: 33147 - RNA, 22 nt, Homo sapiens
auaaggauuuuuaggggcauua

SEQ ID NO: 33148 - RNA, 22 nt, Homo sapiens
gccaccuucaaaugggaagucu

SEQ ID NO: 33149 - RNA, 22 nt, Homo sapiens
ccucaggcacggccgggccacc

SEQ ID NO: 33150 - RNA, 22 nt, Homo sapiens
cacaagaucggaucuacggguu

SEQ ID NO: 33151 - RNA, 22 nt, Homo sapiens
cgcaaggucgguucuacgggug

SEQ ID NO: 33152 - RNA, 23 nt, Homo sapiens
cacaaauucggaucuacagggua

SEQ ID NO: 33153 - RNA, 23 nt, Homo sapiens
cacaaauucgguucuacagggua

SEQ ID NO: 33154 - RNA, 22 nt, Homo sapiens
agaaagcgcuuuccuuuguaga

SEQ ID NO: 33155 - RNA, 23 nt, Homo sapiens
gaaacccagcagacaauguagcu

SEQ ID NO: 33156 - RNA, 23 nt, Homo sapiens
cgugagcuccuggaggacaggga

SEQ ID NO: 33157 - RNA, 22 nt, Homo sapiens
acaaaaguugccuuugugugau

SEQ ID NO: 33158 - RNA, 22 nt, Homo sapiens
gccagcuaacaauacacugccu

SEQ ID NO: 33159 - RNA, 21 nt, Homo sapiens
cucacucagauggccaacuca

SEQ ID NO: 33160 - RNA, 20 nt, Homo sapiens
agagaugagagaaacacccu

SEQ ID NO: 33161 - RNA, 20 nt, Homo sapiens
aggggccucagccuccuggu

SEQ ID NO: 33162 - RNA, 23 nt, Homo sapiens
cccagcuagauuguaagcuccuu

SEQ ID NO: 33163 - RNA, 23 nt, Homo sapiens
gacguaguccuauucucugcugc

SEQ ID NO: 33164 - RNA, 21 nt, Homo sapiens
agaaguagaccauguguccua

SEQ ID NO: 33165 - RNA, 22 nt, Homo sapiens
gaggcucagaauggcucaggag

SEQ ID NO: 33166 - RNA, 22 nt, Homo sapiens
ugaagaagggggggaagggcgu

SEQ ID NO: 33167 - RNA, 23 nt, Homo sapiens
gggagugaagacacggagccaga

SEQ ID NO: 33168 - RNA, 22 nt, Homo sapiens
cuguuccugcugaacugagcca

SEQ ID NO: 33169 - RNA, 23 nt, Homo sapiens
aaagucucgcucucugccccuca

SEQ ID NO: 33170 - RNA, 22 nt, Homo sapiens
acuucaaggaucuuaaacuuug

SEQ ID NO: 33171 - RNA, 22 nt, Homo sapiens
acuggguucaccuuuaagggca

SEQ ID NO: 33172 - RNA, 22 nt, Homo sapiens
caaacaccauugucacacucca

SEQ ID NO: 33173 - RNA, 18 nt, Homo sapiens
ugguggcagaggugggau

SEQ ID NO: 33174 - RNA, 18 nt, Homo sapiens
ugguggcagaggugggau

SEQ ID NO: 33175 - RNA, 21 nt, Homo sapiens
uuuagcauaaguaugucccaa

SEQ ID NO: 33176 - RNA, 22 nt, Homo sapiens
uucacacugcaugcucugggua

SEQ ID NO: 33177 - RNA, 22 nt, Homo sapiens
uggcagcagcggagggggcaga

SEQ ID NO: 33178 - RNA, 20 nt, Homo sapiens
ccagcagcaccuggggcagu

SEQ ID NO: 33179 - RNA, 21 nt, Homo sapiens
acaggccaucuguguuauauu

SEQ ID NO: 33180 - RNA, 23 nt, Homo sapiens
ucaacgggagugaucgugucauu

SEQ ID NO: 33181 - RNA, 21 nt, Homo sapiens
auccuguacugagcugccccg

SEQ ID NO: 33182 - RNA, 22 nt, Homo sapiens
ugcaagccuugggugugggagg

SEQ ID NO: 33183 - RNA, 25 nt, Homo sapiens
acggagcugucccaacaccaccccu

SEQ ID NO: 33184 - RNA, 25 nt, Homo sapiens
acggagcugucccaacaccaccccu

SEQ ID NO: 33185 - RNA, 21 nt, Homo sapiens
auguaggccuuuagaucacuu

SEQ ID NO: 33186 - RNA, 22 nt, Homo sapiens
ucaucucgcccgcaaagaccca

SEQ ID NO: 33187 - RNA, 21 nt, Homo sapiens
gagcuacagugcuucaucuca

SEQ ID NO: 33188 - RNA, 21 nt, Homo sapiens
cguacgcuauacggucuacua

SEQ ID NO: 33189 - RNA, 22 nt, Homo sapiens
acaaaauccacaauuacuuuug

SEQ ID NO: 33190 - RNA, 22 nt, Homo sapiens
cacauggccaaaacagagaaga

SEQ ID NO: 33191 - RNA, 22 nt, Homo sapiens
gacucgaaccacugauccagca

SEQ ID NO: 33192 - RNA, 22 nt, Homo sapiens
ccccucuggucaaccagucaca

SEQ ID NO: 33193 - RNA, 22 nt, Homo sapiens
agugaauucuaccagugccaua

SEQ ID NO: 33194 - RNA, 21 nt, Homo sapiens
uucuaggauaggcccaggggc

SEQ ID NO: 33195 - RNA, 23 nt, Homo sapiens
ucaacgggagugaucgugucauu

SEQ ID NO: 33196 - RNA, 22 nt, Homo sapiens
cgauguaguccaaaggcacaua

SEQ ID NO: 33197 - RNA, 22 nt, Homo sapiens
aaagacguggagaaauuagaau

SEQ ID NO: 33198 - RNA, 23 nt, Homo sapiens
aaucgcgguuuauaccaaaugaa

SEQ ID NO: 33199 - RNA, 22 nt, Homo sapiens
ccucuaguaaauaugucagcau

SEQ ID NO: 33200 - RNA, 21 nt, Homo sapiens
gaaggaagugagugcagccac

SEQ ID NO: 33201 - RNA, 23 nt, Homo sapiens
agaaaccaugggguaugagcaga

SEQ ID NO: 33202 - RNA, 22 nt, Homo sapiens
ucggucccucgggccagggcag

SEQ ID NO: 33203 - RNA, 22 nt, Homo sapiens
gggagaggucucccugcgcaca

SEQ ID NO: 33204 - RNA, 21 nt, Homo sapiens
cuggaggacggcaacagucag

SEQ ID NO: 33205 - RNA, 20 nt, Homo sapiens
cucaaagcaaacccugcaga

SEQ ID NO: 33206 - RNA, 24 nt, Homo sapiens
acugcaggcuccagcuuccaggcu

SEQ ID NO: 33207 - RNA, 24 nt, Homo sapiens
acugcaggcuccagcuuccaggcu

SEQ ID NO: 33208 - RNA, 17 nt, Homo sapiens
gacagccucucccccac

SEQ ID NO: 33209 - RNA, 21 nt, Homo sapiens
ccgugguucuacccuguggua

SEQ ID NO: 33210 - RNA, 22 nt, Homo sapiens
aacccauggaauucaguucuca

SEQ ID NO: 33211 - RNA, 22 nt, Homo sapiens
agccuauggaauucaguucuca

SEQ ID NO: 33212 - RNA, 23 nt, Homo sapiens
cuaccugcacuguaagcacuuug

SEQ ID NO: 33213 - RNA, 20 nt, Homo sapiens
cccgccgcgucgcccugggg

SEQ ID NO: 33214 - RNA, 21 nt, Homo sapiens
uucuaggauaggcccaggggc

SEQ ID NO: 33215 - RNA, 23 nt, Homo sapiens
aaaucagaaucacaccuggggga

SEQ ID NO: 33216 - RNA, 21 nt, Homo sapiens
ccuucugacuccaaguccagu

SEQ ID NO: 33217 - RNA, 22 nt, Homo sapiens
gccuucugacccuaaguccagu

SEQ ID NO: 33218 - RNA, 22 nt, Homo sapiens
caugauugccacgucugcagua

SEQ ID NO: 33219 - RNA, 21 nt, Homo sapiens
ugauugccacugucugcagua

SEQ ID NO: 33220 - RNA, 24 nt, Homo sapiens
acgcagagcccgaaagcccccagu

SEQ ID NO: 33221 - RNA, 23 nt, Homo sapiens
uguaggcuggggauaaaugaaua

SEQ ID NO: 33222 - RNA, 20 nt, Homo sapiens
ugucuccacagggcucuuua

SEQ ID NO: 33223 - RNA, 21 nt, Homo sapiens
gcaagcccagaccgcaaaaag

SEQ ID NO: 33224 - RNA, 22 nt, Homo sapiens
cacgaccgacgccacgccgagu

SEQ ID NO: 33225 - RNA, 22 nt, Homo sapiens
augcccuuucaucauugcacug

SEQ ID NO: 33226 - RNA, 22 nt, Homo sapiens
uggcagcagcggagggggcaga

SEQ ID NO: 33227 - RNA, 23 nt, Homo sapiens
cuacuaaaacauggaagcacuua

SEQ ID NO: 33228 - RNA, 23 nt, Homo sapiens
acacucaaacauggaagcacuua

SEQ ID NO: 33229 - RNA, 20 nt, Homo sapiens
ccagcagcaccuggggcagu

SEQ ID NO: 33230 - RNA, 23 nt, Homo sapiens
cggcucugucgucgaggcgcuca

SEQ ID NO: 33231 - RNA, 21 nt, Homo sapiens
auccuguacugagcugccccg

SEQ ID NO: 33232 - RNA, 22 nt, Homo sapiens
ucucacccagggacaaaggauu

SEQ ID NO: 33233 - RNA, 23 nt, Homo sapiens
acccucuauagggaagcgcguuc

SEQ ID NO: 33234 - RNA, 21 nt, Homo sapiens
gaaggaagugagugcagccac

SEQ ID NO: 33235 - RNA, 22 nt, Homo sapiens
cagaagugggccgggcacaggg

SEQ ID NO: 33236 - RNA, 25 nt, Homo sapiens
acggagcugucccaacaccaccccu

SEQ ID NO: 33237 - RNA, 21 nt, Homo sapiens
gaaggaagugagugcagccac

SEQ ID NO: 33238 - RNA, 24 nt, Homo sapiens
gaagucacucccaggcagcugcaa

SEQ ID NO: 33239 - RNA, 21 nt, Homo sapiens
gggcaucugggacgcgcagga

SEQ ID NO: 33240 - RNA, 22 nt, Homo sapiens
uggcagcagcggagggggcaga

SEQ ID NO: 33241 - RNA, 22 nt, Homo sapiens
gcgaacgcgccacggaccaccu

SEQ ID NO: 33242 - RNA, 20 nt, Homo sapiens
ccagcagcaccuggggcagu

SEQ ID NO: 33243 - RNA, 21 nt, Homo sapiens
auccuguacugagcugccccg

SEQ ID NO: 33244 - RNA, 19 nt, Homo sapiens
auuuugguacagcagcuca

SEQ ID NO: 33245 - RNA, 20 nt, Homo sapiens
ugggccaccgccgagcggac

SEQ ID NO: 33246 - RNA, 22 nt, Homo sapiens
uauccacuacaccccgcugccu

SEQ ID NO: 33247 - RNA, 22 nt, Homo sapiens
ggcagagagucagagcgcggau

SEQ ID NO: 33248 - RNA, 20 nt, Homo sapiens
gcagcuguccgcccagacac

SEQ ID NO: 33249 - RNA, 21 nt, Homo sapiens
aagggucaguaagcacccgcg

SEQ ID NO: 33250 - RNA, 22 nt, Homo sapiens
caaacaccauugucacacucca

SEQ ID NO: 33251 - RNA, 22 nt, Homo sapiens
ccagaacugaguccacagggca

SEQ ID NO: 33252 - RNA, 23 nt, Homo sapiens
gggagugaagacacggagccaga

SEQ ID NO: 33253 - RNA, 22 nt, Homo sapiens
acccuuaucaguucuccgucca

SEQ ID NO: 33254 - RNA, 20 nt, Homo sapiens
cccgccgcgucgcccugggg

SEQ ID NO: 33255 - RNA, 23 nt, Homo sapiens
cggcucugucgucgaggcgcuca

SEQ ID NO: 33256 - RNA, 23 nt, Homo sapiens
cgugagcuccuggaggacaggga

SEQ ID NO: 33257 - RNA, 18 nt, Homo sapiens
acccucugaaaggaagca

SEQ ID NO: 33258 - RNA, 22 nt, Homo sapiens
aaagugcuucuuaccuccagau

SEQ ID NO: 33259 - RNA, 17 nt, Homo sapiens
gacagccucucccccac

SEQ ID NO: 33260 - RNA, 17 nt, Homo sapiens
ggguggcagcgguggga

SEQ ID NO: 33261 - RNA, 18 nt, Homo sapiens
auucaaucuacugccuca

SEQ ID NO: 33262 - RNA, 22 nt, Homo sapiens
agcgggacuuugagggccaguu

SEQ ID NO: 33263 - RNA, 22 nt, Homo sapiens
auggcaguggaguuagugauug

SEQ ID NO: 33264 - RNA, 21 nt, Homo sapiens
ggacuauagaacuuucccccu

SEQ ID NO: 33265 - RNA, 20 nt, Homo sapiens
aggggccucagccuccuggu

SEQ ID NO: 33266 - RNA, 23 nt, Homo sapiens
cuccagccccuccagggcuuccu

SEQ ID NO: 33267 - RNA, 20 nt, Homo sapiens
uacugcuuccacagcucccc

SEQ ID NO: 33268 - RNA, 23 nt, Homo sapiens
gcacaugugcacacagccgggug

SEQ ID NO: 33269 - RNA, 22 nt, Homo sapiens
auccuucuacaaauucacccau

SEQ ID NO: 33270 - RNA, 22 nt, Homo sapiens
uagcagaagcauuuccgcacac

SEQ ID NO: 33271 - RNA, 22 nt, Homo sapiens
ccggcugcaacacaagacacga

SEQ ID NO: 33272 - RNA, 21 nt, Homo sapiens
gaccaaucgccguccccgccg

SEQ ID NO: 33273 - RNA, 22 nt, Homo sapiens
cucaauagacugugagcuccuu

SEQ ID NO: 33274 - RNA, 22 nt, Homo sapiens
cucggggcagcucaguacagga

SEQ ID NO: 33275 - RNA, 22 nt, Homo sapiens
gcggucccgcggcgccccgccu

SEQ ID NO: 33276 - RNA, 23 nt, Homo sapiens
cccagcuagauuguaagcuccuu

SEQ ID NO: 33277 - RNA, 23 nt, Homo sapiens
gcacaugugcacacagccgggug

SEQ ID NO: 33278 - RNA, 19 nt, Homo sapiens
ccaccucccgaguccucac

SEQ ID NO: 33279 - RNA, 22 nt, Homo sapiens
cugggggcggcacaggggcuca

SEQ ID NO: 33280 - RNA, 21 nt, Homo sapiens
auguaggccuuuagaucacuu

SEQ ID NO: 33281 - RNA, 22 nt, Homo sapiens
ccagaacugaguccacagggca

SEQ ID NO: 33282 - RNA, 20 nt, Homo sapiens
gcagaagcauuuccacacac

SEQ ID NO: 33283 - RNA, 23 nt, Homo sapiens
gggagugaagacacggagccaga

SEQ ID NO: 33284 - RNA, 22 nt, Homo sapiens
ugagccacugugccuggccuga

SEQ ID NO: 33285 - RNA, 21 nt, Homo sapiens
ggaaaucccuggcaaugugau

SEQ ID NO: 33286 - RNA, 21 nt, Homo sapiens
gguaaucccuggcaaugugau

SEQ ID NO: 33287 - RNA, 21 nt, Homo sapiens
acaggauugagggggggcccu

SEQ ID NO: 33288 - RNA, 21 nt, Homo sapiens
acaggauugagggggggcccu

SEQ ID NO: 33289 - RNA, 23 nt, Homo sapiens
aaagucucgcucucugccccuca

SEQ ID NO: 33290 - RNA, 22 nt, Homo sapiens
uauggaugcaaaaugaucccaa

SEQ ID NO: 33291 - RNA, 22 nt, Homo sapiens
cagcauggaguccuccagguug

SEQ ID NO: 33292 - RNA, 22 nt, Homo sapiens
aggaaaccagcaaguguugacg

SEQ ID NO: 33293 - RNA, 20 nt, Homo sapiens
aggggccucagccuccuggu

SEQ ID NO: 33294 - RNA, 23 nt, Homo sapiens
aaccaagaccccggagaucccag

SEQ ID NO: 33295 - RNA, 22 nt, Homo sapiens
ugaagaagggggggaagggcgu

SEQ ID NO: 33296 - RNA, 22 nt, Homo sapiens
aacaacacuugaccacauccug

SEQ ID NO: 33297 - RNA, 18 nt, Homo sapiens
aucacauucaccucccug

SEQ ID NO: 33298 - RNA, 21 nt, Homo sapiens
gaccaaucgccguccccgccg

SEQ ID NO: 33299 - RNA, 19 nt, Homo sapiens
guccugaauuccgcagccu

SEQ ID NO: 33300 - RNA, 21 nt, Homo sapiens
gaaggaagugagugcagccac

SEQ ID NO: 33301 - RNA, 22 nt, Homo sapiens
gcggucccgcggcgccccgccu

SEQ ID NO: 33302 - RNA, 22 nt, Homo sapiens
agcucagaacccagaggucuca

SEQ ID NO: 33303 - RNA, 22 nt, Homo sapiens
agacaacaaugccaaccucaca

SEQ ID NO: 33304 - RNA, 18 nt, Homo sapiens
auucaaucuacugccuca

SEQ ID NO: 33305 - RNA, 21 nt, Homo sapiens
gaccaaucgccguccccgccg

SEQ ID NO: 33306 - RNA, 22 nt, Homo sapiens
uggcagcagcggagggggcaga

SEQ ID NO: 33307 - RNA, 20 nt, Homo sapiens
cccgccgcgucgcccugggg

SEQ ID NO: 33308 - RNA, 23 nt, Homo sapiens
cagcugcuuuugggauuccguug

SEQ ID NO: 33309 - RNA, 20 nt, Homo sapiens
ccagcagcaccuggggcagu

SEQ ID NO: 33310 - RNA, 22 nt, Homo sapiens
acaaccagcuaagacacugcca

SEQ ID NO: 33311 - RNA, 22 nt, Homo sapiens
auggcaguggaguuagugauug

SEQ ID NO: 33312 - RNA, 23 nt, Homo sapiens
gcaaucagcuaacuacacugccu

SEQ ID NO: 33313 - RNA, 22 nt, Homo sapiens
accagcuaacaauacacugcca

SEQ ID NO: 33314 - RNA, 22 nt, Homo sapiens
gccagcuaacaauacacugccu

SEQ ID NO: 33315 - RNA, 21 nt, Homo sapiens
auccuguacugagcugccccg

SEQ ID NO: 33316 - RNA, 22 nt, Homo sapiens
ccucauggaaggguuccccacu

SEQ ID NO: 33317 - RNA, 21 nt, Homo sapiens
guccugagagcgcugccuccu

SEQ ID NO: 33318 - RNA, 22 nt, Homo sapiens
gcggucccgcggcgccccgccu

SEQ ID NO: 33319 - RNA, 22 nt, Homo sapiens
ugcuguuagcccuagccccgca

SEQ ID NO: 33320 - RNA, 21 nt, Homo sapiens
ggggagcgggggcccugccuu

SEQ ID NO: 33321 - RNA, 21 nt, Homo sapiens
ccaaccaaugaaagaaugcuu

SEQ ID NO: 33322 - RNA, 20 nt, Homo sapiens
ggcauucaccgcgugccuua

SEQ ID NO: 33323 - RNA, 18 nt, Homo sapiens
cagcagccuccuucucaa

SEQ ID NO: 33324 - RNA, 21 nt, Homo sapiens
acaugguuagaucaagcacaa

SEQ ID NO: 33325 - RNA, 22 nt, Homo sapiens
cuuccagucgaggauguuuaca

SEQ ID NO: 33326 - RNA, 22 nt, Homo sapiens
cuuccagucggggauguuuaca

SEQ ID NO: 33327 - RNA, 22 nt, Homo sapiens
cuuccagucaaggauguuuaca

SEQ ID NO: 33328 - RNA, 22 nt, Homo sapiens
ggaucccugggaccauaccuag

SEQ ID NO: 33329 - RNA, 20 nt, Homo sapiens
gcaaugcaacagcaaugcac

SEQ ID NO: 33330 - RNA, 22 nt, Homo sapiens
agggguucaccgagcaacauuc

SEQ ID NO: 33331 - RNA, 21 nt, Homo sapiens
ucuacucagaagggugccuua

SEQ ID NO: 33332 - RNA, 22 nt, Homo sapiens
aacgcuccaaaagaaggcacuc

SEQ ID NO: 33333 - RNA, 20 nt, Homo sapiens
gaaagggcuucccuuugcag

SEQ ID NO: 33334 - RNA, 22 nt, Homo sapiens
aacacucuaaaaggaggcacuu

SEQ ID NO: 33335 - RNA, 20 nt, Homo sapiens
gaaagggcuucccuuugcag

SEQ ID NO: 33336 - RNA, 22 nt, Homo sapiens
gaacuugcuaaaaaugcagaau

SEQ ID NO: 33337 - RNA, 21 nt, Homo sapiens
agguaagcgcuguugcuagcc

SEQ ID NO: 33338 - RNA, 21 nt, Homo sapiens
cuagggaagaacagugagcaa

SEQ ID NO: 33339 - RNA, 18 nt, Homo sapiens
cccccaccaccacgcccg

SEQ ID NO: 33340 - RNA, 21 nt, Homo sapiens
aaagagaccgguucacuguga

SEQ ID NO: 33341 - RNA, 20 nt, Homo sapiens
gcagaagcauuuccacacac

SEQ ID NO: 33342 - RNA, 23 nt, Homo sapiens
gggagugaagacacggagccaga

SEQ ID NO: 33343 - RNA, 22 nt, Homo sapiens
uguaaaccaugaugugcugcua

SEQ ID NO: 33344 - RNA, 20 nt, Homo sapiens
cccgccgcgucgcccugggg

SEQ ID NO: 33345 - RNA, 22 nt, Homo sapiens
uccacauggaguugcuguuaca

SEQ ID NO: 33346 - RNA, 22 nt, Homo sapiens
acugccugucugugccugcugu

SEQ ID NO: 33347 - RNA, 22 nt, Homo sapiens
agcugaguguaggauguuuaca

SEQ ID NO: 33348 - RNA, 21 nt, Homo sapiens
uucuaggauaggcccaggggc

SEQ ID NO: 33349 - RNA, 22 nt, Homo sapiens
accagguuccaccccagcaggc

SEQ ID NO: 33350 - RNA, 23 nt, Homo sapiens
aaagucucgcucucugccccuca

SEQ ID NO: 33351 - RNA, 22 nt, Homo sapiens
cacaaguucggaucuacggguu

SEQ ID NO: 33352 - RNA, 21 nt, Homo sapiens
ccccucccagccucccugcca

SEQ ID NO: 33353 - RNA, 20 nt, Homo sapiens
cugcgggaggacagggcuca

SEQ ID NO: 33354 - RNA, 21 nt, Homo sapiens
agcgccuuuggcagcuagagu

SEQ ID NO: 33355 - RNA, 21 nt, Homo sapiens
cggggugcacgggcggagggc

SEQ ID NO: 33356 - RNA, 23 nt, Homo sapiens
aggaacagcagcagcccgggccg

SEQ ID NO: 33357 - RNA, 22 nt, Homo sapiens
cggugagcacccggccccugcg

SEQ ID NO: 33358 - RNA, 22 nt, Homo sapiens
ggagagccuccacccaacccuc

SEQ ID NO: 33359 - RNA, 21 nt, Homo sapiens
acaggauugagggggggcccu

SEQ ID NO: 33360 - RNA, 18 nt, Homo sapiens
acccucugaaaggaagca

SEQ ID NO: 33361 - RNA, 22 nt, Homo sapiens
aaagugcuucuuaccuccagau

SEQ ID NO: 33362 - RNA, 19 nt, Homo sapiens
guccugaauuccgcagccu

SEQ ID NO: 33363 - RNA, 21 nt, Homo sapiens
gaaggaagugagugcagccac

SEQ ID NO: 33364 - RNA, 21 nt, Homo sapiens
guccugagagcgcugccuccu

SEQ ID NO: 33365 - RNA, 21 nt, Homo sapiens
caucaccuuccuucuccucca

SEQ ID NO: 33366 - RNA, 22 nt, Homo sapiens
cacucuaaagggaggcacuuug

SEQ ID NO: 33367 - RNA, 21 nt, Homo sapiens
ugcaggcugaucuucuucucu

SEQ ID NO: 33368 - RNA, 22 nt, Homo sapiens
ggagauggagccagggcccuaa

SEQ ID NO: 33369 - RNA, 18 nt, Homo sapiens
cagcagccuccuucucaa

SEQ ID NO: 33370 - RNA, 21 nt, Homo sapiens
acaggauugagggggggcccu

SEQ ID NO: 33371 - RNA, 22 nt, Homo sapiens
ugcaacuuaguaaugugcaaua

SEQ ID NO: 33372 - RNA, 23 nt, Homo sapiens
acaccaaugcccuaggggaugcg

SEQ ID NO: 33373 - RNA, 21 nt, Homo sapiens
ugcaaugcaacuacaaugcac

SEQ ID NO: 33374 - RNA, 23 nt, Homo sapiens
aaagucucgcucucugccccuca

SEQ ID NO: 33375 - RNA, 22 nt, Homo sapiens
gagguuucccguguauguuuca

SEQ ID NO: 33376 - RNA, 22 nt, Homo sapiens
acaucaucgcauauugacacaa

SEQ ID NO: 33377 - RNA, 20 nt, Homo sapiens
guuugauaaacugacacaac

SEQ ID NO: 33378 - RNA, 25 nt, Homo sapiens
acggagcugucccaacaccaccccu

SEQ ID NO: 33379 - RNA, 20 nt, Homo sapiens
uacugcuuccacagcucccc

SEQ ID NO: 33380 - RNA, 21 nt, Homo sapiens
ccccucccagccucccugcca

SEQ ID NO: 33381 - RNA, 21 nt, Homo sapiens
cugggggacggagcagaagga

SEQ ID NO: 33382 - RNA, 22 nt, Homo sapiens
ugaagaagggggggaagggcgu

SEQ ID NO: 33383 - RNA, 23 nt, Homo sapiens
gggagugaagacacggagccaga

SEQ ID NO: 33384 - RNA, 23 nt, Homo sapiens
cuaucugcacuagaugcaccuua

SEQ ID NO: 33385 - RNA, 22 nt, Homo sapiens
cggugagcacccggccccugcg

SEQ ID NO: 33386 - RNA, 23 nt, Homo sapiens
acaccaaugcccuaggggaugcg

SEQ ID NO: 33387 - RNA, 17 nt, Homo sapiens
uggaggccccagcgaga

SEQ ID NO: 33388 - RNA, 18 nt, Homo sapiens
gaaaugagggccagcuga

SEQ ID NO: 33389 - RNA, 22 nt, Homo sapiens
cuagggaacacagggcugguga

SEQ ID NO: 33390 - RNA, 21 nt, Homo sapiens
ugcaggcugaucuucuucucu

SEQ ID NO: 33391 - RNA, 18 nt, Homo sapiens
uggcgccugaacagggac

SEQ ID NO: 33392 - RNA, 17 nt, Homo sapiens
uggcgcccgaacaggga

SEQ ID NO: 33393 - RNA, 24 nt, Homo sapiens
gaagucacucccaggcagcugcaa

SEQ ID NO: 33394 - RNA, 18 nt, Homo sapiens
aucacauucaccucccug

SEQ ID NO: 33395 - RNA, 23 nt, Homo sapiens
cggccugauucacaacaccagcu

SEQ ID NO: 33396 - RNA, 23 nt, Homo sapiens
gggagugaagacacggagccaga

SEQ ID NO: 33397 - RNA, 22 nt, Homo sapiens
ucaggaacugccuuucucucca

SEQ ID NO: 33398 - RNA, 23 nt, Homo sapiens
cagcugcuuuugggauuccguug

SEQ ID NO: 33399 - RNA, 22 nt, Homo sapiens
gcgaacgcgccacggaccaccu

SEQ ID NO: 33400 - RNA, 23 nt, Homo sapiens
aaaucagaaucacaccuggggga

SEQ ID NO: 33401 - RNA, 23 nt, Homo sapiens
ucucacccagguagcaaggauua

SEQ ID NO: 33402 - RNA, 22 nt, Homo sapiens
aaagugcuucuuaccuccagau

SEQ ID NO: 33403 - RNA, 22 nt, Homo sapiens
gcaaagguaauugcuguuuucg

SEQ ID NO: 33404 - RNA, 24 nt, Homo sapiens
acgcagagcccgaaagcccccagu

SEQ ID NO: 33405 - RNA, 22 nt, Homo sapiens
cacauggccaaaacagagaaga

SEQ ID NO: 33406 - RNA, 24 nt, Homo sapiens
ucagagcauguguuuaaucaggcu

SEQ ID NO: 33407 - RNA, 22 nt, Homo sapiens
cuacccacagacguaccaauca

SEQ ID NO: 33408 - RNA, 22 nt, Homo sapiens
acaaaagcaacugagguucuug

SEQ ID NO: 33409 - RNA, 23 nt, Homo sapiens
uguaggcuggggauaaaugaaua

SEQ ID NO: 33410 - RNA, 21 nt, Homo sapiens
ccccucccagccucccugcca

SEQ ID NO: 33411 - RNA, 22 nt, Homo sapiens
ccacacacuuccuuacauucca

SEQ ID NO: 33412 - RNA, 17 nt, Homo sapiens
gggagaggaggaggcga

SEQ ID NO: 33413 - RNA, 23 nt, Homo sapiens
gggagugaagacacggagccaga

SEQ ID NO: 33414 - RNA, 21 nt, Homo sapiens
gaccaaucgccguccccgccg

SEQ ID NO: 33415 - RNA, 21 nt, Homo sapiens
acaggccaucuguguuauauu

SEQ ID NO: 33416 - RNA, 21 nt, Homo sapiens
guccugagagcgcugccuccu

SEQ ID NO: 33417 - RNA, 22 nt, Homo sapiens
gcggucccgcggcgccccgccu

SEQ ID NO: 33418 - RNA, 21 nt, Homo sapiens
aagggucaguaagcacccgcg

SEQ ID NO: 33419 - RNA, 21 nt, Homo sapiens
ggggagcgggggcccugccuu

SEQ ID NO: 33420 - RNA, 23 nt, Homo sapiens
aggaacagcagcagcccgggccg

SEQ ID NO: 33421 - RNA, 23 nt, Homo sapiens
aggaacagcagcagcccgggccg

SEQ ID NO: 33422 - RNA, 21 nt, Homo sapiens
gaccaaucgccguccccgccg

SEQ ID NO: 33423 - RNA, 21 nt, Homo sapiens
acaggauugagggggggcccu

SEQ ID NO: 33424 - RNA, 23 nt, Homo sapiens
cggcucugucgucgaggcgcuca

SEQ ID NO: 33425 - RNA, 22 nt, Homo sapiens
gcggucccgcggcgccccgccu

SEQ ID NO: 33426 - RNA, 22 nt, Homo sapiens
ugcuguuagcccuagccccgca

SEQ ID NO: 33427 - RNA, 21 nt, Homo sapiens
caucaccuuccuucuccucca

SEQ ID NO: 33428 - RNA, 22 nt, Homo sapiens
caaacaccauugucacacucca

SEQ ID NO: 33429 - RNA, 22 nt, Homo sapiens
ugaagaagggggggaagggcgu

SEQ ID NO: 33430 - RNA, 23 nt, Homo sapiens
aggaacagcagcagcccgggccg

SEQ ID NO: 33431 - RNA, 21 nt, Homo sapiens
gaccaaucgccguccccgccg

SEQ ID NO: 33432 - RNA, 22 nt, Homo sapiens
ucagaccgagacaagugcaaug

SEQ ID NO: 33433 - RNA, 19 nt, Homo sapiens
gcuccuguccaacuggcuc

SEQ ID NO: 33434 - RNA, 22 nt, Homo sapiens
gcggucccgcggcgccccgccu

SEQ ID NO: 33435 - RNA, 22 nt, Homo sapiens
ccucaggcacggccgggccacc

SEQ ID NO: 33436 - RNA, 21 nt, Homo sapiens
caucaccuuccuucuccucca

SEQ ID NO: 33437 - RNA, 22 nt, Homo sapiens
gcugaggcuguggggcuggagu

SEQ ID NO: 33438 - RNA, 22 nt, Homo sapiens
ucggucccucgggccagggcag

SEQ ID NO: 33439 - RNA, 22 nt, Homo sapiens
ucuacccagaaaggagccagug

SEQ ID NO: 33440 - RNA, 23 nt, Homo sapiens
ggaagccaucaagucgcugcagg

SEQ ID NO: 33441 - RNA, 20 nt, Homo sapiens
cucaaagcaaacccugcaga

SEQ ID NO: 33442 - RNA, 22 nt, Homo sapiens
cgcauuauuacucacgguacga

SEQ ID NO: 33443 - RNA, 23 nt, Homo sapiens
aggaacagcagcagcccgggccg

SEQ ID NO: 33444 - RNA, 18 nt, Homo sapiens
ggagaggagggcacugga

SEQ ID NO: 33445 - RNA, 22 nt, Homo sapiens
cuguuccugcugaacugagcca

SEQ ID NO: 33446 - RNA, 22 nt, Homo sapiens
gauagagugcagaccagggucu

SEQ ID NO: 33447 - RNA, 22 nt, Homo sapiens
aagagggagacccaggcucgga

SEQ ID NO: 33448 - RNA, 22 nt, Homo sapiens
cugggggcggcacaggggcuca

SEQ ID NO: 33449 - RNA, 18 nt, Homo sapiens
ugguggcagaggugggau

SEQ ID NO: 33450 - RNA, 22 nt, Homo sapiens
cacgaccgacgccacgccgagu

SEQ ID NO: 33451 - RNA, 22 nt, Homo sapiens
ggagcccgcgccccgcgccgag

SEQ ID NO: 33452 - RNA, 21 nt, Homo sapiens
cggggugcacgggcggagggc

SEQ ID NO: 33453 - RNA, 21 nt, Homo sapiens
gaccaaucgccguccccgccg

SEQ ID NO: 33454 - RNA, 22 nt, Homo sapiens
ucagaccgagacaagugcaaug

SEQ ID NO: 33455 - RNA, 22 nt, Homo sapiens
agcugaguguaggauguuuaca

SEQ ID NO: 33456 - RNA, 23 nt, Homo sapiens
aaaucagaaucacaccuggggga

SEQ ID NO: 33457 - RNA, 23 nt, Homo sapiens
aaagucucgcucucugccccuca

SEQ ID NO: 33458 - RNA, 22 nt, Homo sapiens
ugcaagccuugggugugggagg

SEQ ID NO: 33459 - RNA, 25 nt, Homo sapiens
acggagcugucccaacaccaccccu

SEQ ID NO: 33460 - RNA, 22 nt, Homo sapiens
aagagggagacccaggcucgga

SEQ ID NO: 33461 - RNA, 24 nt, Homo sapiens
acgcagagcccgaaagcccccagu

SEQ ID NO: 33462 - RNA, 25 nt, Homo sapiens
accaacggaccuacuucccuccgcc

SEQ ID NO: 33463 - RNA, 22 nt, Homo sapiens
gcggucccgcggcgccccgccu

SEQ ID NO: 33464 - RNA, 22 nt, Homo sapiens
ugcuguuagcccuagccccgca

SEQ ID NO: 33465 - RNA, 21 nt, Homo sapiens
caucaccuuccuucuccucca

SEQ ID NO: 33466 - RNA, 23 nt, Homo sapiens
cuaccugcacuguaagcacuuuu

SEQ ID NO: 33467 - RNA, 21 nt, Homo sapiens
aucugcacugucagcacuuua

SEQ ID NO: 33468 - RNA, 22 nt, Homo sapiens
cacgaccgacgccacgccgagu

SEQ ID NO: 33469 - RNA, 22 nt, Homo sapiens
cuaccauaggguaaaaccacug

SEQ ID NO: 33470 - RNA, 23 nt, Homo sapiens
gggagugaagacacggagccaga

SEQ ID NO: 33471 - RNA, 23 nt, Homo sapiens
cuaccugcacuguaagcacuuug

SEQ ID NO: 33472 - RNA, 23 nt, Homo sapiens
cuaccugcacuauaagcacuuua

SEQ ID NO: 33473 - RNA, 23 nt, Homo sapiens
cuaccugcacuaugagcacuuug

SEQ ID NO: 33474 - RNA, 22 nt, Homo sapiens
agccacaaucaccuucugaucu

SEQ ID NO: 33475 - RNA, 21 nt, Homo sapiens
acaaaccacagugugcugcug

SEQ ID NO: 33476 - RNA, 22 nt, Homo sapiens
gauagagugcagaccagggucu

SEQ ID NO: 33477 - RNA, 23 nt, Homo sapiens
ccuucucagaaaggugaaauuua

SEQ ID NO: 33478 - RNA, 22 nt, Homo sapiens
acacucuaaaaggaugcacuuu

SEQ ID NO: 33479 - RNA, 22 nt, Homo sapiens
aaccucuaaaaggaugcacuuu

SEQ ID NO: 33480 - RNA, 22 nt, Homo sapiens
auccucuaaaaagaugcacuuu

SEQ ID NO: 33481 - RNA, 22 nt, Homo sapiens
cacucuaaagggaggcacuuug

SEQ ID NO: 33482 - RNA, 23 nt, Homo sapiens
acagaaagugcuucccucaagag

SEQ ID NO: 33483 - RNA, 23 nt, Homo sapiens
cuaccugcacgaacagcacuuug

SEQ ID NO: 33484 - RNA, 18 nt, Homo sapiens
ugguggcagaggugggau

SEQ ID NO: 33485 - RNA, 17 nt, Homo sapiens
gggagaggaggaggcga

SEQ ID NO: 33486 - RNA, 21 nt, Homo sapiens
gaccaaucgccguccccgccg

SEQ ID NO: 33487 - RNA, 20 nt, Homo sapiens
ugggccaccgccgagcggac

SEQ ID NO: 33488 - RNA, 25 nt, Homo sapiens
acggagcugucccaacaccaccccu

SEQ ID NO: 33489 - RNA, 22 nt, Homo sapiens
gcggucccgcggcgccccgccu

SEQ ID NO: 33490 - RNA, 22 nt, Homo sapiens
uauccacuacaccccgcugccu

SEQ ID NO: 33491 - RNA, 24 nt, Homo sapiens
cacccccagagccucagcucccca

SEQ ID NO: 33492 - RNA, 22 nt, Homo sapiens
ccccucuggucaaccagucaca

SEQ ID NO: 33493 - RNA, 22 nt, Homo sapiens
ucaguuuccucugcaaacaguu

SEQ ID NO: 33494 - RNA, 21 nt, Homo sapiens
gccaauauuucugugcugcua

SEQ ID NO: 33495 - RNA, 22 nt, Homo sapiens
cuagugguccuaaacauuucac

SEQ ID NO: 33496 - RNA, 22 nt, Homo sapiens
cacucagcaccaggauauuguu

SEQ ID NO: 33497 - RNA, 21 nt, Homo sapiens
ccuucugacuccaaguccagu

SEQ ID NO: 33498 - RNA, 23 nt, Homo sapiens
caugagugacgcccucuggagua

SEQ ID NO: 33499 - RNA, 22 nt, Homo sapiens
aaagugcuucuuaccuccagau

SEQ ID NO: 33500 - RNA, 22 nt, Homo sapiens
uuucaguuaucaaucugucaca

SEQ ID NO: 33501 - RNA, 21 nt, Homo sapiens
cugaaaccaaguaugggucgc

SEQ ID NO: 33502 - RNA, 23 nt, Homo sapiens
guagugggccgagccgagugaca

SEQ ID NO: 33503 - RNA, 23 nt, Homo sapiens
guagugggccgagccgagugaca

SEQ ID NO: 33504 - RNA, 21 nt, Homo sapiens
cuggaggacggcaacagucag

SEQ ID NO: 33505 - RNA, 23 nt, Homo sapiens
gggagugaagacacggagccaga

SEQ ID NO: 33506 - RNA, 20 nt, Homo sapiens
acauuacuguuaucaaaaca

SEQ ID NO: 33507 - RNA, 22 nt, Homo sapiens
accagcuaacaauacacugcca

SEQ ID NO: 33508 - RNA, 23 nt, Homo sapiens
acaccccaaaaucgaagcacuuc

SEQ ID NO: 33509 - RNA, 22 nt, Homo sapiens
agagaggagagccguguaugac

SEQ ID NO: 33510 - RNA, 22 nt, Homo sapiens
cugcucaaacccuccaaugacu

SEQ ID NO: 33511 - RNA, 21 nt, Homo sapiens
aguucucccaacguaaaccca

SEQ ID NO: 33512 - RNA, 21 nt, Homo sapiens
ugacugacagcuuuuugagua

SEQ ID NO: 33513 - RNA, 22 nt, Homo sapiens
cacauggccaaaacagagaaga

SEQ ID NO: 33514 - RNA, 22 nt, Homo sapiens
uccggggacgaacgggacgggu

SEQ ID NO: 33515 - RNA, 18 nt, Homo sapiens
ugguggcagaggugggau

SEQ ID NO: 33516 - RNA, 18 nt, Homo sapiens
uggcgccugaacagggac

SEQ ID NO: 33517 - RNA, 22 nt, Homo sapiens
agcccaaaaggagaauucuuug

SEQ ID NO: 33518 - RNA, 23 nt, Homo sapiens
gaaacccagcagacaauguagcu

SEQ ID NO: 33519 - RNA, 23 nt, Homo sapiens
cgugagcuccuggaggacaggga

SEQ ID NO: 33520 - RNA, 22 nt, Homo sapiens
acaaccagcuaagacacugcca

SEQ ID NO: 33521 - RNA, 22 nt, Homo sapiens
auggcaguggaguuagugauug

SEQ ID NO: 33522 - RNA, 23 nt, Homo sapiens
gcaaucagcuaacuacacugccu

SEQ ID NO: 33523 - RNA, 22 nt, Homo sapiens
accagcuaacaauacacugcca

SEQ ID NO: 33524 - RNA, 22 nt, Homo sapiens
gccagcuaacaauacacugccu

SEQ ID NO: 33525 - RNA, 22 nt, Homo sapiens
uauggaugcaaaaugaucccaa

SEQ ID NO: 33526 - RNA, 22 nt, Homo sapiens
uauggaugcaaaaugaucccaa

SEQ ID NO: 33527 - RNA, 22 nt, Homo sapiens
gaauucaucacggccagccucu

SEQ ID NO: 33528 - RNA, 23 nt, Homo sapiens
cugcagaacuguucccgcugcua

SEQ ID NO: 33529 - RNA, 23 nt, Homo sapiens
caugagugacgcccucuggagua

SEQ ID NO: 33530 - RNA, 21 nt, Homo sapiens
agguaagcgcuguugcuagcc

SEQ ID NO: 33531 - RNA, 23 nt, Homo sapiens
acagcgcucgcaaccgcagcgau

SEQ ID NO: 33532 - RNA, 23 nt, Homo sapiens
aaccaagaccccggagaucccag

SEQ ID NO: 33533 - RNA, 23 nt, Homo sapiens
aaccaagaccccggagaucccag

SEQ ID NO: 33534 - RNA, 22 nt, Homo sapiens
ggaggccgggacgagugcaaua

SEQ ID NO: 33535 - RNA, 22 nt, Homo sapiens
ccucauggaaggguuccccacu

SEQ ID NO: 33536 - RNA, 22 nt, Homo sapiens
ggcagagagucagagcgcggau

SEQ ID NO: 33537 - RNA, 21 nt, Homo sapiens
auaauggagaccaggccacga

SEQ ID NO: 33538 - RNA, 22 nt, Homo sapiens
caaacaccauugucacacucca

SEQ ID NO: 33539 - RNA, 22 nt, Homo sapiens
uccggggacgaacgggacgggu

SEQ ID NO: 33540 - RNA, 18 nt, Homo sapiens
cccccaccaccacgcccg

SEQ ID NO: 33541 - RNA, 17 nt, Homo sapiens
ggguggcagcgguggga

SEQ ID NO: 33542 - RNA, 21 nt, Homo sapiens
ucacccagaucugcggccuaa

SEQ ID NO: 33543 - RNA, 21 nt, Homo sapiens
gaccaaucgccguccccgccg

SEQ ID NO: 33544 - RNA, 20 nt, Homo sapiens
cccgccgcgucgcccugggg

SEQ ID NO: 33545 - RNA, 22 nt, Homo sapiens
ugagccacugugccuggccuga

SEQ ID NO: 33546 - RNA, 21 nt, Homo sapiens
uucuaggauaggcccaggggc

SEQ ID NO: 33547 - RNA, 22 nt, Homo sapiens
aucgggaggggacugagccuga

SEQ ID NO: 33548 - RNA, 21 nt, Homo sapiens
cccgaggagccgggcaggcuu

SEQ ID NO: 33549 - RNA, 22 nt, Homo sapiens
gcggucccgcggcgccccgccu

SEQ ID NO: 33550 - RNA, 22 nt, Homo sapiens
ugcuguuagcccuagccccgca

SEQ ID NO: 33551 - RNA, 17 nt, Homo sapiens
uggcgcccgaacaggga

SEQ ID NO: 33552 - RNA, 22 nt, Homo sapiens
aacccauggaauucaguucuca

SEQ ID NO: 33553 - RNA, 22 nt, Homo sapiens
ccagaacugaguccacagggca

SEQ ID NO: 33554 - RNA, 23 nt, Homo sapiens
gggagugaagacacggagccaga

SEQ ID NO: 33555 - RNA, 21 nt, Homo sapiens
acuagacugugagcuccucga

SEQ ID NO: 33556 - RNA, 23 nt, Homo sapiens
aggaacagcagcagcccgggccg

SEQ ID NO: 33557 - RNA, 22 nt, Homo sapiens
agcgggacuuugagggccaguu

SEQ ID NO: 33558 - RNA, 22 nt, Homo sapiens
cagacuccgguggaaugaagga

SEQ ID NO: 33559 - RNA, 22 nt, Homo sapiens
ucagaccgagacaagugcaaug

SEQ ID NO: 33560 - RNA, 22 nt, Homo sapiens
cgauguaguccaaaggcacaua

SEQ ID NO: 33561 - RNA, 21 nt, Homo sapiens
guccugagagcgcugccuccu

SEQ ID NO: 33562 - RNA, 25 nt, Homo sapiens
accaacggaccuacuucccuccgcc

SEQ ID NO: 33563 - RNA, 22 nt, Homo sapiens
gcugaggcuguggggcuggagu

SEQ ID NO: 33564 - RNA, 22 nt, Homo sapiens
uggugauucacaaagaaaucca

SEQ ID NO: 33565 - RNA, 23 nt, Homo sapiens
gacguaguccuauucucugcugc

SEQ ID NO: 33566 - RNA, 20 nt, Homo sapiens
uacugcuuccacagcucccc

SEQ ID NO: 33567 - RNA, 18 nt, Homo sapiens
aucacauucaccucccug

SEQ ID NO: 33568 - RNA, 22 nt, Homo sapiens
accuaauauaucaaacauauca

SEQ ID NO: 33569 - RNA, 20 nt, Homo sapiens
acagcaaggagggcaggagg

SEQ ID NO: 33570 - RNA, 22 nt, Homo sapiens
aaucagucucauugcuuuauaa

SEQ ID NO: 33571 - RNA, 22 nt, Homo sapiens
gagcccuggacuaggagucagc

SEQ ID NO: 33572 - RNA, 22 nt, Homo sapiens
cagcauggaguccuccagguug

SEQ ID NO: 33573 - RNA, 22 nt, Homo sapiens
gaccucagcuaugacagcacuu

SEQ ID NO: 33574 - RNA, 22 nt, Homo sapiens
gacucuugaacaacacagguuu

SEQ ID NO: 33575 - RNA, 23 nt, Homo sapiens
agaaaccaugggguaugagcaga

SEQ ID NO: 33576 - RNA, 22 nt, Homo sapiens
ucggucccucgggccagggcag

SEQ ID NO: 33577 - RNA, 23 nt, Homo sapiens
ucauacagcuagauaaccaaaga

SEQ ID NO: 33578 - RNA, 22 nt, Homo sapiens
uccggggacgaacgggacgggu

SEQ ID NO: 33579 - RNA, 21 nt, Homo sapiens
agggcucaucuugguccugca

SEQ ID NO: 33580 - RNA, 23 nt, Homo sapiens
gggagugaagacacggagccaga

SEQ ID NO: 33581 - RNA, 21 nt, Homo sapiens
gaccaaucgccguccccgccg

SEQ ID NO: 33582 - RNA, 22 nt, Homo sapiens
uucacacugcaugcucugggua

SEQ ID NO: 33583 - RNA, 22 nt, Homo sapiens
cagaagugggccgggcacaggg

SEQ ID NO: 33584 - RNA, 22 nt, Homo sapiens
aaagagguuaaccagguguguu

SEQ ID NO: 33585 - RNA, 22 nt, Homo sapiens
ugaauccuugaauagguguguu

SEQ ID NO: 33586 - RNA, 23 nt, Homo sapiens
aaagucucgcucucugccccuca

SEQ ID NO: 33587 - RNA, 19 nt, Homo sapiens
guccugaauuccgcagccu

SEQ ID NO: 33588 - RNA, 22 nt, Homo sapiens
gcggucccgcggcgccccgccu

SEQ ID NO: 33589 - RNA, 20 nt, Homo sapiens
aggggccucagccuccuggu

SEQ ID NO: 33590 - RNA, 22 nt, Homo sapiens
ugcuguuagcccuagccccgca

SEQ ID NO: 33591 - RNA, 22 nt, Homo sapiens
gcugaggcuguggggcuggagu

SEQ ID NO: 33592 - RNA, 22 nt, Homo sapiens
ggaggccgggacgagugcaaua

SEQ ID NO: 33593 - RNA, 21 nt, Homo sapiens
ccccucccagccucccugcca

SEQ ID NO: 33594 - RNA, 22 nt, Homo sapiens
cugggggcggcacaggggcuca

SEQ ID NO: 33595 - RNA, 20 nt, Homo sapiens
cugcgggaggacagggcuca

SEQ ID NO: 33596 - RNA, 21 nt, Homo sapiens
gaccaaucgccguccccgccg

SEQ ID NO: 33597 - RNA, 22 nt, Homo sapiens
ucagaccgagacaagugcaaug

SEQ ID NO: 33598 - RNA, 23 nt, Homo sapiens
cggcucugucgucgaggcgcuca

SEQ ID NO: 33599 - RNA, 22 nt, Homo sapiens
aagagggagacccaggcucgga

SEQ ID NO: 33600 - RNA, 22 nt, Homo sapiens
gcggucccgcggcgccccgccu

SEQ ID NO: 33601 - RNA, 22 nt, Homo sapiens
ugcuguuagcccuagccccgca

SEQ ID NO: 33602 - RNA, 22 nt, Homo sapiens
cugggggcggcacaggggcuca

SEQ ID NO: 33603 - RNA, 17 nt, Homo sapiens
uggcgcccgaacaggga

SEQ ID NO: 33604 - RNA, 18 nt, Homo sapiens
aucacauucaccucccug

SEQ ID NO: 33605 - RNA, 22 nt, Homo sapiens
ccagaacugaguccacagggca

SEQ ID NO: 33606 - RNA, 23 nt, Homo sapiens
gggagugaagacacggagccaga

SEQ ID NO: 33607 - RNA, 23 nt, Homo sapiens
cagcugcuuuugggauuccguug

SEQ ID NO: 33608 - RNA, 21 nt, Homo sapiens
ggcugucaauucauaggucag

SEQ ID NO: 33609 - RNA, 23 nt, Homo sapiens
cggcucugucgucgaggcgcuca

SEQ ID NO: 33610 - RNA, 22 nt, Homo sapiens
acaaccagcuaagacacugcca

SEQ ID NO: 33611 - RNA, 23 nt, Homo sapiens
aaagucucgcucucugccccuca

SEQ ID NO: 33612 - RNA, 19 nt, Homo sapiens
guccugaauuccgcagccu

SEQ ID NO: 33613 - RNA, 22 nt, Homo sapiens
gauccgagcaccggggaccccc

SEQ ID NO: 33614 - RNA, 21 nt, Homo sapiens
gaaggaagugagugcagccac

SEQ ID NO: 33615 - RNA, 17 nt, Homo sapiens
uggaggccccagcgaga

SEQ ID NO: 33616 - RNA, 20 nt, Homo sapiens
uccccacagacccagagccg

SEQ ID NO: 33617 - RNA, 22 nt, Homo sapiens
ggcagagagucagagcgcggau

SEQ ID NO: 33618 - RNA, 21 nt, Homo sapiens
ucuccagaucagggcagucca

SEQ ID NO: 33619 - RNA, 18 nt, Homo sapiens
aucacauucaccucccug

SEQ ID NO: 33620 - RNA, 22 nt, Homo sapiens
uggcagcagcggagggggcaga

SEQ ID NO: 33621 - RNA, 22 nt, Homo sapiens
ucagaccgagacaagugcaaug

SEQ ID NO: 33622 - RNA, 20 nt, Homo sapiens
ccagcagcaccuggggcagu

SEQ ID NO: 33623 - RNA, 23 nt, Homo sapiens
aaagucucgcucucugccccuca

SEQ ID NO: 33624 - RNA, 21 nt, Homo sapiens
auccuguacugagcugccccg

SEQ ID NO: 33625 - RNA, 25 nt, Homo sapiens
acggagcugucccaacaccaccccu

SEQ ID NO: 33626 - RNA, 21 nt, Homo sapiens
ggacuauagaacuuucccccu

SEQ ID NO: 33627 - RNA, 19 nt, Homo sapiens
gcucuaagaaagccacacu

SEQ ID NO: 33628 - RNA, 22 nt, Homo sapiens
ccucaggcacggccgggccacc

SEQ ID NO: 33629 - RNA, 21 nt, Homo sapiens
caucaccuuccuucuccucca

SEQ ID NO: 33630 - RNA, 20 nt, Homo sapiens
uacugcuuccacagcucccc

SEQ ID NO: 33631 - RNA, 23 nt, Homo sapiens
cuaccugcacuguaagcacuuuu

SEQ ID NO: 33632 - RNA, 18 nt, Homo sapiens
gaaaugagggccagcuga

SEQ ID NO: 33633 - RNA, 22 nt, Homo sapiens
cuagggaacacagggcugguga

SEQ ID NO: 33634 - RNA, 22 nt, Homo sapiens
cgaccauggcuguagacuguua

SEQ ID NO: 33635 - RNA, 23 nt, Homo sapiens
cggccugauucacaacaccagcu

SEQ ID NO: 33636 - RNA, 21 nt, Homo sapiens
ggccgugacuggagacuguua

SEQ ID NO: 33637 - RNA, 22 nt, Homo sapiens
cacuuagcagguuguauuauau

SEQ ID NO: 33638 - RNA, 22 nt, Homo sapiens
ucaguuuccucugcaaacaguu

SEQ ID NO: 33639 - RNA, 22 nt, Homo sapiens
aucgggaggggacugagccuga

SEQ ID NO: 33640 - RNA, 19 nt, Homo sapiens
auuuugguacagcagcuca

SEQ ID NO: 33641 - RNA, 22 nt, Homo sapiens
acaucaucgcauauugacacaa

SEQ ID NO: 33642 - RNA, 22 nt, Homo sapiens
ccucuaguaaauaugucagcau

SEQ ID NO: 33643 - RNA, 19 nt, Homo sapiens
ucccacaggaagcagacac

SEQ ID NO: 33644 - RNA, 19 nt, Homo sapiens
gccucagaggcagcugcuu

SEQ ID NO: 33645 - RNA, 21 nt, Homo sapiens
gaaggaagugagugcagccac

SEQ ID NO: 33646 - RNA, 22 nt, Homo sapiens
gggagaggucucccugcgcaca

SEQ ID NO: 33647 - RNA, 22 nt, Homo sapiens
ggagcccgcgccccgcgccgag

SEQ ID NO: 33648 - RNA, 26 nt, Homo sapiens
uuucagaauuugcugccaucaucauc

SEQ ID NO: 33649 - RNA, 18 nt, Homo sapiens
cagcagccuccuucucaa

SEQ ID NO: 33650 - RNA, 22 nt, Homo sapiens
cacugguacaaggguugggaga

SEQ ID NO: 33651 - RNA, 22 nt, Homo sapiens
acaguucuucaacuggcagcuu

SEQ ID NO: 33652 - RNA, 23 nt, Homo sapiens
gaaacccagcagacaauguagcu

SEQ ID NO: 33653 - RNA, 21 nt, Homo sapiens
acccaguagccagauguagcu

SEQ ID NO: 33654 - RNA, 22 nt, Homo sapiens
acaaccagcuaagacacugcca

SEQ ID NO: 33655 - RNA, 21 nt, Homo sapiens
acaauccuagagcacaagaag

SEQ ID NO: 33656 - RNA, 18 nt, Homo sapiens
auucaaucuacugccuca

SEQ ID NO: 33657 - RNA, 22 nt, Homo sapiens
caagacacauuuggagagggac

SEQ ID NO: 33658 - RNA, 21 nt, Homo sapiens
guccugagagcgcugccuccu

SEQ ID NO: 33659 - RNA, 22 nt, Homo sapiens
ucaguggcucagguucguugca

SEQ ID NO: 33660 - RNA, 24 nt, Homo sapiens
agugugaguucuaccauugccaaa

SEQ ID NO: 33661 - RNA, 21 nt, Homo sapiens
ggcugucaauucauaggucag

SEQ ID NO: 33662 - RNA, 22 nt, Homo sapiens
cuacccacagacguaccaauca

SEQ ID NO: 33663 - RNA, 18 nt, Homo sapiens
acccucugaaaggaagca

SEQ ID NO: 33664 - RNA, 22 nt, Homo sapiens
aaagugcuucuuaccuccagau

SEQ ID NO: 33665 - RNA, 21 nt, Homo sapiens
guucuaacccauuguggccaa

SEQ ID NO: 33666 - RNA, 21 nt, Homo sapiens
gaccaaucgccguccccgccg

SEQ ID NO: 33667 - RNA, 22 nt, Homo sapiens
gauccgagcaccggggaccccc

SEQ ID NO: 33668 - RNA, 22 nt, Homo sapiens
gcggucccgcggcgccccgccu

SEQ ID NO: 33669 - RNA, 20 nt, Homo sapiens
uccccacagacccagagccg

SEQ ID NO: 33670 - RNA, 22 nt, Homo sapiens
cacaagaucggaucuacggguu

SEQ ID NO: 33671 - RNA, 22 nt, Homo sapiens
cgcaaggucgguucuacgggug

SEQ ID NO: 33672 - RNA, 21 nt, Homo sapiens
gagcugcauccuggcuccggg

SEQ ID NO: 33673 - RNA, 22 nt, Homo sapiens
cacgaccgacgccacgccgagu

SEQ ID NO: 33674 - RNA, 22 nt, Homo sapiens
ggagcccgcgccccgcgccgag

SEQ ID NO: 33675 - RNA, 23 nt, Homo sapiens
aggaacagcagcagcccgggccg

SEQ ID NO: 33676 - RNA, 22 nt, Homo sapiens
gaaccuaucuccccucuggacc

SEQ ID NO: 33677 - RNA, 23 nt, Homo sapiens
cggcucugucgucgaggcgcuca

SEQ ID NO: 33678 - RNA, 22 nt, Homo sapiens
accagguuccaccccagcaggc

SEQ ID NO: 33679 - RNA, 23 nt, Homo sapiens
acacucuaaagagaagcgcuuug

SEQ ID NO: 33680 - RNA, 21 nt, Homo sapiens
agaaaguacuucccucuggag

SEQ ID NO: 33681 - RNA, 21 nt, Homo sapiens
agaaagugcaucccucuggag

SEQ ID NO: 33682 - RNA, 21 nt, Homo sapiens
guucuaacccauuguggccaa

SEQ ID NO: 33683 - RNA, 22 nt, Homo sapiens
ugcuguuagcccuagccccgca

SEQ ID NO: 33684 - RNA, 21 nt, Homo sapiens
cugggggacggagcagaagga

SEQ ID NO: 33685 - RNA, 21 nt, Homo sapiens
cggggugcacgggcggagggc

SEQ ID NO: 33686 - RNA, 22 nt, Homo sapiens
cuguuccugcugaacugagcca

SEQ ID NO: 33687 - RNA, 22 nt, Homo sapiens
guagaagggaaucuugcauaag

SEQ ID NO: 33688 - RNA, 21 nt, Homo sapiens
gagcuacagugcuucaucuca

SEQ ID NO: 33689 - RNA, 22 nt, Homo sapiens
acaguucuucaacuggcagcuu

SEQ ID NO: 33690 - RNA, 21 nt, Homo sapiens
aucugcacugucagcacuuua

SEQ ID NO: 33691 - RNA, 23 nt, Homo sapiens
gcuuugacaauaucauugcacug

SEQ ID NO: 33692 - RNA, 21 nt, Homo sapiens
acuccaaagggaagcgccuuc

SEQ ID NO: 33693 - RNA, 22 nt, Homo sapiens
cgcucuaaagggaagcgccuuc

SEQ ID NO: 33694 - RNA, 19 nt, Homo sapiens
guugggaucacaggcgccc

SEQ ID NO: 33695 - RNA, 25 nt, Homo sapiens
accaacggaccuacuucccuccgcc

SEQ ID NO: 33696 - RNA, 22 nt, Homo sapiens
ccucaggcacggccgggccacc

SEQ ID NO: 33697 - RNA, 22 nt, Homo sapiens
ugcuguuagcccuagccccgca

SEQ ID NO: 33698 - RNA, 22 nt, Homo sapiens
uauccacuacaccccgcugccu

SEQ ID NO: 33699 - RNA, 22 nt, Homo sapiens
ggcagagagucagagcgcggau

SEQ ID NO: 33700 - RNA, 21 nt, Homo sapiens
uucaguuaucacaguacugua

SEQ ID NO: 33701 - RNA, 22 nt, Homo sapiens
gugggguggguggucaggccga

SEQ ID NO: 33702 - RNA, 17 nt, Homo sapiens
gggagaggaggaggcga

SEQ ID NO: 33703 - RNA, 22 nt, Homo sapiens
agacaacaaugccaaccucaca

SEQ ID NO: 33704 - RNA, 23 nt, Homo sapiens
gggagugaagacacggagccaga

SEQ ID NO: 33705 - RNA, 23 nt, Homo sapiens
cgugagcuccuggaggacaggga

SEQ ID NO: 33706 - RNA, 21 nt, Homo sapiens
aagggucaguaagcacccgcg

SEQ ID NO: 33707 - RNA, 23 nt, Homo sapiens
ggaagccaucaagucgcugcagg

SEQ ID NO: 33708 - RNA, 23 nt, Homo sapiens
gggagugaagacacggagccaga

SEQ ID NO: 33709 - RNA, 23 nt, Homo sapiens
aggaacagcagcagcccgggccg

SEQ ID NO: 33710 - RNA, 23 nt, Homo sapiens
cccaacagacauggcgguacuca

SEQ ID NO: 33711 - RNA, 20 nt, Homo sapiens
acagcaaggagggcaggagg

SEQ ID NO: 33712 - RNA, 21 nt, Homo sapiens
ucaaucacagauagcaccccu

SEQ ID NO: 33713 - RNA, 22 nt, Homo sapiens
gaauucaucacggccagccucu

SEQ ID NO: 33714 - RNA, 21 nt, Homo sapiens
gguggagcccugagaaccgga

SEQ ID NO: 33715 - RNA, 24 nt, Homo sapiens
cacccccagagccucagcucccca

SEQ ID NO: 33716 - RNA, 23 nt, Homo sapiens
gggagugaagacacggagccaga

SEQ ID NO: 33717 - RNA, 21 nt, Homo sapiens
gaccaaucgccguccccgccg

SEQ ID NO: 33718 - RNA, 22 nt, Homo sapiens
agucuucacaacagcccugugu

SEQ ID NO: 33719 - RNA, 21 nt, Homo sapiens
ugcaugacggccugcaagaca

SEQ ID NO: 33720 - RNA, 23 nt, Homo sapiens
gaaagugcccucaaggcugagug

SEQ ID NO: 33721 - RNA, 22 nt, Homo sapiens
gcggucccgcggcgccccgccu

SEQ ID NO: 33722 - RNA, 22 nt, Homo sapiens
ugcuguuagcccuagccccgca

SEQ ID NO: 33723 - RNA, 22 nt, Homo sapiens
gggagaggucucccugcgcaca

SEQ ID NO: 33724 - RNA, 22 nt, Homo sapiens
acacacccacgcgagccggaaa

SEQ ID NO: 33725 - RNA, 21 nt, Homo sapiens
ccccucccagccucccugcca

SEQ ID NO: 33726 - RNA, 18 nt, Homo sapiens
ugguggcagaggugggau

SEQ ID NO: 33727 - RNA, 17 nt, Homo sapiens
ggguggcagcgguggga

SEQ ID NO: 33728 - RNA, 21 nt, Homo sapiens
ucuccagaucagggcagucca

SEQ ID NO: 33729 - RNA, 22 nt, Homo sapiens
cacgaccgacgccacgccgagu

SEQ ID NO: 33730 - RNA, 22 nt, Homo sapiens
acuccaacagggccgcgucucc

SEQ ID NO: 33731 - RNA, 22 nt, Homo sapiens
acagauguccagccacaauucu

SEQ ID NO: 33732 - RNA, 21 nt, Homo sapiens
aucugcacugucagcacuuua

SEQ ID NO: 33733 - RNA, 23 nt, Homo sapiens
gcuuugacaauaucauugcacug

SEQ ID NO: 33734 - RNA, 20 nt, Homo sapiens
cuggaggaagggcccagagg

SEQ ID NO: 33735 - RNA, 22 nt, Homo sapiens
gccuaagacacaggcccagaga

SEQ ID NO: 33736 - RNA, 22 nt, Homo sapiens
ugcuguuagcccuagccccgca

SEQ ID NO: 33737 - RNA, 21 nt, Homo sapiens
ggggagcgggggcccugccuu

SEQ ID NO: 33738 - RNA, 22 nt, Homo sapiens
caaacaccauugucacacucca

SEQ ID NO: 33739 - RNA, 23 nt, Homo sapiens
cuaucugcacuagaugcaccuua

SEQ ID NO: 33740 - RNA, 21 nt, Homo sapiens
ccuucugacuccaaguccagu

SEQ ID NO: 33741 - RNA, 21 nt, Homo sapiens
acaggccaucuguguuauauu

SEQ ID NO: 33742 - RNA, 24 nt, Homo sapiens
acgcgcaggccagagacccaggca

SEQ ID NO: 33743 - RNA, 22 nt, Homo sapiens
uauccacuacaccccgcugccu

SEQ ID NO: 33744 - RNA, 20 nt, Homo sapiens
uacugcuuccacagcucccc

SEQ ID NO: 33745 - RNA, 22 nt, Homo sapiens
acuccaacagggccgcgucucc

SEQ ID NO: 33746 - RNA, 21 nt, Homo sapiens
gaccaaucgccguccccgccg

SEQ ID NO: 33747 - RNA, 22 nt, Homo sapiens
gcggucccgcggcgccccgccu

SEQ ID NO: 33748 - RNA, 23 nt, Homo sapiens
cacugugggcccucuccgcacca

SEQ ID NO: 33749 - RNA, 24 nt, Homo sapiens
cacccccagagccucagcucccca

SEQ ID NO: 33750 - RNA, 23 nt, Homo sapiens
gcacaugugcacacagccgggug

SEQ ID NO: 33751 - RNA, 18 nt, Homo sapiens
aucacauucaccucccug

SEQ ID NO: 33752 - RNA, 23 nt, Homo sapiens
gggagugaagacacggagccaga

SEQ ID NO: 33753 - RNA, 22 nt, Homo sapiens
ucaggaacugccuuucucucca

SEQ ID NO: 33754 - RNA, 22 nt, Homo sapiens
ucagaccgagacaagugcaaug

SEQ ID NO: 33755 - RNA, 21 nt, Homo sapiens
caucaccuuccuucuccucca

SEQ ID NO: 33756 - RNA, 21 nt, Homo sapiens
cggggugcacgggcggagggc

SEQ ID NO: 33757 - RNA, 21 nt, Homo sapiens
ucaaucacagauagcaccccu

SEQ ID NO: 33758 - RNA, 25 nt, Homo sapiens
acggagcugucccaacaccaccccu

SEQ ID NO: 33759 - RNA, 22 nt, Homo sapiens
gccaccuucaaaugggaagucu

SEQ ID NO: 33760 - RNA, 23 nt, Homo sapiens
cacugugggcccucuccgcacca

SEQ ID NO: 33761 - RNA, 20 nt, Homo sapiens
uacugcuuccacagcucccc

SEQ ID NO: 33762 - RNA, 21 nt, Homo sapiens
cuagggaagaacagugagcaa

SEQ ID NO: 33763 - RNA, 23 nt, Homo sapiens
gggagugaagacacggagccaga

SEQ ID NO: 33764 - RNA, 22 nt, Homo sapiens
cggugagcacccggccccugcg

SEQ ID NO: 33765 - RNA, 22 nt, Homo sapiens
acaaccagcuaagacacugcca

SEQ ID NO: 33766 - RNA, 22 nt, Homo sapiens
auggcaguggaguuagugauug

SEQ ID NO: 33767 - RNA, 23 nt, Homo sapiens
gcaaucagcuaacuacacugccu

SEQ ID NO: 33768 - RNA, 22 nt, Homo sapiens
accagcuaacaauacacugcca

SEQ ID NO: 33769 - RNA, 22 nt, Homo sapiens
gccagcuaacaauacacugccu

SEQ ID NO: 33770 - RNA, 22 nt, Homo sapiens
ccucuaguaaauaugucagcau

SEQ ID NO: 33771 - RNA, 20 nt, Homo sapiens
uacugcuuccacagcucccc

SEQ ID NO: 33772 - RNA, 23 nt, Homo sapiens
gacguaguccuauucucugcugc

SEQ ID NO: 33773 - RNA, 22 nt, Homo sapiens
ggaggccgggacgagugcaaua

SEQ ID NO: 33774 - RNA, 22 nt, Homo sapiens
ugaagaagggggggaagggcgu

SEQ ID NO: 33775 - RNA, 22 nt, Homo sapiens
ugagugcuugcuaggugccaag

SEQ ID NO: 33776 - RNA, 23 nt, Homo sapiens
aggaacagcagcagcccgggccg

SEQ ID NO: 33777 - RNA, 23 nt, Homo sapiens
cuaucugcacuagaugcaccuua

SEQ ID NO: 33778 - RNA, 23 nt, Homo sapiens
cuaacugcacuagaugcaccuua

SEQ ID NO: 33779 - RNA, 21 nt, Homo sapiens
gaccaaucgccguccccgccg

SEQ ID NO: 33780 - RNA, 22 nt, Homo sapiens
cuacccacagacguaccaauca

SEQ ID NO: 33781 - RNA, 21 nt, Homo sapiens
cacucugaagggaagcgcuuu

SEQ ID NO: 33782 - RNA, 22 nt, Homo sapiens
gcggucccgcggcgccccgccu

SEQ ID NO: 33783 - RNA, 24 nt, Homo sapiens
cacccccagagccucagcucccca

SEQ ID NO: 33784 - RNA, 23 nt, Homo sapiens
agcaaaaaugugcuagugccaaa

SEQ ID NO: 33785 - RNA, 22 nt, Homo sapiens
acacacccacgcgagccggaaa

SEQ ID NO: 33786 - RNA, 22 nt, Homo sapiens
agaaaaugccccucaguuuuga

SEQ ID NO: 33787 - RNA, 21 nt, Homo sapiens
gaccaaucgccguccccgccg

SEQ ID NO: 33788 - RNA, 22 nt, Homo sapiens
gcaaaaguaacugcaguuuugg

SEQ ID NO: 33789 - RNA, 22 nt, Homo sapiens
gccaccuucaaaugggaagucu

SEQ ID NO: 33790 - RNA, 22 nt, Homo sapiens
gcggucccgcggcgccccgccu

SEQ ID NO: 33791 - RNA, 22 nt, Homo sapiens
ugcuguuagcccuagccccgca

SEQ ID NO: 33792 - RNA, 22 nt, Homo sapiens
cuggagagacaaggggaagagg

SEQ ID NO: 33793 - RNA, 23 nt, Homo sapiens
aaagucucgcucucugccccuca

SEQ ID NO: 33794 - RNA, 23 nt, Homo sapiens
ccaccuggcaagaacaggcguuc

SEQ ID NO: 33795 - RNA, 21 nt, Homo sapiens
aguucucccaacguaaaccca

SEQ ID NO: 33796 - RNA, 20 nt, Homo sapiens
cccugcgccaucuccucuac

SEQ ID NO: 33797 - RNA, 18 nt, Homo sapiens
gaaaugagggccagcuga

SEQ ID NO: 33798 - RNA, 21 nt, Homo sapiens
cugggggacggagcagaagga

SEQ ID NO: 33799 - RNA, 22 nt, Homo sapiens
uaaaugaauucaauuuccuucu

SEQ ID NO: 33800 - RNA, 20 nt, Homo sapiens
gcagaagcauuuccacacac

SEQ ID NO: 33801 - RNA, 22 nt, Homo sapiens
ucaggaacugccuuucucucca

SEQ ID NO: 33802 - RNA, 22 nt, Homo sapiens
ucaggaacugccuuucucucca

SEQ ID NO: 33803 - RNA, 22 nt, Homo sapiens
uaaccgauuucagauggugcua

SEQ ID NO: 33804 - RNA, 22 nt, Homo sapiens
acaaccagcuaagacacugcca

SEQ ID NO: 33805 - RNA, 18 nt, Homo sapiens
acccucugaaaggaagca

SEQ ID NO: 33806 - RNA, 22 nt, Homo sapiens
aaagugcuucuuaccuccagau

SEQ ID NO: 33807 - RNA, 22 nt, Homo sapiens
gcaaaaguaauugagauuuuug

SEQ ID NO: 33808 - RNA, 19 nt, Homo sapiens
guugggaucacaggcgccc

SEQ ID NO: 33809 - RNA, 19 nt, Homo sapiens
gccucagaggcagcugcuu

SEQ ID NO: 33810 - RNA, 21 nt, Homo sapiens
caucaccuuccuucuccucca

SEQ ID NO: 33811 - RNA, 22 nt, Homo sapiens
gggagaggucucccugcgcaca

SEQ ID NO: 33812 - RNA, 21 nt, Homo sapiens
ucaaucacagauagcaccccu

SEQ ID NO: 33813 - RNA, 21 nt, Homo sapiens
gaaggaagugagugcagccac

SEQ ID NO: 33814 - RNA, 22 nt, Homo sapiens
gggagaggucucccugcgcaca

SEQ ID NO: 33815 - RNA, 21 nt, Homo sapiens
aucugcacugucagcacuuua

SEQ ID NO: 33816 - RNA, 21 nt, Homo sapiens
cucccccacugcagcuggcac

SEQ ID NO: 33817 - RNA, 18 nt, Homo sapiens
ugguggcagaggugggau

SEQ ID NO: 33818 - RNA, 18 nt, Homo sapiens
cccccaccaccacgcccg

SEQ ID NO: 33819 - RNA, 22 nt, Homo sapiens
acaccuggcuccacacgcgggc

SEQ ID NO: 33820 - RNA, 22 nt, Homo sapiens
acaaccagcuaagacacugcca

SEQ ID NO: 33821 - RNA, 23 nt, Homo sapiens
gcaaucagcuaacuacacugccu

SEQ ID NO: 33822 - RNA, 22 nt, Homo sapiens
accagcuaacaauacacugcca

SEQ ID NO: 33823 - RNA, 22 nt, Homo sapiens
gccagcuaacaauacacugccu

SEQ ID NO: 33824 - RNA, 22 nt, Homo sapiens
acacucuaaagggaugcacgau

SEQ ID NO: 33825 - RNA, 22 nt, Homo sapiens
acacucuaaaaggaugcacgau

SEQ ID NO: 33826 - RNA, 22 nt, Homo sapiens
ugcaagccuugggugugggagg

SEQ ID NO: 33827 - RNA, 21 nt, Homo sapiens
uggaaaccaagagugggucgc

SEQ ID NO: 33828 - RNA, 21 nt, Homo sapiens
cugaaaccaaguaugggucgc

SEQ ID NO: 33829 - RNA, 25 nt, Homo sapiens
acggagcugucccaacaccaccccu

SEQ ID NO: 33830 - RNA, 18 nt, Homo sapiens
ugguggcagaggugggau

SEQ ID NO: 33831 - RNA, 21 nt, Homo sapiens
agggcucaucuugguccugca

SEQ ID NO: 33832 - RNA, 21 nt, Homo sapiens
uuuagcauaaguaugucccaa

SEQ ID NO: 33833 - RNA, 22 nt, Homo sapiens
acaaaguucugugaugcacuga

SEQ ID NO: 33834 - RNA, 23 nt, Homo sapiens
acucaccgacagcguugaauguu

SEQ ID NO: 33835 - RNA, 23 nt, Homo sapiens
acccaccgacagcaaugaauguu

SEQ ID NO: 33836 - RNA, 22 nt, Homo sapiens
acucaccgacagguugaauguu

SEQ ID NO: 33837 - RNA, 23 nt, Homo sapiens
acccaccgacaacaaugaauguu

SEQ ID NO: 33838 - RNA, 22 nt, Homo sapiens
uccacauggaguugcuguuaca

SEQ ID NO: 33839 - RNA, 22 nt, Homo sapiens
cuagugguccuaaacauuucac

SEQ ID NO: 33840 - RNA, 23 nt, Homo sapiens
aaagucucgcucucugccccuca

SEQ ID NO: 33841 - RNA, 21 nt, Homo sapiens
ucuacucacagaagugucaau

SEQ ID NO: 33842 - RNA, 22 nt, Homo sapiens
ggaccuaaaaauacaaugcaua

SEQ ID NO: 33843 - RNA, 22 nt, Homo sapiens
acaucaucgcauauugacacaa

SEQ ID NO: 33844 - RNA, 22 nt, Homo sapiens
gccaccuucaaaugggaagucu

SEQ ID NO: 33845 - RNA, 22 nt, Homo sapiens
cacucuaaagggaggcacuuug

SEQ ID NO: 33846 - RNA, 22 nt, Homo sapiens
cugggggcggcacaggggcuca

SEQ ID NO: 33847 - RNA, 22 nt, Homo sapiens
caaacaccauugucacacucca

SEQ ID NO: 33848 - RNA, 17 nt, Homo sapiens
ggguggcagcgguggga

SEQ ID NO: 33849 - RNA, 23 nt, Homo sapiens
aggaacagcagcagcccgggccg

SEQ ID NO: 33850 - RNA, 22 nt, Homo sapiens
uuaacagcuaagcacccuaauc

SEQ ID NO: 33851 - RNA, 21 nt, Homo sapiens
uucuaggauaggcccaggggc

SEQ ID NO: 33852 - RNA, 22 nt, Homo sapiens
uacagauggauaccgugcaauu

SEQ ID NO: 33853 - RNA, 22 nt, Homo sapiens
aguccagauucugugcccacca

SEQ ID NO: 33854 - RNA, 19 nt, Homo sapiens
guccugaauuccgcagccu

SEQ ID NO: 33855 - RNA, 22 nt, Homo sapiens
gauccgagcaccggggaccccc

SEQ ID NO: 33856 - RNA, 21 nt, Homo sapiens
gaaggaagugagugcagccac

SEQ ID NO: 33857 - RNA, 22 nt, Homo sapiens
gcacauguucugcggcccacca

SEQ ID NO: 33858 - RNA, 20 nt, Homo sapiens
uccccacagacccagagccg

SEQ ID NO: 33859 - RNA, 21 nt, Homo sapiens
aagggucaguaagcacccgcg

SEQ ID NO: 33860 - RNA, 23 nt, Homo sapiens
gucacaucccucccaagacccuc

SEQ ID NO: 33861 - RNA, 23 nt, Homo sapiens
agcccuguucuacagcccugagg

SEQ ID NO: 33862 - RNA, 23 nt, Homo sapiens
agggauuccugggaaaacuggac

SEQ ID NO: 33863 - RNA, 22 nt, Homo sapiens
gauagagugcagaccagggucu

SEQ ID NO: 33864 - RNA, 21 nt, Homo sapiens
agaggcagguuccuggaucau

SEQ ID NO: 33865 - RNA, 21 nt, Homo sapiens
aagggucaguaagcacccgcg

SEQ ID NO: 33866 - RNA, 20 nt, Homo sapiens
uacugcuuccacagcucccc

SEQ ID NO: 33867 - RNA, 21 nt, Homo sapiens
cugaggagagaggaggugggg

SEQ ID NO: 33868 - RNA, 27 nt, Homo sapiens
uuuagcacagugcuuauacaagaaggu

SEQ ID NO: 33869 - RNA, 22 nt, Homo sapiens
ggagauggagccagggcccuaa

SEQ ID NO: 33870 - RNA, 18 nt, Homo sapiens
aucacauucaccucccug

SEQ ID NO: 33871 - RNA, 23 nt, Homo sapiens
ucacauaggaaugaaaagccaua

SEQ ID NO: 33872 - RNA, 23 nt, Homo sapiens
gggagugaagacacggagccaga

SEQ ID NO: 33873 - RNA, 21 nt, Homo sapiens
acaggauugagggggggcccu

SEQ ID NO: 33874 - RNA, 20 nt, Homo sapiens
uacugcuuccacagcucccc

SEQ ID NO: 33875 - RNA, 22 nt, Homo sapiens
aacuauacaaccuacuaccuca

SEQ ID NO: 33876 - RNA, 22 nt, Homo sapiens
aaccacacaaccuacuaccuca

SEQ ID NO: 33877 - RNA, 22 nt, Homo sapiens
aaccauacaaccuacuaccuca

SEQ ID NO: 33878 - RNA, 22 nt, Homo sapiens
aacuaugcaaccuacuaccucu

SEQ ID NO: 33879 - RNA, 22 nt, Homo sapiens
aacuauacaaccuccuaccuca

SEQ ID NO: 33880 - RNA, 22 nt, Homo sapiens
aacuauacaaucuacuaccuca

SEQ ID NO: 33881 - RNA, 22 nt, Homo sapiens
aacuguacaaacuacuaccuca

SEQ ID NO: 33882 - RNA, 22 nt, Homo sapiens
aacagcacaaacuacuaccuca

SEQ ID NO: 33883 - RNA, 22 nt, Homo sapiens
cccaacaacaugaaacuaccua

SEQ ID NO: 33884 - RNA, 22 nt, Homo sapiens
cccaacaacaggaaacuaccua

SEQ ID NO: 33885 - RNA, 20 nt, Homo sapiens
cuggaggaagggcccagagg

SEQ ID NO: 33886 - RNA, 22 nt, Homo sapiens
gccuaagacacaggcccagaga

SEQ ID NO: 33887 - RNA, 22 nt, Homo sapiens
gaagaaaggcaucauauaggag

SEQ ID NO: 33888 - RNA, 22 nt, Homo sapiens
aaucagucucauugcuuuauaa

SEQ ID NO: 33889 - RNA, 22 nt, Homo sapiens
ucaguuuccucugcaaacaguu

SEQ ID NO: 33890 - RNA, 22 nt, Homo sapiens
guagaagggaaucuugcauaag

SEQ ID NO: 33891 - RNA, 22 nt, Homo sapiens
cuacccacagacguaccaauca

SEQ ID NO: 33892 - RNA, 22 nt, Homo sapiens
gacaaaacccgcaaauacuuuu

SEQ ID NO: 33893 - RNA, 22 nt, Homo sapiens
acaaaauccacaauuacuuuug

SEQ ID NO: 33894 - RNA, 20 nt, Homo sapiens
uccccacagacccagagccg

SEQ ID NO: 33895 - RNA, 22 nt, Homo sapiens
aacaauacaacuuacuaccuca

SEQ ID NO: 33896 - RNA, 21 nt, Homo sapiens
ggucagaacccaucauucacu

SEQ ID NO: 33897 - RNA, 18 nt, Homo sapiens
cccccaccaccacgcccg

SEQ ID NO: 33898 - RNA, 19 nt, Homo sapiens
cagcaucagcagcaucauc

SEQ ID NO: 33899 - RNA, 23 nt, Homo sapiens
gggagugaagacacggagccaga

SEQ ID NO: 33900 - RNA, 22 nt, Homo sapiens
ccucauggaaggguuccccacu

SEQ ID NO: 33901 - RNA, 23 nt, Homo sapiens
caugagugacgcccucuggagua

SEQ ID NO: 33902 - RNA, 25 nt, Homo sapiens
acggagcugucccaacaccaccccu

SEQ ID NO: 33903 - RNA, 21 nt, Homo sapiens
aguucucccaacguaaaccca

SEQ ID NO: 33904 - RNA, 21 nt, Homo sapiens
gagcugcauccuggcuccggg

SEQ ID NO: 33905 - RNA, 23 nt, Homo sapiens
gggagugaagacacggagccaga

SEQ ID NO: 33906 - RNA, 22 nt, Homo sapiens
uucacacugcaugcucugggua

SEQ ID NO: 33907 - RNA, 23 nt, Homo sapiens
uauucucgcacggacuacaacca

SEQ ID NO: 33908 - RNA, 22 nt, Homo sapiens
gcugccguauaugugaugucac

SEQ ID NO: 33909 - RNA, 22 nt, Homo sapiens
aggaaaccagcaaguguugacg

SEQ ID NO: 33910 - RNA, 19 nt, Homo sapiens
guccugaauuccgcagccu

SEQ ID NO: 33911 - RNA, 21 nt, Homo sapiens
ccccucccagccucccugcca

SEQ ID NO: 33912 - RNA, 22 nt, Homo sapiens
uaaaugaauucaauuuccuucu

SEQ ID NO: 33913 - RNA, 22 nt, Homo sapiens
aggucucacuuuguugcccaga

SEQ ID NO: 33914 - RNA, 22 nt, Homo sapiens
cggugagcacccggccccugcg

SEQ ID NO: 33915 - RNA, 22 nt, Homo sapiens
ucagaccgagacaagugcaaug

SEQ ID NO: 33916 - RNA, 22 nt, Homo sapiens
uacagauggauaccgugcaauu

SEQ ID NO: 33917 - RNA, 19 nt, Homo sapiens
gcuccuguccaacuggcuc

SEQ ID NO: 33918 - RNA, 25 nt, Homo sapiens
acggagcugucccaacaccaccccu

SEQ ID NO: 33919 - RNA, 25 nt, Homo sapiens
aaggagcucagaagcccugcccagc

SEQ ID NO: 33920 - RNA, 20 nt, Homo sapiens
cccugcgccaucuccucuac

SEQ ID NO: 33921 - RNA, 22 nt, Homo sapiens
ucuacccagaaaggagccagug

SEQ ID NO: 33922 - RNA, 22 nt, Homo sapiens
cugggggcggcacaggggcuca

SEQ ID NO: 33923 - RNA, 22 nt, Homo sapiens
ugaagaagggggggaagggcgu

SEQ ID NO: 33924 - RNA, 17 nt, Homo sapiens
gggagaggaggaggcga

SEQ ID NO: 33925 - RNA, 19 nt, Homo sapiens
guugggaucacaggcgccc

SEQ ID NO: 33926 - RNA, 21 nt, Homo sapiens
guucuaacccauuguggccaa

SEQ ID NO: 33927 - RNA, 22 nt, Homo sapiens
ugcuguuagcccuagccccgca

SEQ ID NO: 33928 - RNA, 20 nt, Homo sapiens
uccccacagacccagagccg

SEQ ID NO: 33929 - RNA, 21 nt, Homo sapiens
aagggucaguaagcacccgcg

SEQ ID NO: 33930 - RNA, 21 nt, Homo sapiens
aaaagcuaagucaucauauau

SEQ ID NO: 33931 - RNA, 22 nt, Homo sapiens
cagcugguugaaggggaccaaa

SEQ ID NO: 33932 - RNA, 22 nt, Homo sapiens
uagcugguugaaggggaccaaa

SEQ ID NO: 33933 - RNA, 23 nt, Homo sapiens
gggagugaagacacggagccaga

SEQ ID NO: 33934 - RNA, 21 nt, Homo sapiens
gaccaaucgccguccccgccg

SEQ ID NO: 33935 - RNA, 22 nt, Homo sapiens
ucagaccgagacaagugcaaug

SEQ ID NO: 33936 - RNA, 25 nt, Homo sapiens
acggagcugucccaacaccaccccu

SEQ ID NO: 33937 - RNA, 22 nt, Homo sapiens
gcggucccgcggcgccccgccu

SEQ ID NO: 33938 - RNA, 22 nt, Homo sapiens
ugcuguuagcccuagccccgca

SEQ ID NO: 33939 - RNA, 20 nt, Homo sapiens
uacugcuuccacagcucccc

SEQ ID NO: 33940 - RNA, 22 nt, Homo sapiens
cuggagagacaaggggaagagg

SEQ ID NO: 33941 - RNA, 22 nt, Homo sapiens
uagucaagugaagcagugggag

SEQ ID NO: 33942 - RNA, 22 nt, Homo sapiens
cacucagcggccguuuccccaa

SEQ ID NO: 33943 - RNA, 22 nt, Homo sapiens
aaucagucucauugcuuuauaa

SEQ ID NO: 33944 - RNA, 20 nt, Homo sapiens
cccugcgccaucuccucuac

SEQ ID NO: 33945 - RNA, 17 nt, Homo sapiens
gggagaggaggaggcga

SEQ ID NO: 33946 - RNA, 22 nt, Homo sapiens
cagaagugggccgggcacaggg

SEQ ID NO: 33947 - RNA, 22 nt, Homo sapiens
agcgggacuuugagggccaguu

SEQ ID NO: 33948 - RNA, 22 nt, Homo sapiens
auguaugugggacgguaaacca

SEQ ID NO: 33949 - RNA, 21 nt, Homo sapiens
aguucucccaacguaaaccca

SEQ ID NO: 33950 - RNA, 25 nt, Homo sapiens
accaacggaccuacuucccuccgcc

SEQ ID NO: 33951 - RNA, 20 nt, Homo sapiens
aguacaucaucuauacugua

SEQ ID NO: 33952 - RNA, 22 nt, Homo sapiens
agcccaaaaggagaauucuuug

SEQ ID NO: 33953 - RNA, 21 nt, Homo sapiens
gcggaacuuagccacugugaa

SEQ ID NO: 33954 - RNA, 22 nt, Homo sapiens
cucauccgauguacaauaauuu

SEQ ID NO: 33955 - RNA, 23 nt, Homo sapiens
agcaaaaaugugcuagugccaaa

SEQ ID NO: 33956 - RNA, 21 nt, Homo sapiens
auaauggagaccaggccacga

SEQ ID NO: 33957 - RNA, 20 nt, Homo sapiens
ggggggcgaggcagguguga

SEQ ID NO: 33958 - RNA, 18 nt, Homo sapiens
cccccaccaccacgcccg

SEQ ID NO: 33959 - RNA, 17 nt, Homo sapiens
gggagaggaggaggcga

SEQ ID NO: 33960 - RNA, 22 nt, Homo sapiens
agcugaguguaggauguuuaca

SEQ ID NO: 33961 - RNA, 21 nt, Homo sapiens
guucuaacccauuguggccaa

SEQ ID NO: 33962 - RNA, 19 nt, Homo sapiens
guccugaauuccgcagccu

SEQ ID NO: 33963 - RNA, 19 nt, Homo sapiens
gcucuaagaaagccacacu

SEQ ID NO: 33964 - RNA, 22 nt, Homo sapiens
agccaagcucagacggauccga

SEQ ID NO: 33965 - RNA, 21 nt, Homo sapiens
gcaagcccagaccgcaaaaag

SEQ ID NO: 33966 - RNA, 22 nt, Homo sapiens
aggcauaggaugacaaagggaa

SEQ ID NO: 33967 - RNA, 22 nt, Homo sapiens
aggcgaaggaugacaaagggaa

SEQ ID NO: 33968 - RNA, 23 nt, Homo sapiens
uccaaucaguuccugaugcagua

SEQ ID NO: 33969 - RNA, 21 nt, Homo sapiens
gcagaacuuagccacugugaa

SEQ ID NO: 33970 - RNA, 22 nt, Homo sapiens
uccaggagcucacaaucuagug

SEQ ID NO: 33971 - RNA, 22 nt, Homo sapiens
cucaauagacugugagcuccuu

SEQ ID NO: 33972 - RNA, 22 nt, Homo sapiens
uauggaugcaaaaugaucccaa

SEQ ID NO: 33973 - RNA, 22 nt, Homo sapiens
gcaaaaguaauugccaguuuug

SEQ ID NO: 33974 - RNA, 22 nt, Homo sapiens
ugcaaaaguagucucaguuuuu

SEQ ID NO: 33975 - RNA, 19 nt, Homo sapiens
aaaaguaauuacaguuuuu

SEQ ID NO: 33976 - RNA, 22 nt, Homo sapiens
ggaccuaaaaauacaaugcaua

SEQ ID NO: 33977 - RNA, 23 nt, Homo sapiens
cccagcuagauuguaagcuccuu

SEQ ID NO: 33978 - RNA, 23 nt, Homo sapiens
cccagcuagauuguaagcuccuu

SEQ ID NO: 33979 - RNA, 23 nt, Homo sapiens
aaccaagaccccggagaucccag

SEQ ID NO: 33980 - RNA, 22 nt, Homo sapiens
ucggucccucgggccagggcag

SEQ ID NO: 33981 - RNA, 21 nt, Homo sapiens
ccaaccaaugaaagaaugcuu

SEQ ID NO: 33982 - RNA, 21 nt, Homo sapiens
ccaaccaaugaaagaaugcuu

SEQ ID NO: 33983 - RNA, 27 nt, Homo sapiens
ugcccacucucaccaucaccuacagug

SEQ ID NO: 33984 - RNA, 22 nt, Homo sapiens
cuggagagacaaggggaagagg

SEQ ID NO: 33985 - RNA, 23 nt, Homo sapiens
aacaggugcucaaauaagacuug

SEQ ID NO: 33986 - RNA, 20 nt, Homo sapiens
ugucuccacagggcucuuua

SEQ ID NO: 33987 - RNA, 18 nt, Homo sapiens
aucacauucaccucccug

SEQ ID NO: 33988 - RNA, 22 nt, Homo sapiens
cuggagacacgugcacuguaga

SEQ ID NO: 33989 - RNA, 21 nt, Homo sapiens
ccgugguucuacccuguggua

SEQ ID NO: 33990 - RNA, 23 nt, Homo sapiens
gggagugaagacacggagccaga

SEQ ID NO: 33991 - RNA, 23 nt, Homo sapiens
accccuaucacgauuagcauuaa

SEQ ID NO: 33992 - RNA, 22 nt, Homo sapiens
uccacauggaguugcuguuaca

SEQ ID NO: 33993 - RNA, 22 nt, Homo sapiens
gcuggguggagaagguggugaa

SEQ ID NO: 33994 - RNA, 22 nt, Homo sapiens
uagucaagugaagcagugggag

SEQ ID NO: 33995 - RNA, 23 nt, Homo sapiens
uccaucauuacccggcaguauua

SEQ ID NO: 33996 - RNA, 22 nt, Homo sapiens
aggcauaggaugacaaagggaa

SEQ ID NO: 33997 - RNA, 22 nt, Homo sapiens
aggcgaaggaugacaaagggaa

SEQ ID NO: 33998 - RNA, 22 nt, Homo sapiens
ugcaacuuaguaaugugcaaua

SEQ ID NO: 33999 - RNA, 21 nt, Homo sapiens
gaccaagaaauagccuuucaa

SEQ ID NO: 34000 - RNA, 21 nt, Homo sapiens
aaacaucacugcaagucuuaa

SEQ ID NO: 34001 - RNA, 23 nt, Homo sapiens
gggcucuuacucccucaggcacu

SEQ ID NO: 34002 - RNA, 24 nt, Homo sapiens
acugggcacaaacauguccagguc

SEQ ID NO: 34003 - RNA, 21 nt, Homo sapiens
caucaccuuccuucuccucca

SEQ ID NO: 34004 - RNA, 19 nt, Homo sapiens
ccaccucccgaguccucac

SEQ ID NO: 34005 - RNA, 22 nt, Homo sapiens
cacgaccgacgccacgccgagu

SEQ ID NO: 34006 - RNA, 22 nt, Homo sapiens
ccagaacugaguccacagggca

SEQ ID NO: 34007 - RNA, 22 nt, Homo sapiens
agucuucacaacagcccugugu

SEQ ID NO: 34008 - RNA, 21 nt, Homo sapiens
ucaaucacagauagcaccccu

SEQ ID NO: 34009 - RNA, 22 nt, Homo sapiens
aguccagauucugugcccacca

SEQ ID NO: 34010 - RNA, 23 nt, Homo sapiens
gucagaccccgagggguccucgc

SEQ ID NO: 34011 - RNA, 22 nt, Homo sapiens
aagagggagacccaggcucgga

SEQ ID NO: 34012 - RNA, 22 nt, Homo sapiens
gcacauguucugcggcccacca

SEQ ID NO: 34013 - RNA, 24 nt, Homo sapiens
acgcgcaggccagagacccaggca

SEQ ID NO: 34014 - RNA, 21 nt, Homo sapiens
agguaauaccaauaccuugug

SEQ ID NO: 34015 - RNA, 22 nt, Homo sapiens
aacuguacaaacuacuaccuca

SEQ ID NO: 34016 - RNA, 22 nt, Homo sapiens
aacaacacuugaccacauccug

SEQ ID NO: 34017 - RNA, 23 nt, Homo sapiens
acggcuaguggaccaggugaagu

SEQ ID NO: 34018 - RNA, 22 nt, Homo sapiens
cgauguaguccaaaggcacaua

SEQ ID NO: 34019 - RNA, 23 nt, Homo sapiens
ucuacuccaaaaggcuacaauca

SEQ ID NO: 34020 - RNA, 20 nt, Homo sapiens
gaaagggcuucccuuugcag

SEQ ID NO: 34021 - RNA, 20 nt, Homo sapiens
gaaagggcuucccuuugcag

SEQ ID NO: 34022 - RNA, 21 nt, Homo sapiens
agaaguagaccauguguccua

SEQ ID NO: 34023 - RNA, 22 nt, Homo sapiens
ccccucuggucaaccagucaca

SEQ ID NO: 34024 - RNA, 22 nt, Homo sapiens
acuccaacagggccgcgucucc

SEQ ID NO: 34025 - RNA, 23 nt, Homo sapiens
gggagugaagacacggagccaga

SEQ ID NO: 34026 - RNA, 21 nt, Homo sapiens
gaccaaucgccguccccgccg

SEQ ID NO: 34027 - RNA, 21 nt, Homo sapiens
agagcucauccauaguuguca

SEQ ID NO: 34028 - RNA, 22 nt, Homo sapiens
acaguucuucaacuggcagcuu

SEQ ID NO: 34029 - RNA, 22 nt, Homo sapiens
cucauauuacaaugagcucauc

SEQ ID NO: 34030 - RNA, 19 nt, Homo sapiens
auuuugguacagcagcuca

SEQ ID NO: 34031 - RNA, 21 nt, Homo sapiens
cucacucagauggccaacuca

SEQ ID NO: 34032 - RNA, 22 nt, Homo sapiens
uggggacccucccugaaccaag

SEQ ID NO: 34033 - RNA, 22 nt, Homo sapiens
gcggucccgcggcgccccgccu

SEQ ID NO: 34034 - RNA, 21 nt, Homo sapiens
ggucagaacccaucauucacu

SEQ ID NO: 34035 - RNA, 20 nt, Homo sapiens
ugucuccacagggcucuuua

SEQ ID NO: 34036 - RNA, 18 nt, Homo sapiens
aucacauucaccucccug

SEQ ID NO: 34037 - RNA, 19 nt, Homo sapiens
cagcaucagcagcaucauc

SEQ ID NO: 34038 - RNA, 22 nt, Homo sapiens
acaguucuucaacuggcagcuu

SEQ ID NO: 34039 - RNA, 22 nt, Homo sapiens
uaaccgauuucagauggugcua

SEQ ID NO: 34040 - RNA, 23 nt, Homo sapiens
aacacugauuucaaauggugcua

SEQ ID NO: 34041 - RNA, 22 nt, Homo sapiens
uaaccgauuucaaauggugcua

SEQ ID NO: 34042 - RNA, 22 nt, Homo sapiens
aggaaaccagcaaguguugacg

SEQ ID NO: 34043 - RNA, 21 nt, Homo sapiens
uugucuaaccagucaccuguu

SEQ ID NO: 34044 - RNA, 19 nt, Homo sapiens
auuuugguacagcagcuca

SEQ ID NO: 34045 - RNA, 22 nt, Homo sapiens
ggaccuaaaaauacaaugcaua

SEQ ID NO: 34046 - RNA, 21 nt, Homo sapiens
guccugagagcgcugccuccu

SEQ ID NO: 34047 - RNA, 22 nt, Homo sapiens
gcacaaaucuccagaccaccca

SEQ ID NO: 34048 - RNA, 21 nt, Homo sapiens
gaccaaucgccguccccgccg

SEQ ID NO: 34049 - RNA, 21 nt, Homo sapiens
aagugucagacacgguggugg

SEQ ID NO: 34050 - RNA, 23 nt, Homo sapiens
aaaucagaaucacaccuggggga

SEQ ID NO: 34051 - RNA, 23 nt, Homo sapiens
aaaucagaaucacaccuggggga

SEQ ID NO: 34052 - RNA, 25 nt, Homo sapiens
acggagcugucccaacaccaccccu

SEQ ID NO: 34053 - RNA, 22 nt, Homo sapiens
gauccgagcaccggggaccccc

SEQ ID NO: 34054 - RNA, 21 nt, Homo sapiens
aguucucccaacguaaaccca

SEQ ID NO: 34055 - RNA, 24 nt, Homo sapiens
acgcagagcccgaaagcccccagu

SEQ ID NO: 34056 - RNA, 24 nt, Homo sapiens
acgcagagcccgaaagcccccagu

SEQ ID NO: 34057 - RNA, 22 nt, Homo sapiens
gcggucccgcggcgccccgccu

SEQ ID NO: 34058 - RNA, 22 nt, Homo sapiens
cacucuaaagggaggcacuuug

SEQ ID NO: 34059 - RNA, 21 nt, Homo sapiens
ccaaccaaugaaagaaugcuu

SEQ ID NO: 34060 - RNA, 17 nt, Homo sapiens
gggagaggaggaggcga

SEQ ID NO: 34061 - RNA, 23 nt, Homo sapiens
gggagugaagacacggagccaga

SEQ ID NO: 34062 - RNA, 22 nt, Homo sapiens
cggugagcacccggccccugcg

SEQ ID NO: 34063 - RNA, 22 nt, Homo sapiens
cccaacaacaggaaacuaccua

SEQ ID NO: 34064 - RNA, 22 nt, Homo sapiens
acugccugucugugccugcugu

SEQ ID NO: 34065 - RNA, 21 nt, Homo sapiens
acaggauugagggggggcccu

SEQ ID NO: 34066 - RNA, 21 nt, Homo sapiens
acaggauugagggggggcccu

SEQ ID NO: 34067 - RNA, 22 nt, Homo sapiens
ucgcccucucaacccagcuuuu

SEQ ID NO: 34068 - RNA, 22 nt, Homo sapiens
uugcccucucaacccagcuuuu

SEQ ID NO: 34069 - RNA, 20 nt, Homo sapiens
acccucucaacccagcuuuu

SEQ ID NO: 34070 - RNA, 19 nt, Homo sapiens
uccucucaacccagcuuuu

SEQ ID NO: 34071 - RNA, 21 nt, Homo sapiens
ccuacguuccauagucuacca

SEQ ID NO: 34072 - RNA, 22 nt, Homo sapiens
aaaguaacugcaguuuuugcua

SEQ ID NO: 34073 - RNA, 25 nt, Homo sapiens
aggccgccacccgcccgcgaucccu

SEQ ID NO: 34074 - RNA, 23 nt, Homo sapiens
ggaagccaucaagucgcugcagg

SEQ ID NO: 34075 - RNA, 21 nt, Homo sapiens
ccccucccagccucccugcca

SEQ ID NO: 34076 - RNA, 24 nt, Homo sapiens
gaagucacucccaggcagcugcaa

SEQ ID NO: 34077 - RNA, 18 nt, Homo sapiens
aucacauucaccucccug

SEQ ID NO: 34078 - RNA, 23 nt, Homo sapiens
gggagugaagacacggagccaga

SEQ ID NO: 34079 - RNA, 22 nt, Homo sapiens
ucaggaacugccuuucucucca

SEQ ID NO: 34080 - RNA, 22 nt, Homo sapiens
ggagagccuccacccaacccuc

SEQ ID NO: 34081 - RNA, 22 nt, Homo sapiens
aaucagucucauugcuuuauaa

SEQ ID NO: 34082 - RNA, 19 nt, Homo sapiens
auuuugguacagcagcuca

SEQ ID NO: 34083 - RNA, 23 nt, Homo sapiens
acccaacagccccugcaagggau

SEQ ID NO: 34084 - RNA, 21 nt, Homo sapiens
caucaccuuccuucuccucca

SEQ ID NO: 34085 - RNA, 23 nt, Homo sapiens
ccgcuugagcuaacuccgacccg

SEQ ID NO: 34086 - RNA, 22 nt, Homo sapiens
ggaggccgggacgagugcaaua

SEQ ID NO: 34087 - RNA, 18 nt, Homo sapiens
cccccaccaccacgcccg

SEQ ID NO: 34088 - RNA, 17 nt, Homo sapiens
gggagaggaggaggcga

SEQ ID NO: 34089 - RNA, 23 nt, Homo sapiens
gggagugaagacacggagccaga

SEQ ID NO: 34090 - RNA, 23 nt, Homo sapiens
aggaacagcagcagcccgggccg

SEQ ID NO: 34091 - RNA, 22 nt, Homo sapiens
ccucauggaaggguuccccacu

SEQ ID NO: 34092 - RNA, 23 nt, Homo sapiens
cugcagaacuguucccgcugcua

SEQ ID NO: 34093 - RNA, 17 nt, Homo sapiens
uggaggccccagcgaga

SEQ ID NO: 34094 - RNA, 22 nt, Homo sapiens
ugcuguuagcccuagccccgca

SEQ ID NO: 34095 - RNA, 21 nt, Homo sapiens
ccccucccagccucccugcca

SEQ ID NO: 34096 - RNA, 22 nt, Homo sapiens
auccuucuacaaauucacccau

SEQ ID NO: 34097 - RNA, 22 nt, Homo sapiens
agacaacaaugccaaccucaca

SEQ ID NO: 34098 - RNA, 23 nt, Homo sapiens
gaaacccagcagacaauguagcu

SEQ ID NO: 34099 - RNA, 24 nt, Homo sapiens
ucagagcauguguuuaaucaggcu

SEQ ID NO: 34100 - RNA, 24 nt, Homo sapiens
ucacagguuaaagggucucaggga

SEQ ID NO: 34101 - RNA, 22 nt, Homo sapiens
ucacaaguuagggucucaggga

SEQ ID NO: 34102 - RNA, 23 nt, Homo sapiens
agcccuguucuacagcccugagg

SEQ ID NO: 34103 - RNA, 23 nt, Homo sapiens
gggagugaagacacggagccaga

SEQ ID NO: 34104 - RNA, 22 nt, Homo sapiens
acugggacuuuguaggccaguu

SEQ ID NO: 34105 - RNA, 22 nt, Homo sapiens
agcgggacuuugagggccaguu

SEQ ID NO: 34106 - RNA, 22 nt, Homo sapiens
ugagccacugugccuggccuga

SEQ ID NO: 34107 - RNA, 23 nt, Homo sapiens
uauucucgcacggacuacaacca

SEQ ID NO: 34108 - RNA, 22 nt, Homo sapiens
uagucaagugaagcagugggag

SEQ ID NO: 34109 - RNA, 22 nt, Homo sapiens
acaguucuucaacuggcagcuu

SEQ ID NO: 34110 - RNA, 22 nt, Homo sapiens
cucaauagacugugagcuccuu

SEQ ID NO: 34111 - RNA, 23 nt, Homo sapiens
acaccaaugcccuaggggaugcg

SEQ ID NO: 34112 - RNA, 22 nt, Homo sapiens
aaucagucucauugcuuuauaa

SEQ ID NO: 34113 - RNA, 22 nt, Homo sapiens
ugcaagccuugggugugggagg

SEQ ID NO: 34114 - RNA, 19 nt, Homo sapiens
auuuugguacagcagcuca

SEQ ID NO: 34115 - RNA, 19 nt, Homo sapiens
gccugcugacaccgugccu

SEQ ID NO: 34116 - RNA, 23 nt, Homo sapiens
cccagcuagauuguaagcuccuu

SEQ ID NO: 34117 - RNA, 21 nt, Homo sapiens
caucaccuuccuucuccucca

SEQ ID NO: 34118 - RNA, 22 nt, Homo sapiens
gcugaggcuguggggcuggagu

SEQ ID NO: 34119 - RNA, 18 nt, Homo sapiens
cccccaccaccacgcccg

SEQ ID NO: 34120 - RNA, 17 nt, Homo sapiens
ggguggcagcgguggga

SEQ ID NO: 34121 - RNA, 24 nt, Homo sapiens
acugcuggucuucagucagggcca

SEQ ID NO: 34122 - RNA, 19 nt, Homo sapiens
cagcaucagcagcaucauc

SEQ ID NO: 34123 - RNA, 22 nt, Homo sapiens
ucagaccgagacaagugcaaug

SEQ ID NO: 34124 - RNA, 22 nt, Homo sapiens
aggaaaccagcaaguguugacg

SEQ ID NO: 34125 - RNA, 22 nt, Homo sapiens
uccucuuuucuuagagacucac

SEQ ID NO: 34126 - RNA, 22 nt, Homo sapiens
ugcuguuagcccuagccccgca

SEQ ID NO: 34127 - RNA, 20 nt, Homo sapiens
gcaagacaucacaagacucu

SEQ ID NO: 34128 - RNA, 20 nt, Homo sapiens
uacugcuuccacagcucccc

SEQ ID NO: 34129 - RNA, 21 nt, Homo sapiens
gagcugcauccuggcuccggg

SEQ ID NO: 34130 - RNA, 18 nt, Homo sapiens
gaaaugagggccagcuga

SEQ ID NO: 34131 - RNA, 21 nt, Homo sapiens
cugaggagagaggaggugggg

SEQ ID NO: 34132 - RNA, 22 nt, Homo sapiens
gugggguggguggucaggccga

SEQ ID NO: 34133 - RNA, 17 nt, Homo sapiens
gggagaggaggaggcga

SEQ ID NO: 34134 - RNA, 23 nt, Homo sapiens
cggcucugucgucgaggcgcuca

SEQ ID NO: 34135 - RNA, 23 nt, Homo sapiens
ucucacccagguagcaaggauua

SEQ ID NO: 34136 - RNA, 21 nt, Homo sapiens
caucaccuuccuucuccucca

SEQ ID NO: 34137 - RNA, 22 nt, Homo sapiens
gcugaggcuguggggcuggagu

SEQ ID NO: 34138 - RNA, 21 nt, Homo sapiens
cggcucggguggcggcgacgg

SEQ ID NO: 34139 - RNA, 21 nt, Homo sapiens
cucccccacugcagcuggcac

SEQ ID NO: 34140 - RNA, 21 nt, Homo sapiens
ccccucccagccucccugcca

SEQ ID NO: 34141 - RNA, 17 nt, Homo sapiens
gggagaggaggaggcga

SEQ ID NO: 34142 - RNA, 21 nt, Homo sapiens
gaccaaucgccguccccgccg

SEQ ID NO: 34143 - RNA, 22 nt, Homo sapiens
uggcagcagcggagggggcaga

SEQ ID NO: 34144 - RNA, 22 nt, Homo sapiens
ucagaccgagacaagugcaaug

SEQ ID NO: 34145 - RNA, 20 nt, Homo sapiens
ccagcagcaccuggggcagu

SEQ ID NO: 34146 - RNA, 21 nt, Homo sapiens
auccuguacugagcugccccg

SEQ ID NO: 34147 - RNA, 22 nt, Homo sapiens
gauagagugcagaccagggucu

SEQ ID NO: 34148 - RNA, 24 nt, Homo sapiens
acgcagagcccgaaagcccccagu

SEQ ID NO: 34149 - RNA, 24 nt, Homo sapiens
acgcgcaggccagagacccaggca

SEQ ID NO: 34150 - RNA, 22 nt, Homo sapiens
gcggucccgcggcgccccgccu

SEQ ID NO: 34151 - RNA, 17 nt, Homo sapiens
uggaggccccagcgaga

SEQ ID NO: 34152 - RNA, 23 nt, Homo sapiens
ccgcuugagcuaacuccgacccg

SEQ ID NO: 34153 - RNA, 20 nt, Homo sapiens
cucaaagcaaacccugcaga

SEQ ID NO: 34154 - RNA, 20 nt, Homo sapiens
cucaaagcaaacccugcaga

SEQ ID NO: 34155 - RNA, 24 nt, Homo sapiens
acugcuggucuucagucagggcca

SEQ ID NO: 34156 - RNA, 23 nt, Homo sapiens
gggagugaagacacggagccaga

SEQ ID NO: 34157 - RNA, 22 nt, Homo sapiens
cagaaagugcuucccucuagag

SEQ ID NO: 34158 - RNA, 20 nt, Homo sapiens
acagcaaggagggcaggagg

SEQ ID NO: 34159 - RNA, 21 nt, Homo sapiens
ugcaaugcaacuacaaugcac

SEQ ID NO: 34160 - RNA, 20 nt, Homo sapiens
gcaaugcaacagcaaugcac

SEQ ID NO: 34161 - RNA, 23 nt, Homo sapiens
acggcuaguggaccaggugaagu

SEQ ID NO: 34162 - RNA, 22 nt, Homo sapiens
aucgggaggggacugagccuga

SEQ ID NO: 34163 - RNA, 22 nt, Homo sapiens
aggaaaccagcaaguguugacg

SEQ ID NO: 34164 - RNA, 22 nt, Homo sapiens
acgguccuacacucaaggcaug

SEQ ID NO: 34165 - RNA, 21 nt, Homo sapiens
cccgaggagccgggcaggcuu

SEQ ID NO: 34166 - RNA, 25 nt, Homo sapiens
acggagcugucccaacaccaccccu

SEQ ID NO: 34167 - RNA, 21 nt, Homo sapiens
gaaggaagugagugcagccac

SEQ ID NO: 34168 - RNA, 24 nt, Homo sapiens
acgcgcaggccagagacccaggca

SEQ ID NO: 34169 - RNA, 20 nt, Homo sapiens
uacugcuuccacagcucccc

SEQ ID NO: 34170 - RNA, 23 nt, Homo sapiens
uccaucaucaaaacaaauggagu

SEQ ID NO: 34171 - RNA, 22 nt, Homo sapiens
acaaaguucugugaugcacuga

SEQ ID NO: 34172 - RNA, 21 nt, Homo sapiens
gggcaucugggacgcgcagga

SEQ ID NO: 34173 - RNA, 21 nt, Homo sapiens
gaccaaucgccguccccgccg

SEQ ID NO: 34174 - RNA, 23 nt, Homo sapiens
gaaacccagcagacaauguagcu

SEQ ID NO: 34175 - RNA, 21 nt, Homo sapiens
acccaguagccagauguagcu

SEQ ID NO: 34176 - RNA, 21 nt, Homo sapiens
aaagugucagauacggugugg

SEQ ID NO: 34177 - RNA, 23 nt, Homo sapiens
gcgcccaauuaaugucuguugau

SEQ ID NO: 34178 - RNA, 22 nt, Homo sapiens
auaaggauuuuuaggggcauua

SEQ ID NO: 34179 - RNA, 22 nt, Homo sapiens
gcggucccgcggcgccccgccu

SEQ ID NO: 34180 - RNA, 22 nt, Homo sapiens
ugcuguuagcccuagccccgca

SEQ ID NO: 34181 - RNA, 22 nt, Homo sapiens
ccucgggauggcgcccguucac

SEQ ID NO: 34182 - RNA, 22 nt, Homo sapiens
acacacccacgcgagccggaaa

SEQ ID NO: 34183 - RNA, 21 nt, Homo sapiens
guccugagagcgcugccuccu

SEQ ID NO: 34184 - RNA, 17 nt, Homo sapiens
uggaggccccagcgaga

SEQ ID NO: 34185 - RNA, 22 nt, Homo sapiens
agacaacaaugccaaccucaca

SEQ ID NO: 34186 - RNA, 18 nt, Homo sapiens
aucacauucaccucccug

SEQ ID NO: 34187 - RNA, 21 nt, Homo sapiens
cggggugcacgggcggagggc

SEQ ID NO: 34188 - RNA, 23 nt, Homo sapiens
gggagugaagacacggagccaga

SEQ ID NO: 34189 - RNA, 21 nt, Homo sapiens
gggcaucugggacgcgcagga

SEQ ID NO: 34190 - RNA, 23 nt, Homo sapiens
cccaacagacauggcgguacuca

SEQ ID NO: 34191 - RNA, 23 nt, Homo sapiens
aagaaucuugucccgcagguccu

SEQ ID NO: 34192 - RNA, 22 nt, Homo sapiens
uccagcaaagggaagcgcuuuc

SEQ ID NO: 34193 - RNA, 22 nt, Homo sapiens
accucuaaaggggagcgcuuug

SEQ ID NO: 34194 - RNA, 23 nt, Homo sapiens
acacucuaaagagaagcgcuuug

SEQ ID NO: 34195 - RNA, 21 nt, Homo sapiens
gcuccaaagggaagcgcuuug

SEQ ID NO: 34196 - RNA, 21 nt, Homo sapiens
ccucuaaagagaagcgcuuuc

SEQ ID NO: 34197 - RNA, 21 nt, Homo sapiens
cccgaggagccgggcaggcuu

SEQ ID NO: 34198 - RNA, 19 nt, Homo sapiens
gcucuaagaaagccacacu

SEQ ID NO: 34199 - RNA, 21 nt, Homo sapiens
gaaggaagugagugcagccac

SEQ ID NO: 34200 - RNA, 22 nt, Homo sapiens
uauccacuacaccccgcugccu

SEQ ID NO: 34201 - RNA, 22 nt, Homo sapiens
aaccauacaaccuacuaccuca

SEQ ID NO: 34202 - RNA, 21 nt, Homo sapiens
ugcaggcugaucuucuucucu

SEQ ID NO: 34203 - RNA, 18 nt, Homo sapiens
cccccaccaccacgcccg

SEQ ID NO: 34204 - RNA, 23 nt, Homo sapiens
uccaucaucaaaacaaauggagu

SEQ ID NO: 34205 - RNA, 21 nt, Homo sapiens
gaccaaucgccguccccgccg

SEQ ID NO: 34206 - RNA, 22 nt, Homo sapiens
cggugagcacccggccccugcg

SEQ ID NO: 34207 - RNA, 22 nt, Homo sapiens
ucacaguugccagcugagauua

SEQ ID NO: 34208 - RNA, 23 nt, Homo sapiens
acaccccaaaaucgaagcacuuc

SEQ ID NO: 34209 - RNA, 23 nt, Homo sapiens
ucaacgggagugaucgugucauu

SEQ ID NO: 34210 - RNA, 23 nt, Homo sapiens
cugcagaacuguucccgcugcua

SEQ ID NO: 34211 - RNA, 24 nt, Homo sapiens
cagaaagugcuuucuuuuggagaa

SEQ ID NO: 34212 - RNA, 22 nt, Homo sapiens
aacacucuaaaaggaggcacuu

SEQ ID NO: 34213 - RNA, 22 nt, Homo sapiens
cugcucaaacccuccaaugacu

SEQ ID NO: 34214 - RNA, 22 nt, Homo sapiens
gcggucccgcggcgccccgccu

SEQ ID NO: 34215 - RNA, 21 nt, Homo sapiens
ugacugacagcuuuuugagua

SEQ ID NO: 34216 - RNA, 21 nt, Homo sapiens
cggggugcacgggcggagggc

SEQ ID NO: 34217 - RNA, 22 nt, Homo sapiens
ucagaccgagacaagugcaaug

SEQ ID NO: 34218 - RNA, 22 nt, Homo sapiens
aagagggagacccaggcucgga

SEQ ID NO: 34219 - RNA, 25 nt, Homo sapiens
aggccgccacccgcccgcgaucccu

SEQ ID NO: 34220 - RNA, 23 nt, Homo sapiens
acagcgcucgcaaccgcagcgau

SEQ ID NO: 34221 - RNA, 25 nt, Homo sapiens
accaacggaccuacuucccuccgcc

SEQ ID NO: 34222 - RNA, 21 nt, Homo sapiens
aagggucaguaagcacccgcg

SEQ ID NO: 34223 - RNA, 24 nt, Homo sapiens
cacccccagagccucagcucccca

SEQ ID NO: 34224 - RNA, 22 nt, Homo sapiens
ucaggaacugccuuucucucca

SEQ ID NO: 34225 - RNA, 22 nt, Homo sapiens
uggcagcagcggagggggcaga

SEQ ID NO: 34226 - RNA, 20 nt, Homo sapiens
cccgccgcgucgcccugggg

SEQ ID NO: 34227 - RNA, 20 nt, Homo sapiens
ccagcagcaccuggggcagu

SEQ ID NO: 34228 - RNA, 23 nt, Homo sapiens
aaagucucgcucucugccccuca

SEQ ID NO: 34229 - RNA, 21 nt, Homo sapiens
auccuguacugagcugccccg

SEQ ID NO: 34230 - RNA, 18 nt, Homo sapiens
acccucugaaaggaagca

SEQ ID NO: 34231 - RNA, 22 nt, Homo sapiens
aaagugcuucuuaccuccagau

SEQ ID NO: 34232 - RNA, 19 nt, Homo sapiens
gccucagaggcagcugcuu

SEQ ID NO: 34233 - RNA, 21 nt, Homo sapiens
ggggagcgggggcccugccuu

SEQ ID NO: 34234 - RNA, 21 nt, Homo sapiens
aucugcacugucagcacuuua

SEQ ID NO: 34235 - RNA, 21 nt, Homo sapiens
cucccccacugcagcuggcac

SEQ ID NO: 34236 - RNA, 18 nt, Homo sapiens
gaaaugagggccagcuga

SEQ ID NO: 34237 - RNA, 22 nt, Homo sapiens
uccggggacgaacgggacgggu

SEQ ID NO: 34238 - RNA, 23 nt, Homo sapiens
gggagugaagacacggagccaga

SEQ ID NO: 34239 - RNA, 22 nt, Homo sapiens
acaguucuucaacuggcagcuu

SEQ ID NO: 34240 - RNA, 23 nt, Homo sapiens
aaagucucgcucucugccccuca

SEQ ID NO: 34241 - RNA, 21 nt, Homo sapiens
acuccaaagggaagcgccuuc

SEQ ID NO: 34242 - RNA, 22 nt, Homo sapiens
cgcucuaaagggaagcgccuuc

SEQ ID NO: 34243 - RNA, 20 nt, Homo sapiens
uacugcuuccacagcucccc

SEQ ID NO: 34244 - RNA, 22 nt, Homo sapiens
gggagaggucucccugcgcaca

SEQ ID NO: 34245 - RNA, 22 nt, Homo sapiens
ggagauggagccagggcccuaa

SEQ ID NO: 34246 - RNA, 18 nt, Homo sapiens
auucaaucuacugccuca

SEQ ID NO: 34247 - RNA, 21 nt, Homo sapiens
aacuccuguaugaagccguuc

SEQ ID NO: 34248 - RNA, 21 nt, Homo sapiens
guccugagagcgcugccuccu

SEQ ID NO: 34249 - RNA, 21 nt, Homo sapiens
ggggagcgggggcccugccuu

SEQ ID NO: 34250 - RNA, 22 nt, Homo sapiens
gaggcucagaauggcucaggag

SEQ ID NO: 34251 - RNA, 21 nt, Homo sapiens
uggggauuacacuucaacagg

SEQ ID NO: 34252 - RNA, 22 nt, Homo sapiens
ucucucccauuagaguugaaaa

SEQ ID NO: 34253 - RNA, 22 nt, Homo sapiens
aggcauaggaugacaaagggaa

SEQ ID NO: 34254 - RNA, 22 nt, Homo sapiens
aggcgaaggaugacaaagggaa

SEQ ID NO: 34255 - RNA, 23 nt, Homo sapiens
gcgcccaauuaaugucuguugau

SEQ ID NO: 34256 - RNA, 22 nt, Homo sapiens
uauucaggaacauauugcaaaa

SEQ ID NO: 34257 - RNA, 22 nt, Homo sapiens
uauucaggaacauauugcaaaa

SEQ ID NO: 34258 - RNA, 22 nt, Homo sapiens
acuucaaggaucuuaaacuuug

SEQ ID NO: 34259 - RNA, 24 nt, Homo sapiens
acugggcacaaacauguccagguc

SEQ ID NO: 34260 - RNA, 21 nt, Homo sapiens
caguagagauuguuucaacac

SEQ ID NO: 34261 - RNA, 23 nt, Homo sapiens
uauucucgcacggacuacaacca

SEQ ID NO: 34262 - RNA, 22 nt, Homo sapiens
acaguucuucaacuggcagcuu

SEQ ID NO: 34263 - RNA, 22 nt, Homo sapiens
cucaauagacugugagcuccuu

SEQ ID NO: 34264 - RNA, 23 nt, Homo sapiens
acccuauaagcaauauugcacua

SEQ ID NO: 34265 - RNA, 22 nt, Homo sapiens
acacucuaaagggaugcacgau

SEQ ID NO: 34266 - RNA, 22 nt, Homo sapiens
acacucuaaaaggaugcacgau

SEQ ID NO: 34267 - RNA, 23 nt, Homo sapiens
cccagcuagauuguaagcuccuu

SEQ ID NO: 34268 - RNA, 21 nt, Homo sapiens
caucaccuuccuucuccucca

SEQ ID NO: 34269 - RNA, 21 nt, Homo sapiens
aucugcacugucagcacuuua

SEQ ID NO: 34270 - RNA, 22 nt, Homo sapiens
agacaacaaugccaaccucaca

SEQ ID NO: 34271 - RNA, 22 nt, Homo sapiens
acucaccgacagguugaauguu

SEQ ID NO: 34272 - RNA, 18 nt, Homo sapiens
ggagaggagggcacugga

SEQ ID NO: 34273 - RNA, 22 nt, Homo sapiens
uggcagcagcggagggggcaga

SEQ ID NO: 34274 - RNA, 22 nt, Homo sapiens
acugggacuuuguaggccaguu

SEQ ID NO: 34275 - RNA, 22 nt, Homo sapiens
agcgggacuuugagggccaguu

SEQ ID NO: 34276 - RNA, 21 nt, Homo sapiens
acaugguuagaucaagcacaa

SEQ ID NO: 34277 - RNA, 21 nt, Homo sapiens
aagugucagacacgguggugg

SEQ ID NO: 34278 - RNA, 20 nt, Homo sapiens
ccagcagcaccuggggcagu

SEQ ID NO: 34279 - RNA, 22 nt, Homo sapiens
aucgggaggggacugagccuga

SEQ ID NO: 34280 - RNA, 21 nt, Homo sapiens
auccuguacugagcugccccg

SEQ ID NO: 34281 - RNA, 21 nt, Homo sapiens
guucuaacccauuguggccaa

SEQ ID NO: 34282 - RNA, 21 nt, Homo sapiens
cccgaggagccgggcaggcuu

SEQ ID NO: 34283 - RNA, 23 nt, Homo sapiens
ugcgggcgggacgagcaagcaca

SEQ ID NO: 34284 - RNA, 22 nt, Homo sapiens
gcugaggcuguggggcuggagu

SEQ ID NO: 34285 - RNA, 20 nt, Homo sapiens
uacugcuuccacagcucccc

SEQ ID NO: 34286 - RNA, 21 nt, Homo sapiens
gagcugcauccuggcuccggg

SEQ ID NO: 34287 - RNA, 23 nt, Homo sapiens
gggagugaagacacggagccaga

SEQ ID NO: 34288 - RNA, 23 nt, Homo sapiens
aggaacagcagcagcccgggccg

SEQ ID NO: 34289 - RNA, 23 nt, Homo sapiens
aggaacagcagcagcccgggccg

SEQ ID NO: 34290 - RNA, 22 nt, Homo sapiens
ucaggaacugccuuucucucca

SEQ ID NO: 34291 - RNA, 22 nt, Homo sapiens
ucaggaacugccuuucucucca

SEQ ID NO: 34292 - RNA, 21 nt, Homo sapiens
gaccaaucgccguccccgccg

SEQ ID NO: 34293 - RNA, 21 nt, Homo sapiens
gaccaaucgccguccccgccg

SEQ ID NO: 34294 - RNA, 21 nt, Homo sapiens
acaggauugagggggggcccu

SEQ ID NO: 34295 - RNA, 23 nt, Homo sapiens
cggcucugucgucgaggcgcuca

SEQ ID NO: 34296 - RNA, 23 nt, Homo sapiens
aaaucagaaucacaccuggggga

SEQ ID NO: 34297 - RNA, 22 nt, Homo sapiens
gaauucaucacggccagccucu

SEQ ID NO: 34298 - RNA, 19 nt, Homo sapiens
auuuugguacagcagcuca

SEQ ID NO: 34299 - RNA, 24 nt, Homo sapiens
acgcagagcccgaaagcccccagu

SEQ ID NO: 34300 - RNA, 19 nt, Homo sapiens
gccucagaggcagcugcuu

SEQ ID NO: 34301 - RNA, 22 nt, Homo sapiens
gcggucccgcggcgccccgccu

SEQ ID NO: 34302 - RNA, 22 nt, Homo sapiens
gcggucccgcggcgccccgccu

SEQ ID NO: 34303 - RNA, 22 nt, Homo sapiens
ugcuguuagcccuagccccgca

SEQ ID NO: 34304 - RNA, 22 nt, Homo sapiens
cgaccauggcuguagacuguua

SEQ ID NO: 34305 - RNA, 22 nt, Homo sapiens
acuccaacagggccgcgucucc

SEQ ID NO: 34306 - RNA, 21 nt, Homo sapiens
uagaaaggcuaggaccaaacc

SEQ ID NO: 34307 - RNA, 23 nt, Homo sapiens
cuaccugcacuauaagcacuuua

SEQ ID NO: 34308 - RNA, 21 nt, Homo sapiens
ggccgugacuggagacuguua

SEQ ID NO: 34309 - RNA, 21 nt, Homo sapiens
aaagugucagauacggugugg

SEQ ID NO: 34310 - RNA, 21 nt, Homo sapiens
guucuaacccauuguggccaa

SEQ ID NO: 34311 - RNA, 19 nt, Homo sapiens
gcucuaagaaagccacacu

SEQ ID NO: 34312 - RNA, 22 nt, Homo sapiens
cuagugguccuaaacauuucac

SEQ ID NO: 34313 - RNA, 22 nt, Homo sapiens
ggcaaaauccgcaauuacuuuu

SEQ ID NO: 34314 - RNA, 21 nt, Homo sapiens
aacggaaccacuagugacuug

SEQ ID NO: 34315 - RNA, 21 nt, Homo sapiens
gcggaacuuagccacugugaa

SEQ ID NO: 34316 - RNA, 22 nt, Homo sapiens
accagcuaacaauacacugcca

SEQ ID NO: 34317 - RNA, 22 nt, Homo sapiens
agccacaaucaccuucugaucu

SEQ ID NO: 34318 - RNA, 23 nt, Homo sapiens
ucucugcaggccgugugcuuugc

SEQ ID NO: 34319 - RNA, 24 nt, Homo sapiens
acucacaccuagguuccaaggauu

SEQ ID NO: 34320 - RNA, 22 nt, Homo sapiens
cgaauccaccacgaacaacuuc

SEQ ID NO: 34321 - RNA, 23 nt, Homo sapiens
acccuauaagcaauauugcacua

SEQ ID NO: 34322 - RNA, 21 nt, Homo sapiens
gaccaagaaauagccuuucaa

SEQ ID NO: 34323 - RNA, 22 nt, Homo sapiens
acacucuaaagggaaccauuuu

SEQ ID NO: 34324 - RNA, 22 nt, Homo sapiens
uuucaguuaucaaucugucaca

SEQ ID NO: 34325 - RNA, 23 nt, Homo sapiens
gagcaaggcucuugucuguaagu

SEQ ID NO: 34326 - RNA, 23 nt, Homo sapiens
ggacauuguuucagugcccaagu

SEQ ID NO: 34327 - RNA, 19 nt, Homo sapiens
gccucagaggcagcugcuu

SEQ ID NO: 34328 - RNA, 21 nt, Homo sapiens
cggcucggguggcggcgacgg

SEQ ID NO: 34329 - RNA, 18 nt, Homo sapiens
gaaaugagggccagcuga

SEQ ID NO: 34330 - RNA, 18 nt, Homo sapiens
gaaaugagggccagcuga

SEQ ID NO: 34331 - RNA, 23 nt, Homo sapiens
gggagugaagacacggagccaga

SEQ ID NO: 34332 - RNA, 23 nt, Homo sapiens
gggagugaagacacggagccaga

SEQ ID NO: 34333 - RNA, 22 nt, Homo sapiens
cacugguacaaggguugggaga

SEQ ID NO: 34334 - RNA, 23 nt, Homo sapiens
uccaucauuacccggcaguauua

SEQ ID NO: 34335 - RNA, 22 nt, Homo sapiens
acugccugucugugccugcugu

SEQ ID NO: 34336 - RNA, 22 nt, Homo sapiens
agcugaguguaggauguuuaca

SEQ ID NO: 34337 - RNA, 22 nt, Homo sapiens
accagguuccaccccagcaggc

SEQ ID NO: 34338 - RNA, 23 nt, Homo sapiens
gggcucuuacucccucaggcacu

SEQ ID NO: 34339 - RNA, 21 nt, Homo sapiens
gugacucaucaccuauggaaa

SEQ ID NO: 34340 - RNA, 23 nt, Homo sapiens
aggagaaggcaccaugggauuua

SEQ ID NO: 34341 - RNA, 22 nt, Homo sapiens
cugcgauuccucccucuacugu

SEQ ID NO: 34342 - RNA, 22 nt, Homo sapiens
ggcagagagucagagcgcggau

SEQ ID NO: 34343 - RNA, 20 nt, Homo sapiens
cucaaagcaaacccugcaga

SEQ ID NO: 34344 - RNA, 20 nt, Homo sapiens
cucaaagcaaacccugcaga

SEQ ID NO: 34345 - RNA, 23 nt, Homo sapiens
uccaucaucaaaacaaauggagu

SEQ ID NO: 34346 - RNA, 22 nt, Homo sapiens
ucaggaacugccuuucucucca

SEQ ID NO: 34347 - RNA, 22 nt, Homo sapiens
gcuggguggagaagguggugaa

SEQ ID NO: 34348 - RNA, 22 nt, Homo sapiens
uuucaguuaucaaucugucaca

SEQ ID NO: 34349 - RNA, 20 nt, Homo sapiens
ugggccaccgccgagcggac

SEQ ID NO: 34350 - RNA, 20 nt, Homo sapiens
uacugcuuccacagcucccc

SEQ ID NO: 34351 - RNA, 21 nt, Homo sapiens
gagcugcauccuggcuccggg

SEQ ID NO: 34352 - RNA, 17 nt, Homo sapiens
gggagaggaggaggcga

SEQ ID NO: 34353 - RNA, 17 nt, Homo sapiens
gggagaggaggaggcga

SEQ ID NO: 34354 - RNA, 21 nt, Homo sapiens
cggggugcacgggcggagggc

SEQ ID NO: 34355 - RNA, 23 nt, Homo sapiens
aggaacagcagcagcccgggccg

SEQ ID NO: 34356 - RNA, 18 nt, Homo sapiens
auucaaucuacugccuca

SEQ ID NO: 34357 - RNA, 22 nt, Homo sapiens
ucagaccgagacaagugcaaug

SEQ ID NO: 34358 - RNA, 23 nt, Homo sapiens
aaagucucgcucucugccccuca

SEQ ID NO: 34359 - RNA, 21 nt, Homo sapiens
guccugagagcgcugccuccu

SEQ ID NO: 34360 - RNA, 22 nt, Homo sapiens
ccucaggcacggccgggccacc

SEQ ID NO: 34361 - RNA, 22 nt, Homo sapiens
uauccacuacaccccgcugccu

SEQ ID NO: 34362 - RNA, 24 nt, Homo sapiens
ucacagguuaaagggucucaggga

SEQ ID NO: 34363 - RNA, 22 nt, Homo sapiens
ucacaaguuagggucucaggga

SEQ ID NO: 34364 - RNA, 23 nt, Homo sapiens
agcccuguucuacagcccugagg

SEQ ID NO: 34365 - RNA, 22 nt, Homo sapiens
accuaauauaucaaacauauca

SEQ ID NO: 34366 - RNA, 22 nt, Homo sapiens
acugccugucugugccugcugu

SEQ ID NO: 34367 - RNA, 22 nt, Homo sapiens
accagguuccaccccagcaggc

SEQ ID NO: 34368 - RNA, 23 nt, Homo sapiens
acacucaaaagauggcggcacuu

SEQ ID NO: 34369 - RNA, 20 nt, Homo sapiens
agagaugagagaaacacccu

SEQ ID NO: 34370 - RNA, 22 nt, Homo sapiens
gggagaggucucccugcgcaca

SEQ ID NO: 34371 - RNA, 22 nt, Homo sapiens
cugggggcggcacaggggcuca

SEQ ID NO: 34372 - RNA, 21 nt, Homo sapiens
aaaggccacauccagcaccgu

SEQ ID NO: 34373 - RNA, 21 nt, Homo sapiens
cggggugcacgggcggagggc

SEQ ID NO: 34374 - RNA, 23 nt, Homo sapiens
aggaacagcagcagcccgggccg

SEQ ID NO: 34375 - RNA, 21 nt, Homo sapiens
gaccaaucgccguccccgccg

SEQ ID NO: 34376 - RNA, 22 nt, Homo sapiens
ucaucucgcccgcaaagaccca

SEQ ID NO: 34377 - RNA, 22 nt, Homo sapiens
cuguuccugcugaacugagcca

SEQ ID NO: 34378 - RNA, 19 nt, Homo sapiens
gccucagaggcagcugcuu

SEQ ID NO: 34379 - RNA, 25 nt, Homo sapiens
accaacggaccuacuucccuccgcc

SEQ ID NO: 34380 - RNA, 22 nt, Homo sapiens
gcggucccgcggcgccccgccu

SEQ ID NO: 34381 - RNA, 23 nt, Homo sapiens
cacugugggcccucuccgcacca

SEQ ID NO: 34382 - RNA, 22 nt, Homo sapiens
ugcuguuagcccuagccccgca

SEQ ID NO: 34383 - RNA, 22 nt, Homo sapiens
aacuauacaaccuacuaccuca

SEQ ID NO: 34384 - RNA, 22 nt, Homo sapiens
aaccacacaaccuacuaccuca

SEQ ID NO: 34385 - RNA, 19 nt, Homo sapiens
agaaaccccagcagagaca

SEQ ID NO: 34386 - RNA, 21 nt, Homo sapiens
ugcaggcugaucuucuucucu

SEQ ID NO: 34387 - RNA, 18 nt, Homo sapiens
cagcagccuccuucucaa

SEQ ID NO: 34388 - RNA, 23 nt, Homo sapiens
gggagugaagacacggagccaga

SEQ ID NO: 34389 - RNA, 22 nt, Homo sapiens
ugggguauuugacaaacugaca

SEQ ID NO: 34390 - RNA, 22 nt, Homo sapiens
cacucagcaccaggauauuguu

SEQ ID NO: 34391 - RNA, 22 nt, Homo sapiens
aggaaaccagcaaguguugacg

SEQ ID NO: 34392 - RNA, 21 nt, Homo sapiens
cagguaccaauauuuuaucua

SEQ ID NO: 34393 - RNA, 22 nt, Homo sapiens
cuggagagacaaggggaagagg

SEQ ID NO: 34394 - RNA, 23 nt, Homo sapiens
aaagucucgcucucugccccuca

SEQ ID NO: 34395 - RNA, 24 nt, Homo sapiens
acgcgcaggccagagacccaggca

SEQ ID NO: 34396 - RNA, 21 nt, Homo sapiens
cuagggaagaacagugagcaa

SEQ ID NO: 34397 - RNA, 21 nt, Homo sapiens
aacauacaaaggguauccucu

SEQ ID NO: 34398 - RNA, 22 nt, Homo sapiens
augggacauccuacauaugcaa

SEQ ID NO: 34399 - RNA, 22 nt, Homo sapiens
acacaccaaggauaauuucucc

SEQ ID NO: 34400 - RNA, 21 nt, Homo sapiens
gagcugcauccuggcuccggg

SEQ ID NO: 34401 - RNA, 21 nt, Homo sapiens
auaauggagaccaggccacga

SEQ ID NO: 34402 - RNA, 22 nt, Homo sapiens
cugggggcggcacaggggcuca

SEQ ID NO: 34403 - RNA, 22 nt, Homo sapiens
uccggggacgaacgggacgggu

SEQ ID NO: 34404 - RNA, 18 nt, Homo sapiens
cccccaccaccacgcccg

SEQ ID NO: 34405 - RNA, 17 nt, Homo sapiens
gggagaggaggaggcga

SEQ ID NO: 34406 - RNA, 23 nt, Homo sapiens
gggagugaagacacggagccaga

SEQ ID NO: 34407 - RNA, 21 nt, Homo sapiens
gaccaaucgccguccccgccg

SEQ ID NO: 34408 - RNA, 22 nt, Homo sapiens
cuguuccugcugaacugagcca

SEQ ID NO: 34409 - RNA, 23 nt, Homo sapiens
acacucaaaagauggcggcacuu

SEQ ID NO: 34410 - RNA, 22 nt, Homo sapiens
gcggucccgcggcgccccgccu

SEQ ID NO: 34411 - RNA, 20 nt, Homo sapiens
cugcgggaggacagggcuca

SEQ ID NO: 34412 - RNA, 22 nt, Homo sapiens
uccggggacgaacgggacgggu

SEQ ID NO: 34413 - RNA, 18 nt, Homo sapiens
caccaccagagccaacgu

SEQ ID NO: 34414 - RNA, 22 nt, Homo sapiens
cacgaccgacgccacgccgagu

SEQ ID NO: 34415 - RNA, 18 nt, Homo sapiens
aucacauucaccucccug

SEQ ID NO: 34416 - RNA, 22 nt, Homo sapiens
ggagcccgcgccccgcgccgag

SEQ ID NO: 34417 - RNA, 23 nt, Homo sapiens
gggagugaagacacggagccaga

SEQ ID NO: 34418 - RNA, 21 nt, Homo sapiens
gggcaucugggacgcgcagga

SEQ ID NO: 34419 - RNA, 22 nt, Homo sapiens
uggcagcagcggagggggcaga

SEQ ID NO: 34420 - RNA, 23 nt, Homo sapiens
cuaccugcacuaugagcacuuug

SEQ ID NO: 34421 - RNA, 21 nt, Homo sapiens
aaagugucagauacggugugg

SEQ ID NO: 34422 - RNA, 23 nt, Homo sapiens
gcgcccaauuaaugucuguugau

SEQ ID NO: 34423 - RNA, 20 nt, Homo sapiens
ccagcagcaccuggggcagu

SEQ ID NO: 34424 - RNA, 23 nt, Homo sapiens
aaagucucgcucucugccccuca

SEQ ID NO: 34425 - RNA, 22 nt, Homo sapiens
aacucaguaaugguaacgguuu

SEQ ID NO: 34426 - RNA, 21 nt, Homo sapiens
auccuguacugagcugccccg

SEQ ID NO: 34427 - RNA, 22 nt, Homo sapiens
uauccacuacaccccgcugccu

SEQ ID NO: 34428 - RNA, 22 nt, Homo sapiens
ggaggccgggacgagugcaaua

SEQ ID NO: 34429 - RNA, 18 nt, Homo sapiens
gaaaugagggccagcuga

SEQ ID NO: 34430 - RNA, 23 nt, Homo sapiens
gggagugaagacacggagccaga

SEQ ID NO: 34431 - RNA, 22 nt, Homo sapiens
cacugguacaaggguugggaga

SEQ ID NO: 34432 - RNA, 22 nt, Homo sapiens
ucaggaacugccuuucucucca

SEQ ID NO: 34433 - RNA, 21 nt, Homo sapiens
gaccaaucgccguccccgccg

SEQ ID NO: 34434 - RNA, 21 nt, Homo sapiens
aggcggcaggcacaggacugg

SEQ ID NO: 34435 - RNA, 22 nt, Homo sapiens
agcugaguguaggauguuuaca

SEQ ID NO: 34436 - RNA, 22 nt, Homo sapiens
acggaagggcagagagggccag

SEQ ID NO: 34437 - RNA, 21 nt, Homo sapiens
uucuaggauaggcccaggggc

SEQ ID NO: 34438 - RNA, 21 nt, Homo sapiens
ucaaucacagauagcaccccu

SEQ ID NO: 34439 - RNA, 23 nt, Homo sapiens
ucaacgggagugaucgugucauu

SEQ ID NO: 34440 - RNA, 22 nt, Homo sapiens
gcaaaagaaacugugguuuuug

SEQ ID NO: 34441 - RNA, 25 nt, Homo sapiens
accaacggaccuacuucccuccgcc

SEQ ID NO: 34442 - RNA, 22 nt, Homo sapiens
gcggucccgcggcgccccgccu

SEQ ID NO: 34443 - RNA, 22 nt, Homo sapiens
cacucuaaagggaggcacuuug

SEQ ID NO: 34444 - RNA, 24 nt, Homo sapiens
ucagagcauguguuuaaucaggcu

SEQ ID NO: 34445 - RNA, 22 nt, Homo sapiens
cugggggcggcacaggggcuca

SEQ ID NO: 34446 - RNA, 23 nt, Homo sapiens
aaucuacuuucuuugcucauccu

SEQ ID NO: 34447 - RNA, 22 nt, Homo sapiens
aaccacuuucuuugcucauccg

SEQ ID NO: 34448 - RNA, 20 nt, Homo sapiens
aagcagaaaaaggcaaacga

SEQ ID NO: 34449 - RNA, 21 nt, Homo sapiens
ccuacguuccauagucuacca

SEQ ID NO: 34450 - RNA, 22 nt, Homo sapiens
uauggaugcaaaaugaucccaa

SEQ ID NO: 34451 - RNA, 22 nt, Homo sapiens
auaaaugacaccuccuugugaa

SEQ ID NO: 34452 - RNA, 23 nt, Homo sapiens
gucagaccccgagggguccucgc

SEQ ID NO: 34453 - RNA, 21 nt, Homo sapiens
agguaauaccaauaccuugug

SEQ ID NO: 34454 - RNA, 19 nt, Homo sapiens
aagacauuuucagacagcu

SEQ ID NO: 34455 - RNA, 25 nt, Homo sapiens
aggccgccacccgcccgcgaucccu

SEQ ID NO: 34456 - RNA, 23 nt, Homo sapiens
aaccaagaccccggagaucccag

SEQ ID NO: 34457 - RNA, 17 nt, Homo sapiens
gggagaggaggaggcga

SEQ ID NO: 34458 - RNA, 22 nt, Homo sapiens
cacugguacaaggguugggaga

SEQ ID NO: 34459 - RNA, 22 nt, Homo sapiens
acaaccagcuaagacacugcca

SEQ ID NO: 34460 - RNA, 22 nt, Homo sapiens
uacagauggauaccgugcaauu

SEQ ID NO: 34461 - RNA, 22 nt, Homo sapiens
gccaccuucaaaugggaagucu

SEQ ID NO: 34462 - RNA, 23 nt, Homo sapiens
acagcgcucgcaaccgcagcgau

SEQ ID NO: 34463 - RNA, 23 nt, Homo sapiens
gacguaguccuauucucugcugc

SEQ ID NO: 34464 - RNA, 22 nt, Homo sapiens
gggagaggucucccugcgcaca

SEQ ID NO: 34465 - RNA, 22 nt, Homo sapiens
ggcagagagucagagcgcggau

SEQ ID NO: 34466 - RNA, 21 nt, Homo sapiens
ugcaggcugaucuucuucucu

SEQ ID NO: 34467 - RNA, 23 nt, Homo sapiens
aaagucucgcucucugccccuca

SEQ ID NO: 34468 - RNA, 22 nt, Homo sapiens
aaagugcuucuuaccuccagau

SEQ ID NO: 34469 - RNA, 19 nt, Homo sapiens
agaaaccccagcagagaca

SEQ ID NO: 34470 - RNA, 23 nt, Homo sapiens
aggagaaggcaccaugggauuua

SEQ ID NO: 34471 - RNA, 23 nt, Homo sapiens
acacagcucuuccauaucuccag

SEQ ID NO: 34472 - RNA, 23 nt, Homo sapiens
gaaacccagcagacaauguagcu

SEQ ID NO: 34473 - RNA, 21 nt, Homo sapiens
acccaguagccagauguagcu

SEQ ID NO: 34474 - RNA, 22 nt, Homo sapiens
ugggguauuugacaaacugaca

SEQ ID NO: 34475 - RNA, 22 nt, Homo sapiens
cuuccagucgaggauguuuaca

SEQ ID NO: 34476 - RNA, 22 nt, Homo sapiens
agcugaguguaggauguuuaca

SEQ ID NO: 34477 - RNA, 23 nt, Homo sapiens
gcugagaguguaggauguuuaca

SEQ ID NO: 34478 - RNA, 22 nt, Homo sapiens
cuuccagucggggauguuuaca

SEQ ID NO: 34479 - RNA, 22 nt, Homo sapiens
cuuccagucaaggauguuuaca

SEQ ID NO: 34480 - RNA, 21 nt, Homo sapiens
aaagaucaaccauguauuauu

SEQ ID NO: 34481 - RNA, 22 nt, Homo sapiens
agcacagacuugcugugauguu

SEQ ID NO: 34482 - RNA, 22 nt, Homo sapiens
gguaaaacucgcaauuacuuuu

SEQ ID NO: 34483 - RNA, 22 nt, Homo sapiens
ggccaaaaccacaauuacuuuu

SEQ ID NO: 34484 - RNA, 22 nt, Homo sapiens
ggcaaaaaccgcaauuacuuuu

SEQ ID NO: 34485 - RNA, 22 nt, Homo sapiens
ggcaaaaaccacaauuacuuuu

SEQ ID NO: 34486 - RNA, 22 nt, Homo sapiens
gacaaaaaccgcgauuacuuuu

SEQ ID NO: 34487 - RNA, 22 nt, Homo sapiens
ggcaaaauccgcaauuacuuuu

SEQ ID NO: 34488 - RNA, 22 nt, Homo sapiens
accaaagaccgcaauuacuuuu

SEQ ID NO: 34489 - RNA, 22 nt, Homo sapiens
acaaaauccacaauuacuuuug

SEQ ID NO: 34490 - RNA, 21 nt, Homo sapiens
uuuuggugcauauuuacuuua

SEQ ID NO: 34491 - RNA, 20 nt, Homo sapiens
auuucuauaucuaucuccau

SEQ ID NO: 34492 - RNA, 22 nt, Homo sapiens
aaagagguuaaccauguauuau

SEQ ID NO: 34493 - RNA, 23 nt, Homo sapiens
uguaggcuggggauaaaugaaua

SEQ ID NO: 34494 - RNA, 21 nt, Homo sapiens
cuacgcagaaaggacacagug

SEQ ID NO: 34495 - RNA, 23 nt, Homo sapiens
ccgcuugagcuaacuccgacccg

SEQ ID NO: 34496 - RNA, 17 nt, Homo sapiens
gggagaggaggaggcga

SEQ ID NO: 34497 - RNA, 23 nt, Homo sapiens
gggagugaagacacggagccaga

SEQ ID NO: 34498 - RNA, 23 nt, Homo sapiens
cugcagaacuguucccgcugcua

SEQ ID NO: 34499 - RNA, 22 nt, Homo sapiens
uccagcaaagggaagcgcuuuc

SEQ ID NO: 34500 - RNA, 22 nt, Homo sapiens
accucuaaaggggagcgcuuug

SEQ ID NO: 34501 - RNA, 23 nt, Homo sapiens
acacucuaaagagaagcgcuuug

SEQ ID NO: 34502 - RNA, 21 nt, Homo sapiens
gcuccaaagggaagcgcuuug

SEQ ID NO: 34503 - RNA, 21 nt, Homo sapiens
ccucuaaagagaagcgcuuuc

SEQ ID NO: 34504 - RNA, 19 nt, Homo sapiens
guugggaucacaggcgccc

SEQ ID NO: 34505 - RNA, 22 nt, Homo sapiens
ugcuguuagcccuagccccgca

SEQ ID NO: 34506 - RNA, 21 nt, Homo sapiens
gagcugcauccuggcuccggg

SEQ ID NO: 34507 - RNA, 22 nt, Homo sapiens
uggcagcagcggagggggcaga

SEQ ID NO: 34508 - RNA, 20 nt, Homo sapiens
ccagcagcaccuggggcagu

SEQ ID NO: 34509 - RNA, 21 nt, Homo sapiens
auccuguacugagcugccccg

SEQ ID NO: 34510 - RNA, 21 nt, Homo sapiens
ccccucccagccucccugcca

SEQ ID NO: 34511 - RNA, 22 nt, Homo sapiens
cuggagagacaaggggaagagg

SEQ ID NO: 34512 - RNA, 22 nt, Homo sapiens
auccuucuacaaauucacccau

SEQ ID NO: 34513 - RNA, 21 nt, Homo sapiens
agggcucaucuugguccugca

SEQ ID NO: 34514 - RNA, 21 nt, Homo sapiens
gggcaucugggacgcgcagga

SEQ ID NO: 34515 - RNA, 22 nt, Homo sapiens
cggugagcacccggccccugcg

SEQ ID NO: 34516 - RNA, 22 nt, Homo sapiens
uccacauggaguugcuguuaca

SEQ ID NO: 34517 - RNA, 22 nt, Homo sapiens
auguaugugggacgguaaacca

SEQ ID NO: 34518 - RNA, 23 nt, Homo sapiens
acaccccaaaaucgaagcacuuc

SEQ ID NO: 34519 - RNA, 22 nt, Homo sapiens
cugcucaaacccuccaaugacu

SEQ ID NO: 34520 - RNA, 23 nt, Homo sapiens
gucacaucccucccaagacccuc

SEQ ID NO: 34521 - RNA, 22 nt, Homo sapiens
cuagggaacacagggcugguga

SEQ ID NO: 34522 - RNA, 24 nt, Homo sapiens
ucacagguuaaagggucucaggga

SEQ ID NO: 34523 - RNA, 22 nt, Homo sapiens
ucacaaguuagggucucaggga

SEQ ID NO: 34524 - RNA, 23 nt, Homo sapiens
agcccuguucuacagcccugagg

SEQ ID NO: 34525 - RNA, 17 nt, Homo sapiens
gggagaggaggaggcga

SEQ ID NO: 34526 - RNA, 22 nt, Homo sapiens
gcacaaaucuccagaccaccca

SEQ ID NO: 34527 - RNA, 23 nt, Homo sapiens
cggccugauucacaacaccagcu

SEQ ID NO: 34528 - RNA, 21 nt, Homo sapiens
gaccaaucgccguccccgccg

SEQ ID NO: 34529 - RNA, 21 nt, Homo sapiens
gaccaaucgccguccccgccg

SEQ ID NO: 34530 - RNA, 22 nt, Homo sapiens
gcuggguggagaagguggugaa

SEQ ID NO: 34531 - RNA, 22 nt, Homo sapiens
aggcauaggaugacaaagggaa

SEQ ID NO: 34532 - RNA, 22 nt, Homo sapiens
aggcgaaggaugacaaagggaa

SEQ ID NO: 34533 - RNA, 21 nt, Homo sapiens
aagugucagacacgguggugg

SEQ ID NO: 34534 - RNA, 22 nt, Homo sapiens
gauagagugcagaccagggucu

SEQ ID NO: 34535 - RNA, 22 nt, Homo sapiens
aggaaaccagcaaguguugacg

SEQ ID NO: 34536 - RNA, 25 nt, Homo sapiens
acggagcugucccaacaccaccccu

SEQ ID NO: 34537 - RNA, 21 nt, Homo sapiens
aguucucccaacguaaaccca

SEQ ID NO: 34538 - RNA, 22 nt, Homo sapiens
guccaaaguuggggugcugguu

SEQ ID NO: 34539 - RNA, 22 nt, Homo sapiens
gcggucccgcggcgccccgccu

SEQ ID NO: 34540 - RNA, 22 nt, Homo sapiens
gcggucccgcggcgccccgccu

SEQ ID NO: 34541 - RNA, 20 nt, Homo sapiens
aggggccucagccuccuggu

SEQ ID NO: 34542 - RNA, 22 nt, Homo sapiens
ugcuguuagcccuagccccgca

SEQ ID NO: 34543 - RNA, 21 nt, Homo sapiens
caucaccuuccuucuccucca

SEQ ID NO: 34544 - RNA, 23 nt, Homo sapiens
gacguaguccuauucucugcugc

SEQ ID NO: 34545 - RNA, 20 nt, Homo sapiens
uacugcuuccacagcucccc

SEQ ID NO: 34546 - RNA, 22 nt, Homo sapiens
ccccucuggucaaccagucaca

SEQ ID NO: 34547 - RNA, 23 nt, Homo sapiens
acauuuuucguuauugcucuuga

SEQ ID NO: 34548 - RNA, 22 nt, Homo sapiens
caagacacauuuggagagggac

SEQ ID NO: 34549 - RNA, 18 nt, Homo sapiens
gaaaugagggccagcuga

SEQ ID NO: 34550 - RNA, 21 nt, Homo sapiens
gaccaaucgccguccccgccg

SEQ ID NO: 34551 - RNA, 23 nt, Homo sapiens
cgugagcuccuggaggacaggga

SEQ ID NO: 34552 - RNA, 22 nt, Homo sapiens
gauagagugcagaccagggucu

SEQ ID NO: 34553 - RNA, 22 nt, Homo sapiens
gcggucccgcggcgccccgccu

SEQ ID NO: 34554 - RNA, 23 nt, Homo sapiens
gcacaugugcacacagccgggug

SEQ ID NO: 34555 - RNA, 22 nt, Homo sapiens
aggucucacuuuguugcccaga

SEQ ID NO: 34556 - RNA, 24 nt, Homo sapiens
acugcuggucuucagucagggcca

SEQ ID NO: 34557 - RNA, 18 nt, Homo sapiens
aucacauucaccucccug

SEQ ID NO: 34558 - RNA, 22 nt, Homo sapiens
cagcugguugaaggggaccaaa

SEQ ID NO: 34559 - RNA, 22 nt, Homo sapiens
uagcugguugaaggggaccaaa

SEQ ID NO: 34560 - RNA, 23 nt, Homo sapiens
gggagugaagacacggagccaga

SEQ ID NO: 34561 - RNA, 22 nt, Homo sapiens
ucaggaacugccuuucucucca

SEQ ID NO: 34562 - RNA, 20 nt, Homo sapiens
cccgccgcgucgcccugggg

SEQ ID NO: 34563 - RNA, 20 nt, Homo sapiens
acagcaaggagggcaggagg

SEQ ID NO: 34564 - RNA, 23 nt, Homo sapiens
gaaacccagcagacaauguagcu

SEQ ID NO: 34565 - RNA, 21 nt, Homo sapiens
acaggauugagggggggcccu

SEQ ID NO: 34566 - RNA, 20 nt, Homo sapiens
cuggaggaagggcccagagg

SEQ ID NO: 34567 - RNA, 22 nt, Homo sapiens
gccuaagacacaggcccagaga

SEQ ID NO: 34568 - RNA, 20 nt, Homo sapiens
gcaaaugguacagcuacuuu

SEQ ID NO: 34569 - RNA, 25 nt, Homo sapiens
aaggagcucagaagcccugcccagc

SEQ ID NO: 34570 - RNA, 21 nt, Homo sapiens
gaaggaagugagugcagccac

SEQ ID NO: 34571 - RNA, 23 nt, Homo sapiens
uguaggcuggggauaaaugaaua

SEQ ID NO: 34572 - RNA, 21 nt, Homo sapiens
gagcugcauccuggcuccggg

SEQ ID NO: 34573 - RNA, 21 nt, Homo sapiens
ccccucccagccucccugcca

SEQ ID NO: 34574 - RNA, 22 nt, Homo sapiens
cugggggcggcacaggggcuca

SEQ ID NO: 34575 - RNA, 27 nt, Homo sapiens
uuuagcacagugcuuauacaagaaggu

SEQ ID NO: 34576 - RNA, 22 nt, Homo sapiens
ugaagaagggggggaagggcgu

SEQ ID NO: 34577 - RNA, 22 nt, Homo sapiens
ucaggaacugccuuucucucca

SEQ ID NO: 34578 - RNA, 21 nt, Homo sapiens
gaccaaucgccguccccgccg

SEQ ID NO: 34579 - RNA, 21 nt, Homo sapiens
gcggaacuuagccacugugaa

SEQ ID NO: 34580 - RNA, 21 nt, Homo sapiens
cucacucagauggccaacuca

SEQ ID NO: 34581 - RNA, 21 nt, Homo sapiens
ggacuauagaacuuucccccu

SEQ ID NO: 34582 - RNA, 22 nt, Homo sapiens
gcggucccgcggcgccccgccu

SEQ ID NO: 34583 - RNA, 21 nt, Homo sapiens
ccgugguucuacccuguggua

SEQ ID NO: 34584 - RNA, 21 nt, Homo sapiens
aggcggcaggcacaggacugg

SEQ ID NO: 34585 - RNA, 21 nt, Homo sapiens
agagcucauccauaguuguca

SEQ ID NO: 34586 - RNA, 23 nt, Homo sapiens
gaaacccagcagacaauguagcu

SEQ ID NO: 34587 - RNA, 23 nt, Homo sapiens
acauuuuucguuauugcucuuga

SEQ ID NO: 34588 - RNA, 22 nt, Homo sapiens
acacaccaaggauaauuucucc

SEQ ID NO: 34589 - RNA, 22 nt, Homo sapiens
uggggacccucccugaaccaag

SEQ ID NO: 34590 - RNA, 21 nt, Homo sapiens
ugacugacagcuuuuugagua

SEQ ID NO: 34591 - RNA, 27 nt, Homo sapiens
uuuagcacagugcuuauacaagaaggu

SEQ ID NO: 34592 - RNA, 21 nt, Homo sapiens
gcaagcccagaccgcaaaaag

SEQ ID NO: 34593 - RNA, 23 nt, Homo sapiens
ucacauaggaauaaaaagccaua

SEQ ID NO: 34594 - RNA, 23 nt, Homo sapiens
accccuaucacgauuagcauuaa

SEQ ID NO: 34595 - RNA, 22 nt, Homo sapiens
gaaccuaucuccccucuggacc

SEQ ID NO: 34596 - RNA, 22 nt, Homo sapiens
uaaccgauuucagauggugcua

SEQ ID NO: 34597 - RNA, 18 nt, Homo sapiens
acccucugaaaggaagca

SEQ ID NO: 34598 - RNA, 22 nt, Homo sapiens
aaagugcuucuuaccuccagau

SEQ ID NO: 34599 - RNA, 22 nt, Homo sapiens
acgguccuacacucaaggcaug

SEQ ID NO: 34600 - RNA, 22 nt, Homo sapiens
aaaguaacugcaguuuuugcua

SEQ ID NO: 34601 - RNA, 23 nt, Homo sapiens
guucuguccuggaagaacauacu

SEQ ID NO: 34602 - RNA, 21 nt, Homo sapiens
agaaguagaccauguguccua

SEQ ID NO: 34603 - RNA, 21 nt, Homo sapiens
cugggggacggagcagaagga

SEQ ID NO: 34604 - RNA, 21 nt, Homo sapiens
agggcucaucuugguccugca

SEQ ID NO: 34605 - RNA, 22 nt, Homo sapiens
agagcaagaccccgucucuaaa

SEQ ID NO: 34606 - RNA, 18 nt, Homo sapiens
auucaaucuacugccuca

SEQ ID NO: 34607 - RNA, 21 nt, Homo sapiens
guccugagagcgcugccuccu

SEQ ID NO: 34608 - RNA, 21 nt, Homo sapiens
ggggagcgggggcccugccuu

SEQ ID NO: 34609 - RNA, 22 nt, Homo sapiens
ucaggaacugccuuucucucca

SEQ ID NO: 34610 - RNA, 21 nt, Homo sapiens
gaccaaucgccguccccgccg

SEQ ID NO: 34611 - RNA, 22 nt, Homo sapiens
uccacauggaguugcuguuaca

SEQ ID NO: 34612 - RNA, 19 nt, Homo sapiens
uaugcuaccuuugcacggu

SEQ ID NO: 34613 - RNA, 22 nt, Homo sapiens
ucagaccgagacaagugcaaug

SEQ ID NO: 34614 - RNA, 22 nt, Homo sapiens
ugcaacuuaguaaugugcaaua

SEQ ID NO: 34615 - RNA, 22 nt, Homo sapiens
uacagauggauaccgugcaauu

SEQ ID NO: 34616 - RNA, 22 nt, Homo sapiens
ucaccauugcuaaagugcaauu

SEQ ID NO: 34617 - RNA, 22 nt, Homo sapiens
gcggucccgcggcgccccgccu

SEQ ID NO: 34618 - RNA, 22 nt, Homo sapiens
ugcuguuagcccuagccccgca

SEQ ID NO: 34619 - RNA, 22 nt, Homo sapiens
acaggccgggacaagugcaaua

SEQ ID NO: 34620 - RNA, 22 nt, Homo sapiens
ggaggccgggacgagugcaaua

SEQ ID NO: 34621 - RNA, 21 nt, Homo sapiens
cucccccacugcagcuggcac

SEQ ID NO: 34622 - RNA, 22 nt, Homo sapiens
cagaagugggccgggcacaggg

SEQ ID NO: 34623 - RNA, 23 nt, Homo sapiens
cagcugcuuuugggauuccguug

SEQ ID NO: 34624 - RNA, 22 nt, Homo sapiens
ucgcccucucaacccagcuuuu

SEQ ID NO: 34625 - RNA, 22 nt, Homo sapiens
uugcccucucaacccagcuuuu

SEQ ID NO: 34626 - RNA, 20 nt, Homo sapiens
acccucucaacccagcuuuu

SEQ ID NO: 34627 - RNA, 19 nt, Homo sapiens
uccucucaacccagcuuuu

SEQ ID NO: 34628 - RNA, 23 nt, Homo sapiens
acauuuuucguuauugcucuuga

SEQ ID NO: 34629 - RNA, 22 nt, Homo sapiens
uacagauggauaccgugcaauu

SEQ ID NO: 34630 - RNA, 25 nt, Homo sapiens
acggagcugucccaacaccaccccu

SEQ ID NO: 34631 - RNA, 22 nt, Homo sapiens
acacacccacgcgagccggaaa

SEQ ID NO: 34632 - RNA, 22 nt, Homo sapiens
cuggagagacaaggggaagagg

SEQ ID NO: 34633 - RNA, 22 nt, Homo sapiens
cacgaccgacgccacgccgagu

SEQ ID NO: 34634 - RNA, 21 nt, Homo sapiens
acuagacugugagcuccucga

SEQ ID NO: 34635 - RNA, 23 nt, Homo sapiens
cccaacagacauggcgguacuca

SEQ ID NO: 34636 - RNA, 21 nt, Homo sapiens
uucuaggauaggcccaggggc

SEQ ID NO: 34637 - RNA, 22 nt, Homo sapiens
gaauucaucacggccagccucu

SEQ ID NO: 34638 - RNA, 19 nt, Homo sapiens
guccugaauuccgcagccu

SEQ ID NO: 34639 - RNA, 22 nt, Homo sapiens
gcugaggcuguggggcuggagu

SEQ ID NO: 34640 - RNA, 18 nt, Homo sapiens
auucaaucuacugccuca

SEQ ID NO: 34641 - RNA, 23 nt, Homo sapiens
cccaacagacauggcgguacuca

SEQ ID NO: 34642 - RNA, 23 nt, Homo sapiens
acccuauaagcaauauugcacua

SEQ ID NO: 34643 - RNA, 23 nt, Homo sapiens
gaaagugcccucaaggcugagug

SEQ ID NO: 34644 - RNA, 19 nt, Homo sapiens
gccugcugacaccgugccu

SEQ ID NO: 34645 - RNA, 23 nt, Homo sapiens
cacugugggcccucuccgcacca

SEQ ID NO: 34646 - RNA, 22 nt, Homo sapiens
uauccacuacaccccgcugccu

SEQ ID NO: 34647 - RNA, 22 nt, Homo sapiens
caaacaccauugucacacucca

SEQ ID NO: 34648 - RNA, 24 nt, Homo sapiens
acugcuggucuucagucagggcca

SEQ ID NO: 34649 - RNA, 21 nt, Homo sapiens
gaccaaucgccguccccgccg

SEQ ID NO: 34650 - RNA, 22 nt, Homo sapiens
uggcagcagcggagggggcaga

SEQ ID NO: 34651 - RNA, 20 nt, Homo sapiens
cccgccgcgucgcccugggg

SEQ ID NO: 34652 - RNA, 20 nt, Homo sapiens
ccagcagcaccuggggcagu

SEQ ID NO: 34653 - RNA, 22 nt, Homo sapiens
acggaagggcagagagggccag

SEQ ID NO: 34654 - RNA, 22 nt, Homo sapiens
acaaccagcuaagacacugcca

SEQ ID NO: 34655 - RNA, 23 nt, Homo sapiens
gcaaucagcuaacuacacugccu

SEQ ID NO: 34656 - RNA, 22 nt, Homo sapiens
auaaggauuuuuaggggcauua

SEQ ID NO: 34657 - RNA, 22 nt, Homo sapiens
accagcuaacaauacacugcca

SEQ ID NO: 34658 - RNA, 22 nt, Homo sapiens
gccagcuaacaauacacugccu

SEQ ID NO: 34659 - RNA, 22 nt, Homo sapiens
gccagcuaacaauacacugccu

SEQ ID NO: 34660 - RNA, 21 nt, Homo sapiens
auccuguacugagcugccccg

SEQ ID NO: 34661 - RNA, 22 nt, Homo sapiens
gugauugccacucuccugagua

SEQ ID NO: 34662 - RNA, 19 nt, Homo sapiens
gcucuaagaaagccacacu

SEQ ID NO: 34663 - RNA, 21 nt, Homo sapiens
gaaggaagugagugcagccac

SEQ ID NO: 34664 - RNA, 22 nt, Homo sapiens
gcggucccgcggcgccccgccu

SEQ ID NO: 34665 - RNA, 20 nt, Homo sapiens
uacugcuuccacagcucccc

SEQ ID NO: 34666 - RNA, 22 nt, Homo sapiens
acacacccacgcgagccggaaa

SEQ ID NO: 34667 - RNA, 22 nt, Homo sapiens
cacaucucacuguagccucaaa

SEQ ID NO: 34668 - RNA, 22 nt, Homo sapiens
cccaacaacaugaaacuaccua

SEQ ID NO: 34669 - RNA, 22 nt, Homo sapiens
cccaacaacaggaaacuaccua

SEQ ID NO: 34670 - RNA, 22 nt, Homo sapiens
acugccugucugugccugcugu

SEQ ID NO: 34671 - RNA, 22 nt, Homo sapiens
uaaccgauuucagauggugcua

SEQ ID NO: 34672 - RNA, 23 nt, Homo sapiens
aacacugauuucaaauggugcua

SEQ ID NO: 34673 - RNA, 22 nt, Homo sapiens
uaaccgauuucaaauggugcua

SEQ ID NO: 34674 - RNA, 22 nt, Homo sapiens
uacagauggauaccgugcaauu

SEQ ID NO: 34675 - RNA, 22 nt, Homo sapiens
accagguuccaccccagcaggc

SEQ ID NO: 34676 - RNA, 22 nt, Homo sapiens
gguucaguuguucaaccaguua

SEQ ID NO: 34677 - RNA, 24 nt, Homo sapiens
cacccccagagccucagcucccca

SEQ ID NO: 34678 - RNA, 22 nt, Homo sapiens
cugggggcggcacaggggcuca

SEQ ID NO: 34679 - RNA, 18 nt, Homo sapiens
caccaccagagccaacgu

SEQ ID NO: 34680 - RNA, 22 nt, Homo sapiens
acaccuggcuccacacgcgggc

SEQ ID NO: 34681 - RNA, 21 nt, Homo sapiens
gaccaaucgccguccccgccg

SEQ ID NO: 34682 - RNA, 19 nt, Homo sapiens
guccugaauuccgcagccu

SEQ ID NO: 34683 - RNA, 23 nt, Homo sapiens
ccuagagagggugagaaccugcc

SEQ ID NO: 34684 - RNA, 22 nt, Homo sapiens
gcggucccgcggcgccccgccu

SEQ ID NO: 34685 - RNA, 22 nt, Homo sapiens
ugcuguuagcccuagccccgca

SEQ ID NO: 34686 - RNA, 22 nt, Homo sapiens
acacacccacgcgagccggaaa

SEQ ID NO: 34687 - RNA, 23 nt, Homo sapiens
ggaagccaucaagucgcugcagg

SEQ ID NO: 34688 - RNA, 21 nt, Homo sapiens
cugaggagagaggaggugggg

SEQ ID NO: 34689 - RNA, 22 nt, Homo sapiens
gcacaaaucuccagaccaccca

SEQ ID NO: 34690 - RNA, 22 nt, Homo sapiens
uagucaagugaagcagugggag

SEQ ID NO: 34691 - RNA, 22 nt, Homo sapiens
ucagaccgagacaagugcaaug

SEQ ID NO: 34692 - RNA, 21 nt, Homo sapiens
ccuacguuccauagucuacca

SEQ ID NO: 34693 - RNA, 21 nt, Homo sapiens
ugcaugacggccugcaagaca

SEQ ID NO: 34694 - RNA, 23 nt, Homo sapiens
aagaaucuugucccgcagguccu

SEQ ID NO: 34695 - RNA, 23 nt, Homo sapiens
acccucuauagggaagcgcguuc

SEQ ID NO: 34696 - RNA, 22 nt, Homo sapiens
ugcaagccuugggugugggagg

SEQ ID NO: 34697 - RNA, 22 nt, Homo sapiens
aguccagauucugugcccacca

SEQ ID NO: 34698 - RNA, 25 nt, Homo sapiens
acggagcugucccaacaccaccccu

SEQ ID NO: 34699 - RNA, 22 nt, Homo sapiens
gcacauguucugcggcccacca

SEQ ID NO: 34700 - RNA, 25 nt, Homo sapiens
accaacggaccuacuucccuccgcc

SEQ ID NO: 34701 - RNA, 22 nt, Homo sapiens
caaacaccauugucacacucca

SEQ ID NO: 34702 - RNA, 20 nt, Homo sapiens
aagcagaaaaaggcaaacga

SEQ ID NO: 34703 - RNA, 22 nt, Homo sapiens
aggucucacuuuguugcccaga

SEQ ID NO: 34704 - RNA, 22 nt, Homo sapiens
cucagagcagacgugguucuca

SEQ ID NO: 34705 - RNA, 25 nt, Homo sapiens
aaggagcucagaagcccugcccagc

SEQ ID NO: 34706 - RNA, 22 nt, Homo sapiens
gcugaggcuguggggcuggagu

SEQ ID NO: 34707 - RNA, 22 nt, Homo sapiens
caaacaccauugucacacucca

SEQ ID NO: 34708 - RNA, 21 nt, Homo sapiens
uuccacgaccuaauccuaacu

SEQ ID NO: 34709 - RNA, 21 nt, Homo sapiens
gaccaaucgccguccccgccg

SEQ ID NO: 34710 - RNA, 22 nt, Homo sapiens
gcggucccgcggcgccccgccu

SEQ ID NO: 34711 - RNA, 22 nt, Homo sapiens
cugggggcggcacaggggcuca

SEQ ID NO: 34712 - RNA, 22 nt, Homo sapiens
caaacaccauugucacacucca

SEQ ID NO: 34713 - RNA, 21 nt, Homo sapiens
cugcugggccacaacguggga

SEQ ID NO: 34714 - RNA, 22 nt, Homo sapiens
ggcagagagucagagcgcggau

SEQ ID NO: 34715 - RNA, 22 nt, Homo sapiens
aaccauacaaccuacuaccuca

SEQ ID NO: 34716 - RNA, 22 nt, Homo sapiens
ucucucccauuagaguugaaaa

SEQ ID NO: 34717 - RNA, 21 nt, Homo sapiens
gcggaacuuagccacugugaa

SEQ ID NO: 34718 - RNA, 21 nt, Homo sapiens
gcagaacuuagccacugugaa

SEQ ID NO: 34719 - RNA, 22 nt, Homo sapiens
accagcuaacaauacacugcca

SEQ ID NO: 34720 - RNA, 22 nt, Homo sapiens
agccacaaucaccuucugaucu

SEQ ID NO: 34721 - RNA, 24 nt, Homo sapiens
cagaaagugcuuucuuuuggagaa

SEQ ID NO: 34722 - RNA, 22 nt, Homo sapiens
aacacucuaaaaggaggcacuu

SEQ ID NO: 34723 - RNA, 22 nt, Homo sapiens
ccucuaguaaauaugucagcau

SEQ ID NO: 34724 - RNA, 22 nt, Homo sapiens
augcccuuucaucauugcacug

SEQ ID NO: 34725 - RNA, 22 nt, Homo sapiens
uagucaagugaagcagugggag

SEQ ID NO: 34726 - RNA, 22 nt, Homo sapiens
uauggaugcaaaaugaucccaa

SEQ ID NO: 34727 - RNA, 22 nt, Homo sapiens
ugcaagccuugggugugggagg

SEQ ID NO: 34728 - RNA, 22 nt, Homo sapiens
acaaaauccacaauuacuuuug

SEQ ID NO: 34729 - RNA, 20 nt, Homo sapiens
ugggccaccgccgagcggac

SEQ ID NO: 34730 - RNA, 23 nt, Homo sapiens
aaccaagaccccggagaucccag

SEQ ID NO: 34731 - RNA, 22 nt, Homo sapiens
uggcagcagcggagggggcaga

SEQ ID NO: 34732 - RNA, 20 nt, Homo sapiens
ccagcagcaccuggggcagu

SEQ ID NO: 34733 - RNA, 22 nt, Homo sapiens
auaaggauuuuuaggggcauua

SEQ ID NO: 34734 - RNA, 21 nt, Homo sapiens
auccuguacugagcugccccg

SEQ ID NO: 34735 - RNA, 22 nt, Homo sapiens
caaacaccauugucacacucca

SEQ ID NO: 34736 - RNA, 22 nt, Homo sapiens
acaaaguucugugaugcacuga

SEQ ID NO: 34737 - RNA, 21 nt, Homo sapiens
gaccaaucgccguccccgccg

SEQ ID NO: 34738 - RNA, 22 nt, Homo sapiens
uggcagcagcggagggggcaga

SEQ ID NO: 34739 - RNA, 22 nt, Homo sapiens
ucaacaucagucugauaagcua

SEQ ID NO: 34740 - RNA, 20 nt, Homo sapiens
ccagcagcaccuggggcagu

SEQ ID NO: 34741 - RNA, 20 nt, Homo sapiens
agugcccccacaguuugagu

SEQ ID NO: 34742 - RNA, 23 nt, Homo sapiens
aaagucucgcucucugccccuca

SEQ ID NO: 34743 - RNA, 21 nt, Homo sapiens
auccuguacugagcugccccg

SEQ ID NO: 34744 - RNA, 21 nt, Homo sapiens
cucacucagauggccaacuca

SEQ ID NO: 34745 - RNA, 22 nt, Homo sapiens
gcggucccgcggcgccccgccu

SEQ ID NO: 34746 - RNA, 22 nt, Homo sapiens
ugcuguuagcccuagccccgca

SEQ ID NO: 34747 - RNA, 21 nt, Homo sapiens
ugacugacagcuuuuugagua

SEQ ID NO: 34748 - RNA, 21 nt, Homo sapiens
ugcaggcugaucuucuucucu

SEQ ID NO: 34749 - RNA, 22 nt, Homo sapiens
ccaguagcacggcucaguccag

SEQ ID NO: 34750 - RNA, 22 nt, Homo sapiens
acaguucuucaacuggcagcuu

SEQ ID NO: 34751 - RNA, 22 nt, Homo sapiens
cuuccagucgaggauguuuaca

SEQ ID NO: 34752 - RNA, 22 nt, Homo sapiens
cuuccagucggggauguuuaca

SEQ ID NO: 34753 - RNA, 22 nt, Homo sapiens
cuuccagucaaggauguuuaca

SEQ ID NO: 34754 - RNA, 22 nt, Homo sapiens
ucgcccucucaacccagcuuuu

SEQ ID NO: 34755 - RNA, 22 nt, Homo sapiens
uugcccucucaacccagcuuuu

SEQ ID NO: 34756 - RNA, 20 nt, Homo sapiens
acccucucaacccagcuuuu

SEQ ID NO: 34757 - RNA, 19 nt, Homo sapiens
uccucucaacccagcuuuu

SEQ ID NO: 34758 - RNA, 20 nt, Homo sapiens
cuggaggaagggcccagagg

SEQ ID NO: 34759 - RNA, 22 nt, Homo sapiens
gccuaagacacaggcccagaga

SEQ ID NO: 34760 - RNA, 22 nt, Homo sapiens
auaaggauuuuuaggggcauua

SEQ ID NO: 34761 - RNA, 20 nt, Homo sapiens
agugcccccacaguuugagu

SEQ ID NO: 34762 - RNA, 21 nt, Homo sapiens
guguauaugcccauggacugc

SEQ ID NO: 34763 - RNA, 22 nt, Homo sapiens
cacauggccaaaacagagaaga

SEQ ID NO: 34764 - RNA, 21 nt, Homo sapiens
gagcugcauccuggcuccggg

SEQ ID NO: 34765 - RNA, 21 nt, Homo sapiens
gagcuacagugcuucaucuca

SEQ ID NO: 34766 - RNA, 23 nt, Homo sapiens
gggagugaagacacggagccaga

SEQ ID NO: 34767 - RNA, 22 nt, Homo sapiens
uccacauggaguugcuguuaca

SEQ ID NO: 34768 - RNA, 20 nt, Homo sapiens
cuggaggaagggcccagagg

SEQ ID NO: 34769 - RNA, 22 nt, Homo sapiens
gccuaagacacaggcccagaga

SEQ ID NO: 34770 - RNA, 19 nt, Homo sapiens
gccugcugacaccgugccu

SEQ ID NO: 34771 - RNA, 23 nt, Homo sapiens
cuaccugcacuguaagcacuuuu

SEQ ID NO: 34772 - RNA, 22 nt, Homo sapiens
gugggguggguggucaggccga

SEQ ID NO: 34773 - RNA, 18 nt, Homo sapiens
uggcgccugaacagggac

SEQ ID NO: 34774 - RNA, 24 nt, Homo sapiens
gaaagugcauagaauucugucugg

SEQ ID NO: 34775 - RNA, 22 nt, Homo sapiens
ccaucuuuaccagacaguguua

SEQ ID NO: 34776 - RNA, 21 nt, Homo sapiens
gggcaucugggacgcgcagga

SEQ ID NO: 34777 - RNA, 22 nt, Homo sapiens
acaucguuaccagacaguguua

SEQ ID NO: 34778 - RNA, 21 nt, Homo sapiens
gugacagagccaagcacaaau

SEQ ID NO: 34779 - RNA, 22 nt, Homo sapiens
ucagaccgagacaagugcaaug

SEQ ID NO: 34780 - RNA, 22 nt, Homo sapiens
ugcaacuuaguaaugugcaaua

SEQ ID NO: 34781 - RNA, 23 nt, Homo sapiens
cgugagcuccuggaggacaggga

SEQ ID NO: 34782 - RNA, 22 nt, Homo sapiens
uacagauggauaccgugcaauu

SEQ ID NO: 34783 - RNA, 22 nt, Homo sapiens
ucaccauugcuaaagugcaauu

SEQ ID NO: 34784 - RNA, 22 nt, Homo sapiens
gauagagugcagaccagggucu

SEQ ID NO: 34785 - RNA, 25 nt, Homo sapiens
accaacggaccuacuucccuccgcc

SEQ ID NO: 34786 - RNA, 22 nt, Homo sapiens
acaggccgggacaagugcaaua

SEQ ID NO: 34787 - RNA, 22 nt, Homo sapiens
ggaggccgggacgagugcaaua

SEQ ID NO: 34788 - RNA, 22 nt, Homo sapiens
acacacccacgcgagccggaaa

SEQ ID NO: 34789 - RNA, 21 nt, Homo sapiens
cggcucggguggcggcgacgg

SEQ ID NO: 34790 - RNA, 21 nt, Homo sapiens
cugaggagagaggaggugggg

SEQ ID NO: 34791 - RNA, 18 nt, Homo sapiens
ugguggcagaggugggau

SEQ ID NO: 34792 - RNA, 23 nt, Homo sapiens
cccaacagacauggcgguacuca

SEQ ID NO: 34793 - RNA, 22 nt, Homo sapiens
cgggacguccagacucaacucu

SEQ ID NO: 34794 - RNA, 20 nt, Homo sapiens
gcaaugcaacagcaaugcac

SEQ ID NO: 34795 - RNA, 22 nt, Homo sapiens
aacgcuccaaaagaaggcacuc

SEQ ID NO: 34796 - RNA, 22 nt, Homo sapiens
aacacucuaaaaggaggcacuu

SEQ ID NO: 34797 - RNA, 20 nt, Homo sapiens
cccugcgccaucuccucuac

SEQ ID NO: 34798 - RNA, 17 nt, Homo sapiens
ggguggcagcgguggga

SEQ ID NO: 34799 - RNA, 23 nt, Homo sapiens
gggagugaagacacggagccaga

SEQ ID NO: 34800 - RNA, 22 nt, Homo sapiens
aguccagauucugugcccacca

SEQ ID NO: 34801 - RNA, 22 nt, Homo sapiens
gcacauguucugcggcccacca

SEQ ID NO: 34802 - RNA, 22 nt, Homo sapiens
gcggucccgcggcgccccgccu

SEQ ID NO: 34803 - RNA, 22 nt, Homo sapiens
ugcuguuagcccuagccccgca

SEQ ID NO: 34804 - RNA, 22 nt, Homo sapiens
ugaagaagggggggaagggcgu

SEQ ID NO: 34805 - RNA, 22 nt, Homo sapiens
aggucucacuuuguugcccaga

SEQ ID NO: 34806 - RNA, 23 nt, Homo sapiens
acaccaaugcccuaggggaugcg

SEQ ID NO: 34807 - RNA, 22 nt, Homo sapiens
caacaaaaucacugaugcugga

SEQ ID NO: 34808 - RNA, 22 nt, Homo sapiens
ucaccauugcuaaagugcaauu

SEQ ID NO: 34809 - RNA, 25 nt, Homo sapiens
aaggagcucagaagcccugcccagc

SEQ ID NO: 34810 - RNA, 22 nt, Homo sapiens
uauccacuacaccccgcugccu

SEQ ID NO: 34811 - RNA, 22 nt, Homo sapiens
acuggguucaccuuuaagggca

SEQ ID NO: 34812 - RNA, 24 nt, Homo sapiens
acugcaggcuccagcuuccaggcu

SEQ ID NO: 34813 - RNA, 17 nt, Homo sapiens
gacagccucucccccac

SEQ ID NO: 34814 - RNA, 17 nt, Homo sapiens
gggagaggaggaggcga

SEQ ID NO: 34815 - RNA, 19 nt, Homo sapiens
uaugcuaccuuugcacggu

SEQ ID NO: 34816 - RNA, 22 nt, Homo sapiens
ucagaccgagacaagugcaaug

SEQ ID NO: 34817 - RNA, 22 nt, Homo sapiens
aacacucuaaagggaugcacga

SEQ ID NO: 34818 - RNA, 21 nt, Homo sapiens
acuccaaagggaagcgccuuc

SEQ ID NO: 34819 - RNA, 22 nt, Homo sapiens
cgcucuaaagggaagcgccuuc

SEQ ID NO: 34820 - RNA, 23 nt, Homo sapiens
ggacauuguuucagugcccaagu

SEQ ID NO: 34821 - RNA, 22 nt, Homo sapiens
uccggggacgaacgggacgggu

SEQ ID NO: 34822 - RNA, 23 nt, Homo sapiens
gggagugaagacacggagccaga

SEQ ID NO: 34823 - RNA, 23 nt, Homo sapiens
cuaucugcacuagaugcaccuua

SEQ ID NO: 34824 - RNA, 22 nt, Homo sapiens
gauagagugcagaccagggucu

SEQ ID NO: 34825 - RNA, 19 nt, Homo sapiens
gccugcugacaccgugccu

SEQ ID NO: 34826 - RNA, 20 nt, Homo sapiens
uccccacagacccagagccg

SEQ ID NO: 34827 - RNA, 23 nt, Homo sapiens
agaaaccaugggguaugagcaga

SEQ ID NO: 34828 - RNA, 22 nt, Homo sapiens
ggaggccgggacgagugcaaua

SEQ ID NO: 34829 - RNA, 20 nt, Homo sapiens
cugcgggaggacagggcuca

SEQ ID NO: 34830 - RNA, 22 nt, Homo sapiens
ucccucacacagaauuccagaa

SEQ ID NO: 34831 - RNA, 21 nt, Homo sapiens
acaggauugagggggggcccu

SEQ ID NO: 34832 - RNA, 23 nt, Homo sapiens
aaagucucgcucucugccccuca

SEQ ID NO: 34833 - RNA, 23 nt, Homo sapiens
aagaaucuugucccgcagguccu

SEQ ID NO: 34834 - RNA, 23 nt, Homo sapiens
acacucuaaagagaagcgcuuug

SEQ ID NO: 34835 - RNA, 21 nt, Homo sapiens
agaaaguacuucccucuggag

SEQ ID NO: 34836 - RNA, 21 nt, Homo sapiens
agaaagugcaucccucuggag

SEQ ID NO: 34837 - RNA, 22 nt, Homo sapiens
gccaccuucaaaugggaagucu

SEQ ID NO: 34838 - RNA, 24 nt, Homo sapiens
acugggcacaaacauguccagguc

SEQ ID NO: 34839 - RNA, 20 nt, Homo sapiens
uccccacagacccagagccg

SEQ ID NO: 34840 - RNA, 22 nt, Homo sapiens
ucggucccucgggccagggcag

SEQ ID NO: 34841 - RNA, 22 nt, Homo sapiens
cugggggcggcacaggggcuca

SEQ ID NO: 34842 - RNA, 22 nt, Homo sapiens
acuccaacagggccgcgucucc

SEQ ID NO: 34843 - RNA, 23 nt, Homo sapiens
gggagugaagacacggagccaga

SEQ ID NO: 34844 - RNA, 22 nt, Homo sapiens
uggcagcagcggagggggcaga

SEQ ID NO: 34845 - RNA, 22 nt, Homo sapiens
agcugaguguaggauguuuaca

SEQ ID NO: 34846 - RNA, 20 nt, Homo sapiens
ccagcagcaccuggggcagu

SEQ ID NO: 34847 - RNA, 23 nt, Homo sapiens
agaggcaggcaugcgggcagaca

SEQ ID NO: 34848 - RNA, 22 nt, Homo sapiens
gaauucaucacggccagccucu

SEQ ID NO: 34849 - RNA, 23 nt, Homo sapiens
acacucuaaagagaagcgcuuug

SEQ ID NO: 34850 - RNA, 21 nt, Homo sapiens
agaaaguacuucccucuggag

SEQ ID NO: 34851 - RNA, 21 nt, Homo sapiens
agaaagugcaucccucuggag

SEQ ID NO: 34852 - RNA, 21 nt, Homo sapiens
cugaaaccaaguaugggucgc

SEQ ID NO: 34853 - RNA, 21 nt, Homo sapiens
guucuaacccauuguggccaa

SEQ ID NO: 34854 - RNA, 21 nt, Homo sapiens
gcuccaaccucagcagacugu

SEQ ID NO: 34855 - RNA, 22 nt, Homo sapiens
accuucccugguacagaauacu

SEQ ID NO: 34856 - RNA, 20 nt, Homo sapiens
uccccacagacccagagccg

SEQ ID NO: 34857 - RNA, 23 nt, Homo sapiens
gggagugaagacacggagccaga

SEQ ID NO: 34858 - RNA, 22 nt, Homo sapiens
agcccaaaaggagaauucuuug

SEQ ID NO: 34859 - RNA, 20 nt, Homo sapiens
cccgccgcgucgcccugggg

SEQ ID NO: 34860 - RNA, 21 nt, Homo sapiens
aucugcacugucagcacuuua

SEQ ID NO: 34861 - RNA, 23 nt, Homo sapiens
gcuuugacaauaucauugcacug

SEQ ID NO: 34862 - RNA, 22 nt, Homo sapiens
ugcaagccuugggugugggagg

SEQ ID NO: 34863 - RNA, 23 nt, Homo sapiens
ccaccuggcaagaacaggcguuc

SEQ ID NO: 34864 - RNA, 23 nt, Homo sapiens
uggcccugacacgugguacugga

SEQ ID NO: 34865 - RNA, 22 nt, Homo sapiens
uggugauucacaaagaaaucca

SEQ ID NO: 34866 - RNA, 23 nt, Homo sapiens
ggaagccaucaagucgcugcagg

SEQ ID NO: 34867 - RNA, 20 nt, Homo sapiens
cucaaagcaaacccugcaga

SEQ ID NO: 34868 - RNA, 20 nt, Homo sapiens
cucaaagcaaacccugcaga

SEQ ID NO: 34869 - RNA, 20 nt, Homo sapiens
cuggggaaaaggguggcacg

SEQ ID NO: 34870 - RNA, 18 nt, Homo sapiens
cccccaccaccacgcccg

SEQ ID NO: 34871 - RNA, 23 nt, Homo sapiens
gggagugaagacacggagccaga

SEQ ID NO: 34872 - RNA, 22 nt, Homo sapiens
acucaccgacagguugaauguu

SEQ ID NO: 34873 - RNA, 18 nt, Homo sapiens
ggagaggagggcacugga

SEQ ID NO: 34874 - RNA, 22 nt, Homo sapiens
accuaauauaucaaacauauca

SEQ ID NO: 34875 - RNA, 23 nt, Homo sapiens
ccacccaaugaccuacuccaaga

SEQ ID NO: 34876 - RNA, 21 nt, Homo sapiens
caucaccuuccuucuccucca

SEQ ID NO: 34877 - RNA, 22 nt, Homo sapiens
agaaagcgcuuuccuuuguaga

SEQ ID NO: 34878 - RNA, 23 nt, Homo sapiens
ucacauaggaaugaaaagccaua

SEQ ID NO: 34879 - RNA, 22 nt, Homo sapiens
ugagccacugugccuggccuga

SEQ ID NO: 34880 - RNA, 21 nt, Homo sapiens
uucuaggauaggcccaggggc

SEQ ID NO: 34881 - RNA, 23 nt, Homo sapiens
cugcagaacuguucccgcugcua

SEQ ID NO: 34882 - RNA, 24 nt, Homo sapiens
acgcgcaggccagagacccaggca

SEQ ID NO: 34883 - RNA, 21 nt, Homo sapiens
cacaaccucaguguuuccagg

SEQ ID NO: 34884 - RNA, 20 nt, Homo sapiens
uacugcuuccacagcucccc

SEQ ID NO: 34885 - RNA, 26 nt, Homo sapiens
uuucagaauuugcugccaucaucauc

SEQ ID NO: 34886 - RNA, 22 nt, Homo sapiens
ccaucuuuaccagacaguguua

SEQ ID NO: 34887 - RNA, 22 nt, Homo sapiens
uucacacugcaugcucugggua

SEQ ID NO: 34888 - RNA, 22 nt, Homo sapiens
cagacuccgguggaaugaagga

SEQ ID NO: 34889 - RNA, 23 nt, Homo sapiens
ucucugcaggccgugugcuuugc

SEQ ID NO: 34890 - RNA, 23 nt, Homo sapiens
acccuauaagcaauauugcacua

SEQ ID NO: 34891 - RNA, 23 nt, Homo sapiens
ccuucucagaaaggugaaauuua

SEQ ID NO: 34892 - RNA, 23 nt, Homo sapiens
gggccgcagcugucgcccguguc

SEQ ID NO: 34893 - RNA, 20 nt, Homo sapiens
acaaugagaacccauggucu

SEQ ID NO: 34894 - RNA, 22 nt, Homo sapiens
caaacaccauugucacacucca

SEQ ID NO: 34895 - RNA, 22 nt, Homo sapiens
cacauggccaaaacagagaaga

SEQ ID NO: 34896 - RNA, 20 nt, Homo sapiens
cugcgggaggacagggcuca

SEQ ID NO: 34897 - RNA, 22 nt, Homo sapiens
ucccucacacagaauuccagaa

SEQ ID NO: 34898 - RNA, 22 nt, Homo sapiens
augcuuuuugggguaagggcuu

SEQ ID NO: 34899 - RNA, 21 nt, Homo sapiens
cggggugcacgggcggagggc

SEQ ID NO: 34900 - RNA, 23 nt, Homo sapiens
aggaacagcagcagcccgggccg

SEQ ID NO: 34901 - RNA, 22 nt, Homo sapiens
ucagaccgagacaagugcaaug

SEQ ID NO: 34902 - RNA, 23 nt, Homo sapiens
aaagucucgcucucugccccuca

SEQ ID NO: 34903 - RNA, 25 nt, Homo sapiens
accaacggaccuacuucccuccgcc

SEQ ID NO: 34904 - RNA, 20 nt, Homo sapiens
ggggggcgaggcagguguga

SEQ ID NO: 34905 - RNA, 23 nt, Homo sapiens
gggagugaagacacggagccaga

SEQ ID NO: 34906 - RNA, 20 nt, Homo sapiens
uucccaugcccuauaccucu

SEQ ID NO: 34907 - RNA, 22 nt, Homo sapiens
ucaacaucagucugauaagcua

SEQ ID NO: 34908 - RNA, 22 nt, Homo sapiens
aaagagguuaaccagguguguu

SEQ ID NO: 34909 - RNA, 21 nt, Homo sapiens
ugcaaugcaacuacaaugcac

SEQ ID NO: 34910 - RNA, 21 nt, Homo sapiens
ugacugcagagcaaaagacac

SEQ ID NO: 34911 - RNA, 22 nt, Homo sapiens
acaaaauccacaauuacuuuug

SEQ ID NO: 34912 - RNA, 19 nt, Homo sapiens
gcuccuguccaacuggcuc

SEQ ID NO: 34913 - RNA, 21 nt, Homo sapiens
aguucucccaacguaaaccca

SEQ ID NO: 34914 - RNA, 22 nt, Homo sapiens
caccugauaaaacugagguaua

SEQ ID NO: 34915 - RNA, 22 nt, Homo sapiens
ucuacccagaaaggagccagug

SEQ ID NO: 34916 - RNA, 20 nt, Homo sapiens
ggcauucaccgcgugccuua

SEQ ID NO: 34917 - RNA, 17 nt, Homo sapiens
ggguggcagcgguggga

SEQ ID NO: 34918 - RNA, 20 nt, Homo sapiens
cccgccgcgucgcccugggg

SEQ ID NO: 34919 - RNA, 22 nt, Homo sapiens
gaaccuaucuccccucuggacc

SEQ ID NO: 34920 - RNA, 22 nt, Homo sapiens
ucaacaucagucugauaagcua

SEQ ID NO: 34921 - RNA, 21 nt, Homo sapiens
aucugcacugucagcacuuua

SEQ ID NO: 34922 - RNA, 23 nt, Homo sapiens
gcuuugacaauaucauugcacug

SEQ ID NO: 34923 - RNA, 23 nt, Homo sapiens
gaaaaacgcccccuggcuugaaa

SEQ ID NO: 34924 - RNA, 21 nt, Homo sapiens
ucuacucagaagggugccuua

SEQ ID NO: 34925 - RNA, 23 nt, Homo sapiens
acacucuaaagagaagcgcuuug

SEQ ID NO: 34926 - RNA, 21 nt, Homo sapiens
agaaaguacuucccucuggag

SEQ ID NO: 34927 - RNA, 21 nt, Homo sapiens
agaaagugcaucccucuggag

SEQ ID NO: 34928 - RNA, 21 nt, Homo sapiens
guccugagagcgcugccuccu

SEQ ID NO: 34929 - RNA, 20 nt, Homo sapiens
aggggccucagccuccuggu

SEQ ID NO: 34930 - RNA, 21 nt, Homo sapiens
cacaaccucaguguuuccagg

SEQ ID NO: 34931 - RNA, 23 nt, Homo sapiens
ucacauaggaauaaaaagccaua

SEQ ID NO: 34932 - RNA, 22 nt, Homo sapiens
aacccauggaauucaguucuca

SEQ ID NO: 34933 - RNA, 22 nt, Homo sapiens
agccuauggaauucaguucuca

SEQ ID NO: 34934 - RNA, 22 nt, Homo sapiens
acaaaguucuguagugcacuga

SEQ ID NO: 34935 - RNA, 22 nt, Homo sapiens
cacugguacaaggguugggaga

SEQ ID NO: 34936 - RNA, 22 nt, Homo sapiens
cacaaaccauuaugugcugcua

SEQ ID NO: 34937 - RNA, 23 nt, Homo sapiens
gaaacccagcagacaauguagcu

SEQ ID NO: 34938 - RNA, 21 nt, Homo sapiens
aucugcacugucagcacuuua

SEQ ID NO: 34939 - RNA, 23 nt, Homo sapiens
gcuuugacaauaucauugcacug

SEQ ID NO: 34940 - RNA, 23 nt, Homo sapiens
acccuauaagcaauauugcacua

SEQ ID NO: 34941 - RNA, 22 nt, Homo sapiens
gcaaaaguaauugagauuuuug

SEQ ID NO: 34942 - RNA, 21 nt, Homo sapiens
cugaaaccaaguaugggucgc

SEQ ID NO: 34943 - RNA, 23 nt, Homo sapiens
gggagugaagacacggagccaga

SEQ ID NO: 34944 - RNA, 22 nt, Homo sapiens
acccuuaucaguucuccgucca

SEQ ID NO: 34945 - RNA, 22 nt, Homo sapiens
agcccaaaaggagaauucuuug

SEQ ID NO: 34946 - RNA, 21 nt, Homo sapiens
auccuguacugagcugccccg

SEQ ID NO: 34947 - RNA, 18 nt, Homo sapiens
acccucugaaaggaagca

SEQ ID NO: 34948 - RNA, 22 nt, Homo sapiens
aaagugcuucuuaccuccagau

SEQ ID NO: 34949 - RNA, 23 nt, Homo sapiens
ggacauuguuucagugcccaagu

SEQ ID NO: 34950 - RNA, 21 nt, Homo sapiens
ggggagcgggggcccugccuu

SEQ ID NO: 34951 - RNA, 20 nt, Homo sapiens
aagcagaaaaaggcaaacga

SEQ ID NO: 34952 - RNA, 22 nt, Homo sapiens
agaaagcgcuuuccuuuguaga

SEQ ID NO: 34953 - RNA, 22 nt, Homo sapiens
augcccuuuuaacauugcacug

SEQ ID NO: 34954 - RNA, 22 nt, Homo sapiens
augcccuuucaucauugcacug

SEQ ID NO: 34955 - RNA, 22 nt, Homo sapiens
acaaaguucuguagugcacuga

SEQ ID NO: 34956 - RNA, 22 nt, Homo sapiens
acaaaguucugugaugcacuga

SEQ ID NO: 34957 - RNA, 21 nt, Homo sapiens
ccaaguucugucaugcacuga

SEQ ID NO: 34958 - RNA, 23 nt, Homo sapiens
ucaguuuugcauagauuugcaca

SEQ ID NO: 34959 - RNA, 23 nt, Homo sapiens
ucaguuuugcauggauuugcaca

SEQ ID NO: 34960 - RNA, 22 nt, Homo sapiens
ucagaccgagacaagugcaaug

SEQ ID NO: 34961 - RNA, 21 nt, Homo sapiens
accuauccugaauuacuugaa

SEQ ID NO: 34962 - RNA, 23 nt, Homo sapiens
gcuuugacaauacuauugcacug

SEQ ID NO: 34963 - RNA, 23 nt, Homo sapiens
gcuuugacaauaucauugcacug

SEQ ID NO: 34964 - RNA, 23 nt, Homo sapiens
acccuauaagcaauauugcacua

SEQ ID NO: 34965 - RNA, 21 nt, Homo sapiens
uucacuccaaaaggugcaaaa

SEQ ID NO: 34966 - RNA, 23 nt, Homo sapiens
agacaaggcccacccgugcaaac

SEQ ID NO: 34967 - RNA, 21 nt, Homo sapiens
aagggucaguaagcacccgcg

SEQ ID NO: 34968 - RNA, 23 nt, Homo sapiens
cacaaauucggaucuacagggua

SEQ ID NO: 34969 - RNA, 23 nt, Homo sapiens
cacaaauucgguucuacagggua

SEQ ID NO: 34970 - RNA, 21 nt, Homo sapiens
cugaggagagaggaggugggg

SEQ ID NO: 34971 - RNA, 22 nt, Homo sapiens
caaacaccauugucacacucca

SEQ ID NO: 34972 - RNA, 22 nt, Homo sapiens
aggucucacuuuguugcccaga

SEQ ID NO: 34973 - RNA, 22 nt, Homo sapiens
cacgaccgacgccacgccgagu

SEQ ID NO: 34974 - RNA, 22 nt, Homo sapiens
ucaggaacugccuuucucucca

SEQ ID NO: 34975 - RNA, 22 nt, Homo sapiens
ucagaccgagacaagugcaaug

SEQ ID NO: 34976 - RNA, 21 nt, Homo sapiens
gcggaacuuagccacugugaa

SEQ ID NO: 34977 - RNA, 23 nt, Homo sapiens
cgugagcuccuggaggacaggga

SEQ ID NO: 34978 - RNA, 23 nt, Homo sapiens
aaagucucgcucucugccccuca

SEQ ID NO: 34979 - RNA, 22 nt, Homo sapiens
aguccagauucugugcccacca

SEQ ID NO: 34980 - RNA, 21 nt, Homo sapiens
aucagagguucagcuuacccu

SEQ ID NO: 34981 - RNA, 20 nt, Homo sapiens
ugggccaccgccgagcggac

SEQ ID NO: 34982 - RNA, 25 nt, Homo sapiens
aaggagcucagaagcccugcccagc

SEQ ID NO: 34983 - RNA, 22 nt, Homo sapiens
gcacauguucugcggcccacca

SEQ ID NO: 34984 - RNA, 17 nt, Homo sapiens
uggaggccccagcgaga

SEQ ID NO: 34985 - RNA, 23 nt, Homo sapiens
accacaggagucugagcauuuga

SEQ ID NO: 34986 - RNA, 21 nt, Homo sapiens
ccaaccaaugaaagaaugcuu

SEQ ID NO: 34987 - RNA, 22 nt, Homo sapiens
aacccauggaauucaguucuca

SEQ ID NO: 34988 - RNA, 22 nt, Homo sapiens
agccuauggaauucaguucuca

SEQ ID NO: 34989 - RNA, 22 nt, Homo sapiens
acaaaguucuguagugcacuga

SEQ ID NO: 34990 - RNA, 22 nt, Homo sapiens
acaaaguucuguagugcacuga

SEQ ID NO: 34991 - RNA, 22 nt, Homo sapiens
acaaaguucugugaugcacuga

SEQ ID NO: 34992 - RNA, 21 nt, Homo sapiens
uucuaggauaggcccaggggc

SEQ ID NO: 34993 - RNA, 22 nt, Homo sapiens
gaagaaaggcaucauauaggag

SEQ ID NO: 34994 - RNA, 22 nt, Homo sapiens
augggacauccuacauaugcaa

SEQ ID NO: 34995 - RNA, 22 nt, Homo sapiens
acacaccaaggauaauuucucc

SEQ ID NO: 34996 - RNA, 22 nt, Homo sapiens
ggaccuaaaaauacaaugcaua

SEQ ID NO: 34997 - RNA, 23 nt, Homo sapiens
uguaggcuggggauaaaugaaua

SEQ ID NO: 34998 - RNA, 21 nt, Homo sapiens
cacaaccucaguguuuccagg

SEQ ID NO: 34999 - RNA, 22 nt, Homo sapiens
uggugauucacaaagaaaucca

SEQ ID NO: 35000 - RNA, 23 nt, Homo sapiens
accacaggagucugagcauuuga

SEQ ID NO: 35001 - RNA, 23 nt, Homo sapiens
ggaagccaucaagucgcugcagg

SEQ ID NO: 35002 - RNA, 21 nt, Homo sapiens
agggcucaucuugguccugca

SEQ ID NO: 35003 - RNA, 23 nt, Homo sapiens
aaaaugcagauuccuggacucca

SEQ ID NO: 35004 - RNA, 18 nt, Homo sapiens
caccaccagagccaacgu

SEQ ID NO: 35005 - RNA, 19 nt, Homo sapiens
cagcaucagcagcaucauc

SEQ ID NO: 35006 - RNA, 21 nt, Homo sapiens
acuagacugugagcuccucga

SEQ ID NO: 35007 - RNA, 23 nt, Homo sapiens
aaaucagaaucacaccuggggga

SEQ ID NO: 35008 - RNA, 22 nt, Homo sapiens
gaacuugcuaaaaaugcagaau

SEQ ID NO: 35009 - RNA, 24 nt, Homo sapiens
acgcagagcccgaaagcccccagu

SEQ ID NO: 35010 - RNA, 23 nt, Homo sapiens
cacugugggcccucuccgcacca

SEQ ID NO: 35011 - RNA, 21 nt, Homo sapiens
aagacgggaggagaggaguga

SEQ ID NO: 35012 - RNA, 23 nt, Homo sapiens
cuaccugcacuguaagcacuuuu

SEQ ID NO: 35013 - RNA, 17 nt, Homo sapiens
gacagccucucccccac

SEQ ID NO: 35014 - RNA, 17 nt, Homo sapiens
gacagccucucccccac

SEQ ID NO: 35015 - RNA, 23 nt, Homo sapiens
gggagugaagacacggagccaga

SEQ ID NO: 35016 - RNA, 21 nt, Homo sapiens
gggcaucugggacgcgcagga

SEQ ID NO: 35017 - RNA, 22 nt, Homo sapiens
uggcagcagcggagggggcaga

SEQ ID NO: 35018 - RNA, 22 nt, Homo sapiens
uccacauggaguugcuguuaca

SEQ ID NO: 35019 - RNA, 22 nt, Homo sapiens
uccacauggaguugcuguuaca

SEQ ID NO: 35020 - RNA, 22 nt, Homo sapiens
acaguucuucaacuggcagcuu

SEQ ID NO: 35021 - RNA, 20 nt, Homo sapiens
ccagcagcaccuggggcagu

SEQ ID NO: 35022 - RNA, 20 nt, Homo sapiens
cuggaggaagggcccagagg

SEQ ID NO: 35023 - RNA, 22 nt, Homo sapiens
gccuaagacacaggcccagaga

SEQ ID NO: 35024 - RNA, 22 nt, Homo sapiens
gagcccuggacuaggagucagc

SEQ ID NO: 35025 - RNA, 22 nt, Homo sapiens
acaaccagcuaagacacugcca

SEQ ID NO: 35026 - RNA, 22 nt, Homo sapiens
auggcaguggaguuagugauug

SEQ ID NO: 35027 - RNA, 23 nt, Homo sapiens
gcaaucagcuaacuacacugccu

SEQ ID NO: 35028 - RNA, 21 nt, Homo sapiens
ccuucugacuccaaguccagu

SEQ ID NO: 35029 - RNA, 23 nt, Homo sapiens
aaagucucgcucucugccccuca

SEQ ID NO: 35030 - RNA, 22 nt, Homo sapiens
accagcuaacaauacacugcca

SEQ ID NO: 35031 - RNA, 22 nt, Homo sapiens
gccagcuaacaauacacugccu

SEQ ID NO: 35032 - RNA, 21 nt, Homo sapiens
auccuguacugagcugccccg

SEQ ID NO: 35033 - RNA, 19 nt, Homo sapiens
ucagcaguaccagccuaga

SEQ ID NO: 35034 - RNA, 22 nt, Homo sapiens
gggagaggucucccugcgcaca

SEQ ID NO: 35035 - RNA, 24 nt, Homo sapiens
cacccccagagccucagcucccca

SEQ ID NO: 35036 - RNA, 18 nt, Homo sapiens
gaaaugagggccagcuga

SEQ ID NO: 35037 - RNA, 22 nt, Homo sapiens
cugggggcggcacaggggcuca

SEQ ID NO: 35038 - RNA, 22 nt, Homo sapiens
ccacacacuuccuuacauucca

SEQ ID NO: 35039 - RNA, 17 nt, Homo sapiens
ggguggcagcgguggga

SEQ ID NO: 35040 - RNA, 23 nt, Homo sapiens
cgugagcuccuggaggacaggga

SEQ ID NO: 35041 - RNA, 22 nt, Homo sapiens
acaaccagcuaagacacugcca

SEQ ID NO: 35042 - RNA, 23 nt, Homo sapiens
acaacaaaaucacuagucuucca

SEQ ID NO: 35043 - RNA, 20 nt, Homo sapiens
uacugcuuccacagcucccc

SEQ ID NO: 35044 - RNA, 22 nt, Homo sapiens
ccaucuuuaccagacaguguua

SEQ ID NO: 35045 - RNA, 23 nt, Homo sapiens
agggauuccugggaaaacuggac

SEQ ID NO: 35046 - RNA, 23 nt, Homo sapiens
cuaccugcacuauaagcacuuua

SEQ ID NO: 35047 - RNA, 24 nt, Homo sapiens
ugggagaaccucccugcuucugcu

SEQ ID NO: 35048 - RNA, 22 nt, Homo sapiens
caacaaaaucacugaugcugga

SEQ ID NO: 35049 - RNA, 22 nt, Homo sapiens
gcgaauauaacacggucgaucu

SEQ ID NO: 35050 - RNA, 22 nt, Homo sapiens
cucccuucuuuccucccgucuu

SEQ ID NO: 35051 - RNA, 22 nt, Homo sapiens
gaacuugcuaaaaaugcagaau

SEQ ID NO: 35052 - RNA, 21 nt, Homo sapiens
gcuccaaccucagcagacugu

SEQ ID NO: 35053 - RNA, 22 nt, Homo sapiens
aacccucuaaaaggaagcacuu

SEQ ID NO: 35054 - RNA, 22 nt, Homo sapiens
caaacaccauugucacacucca

SEQ ID NO: 35055 - RNA, 22 nt, Homo sapiens
cacgaccgacgccacgccgagu

SEQ ID NO: 35056 - RNA, 22 nt, Homo sapiens
ggagcccgcgccccgcgccgag

SEQ ID NO: 35057 - RNA, 22 nt, Homo sapiens
ucaggaacugccuuucucucca

SEQ ID NO: 35058 - RNA, 22 nt, Homo sapiens
ucagaccgagacaagugcaaug

SEQ ID NO: 35059 - RNA, 19 nt, Homo sapiens
guccugaauuccgcagccu

SEQ ID NO: 35060 - RNA, 25 nt, Homo sapiens
accaacggaccuacuucccuccgcc

SEQ ID NO: 35061 - RNA, 22 nt, Homo sapiens
gcggucccgcggcgccccgccu

SEQ ID NO: 35062 - RNA, 21 nt, Homo sapiens
cucccccacugcagcuggcac

SEQ ID NO: 35063 - RNA, 21 nt, Homo sapiens
gagcugcauccuggcuccggg

SEQ ID NO: 35064 - RNA, 22 nt, Homo sapiens
acaaccagcuaagacacugcca

SEQ ID NO: 35065 - RNA, 22 nt, Homo sapiens
aggaaaccagcaaguguugacg

SEQ ID NO: 35066 - RNA, 22 nt, Homo sapiens
cacgaccgacgccacgccgagu

SEQ ID NO: 35067 - RNA, 21 nt, Homo sapiens
gggcaucugggacgcgcagga

SEQ ID NO: 35068 - RNA, 22 nt, Homo sapiens
ugagccacugugccuggccuga

SEQ ID NO: 35069 - RNA, 23 nt, Homo sapiens
acaccaaugcccuaggggaugcg

SEQ ID NO: 35070 - RNA, 23 nt, Homo sapiens
acauuuuucguuauugcucuuga

SEQ ID NO: 35071 - RNA, 22 nt, Homo sapiens
uauucaggaacauauugcaaaa

SEQ ID NO: 35072 - RNA, 21 nt, Homo sapiens
acaaaccacagugugcugcug

SEQ ID NO: 35073 - RNA, 22 nt, Homo sapiens
gcaaagguaauugcuguuuucg

SEQ ID NO: 35074 - RNA, 25 nt, Homo sapiens
aggccgccacccgcccgcgaucccu

SEQ ID NO: 35075 - RNA, 19 nt, Homo sapiens
gcucuaagaaagccacacu

SEQ ID NO: 35076 - RNA, 22 nt, Homo sapiens
ugaauuacuuuguaaaccacca

SEQ ID NO: 35077 - RNA, 22 nt, Homo sapiens
gggagaggucucccugcgcaca

SEQ ID NO: 35078 - RNA, 23 nt, Homo sapiens
gggagugaagacacggagccaga

SEQ ID NO: 35079 - RNA, 21 nt, Homo sapiens
gaccaaucgccguccccgccg

SEQ ID NO: 35080 - RNA, 23 nt, Homo sapiens
cuaccugcacuaugagcacuuug

SEQ ID NO: 35081 - RNA, 22 nt, Homo sapiens
cucaauagacugugagcuccuu

SEQ ID NO: 35082 - RNA, 23 nt, Homo sapiens
aaaucagaaucacaccuggggga

SEQ ID NO: 35083 - RNA, 19 nt, Homo sapiens
guccugaauuccgcagccu

SEQ ID NO: 35084 - RNA, 20 nt, Homo sapiens
aggggccucagccuccuggu

SEQ ID NO: 35085 - RNA, 23 nt, Homo sapiens
cccagcuagauuguaagcuccuu

SEQ ID NO: 35086 - RNA, 22 nt, Homo sapiens
ugcuguuagcccuagccccgca

SEQ ID NO: 35087 - RNA, 17 nt, Homo sapiens
gacagccucucccccac

SEQ ID NO: 35088 - RNA, 23 nt, Homo sapiens
aaaaugcagauuccuggacucca

SEQ ID NO: 35089 - RNA, 18 nt, Homo sapiens
cagcagccuccuucucaa

SEQ ID NO: 35090 - RNA, 23 nt, Homo sapiens
gggagugaagacacggagccaga

SEQ ID NO: 35091 - RNA, 22 nt, Homo sapiens
cacaaaccauuaugugcugcua

SEQ ID NO: 35092 - RNA, 22 nt, Homo sapiens
ucaggaacugccuuucucucca

SEQ ID NO: 35093 - RNA, 21 nt, Homo sapiens
gaccaaucgccguccccgccg

SEQ ID NO: 35094 - RNA, 23 nt, Homo sapiens
aaagucucgcucucugccccuca

SEQ ID NO: 35095 - RNA, 22 nt, Homo sapiens
gcggucccgcggcgccccgccu

SEQ ID NO: 35096 - RNA, 24 nt, Homo sapiens
cacccccagagccucagcucccca

SEQ ID NO: 35097 - RNA, 23 nt, Homo sapiens
ccacccaaugaccuacuccaaga

SEQ ID NO: 35098 - RNA, 22 nt, Homo sapiens
uccagcaaagggaagcgcuuuc

SEQ ID NO: 35099 - RNA, 22 nt, Homo sapiens
accucuaaaggggagcgcuuug

SEQ ID NO: 35100 - RNA, 23 nt, Homo sapiens
acacucuaaagagaagcgcuuug

SEQ ID NO: 35101 - RNA, 21 nt, Homo sapiens
gcuccaaagggaagcgcuuug

SEQ ID NO: 35102 - RNA, 21 nt, Homo sapiens
ccucuaaagagaagcgcuuuc

SEQ ID NO: 35103 - RNA, 22 nt, Homo sapiens
cucagagcagacgugguucuca

SEQ ID NO: 35104 - RNA, 21 nt, Homo sapiens
aagggucaguaagcacccgcg

SEQ ID NO: 35105 - RNA, 20 nt, Homo sapiens
uacugcuuccacagcucccc

SEQ ID NO: 35106 - RNA, 21 nt, Homo sapiens
agaaguagaccauguguccua

SEQ ID NO: 35107 - RNA, 21 nt, Homo sapiens
cucccccacugcagcuggcac

SEQ ID NO: 35108 - RNA, 21 nt, Homo sapiens
ugcaggcugaucuucuucucu

SEQ ID NO: 35109 - RNA, 24 nt, Homo sapiens
ucacagguuaaagggucucaggga

SEQ ID NO: 35110 - RNA, 22 nt, Homo sapiens
ucacaaguuagggucucaggga

SEQ ID NO: 35111 - RNA, 23 nt, Homo sapiens
agcccuguucuacagcccugagg

SEQ ID NO: 35112 - RNA, 18 nt, Homo sapiens
caccaccagagccaacgu

SEQ ID NO: 35113 - RNA, 22 nt, Homo sapiens
accuaauauaucaaacauauca

SEQ ID NO: 35114 - RNA, 22 nt, Homo sapiens
cuguuccugcugaacugagcca

SEQ ID NO: 35115 - RNA, 22 nt, Homo sapiens
agcugaguguaggauguuuaca

SEQ ID NO: 35116 - RNA, 20 nt, Homo sapiens
cuggaggaagggcccagagg

SEQ ID NO: 35117 - RNA, 22 nt, Homo sapiens
gccuaagacacaggcccagaga

SEQ ID NO: 35118 - RNA, 20 nt, Homo sapiens
ggcauucaccgcgugccuua

SEQ ID NO: 35119 - RNA, 22 nt, Homo sapiens
cagaaagugcuucccucuagag

SEQ ID NO: 35120 - RNA, 21 nt, Homo sapiens
cacucugaagggaagcgcuuu

SEQ ID NO: 35121 - RNA, 21 nt, Homo sapiens
ccucuaaagagaagcgcuuuc

SEQ ID NO: 35122 - RNA, 22 nt, Homo sapiens
acacucuaaaaggaugcacuuu

SEQ ID NO: 35123 - RNA, 22 nt, Homo sapiens
cagaaagcgcuucccucuagag

SEQ ID NO: 35124 - RNA, 22 nt, Homo sapiens
cagaaagcgcuucccucuagag

SEQ ID NO: 35125 - RNA, 22 nt, Homo sapiens
cagaaagugcuucccucuagag

SEQ ID NO: 35126 - RNA, 22 nt, Homo sapiens
acacucuaaagggaaccauuuu

SEQ ID NO: 35127 - RNA, 23 nt, Homo sapiens
acccucuauagggaagcgcguuc

SEQ ID NO: 35128 - RNA, 22 nt, Homo sapiens
cagaaagugcuucccucuagag

SEQ ID NO: 35129 - RNA, 21 nt, Homo sapiens
cugcugggccacaacguggga

SEQ ID NO: 35130 - RNA, 22 nt, Homo sapiens
cacauggccaaaacagagaaga

SEQ ID NO: 35131 - RNA, 21 nt, Homo sapiens
cugggggacggagcagaagga

SEQ ID NO: 35132 - RNA, 21 nt, Homo sapiens
cucccccacugcagcuggcac

SEQ ID NO: 35133 - RNA, 22 nt, Homo sapiens
aggucucacuuuguugcccaga

SEQ ID NO: 35134 - RNA, 21 nt, Homo sapiens
ucuccagaucagggcagucca

SEQ ID NO: 35135 - RNA, 18 nt, Homo sapiens
aucacauucaccucccug

SEQ ID NO: 35136 - RNA, 23 nt, Homo sapiens
gggagugaagacacggagccaga

SEQ ID NO: 35137 - RNA, 22 nt, Homo sapiens
ucaggaacugccuuucucucca

SEQ ID NO: 35138 - RNA, 22 nt, Homo sapiens
uggcagcagcggagggggcaga

SEQ ID NO: 35139 - RNA, 23 nt, Homo sapiens
cagcugcuuuugggauuccguug

SEQ ID NO: 35140 - RNA, 22 nt, Homo sapiens
aggcauaggaugacaaagggaa

SEQ ID NO: 35141 - RNA, 22 nt, Homo sapiens
aggcgaaggaugacaaagggaa

SEQ ID NO: 35142 - RNA, 22 nt, Homo sapiens
agcugaguguaggauguuuaca

SEQ ID NO: 35143 - RNA, 20 nt, Homo sapiens
ccagcagcaccuggggcagu

SEQ ID NO: 35144 - RNA, 22 nt, Homo sapiens
caacaaaaucacugaugcugga

SEQ ID NO: 35145 - RNA, 21 nt, Homo sapiens
ucaaucacagauagcaccccu

SEQ ID NO: 35146 - RNA, 22 nt, Homo sapiens
guaccccuggagauucugauaa

SEQ ID NO: 35147 - RNA, 21 nt, Homo sapiens
auccuguacugagcugccccg

SEQ ID NO: 35148 - RNA, 22 nt, Homo sapiens
agaauccuugcccgggugcauu

SEQ ID NO: 35149 - RNA, 22 nt, Homo sapiens
ugaauccuugcccaggugcauu

SEQ ID NO: 35150 - RNA, 21 nt, Homo sapiens
cccgaggagccgggcaggcuu

SEQ ID NO: 35151 - RNA, 25 nt, Homo sapiens
aaggagcucagaagcccugcccagc

SEQ ID NO: 35152 - RNA, 20 nt, Homo sapiens
uacugcuuccacagcucccc

SEQ ID NO: 35153 - RNA, 22 nt, Homo sapiens
auaaaugacaccuccuugugaa

SEQ ID NO: 35154 - RNA, 20 nt, Homo sapiens
uacugcuuccacagcucccc

SEQ ID NO: 35155 - RNA, 21 nt, Homo sapiens
cucccccacugcagcuggcac

SEQ ID NO: 35156 - RNA, 22 nt, Homo sapiens
ugaagaagggggggaagggcgu

SEQ ID NO: 35157 - RNA, 18 nt, Homo sapiens
cccccaccaccacgcccg

SEQ ID NO: 35158 - RNA, 24 nt, Homo sapiens
acugcuggucuucagucagggcca

SEQ ID NO: 35159 - RNA, 22 nt, Homo sapiens
ccggcugcaacacaagacacga

SEQ ID NO: 35160 - RNA, 22 nt, Homo sapiens
ucagaccgagacaagugcaaug

SEQ ID NO: 35161 - RNA, 21 nt, Homo sapiens
accuauccugaauuacuugaa

SEQ ID NO: 35162 - RNA, 22 nt, Homo sapiens
acggaagggcagagagggccag

SEQ ID NO: 35163 - RNA, 22 nt, Homo sapiens
aucgggaggggacugagccuga

SEQ ID NO: 35164 - RNA, 22 nt, Homo sapiens
gaauucaucacggccagccucu

SEQ ID NO: 35165 - RNA, 22 nt, Homo sapiens
aaagugcuucuuaccuccagau

SEQ ID NO: 35166 - RNA, 23 nt, Homo sapiens
uguaggcuggggauaaaugaaua

SEQ ID NO: 35167 - RNA, 22 nt, Homo sapiens
uauccacuacaccccgcugccu

SEQ ID NO: 35168 - RNA, 23 nt, Homo sapiens
ccgcuugagcuaacuccgacccg

SEQ ID NO: 35169 - RNA, 18 nt, Homo sapiens
aucacauucaccucccug

SEQ ID NO: 35170 - RNA, 21 nt, Homo sapiens
cggggugcacgggcggagggc

SEQ ID NO: 35171 - RNA, 23 nt, Homo sapiens
gggagugaagacacggagccaga

SEQ ID NO: 35172 - RNA, 22 nt, Homo sapiens
uacagauggauaccgugcaauu

SEQ ID NO: 35173 - RNA, 20 nt, Homo sapiens
ugggccaccgccgagcggac

SEQ ID NO: 35174 - RNA, 21 nt, Homo sapiens
ggacuauagaacuuucccccu

SEQ ID NO: 35175 - RNA, 22 nt, Homo sapiens
caagacacauuuggagagggac

SEQ ID NO: 35176 - RNA, 21 nt, Homo sapiens
caucaccuuccuucuccucca

SEQ ID NO: 35177 - RNA, 21 nt, Homo sapiens
aagggucaguaagcacccgcg

SEQ ID NO: 35178 - RNA, 22 nt, Homo sapiens
aacagcacaaacuacuaccuca

SEQ ID NO: 35179 - RNA, 24 nt, Homo sapiens
acugcuggucuucagucagggcca

SEQ ID NO: 35180 - RNA, 22 nt, Homo sapiens
ccggcugcaacacaagacacga

SEQ ID NO: 35181 - RNA, 20 nt, Homo sapiens
cccgccgcgucgcccugggg

SEQ ID NO: 35182 - RNA, 22 nt, Homo sapiens
acugggacuuuguaggccaguu

SEQ ID NO: 35183 - RNA, 22 nt, Homo sapiens
agcgggacuuugagggccaguu

SEQ ID NO: 35184 - RNA, 22 nt, Homo sapiens
acggaagggcagagagggccag

SEQ ID NO: 35185 - RNA, 21 nt, Homo sapiens
aacuccuguaugaagccguuc

SEQ ID NO: 35186 - RNA, 19 nt, Homo sapiens
accagugcccugcacacuu

SEQ ID NO: 35187 - RNA, 22 nt, Homo sapiens
gggagaggucucccugcgcaca

SEQ ID NO: 35188 - RNA, 21 nt, Homo sapiens
cucccccacugcagcuggcac

SEQ ID NO: 35189 - RNA, 21 nt, Homo sapiens
gagcugcauccuggcuccggg

SEQ ID NO: 35190 - RNA, 20 nt, Homo sapiens
cccgccgcgucgcccugggg

SEQ ID NO: 35191 - RNA, 21 nt, Homo sapiens
agagcucauccauaguuguca

SEQ ID NO: 35192 - RNA, 18 nt, Homo sapiens
acccucugaaaggaagca

SEQ ID NO: 35193 - RNA, 22 nt, Homo sapiens
aaagugcuucuuaccuccagau

SEQ ID NO: 35194 - RNA, 25 nt, Homo sapiens
accaacggaccuacuucccuccgcc

SEQ ID NO: 35195 - RNA, 22 nt, Homo sapiens
ugcuguuagcccuagccccgca

SEQ ID NO: 35196 - RNA, 22 nt, Homo sapiens
ggcagagagucagagcgcggau

SEQ ID NO: 35197 - RNA, 22 nt, Homo sapiens
caaacaccauugucacacucca

SEQ ID NO: 35198 - RNA, 20 nt, Homo sapiens
ggcauucaccgcgugccuua

SEQ ID NO: 35199 - RNA, 22 nt, Homo sapiens
cgaccauggcuguagacuguua

SEQ ID NO: 35200 - RNA, 22 nt, Homo sapiens
ccggcugcaacacaagacacga

SEQ ID NO: 35201 - RNA, 21 nt, Homo sapiens
ggccgugacuggagacuguua

SEQ ID NO: 35202 - RNA, 23 nt, Homo sapiens
acaccccaaaaucgaagcacuuc

SEQ ID NO: 35203 - RNA, 22 nt, Homo sapiens
ucaguuuccucugcaaacaguu

SEQ ID NO: 35204 - RNA, 21 nt, Homo sapiens
ucuacucagaagggugccuua

SEQ ID NO: 35205 - RNA, 21 nt, Homo sapiens
ugacugcagagcaaaagacac

SEQ ID NO: 35206 - RNA, 24 nt, Homo sapiens
cagaaagugcuuucuuuuggagaa

SEQ ID NO: 35207 - RNA, 22 nt, Homo sapiens
aacacucuaaaaggaggcacuu

SEQ ID NO: 35208 - RNA, 22 nt, Homo sapiens
acaaaauccacaauuacuuuug

SEQ ID NO: 35209 - RNA, 22 nt, Homo sapiens
cugcucaaacccuccaaugacu

SEQ ID NO: 35210 - RNA, 22 nt, Homo sapiens
cuggagagacaaggggaagagg

SEQ ID NO: 35211 - RNA, 23 nt, Homo sapiens
gggagugaagacacggagccaga

SEQ ID NO: 35212 - RNA, 23 nt, Homo sapiens
acaccccaaaaucgaagcacuuc

SEQ ID NO: 35213 - RNA, 22 nt, Homo sapiens
cucggggcagcucaguacagga

SEQ ID NO: 35214 - RNA, 24 nt, Homo sapiens
cagaaagugcuuucuuuuggagaa

SEQ ID NO: 35215 - RNA, 22 nt, Homo sapiens
aacacucuaaaaggaggcacuu

SEQ ID NO: 35216 - RNA, 22 nt, Homo sapiens
cugcucaaacccuccaaugacu

SEQ ID NO: 35217 - RNA, 22 nt, Homo sapiens
caagacacauuuggagagggac

SEQ ID NO: 35218 - RNA, 21 nt, Homo sapiens
ggggagcgggggcccugccuu

SEQ ID NO: 35219 - RNA, 22 nt, Homo sapiens
cacaaaccauuaugugcugcua

SEQ ID NO: 35220 - RNA, 22 nt, Homo sapiens
uguaaaccaugaugugcugcua

SEQ ID NO: 35221 - RNA, 22 nt, Homo sapiens
cgccaauauuuacgugcugcua

SEQ ID NO: 35222 - RNA, 21 nt, Homo sapiens
gccaauauuucugugcugcua

SEQ ID NO: 35223 - RNA, 22 nt, Homo sapiens
auguaugugggacgguaaacca

SEQ ID NO: 35224 - RNA, 22 nt, Homo sapiens
uucaaaacaugaauugcugcug

SEQ ID NO: 35225 - RNA, 21 nt, Homo sapiens
acaaaccacagugugcugcug

SEQ ID NO: 35226 - RNA, 23 nt, Homo sapiens
cugcagaacuguucccgcugcua

SEQ ID NO: 35227 - RNA, 22 nt, Homo sapiens
uauccacuacaccccgcugccu

SEQ ID NO: 35228 - RNA, 22 nt, Homo sapiens
acacacccacgcgagccggaaa

SEQ ID NO: 35229 - RNA, 17 nt, Homo sapiens
gacagccucucccccac

SEQ ID NO: 35230 - RNA, 21 nt, Homo sapiens
acuagacugugagcuccucga

SEQ ID NO: 35231 - RNA, 21 nt, Homo sapiens
ugcaaacccugcaugugggag

SEQ ID NO: 35232 - RNA, 23 nt, Homo sapiens
gaaacccagcagacaauguagcu

SEQ ID NO: 35233 - RNA, 23 nt, Homo sapiens
aaaucagaaucacaccuggggga

SEQ ID NO: 35234 - RNA, 23 nt, Homo sapiens
ucucacccagguagcaaggauua

SEQ ID NO: 35235 - RNA, 23 nt, Homo sapiens
ucucacccagguagcaaggauua

SEQ ID NO: 35236 - RNA, 22 nt, Homo sapiens
agaauccuugcccgggugcauu

SEQ ID NO: 35237 - RNA, 22 nt, Homo sapiens
ugaauccuugcccaggugcauu

SEQ ID NO: 35238 - RNA, 21 nt, Homo sapiens
uugucuaaccagucaccuguu

SEQ ID NO: 35239 - RNA, 21 nt, Homo sapiens
ggacuauagaacuuucccccu

SEQ ID NO: 35240 - RNA, 24 nt, Homo sapiens
acgcagagcccgaaagcccccagu

SEQ ID NO: 35241 - RNA, 19 nt, Homo sapiens
gcucuaagaaagccacacu

SEQ ID NO: 35242 - RNA, 22 nt, Homo sapiens
ugaagaagggggggaagggcgu

SEQ ID NO: 35243 - RNA, 17 nt, Homo sapiens
gggagaggaggaggcga

SEQ ID NO: 35244 - RNA, 23 nt, Homo sapiens
aaaaugcagauuccuggacucca

SEQ ID NO: 35245 - RNA, 22 nt, Homo sapiens
aacccauggaauucaguucuca

SEQ ID NO: 35246 - RNA, 22 nt, Homo sapiens
agccuauggaauucaguucuca

SEQ ID NO: 35247 - RNA, 21 nt, Homo sapiens
gggcaucugggacgcgcagga

SEQ ID NO: 35248 - RNA, 22 nt, Homo sapiens
ucaggaacugccuuucucucca

SEQ ID NO: 35249 - RNA, 21 nt, Homo sapiens
gaccaaucgccguccccgccg

SEQ ID NO: 35250 - RNA, 20 nt, Homo sapiens
acagcaaggagggcaggagg

SEQ ID NO: 35251 - RNA, 20 nt, Homo sapiens
cuggaggaagggcccagagg

SEQ ID NO: 35252 - RNA, 22 nt, Homo sapiens
gccuaagacacaggcccagaga

SEQ ID NO: 35253 - RNA, 25 nt, Homo sapiens
acggagcugucccaacaccaccccu

SEQ ID NO: 35254 - RNA, 22 nt, Homo sapiens
gcggucccgcggcgccccgccu

SEQ ID NO: 35255 - RNA, 22 nt, Homo sapiens
ugcuguuagcccuagccccgca

SEQ ID NO: 35256 - RNA, 20 nt, Homo sapiens
uccccacagacccagagccg

SEQ ID NO: 35257 - RNA, 20 nt, Homo sapiens
uacugcuuccacagcucccc

SEQ ID NO: 35258 - RNA, 23 nt, Homo sapiens
cacaaauucggaucuacagggua

SEQ ID NO: 35259 - RNA, 23 nt, Homo sapiens
cacaaauucgguucuacagggua

SEQ ID NO: 35260 - RNA, 23 nt, Homo sapiens
gucacaucccucccaagacccuc

SEQ ID NO: 35261 - RNA, 22 nt, Homo sapiens
aggucucacuuuguugcccaga

SEQ ID NO: 35262 - RNA, 22 nt, Homo sapiens
agagcaagaccccgucucuaaa

SEQ ID NO: 35263 - RNA, 22 nt, Homo sapiens
augcccuuucaucauugcacug

SEQ ID NO: 35264 - RNA, 24 nt, Homo sapiens
gaaagugcauagaauucugucugg

SEQ ID NO: 35265 - RNA, 22 nt, Homo sapiens
cccaacaacaugaaacuaccua

SEQ ID NO: 35266 - RNA, 23 nt, Homo sapiens
cgugagcuccuggaggacaggga

SEQ ID NO: 35267 - RNA, 22 nt, Homo sapiens
ucaccauugcuaaagugcaauu

SEQ ID NO: 35268 - RNA, 22 nt, Homo sapiens
gauagagugcagaccagggucu

SEQ ID NO: 35269 - RNA, 22 nt, Homo sapiens
acacaccaaggauaauuucucc

SEQ ID NO: 35270 - RNA, 22 nt, Homo sapiens
gguaaaacucgcaauuacuuuu

SEQ ID NO: 35271 - RNA, 22 nt, Homo sapiens
ggccaaaaccacaauuacuuuu

SEQ ID NO: 35272 - RNA, 22 nt, Homo sapiens
ggcaaaaaccgcaauuacuuuu

SEQ ID NO: 35273 - RNA, 22 nt, Homo sapiens
ggcaaaaaccacaauuacuuuu

SEQ ID NO: 35274 - RNA, 22 nt, Homo sapiens
gacaaaaaccgcgauuacuuuu

SEQ ID NO: 35275 - RNA, 22 nt, Homo sapiens
ggcaaaauccgcaauuacuuuu

SEQ ID NO: 35276 - RNA, 22 nt, Homo sapiens
accaaagaccgcaauuacuuuu

SEQ ID NO: 35277 - RNA, 22 nt, Homo sapiens
acaaaauccacaauuacuuuug

SEQ ID NO: 35278 - RNA, 21 nt, Homo sapiens
uuuuggugcauauuuacuuua

SEQ ID NO: 35279 - RNA, 25 nt, Homo sapiens
aaggagcucagaagcccugcccagc

SEQ ID NO: 35280 - RNA, 19 nt, Homo sapiens
ucccacaggaagcagacac

SEQ ID NO: 35281 - RNA, 22 nt, Homo sapiens
ugcuguuagcccuagccccgca

SEQ ID NO: 35282 - RNA, 22 nt, Homo sapiens
gugggguggguggucaggccga

SEQ ID NO: 35283 - RNA, 20 nt, Homo sapiens
ggcauucaccgcgugccuua

SEQ ID NO: 35284 - RNA, 23 nt, Homo sapiens
cagcugcuuuugggauuccguug

SEQ ID NO: 35285 - RNA, 22 nt, Homo sapiens
gcuggguggagaagguggugaa

SEQ ID NO: 35286 - RNA, 23 nt, Homo sapiens
ucaguuuugcauagauuugcaca

SEQ ID NO: 35287 - RNA, 22 nt, Homo sapiens
cacucagcaccaggauauuguu

SEQ ID NO: 35288 - RNA, 22 nt, Homo sapiens
aacuaugcaaccuacuaccucu

SEQ ID NO: 35289 - RNA, 21 nt, Homo sapiens
aagugucagacacgguggugg

SEQ ID NO: 35290 - RNA, 22 nt, Homo sapiens
ugggguauuugacaaacugaca

SEQ ID NO: 35291 - RNA, 21 nt, Homo sapiens
gaccaagaaauagccuuucaa

SEQ ID NO: 35292 - RNA, 21 nt, Homo sapiens
ucuacucagaagggugccuua

SEQ ID NO: 35293 - RNA, 23 nt, Homo sapiens
aaucgcgguuuauaccaaaugaa

SEQ ID NO: 35294 - RNA, 22 nt, Homo sapiens
caaacaccauugucacacucca

SEQ ID NO: 35295 - RNA, 22 nt, Homo sapiens
auccuucuacaaauucacccau

SEQ ID NO: 35296 - RNA, 22 nt, Homo sapiens
cagcugguugaaggggaccaaa

SEQ ID NO: 35297 - RNA, 22 nt, Homo sapiens
uagcugguugaaggggaccaaa

SEQ ID NO: 35298 - RNA, 23 nt, Homo sapiens
aggaacagcagcagcccgggccg

SEQ ID NO: 35299 - RNA, 21 nt, Homo sapiens
gaccaaucgccguccccgccg

SEQ ID NO: 35300 - RNA, 22 nt, Homo sapiens
uucacacugcaugcucugggua

SEQ ID NO: 35301 - RNA, 21 nt, Homo sapiens
acaggauugagggggggcccu

SEQ ID NO: 35302 - RNA, 22 nt, Homo sapiens
aguccagauucugugcccacca

SEQ ID NO: 35303 - RNA, 25 nt, Homo sapiens
acggagcugucccaacaccaccccu

SEQ ID NO: 35304 - RNA, 22 nt, Homo sapiens
gcacauguucugcggcccacca

SEQ ID NO: 35305 - RNA, 22 nt, Homo sapiens
gcggucccgcggcgccccgccu

SEQ ID NO: 35306 - RNA, 23 nt, Homo sapiens
cacugugggcccucuccgcacca

SEQ ID NO: 35307 - RNA, 23 nt, Homo sapiens
ggaagccaucaagucgcugcagg

SEQ ID NO: 35308 - RNA, 20 nt, Homo sapiens
cucaaagcaaacccugcaga

SEQ ID NO: 35309 - RNA, 21 nt, Homo sapiens
ggucagaacccaucauucacu

SEQ ID NO: 35310 - RNA, 24 nt, Homo sapiens
acugcuggucuucagucagggcca

SEQ ID NO: 35311 - RNA, 18 nt, Homo sapiens
caccaccagagccaacgu

SEQ ID NO: 35312 - RNA, 24 nt, Homo sapiens
agugugaguucuaccauugccaaa

SEQ ID NO: 35313 - RNA, 20 nt, Homo sapiens
cccgccgcgucgcccugggg

SEQ ID NO: 35314 - RNA, 20 nt, Homo sapiens
cccgccgcgucgcccugggg

SEQ ID NO: 35315 - RNA, 20 nt, Homo sapiens
acagcaaggagggcaggagg

SEQ ID NO: 35316 - RNA, 21 nt, Homo sapiens
uucuaggauaggcccaggggc

SEQ ID NO: 35317 - RNA, 22 nt, Homo sapiens
aggaaaccagcaaguguugacg

SEQ ID NO: 35318 - RNA, 23 nt, Homo sapiens
cacugugggcccucuccgcacca

SEQ ID NO: 35319 - RNA, 22 nt, Homo sapiens
ugcuguuagcccuagccccgca

SEQ ID NO: 35320 - RNA, 21 nt, Homo sapiens
gagcugcauccuggcuccggg

SEQ ID NO: 35321 - RNA, 21 nt, Homo sapiens
gagcugcauccuggcuccggg

SEQ ID NO: 35322 - RNA, 21 nt, Homo sapiens
auaauggagaccaggccacga

SEQ ID NO: 35323 - RNA, 18 nt, Homo sapiens
gaaaugagggccagcuga

SEQ ID NO: 35324 - RNA, 18 nt, Homo sapiens
cccccaccaccacgcccg

SEQ ID NO: 35325 - RNA, 21 nt, Homo sapiens
cggggugcacgggcggagggc

SEQ ID NO: 35326 - RNA, 25 nt, Homo sapiens
agcuagucaagcgcgguuguggggg

SEQ ID NO: 35327 - RNA, 20 nt, Homo sapiens
acagcaaggagggcaggagg

SEQ ID NO: 35328 - RNA, 22 nt, Homo sapiens
ucagaccgagacaagugcaaug

SEQ ID NO: 35329 - RNA, 25 nt, Homo sapiens
accaacggaccuacuucccuccgcc

SEQ ID NO: 35330 - RNA, 22 nt, Homo sapiens
uccggggacgaacgggacgggu

SEQ ID NO: 35331 - RNA, 27 nt, Homo sapiens
uuuagcacagugcuuauacaagaaggu

SEQ ID NO: 35332 - RNA, 21 nt, Homo sapiens
ugcaggcugaucuucuucucu

SEQ ID NO: 35333 - RNA, 21 nt, Homo sapiens
ggucagaacccaucauucacu

SEQ ID NO: 35334 - RNA, 22 nt, Homo sapiens
augcccuuucaucauugcacug

SEQ ID NO: 35335 - RNA, 22 nt, Homo sapiens
ucaggaacugccuuucucucca

SEQ ID NO: 35336 - RNA, 22 nt, Homo sapiens
cacauggccaaaacagagaaga

SEQ ID NO: 35337 - RNA, 20 nt, Homo sapiens
cugcgggaggacagggcuca

SEQ ID NO: 35338 - RNA, 18 nt, Homo sapiens
uggcgccugaacagggac

SEQ ID NO: 35339 - RNA, 21 nt, Homo sapiens
gcaagcccagaccgcaaaaag

SEQ ID NO: 35340 - RNA, 22 nt, Homo sapiens
accagguuccaccccagcaggc

SEQ ID NO: 35341 - RNA, 23 nt, Homo sapiens
aagaaucuugucccgcagguccu

SEQ ID NO: 35342 - RNA, 22 nt, Homo sapiens
uuucaguuaucaaucugucaca

SEQ ID NO: 35343 - RNA, 22 nt, Homo sapiens
gcaaaagaaacugugguuuuug

SEQ ID NO: 35344 - RNA, 22 nt, Homo sapiens
aagagggagacccaggcucgga

SEQ ID NO: 35345 - RNA, 23 nt, Homo sapiens
guagugggccgagccgagugaca

SEQ ID NO: 35346 - RNA, 22 nt, Homo sapiens
uauccacuacaccccgcugccu

SEQ ID NO: 35347 - RNA, 23 nt, Homo sapiens
gcgguagcggaagcgguaacugg

SEQ ID NO: 35348 - RNA, 21 nt, Homo sapiens
cugaggagagaggaggugggg

SEQ ID NO: 35349 - RNA, 18 nt, Homo sapiens
ugguggcagaggugggau

SEQ ID NO: 35350 - RNA, 23 nt, Homo sapiens
gggagugaagacacggagccaga

SEQ ID NO: 35351 - RNA, 22 nt, Homo sapiens
ucaggaacugccuuucucucca

SEQ ID NO: 35352 - RNA, 22 nt, Homo sapiens
aggcauaggaugacaaagggaa

SEQ ID NO: 35353 - RNA, 22 nt, Homo sapiens
aggcgaaggaugacaaagggaa

SEQ ID NO: 35354 - RNA, 22 nt, Homo sapiens
acaguucuucaacuggcagcuu

SEQ ID NO: 35355 - RNA, 21 nt, Homo sapiens
aucugcacugucagcacuuua

SEQ ID NO: 35356 - RNA, 23 nt, Homo sapiens
gcuuugacaauaucauugcacug

SEQ ID NO: 35357 - RNA, 22 nt, Homo sapiens
aggaaaccagcaaguguugacg

SEQ ID NO: 35358 - RNA, 22 nt, Homo sapiens
ugcaagccuugggugugggagg

SEQ ID NO: 35359 - RNA, 19 nt, Homo sapiens
gcuccuguccaacuggcuc

SEQ ID NO: 35360 - RNA, 21 nt, Homo sapiens
cugcugggccacaacguggga

SEQ ID NO: 35361 - RNA, 21 nt, Homo sapiens
caucaccuuccuucuccucca

SEQ ID NO: 35362 - RNA, 22 nt, Homo sapiens
ucuacccagaaaggagccagug

SEQ ID NO: 35363 - RNA, 22 nt, Homo sapiens
acacacccacgcgagccggaaa

SEQ ID NO: 35364 - RNA, 18 nt, Homo sapiens
gaaaugagggccagcuga

SEQ ID NO: 35365 - RNA, 20 nt, Homo sapiens
cugcgggaggacagggcuca

SEQ ID NO: 35366 - RNA, 24 nt, Homo sapiens
acugcaggcuccagcuuccaggcu

SEQ ID NO: 35367 - RNA, 18 nt, Homo sapiens
cccccaccaccacgcccg

SEQ ID NO: 35368 - RNA, 23 nt, Homo sapiens
acacagcucuuccauaucuccag

SEQ ID NO: 35369 - RNA, 22 nt, Homo sapiens
augcccuuucaucauugcacug

SEQ ID NO: 35370 - RNA, 21 nt, Homo sapiens
gggcaucugggacgcgcagga

SEQ ID NO: 35371 - RNA, 21 nt, Homo sapiens
gaccaaucgccguccccgccg

SEQ ID NO: 35372 - RNA, 19 nt, Homo sapiens
guugggaucacaggcgccc

SEQ ID NO: 35373 - RNA, 19 nt, Homo sapiens
guugggaucacaggcgccc

SEQ ID NO: 35374 - RNA, 20 nt, Homo sapiens
auuucuauaucuaucuccau

SEQ ID NO: 35375 - RNA, 22 nt, Homo sapiens
gcggucccgcggcgccccgccu

SEQ ID NO: 35376 - RNA, 22 nt, Homo sapiens
ugcuguuagcccuagccccgca

SEQ ID NO: 35377 - RNA, 21 nt, Homo sapiens
cuagggaagaacagugagcaa

SEQ ID NO: 35378 - RNA, 20 nt, Homo sapiens
cugcgggaggacagggcuca

SEQ ID NO: 35379 - RNA, 21 nt, Homo sapiens
uuuagcauaaguaugucccaa

SEQ ID NO: 35380 - RNA, 22 nt, Homo sapiens
ucaggaacugccuuucucucca

SEQ ID NO: 35381 - RNA, 20 nt, Homo sapiens
cccgccgcgucgcccugggg

SEQ ID NO: 35382 - RNA, 20 nt, Homo sapiens
acagcaaggagggcaggagg

SEQ ID NO: 35383 - RNA, 23 nt, Homo sapiens
gaacagguagucugaacacuggg

SEQ ID NO: 35384 - RNA, 23 nt, Homo sapiens
gaacagauagucuaaacacuggg

SEQ ID NO: 35385 - RNA, 23 nt, Homo sapiens
ucaguuuugcauagauuugcaca

SEQ ID NO: 35386 - RNA, 23 nt, Homo sapiens
ucaguuuugcauggauuugcaca

SEQ ID NO: 35387 - RNA, 21 nt, Homo sapiens
acaggauugagggggggcccu

SEQ ID NO: 35388 - RNA, 21 nt, Homo sapiens
uucuaggauaggcccaggggc

SEQ ID NO: 35389 - RNA, 23 nt, Homo sapiens
acgggugcgauuucugugugaga

SEQ ID NO: 35390 - RNA, 22 nt, Homo sapiens
acaaaaguugccuuugugugau

SEQ ID NO: 35391 - RNA, 21 nt, Homo sapiens
uucacuccaaaaggugcaaaa

SEQ ID NO: 35392 - RNA, 23 nt, Homo sapiens
agacaaggcccacccgugcaaac

SEQ ID NO: 35393 - RNA, 20 nt, Homo sapiens
cccugcgccaucuccucuac

SEQ ID NO: 35394 - RNA, 20 nt, Homo sapiens
uacugcuuccacagcucccc

SEQ ID NO: 35395 - RNA, 22 nt, Homo sapiens
acuggguucaccuuuaagggca

SEQ ID NO: 35396 - RNA, 22 nt, Homo sapiens
uccggggacgaacgggacgggu

SEQ ID NO: 35397 - RNA, 24 nt, Homo sapiens
ucacagguuaaagggucucaggga

SEQ ID NO: 35398 - RNA, 22 nt, Homo sapiens
ucacaaguuagggucucaggga

SEQ ID NO: 35399 - RNA, 18 nt, Homo sapiens
ugguggcagaggugggau

SEQ ID NO: 35400 - RNA, 23 nt, Homo sapiens
agcccuguucuacagcccugagg

SEQ ID NO: 35401 - RNA, 17 nt, Homo sapiens
uggcgcccgaacaggga

SEQ ID NO: 35402 - RNA, 18 nt, Homo sapiens
ccacugaaccacccaugc

SEQ ID NO: 35403 - RNA, 23 nt, Homo sapiens
gggagugaagacacggagccaga

SEQ ID NO: 35404 - RNA, 22 nt, Homo sapiens
uggcagcagcggagggggcaga

SEQ ID NO: 35405 - RNA, 22 nt, Homo sapiens
cagaagugggccgggcacaggg

SEQ ID NO: 35406 - RNA, 23 nt, Homo sapiens
ucaguuuugcauagauuugcaca

SEQ ID NO: 35407 - RNA, 22 nt, Homo sapiens
cacucagcaccaggauauuguu

SEQ ID NO: 35408 - RNA, 22 nt, Homo sapiens
aacuaugcaaccuacuaccucu

SEQ ID NO: 35409 - RNA, 20 nt, Homo sapiens
ccagcagcaccuggggcagu

SEQ ID NO: 35410 - RNA, 22 nt, Homo sapiens
auggcaguggaguuagugauug

SEQ ID NO: 35411 - RNA, 22 nt, Homo sapiens
accagcuaacaauacacugcca

SEQ ID NO: 35412 - RNA, 22 nt, Homo sapiens
gccagcuaacaauacacugccu

SEQ ID NO: 35413 - RNA, 21 nt, Homo sapiens
acaaaccacagugugcugcug

SEQ ID NO: 35414 - RNA, 25 nt, Homo sapiens
acggagcugucccaacaccaccccu

SEQ ID NO: 35415 - RNA, 20 nt, Homo sapiens
aggggccucagccuccuggu

SEQ ID NO: 35416 - RNA, 22 nt, Homo sapiens
ugaauuacuuuguaaaccacca

SEQ ID NO: 35417 - RNA, 22 nt, Homo sapiens
ggaggccgggacgagugcaaua

SEQ ID NO: 35418 - RNA, 24 nt, Homo sapiens
cacccccagagccucagcucccca

SEQ ID NO: 35419 - RNA, 22 nt, Homo sapiens
caaacaccauugucacacucca

SEQ ID NO: 35420 - RNA, 22 nt, Homo sapiens
uccggggacgaacgggacgggu

SEQ ID NO: 35421 - RNA, 20 nt, Homo sapiens
aguacaucaucuauacugua

SEQ ID NO: 35422 - RNA, 22 nt, Homo sapiens
acaaaguucuguagugcacuga

SEQ ID NO: 35423 - RNA, 22 nt, Homo sapiens
acaaaguucugugaugcacuga

SEQ ID NO: 35424 - RNA, 21 nt, Homo sapiens
ccaaguucugucaugcacuga

SEQ ID NO: 35425 - RNA, 22 nt, Homo sapiens
acacucuaaaaggaugcacgau

SEQ ID NO: 35426 - RNA, 23 nt, Homo sapiens
ucaguuuugcauagauuugcaca

SEQ ID NO: 35427 - RNA, 23 nt, Homo sapiens
ucaguuuugcauggauuugcaca

SEQ ID NO: 35428 - RNA, 22 nt, Homo sapiens
ucaucauuaccaggcaguauua

SEQ ID NO: 35429 - RNA, 23 nt, Homo sapiens
uccaucauuacccggcaguauua

SEQ ID NO: 35430 - RNA, 22 nt, Homo sapiens
acgguuuuaccagacaguauua

SEQ ID NO: 35431 - RNA, 21 nt, Homo sapiens
uucacuccaaaaggugcaaaa

SEQ ID NO: 35432 - RNA, 23 nt, Homo sapiens
agacaaggcccacccgugcaaac

SEQ ID NO: 35433 - RNA, 23 nt, Homo sapiens
aggagaaggcaccaugggauuua

SEQ ID NO: 35434 - RNA, 25 nt, Homo sapiens
accaacggaccuacuucccuccgcc

SEQ ID NO: 35435 - RNA, 22 nt, Homo sapiens
ugcuguuagcccuagccccgca

SEQ ID NO: 35436 - RNA, 22 nt, Homo sapiens
ggaggccgggacgagugcaaua

SEQ ID NO: 35437 - RNA, 22 nt, Homo sapiens
gggagaggucucccugcgcaca

SEQ ID NO: 35438 - RNA, 20 nt, Homo sapiens
gcagcuguccgcccagacac

SEQ ID NO: 35439 - RNA, 24 nt, Homo sapiens
acugcaggcuccagcuuccaggcu

SEQ ID NO: 35440 - RNA, 24 nt, Homo sapiens
gaaagugcauagaauucugucugg

SEQ ID NO: 35441 - RNA, 19 nt, Homo sapiens
gcuccuguccaacuggcuc

SEQ ID NO: 35442 - RNA, 19 nt, Homo sapiens
aagacauuuucagacagcu

SEQ ID NO: 35443 - RNA, 21 nt, Homo sapiens
aagggucaguaagcacccgcg

SEQ ID NO: 35444 - RNA, 22 nt, Homo sapiens
ucuacccagaaaggagccagug

SEQ ID NO: 35445 - RNA, 21 nt, Homo sapiens
cuagggaagaacagugagcaa

SEQ ID NO: 35446 - RNA, 22 nt, Homo sapiens
gaggcucagaauggcucaggag

SEQ ID NO: 35447 - RNA, 22 nt, Homo sapiens
caaacaccauugucacacucca

SEQ ID NO: 35448 - RNA, 22 nt, Homo sapiens
cacugguacaaggguugggaga

SEQ ID NO: 35449 - RNA, 21 nt, Homo sapiens
gaccaaucgccguccccgccg

SEQ ID NO: 35450 - RNA, 22 nt, Homo sapiens
agucuucacaacagcccugugu

SEQ ID NO: 35451 - RNA, 22 nt, Homo sapiens
gugauugccacucuccugagua

SEQ ID NO: 35452 - RNA, 18 nt, Homo sapiens
augacaccucccugugaa

SEQ ID NO: 35453 - RNA, 22 nt, Homo sapiens
gcggucccgcggcgccccgccu

SEQ ID NO: 35454 - RNA, 22 nt, Homo sapiens
ugcuguuagcccuagccccgca

SEQ ID NO: 35455 - RNA, 23 nt, Homo sapiens
agaaaccaugggguaugagcaga

SEQ ID NO: 35456 - RNA, 22 nt, Homo sapiens
ucaaugacucagguaaguugca

SEQ ID NO: 35457 - RNA, 17 nt, Homo sapiens
gggagaggaggaggcga

SEQ ID NO: 35458 - RNA, 19 nt, Homo sapiens
agaaaccccagcagagaca

SEQ ID NO: 35459 - RNA, 25 nt, Homo sapiens
accaacggaccuacuucccuccgcc

SEQ ID NO: 35460 - RNA, 22 nt, Homo sapiens
gggagaggucucccugcgcaca

SEQ ID NO: 35461 - RNA, 22 nt, Homo sapiens
caaacaccauugucacacucca

SEQ ID NO: 35462 - RNA, 22 nt, Homo sapiens
caaacaccauugucacacucca

SEQ ID NO: 35463 - RNA, 21 nt, Homo sapiens
ucuccagaucagggcagucca

SEQ ID NO: 35464 - RNA, 22 nt, Homo sapiens
cacgaccgacgccacgccgagu

SEQ ID NO: 35465 - RNA, 21 nt, Homo sapiens
gaccaaucgccguccccgccg

SEQ ID NO: 35466 - RNA, 22 nt, Homo sapiens
cucaauagacugugagcuccuu

SEQ ID NO: 35467 - RNA, 22 nt, Homo sapiens
acggaagggcagagagggccag

SEQ ID NO: 35468 - RNA, 22 nt, Homo sapiens
aucgggaggggacugagccuga

SEQ ID NO: 35469 - RNA, 19 nt, Homo sapiens
guccugaauuccgcagccu

SEQ ID NO: 35470 - RNA, 22 nt, Homo sapiens
gcggucccgcggcgccccgccu

SEQ ID NO: 35471 - RNA, 23 nt, Homo sapiens
cccagcuagauuguaagcuccuu

SEQ ID NO: 35472 - RNA, 22 nt, Homo sapiens
ugcuguuagcccuagccccgca

SEQ ID NO: 35473 - RNA, 27 nt, Homo sapiens
uuuagcacagugcuuauacaagaaggu

SEQ ID NO: 35474 - RNA, 22 nt, Homo sapiens
cagaaagugcuucccucuagag

SEQ ID NO: 35475 - RNA, 18 nt, Homo sapiens
auucaaucuacugccuca

SEQ ID NO: 35476 - RNA, 22 nt, Homo sapiens
ucaggaacugccuuucucucca

SEQ ID NO: 35477 - RNA, 22 nt, Homo sapiens
agcgggacuuugagggccaguu

SEQ ID NO: 35478 - RNA, 22 nt, Homo sapiens
ggagagccuccacccaacccuc

SEQ ID NO: 35479 - RNA, 22 nt, Homo sapiens
agcugaguguaggauguuuaca

SEQ ID NO: 35480 - RNA, 23 nt, Homo sapiens
acauuuuucguuauugcucuuga

SEQ ID NO: 35481 - RNA, 22 nt, Homo sapiens
gcacacaauaaauguuugcuga

SEQ ID NO: 35482 - RNA, 21 nt, Homo sapiens
guccugagagcgcugccuccu

SEQ ID NO: 35483 - RNA, 22 nt, Homo sapiens
cacucuaaagggaggcacuuug

SEQ ID NO: 35484 - RNA, 21 nt, Homo sapiens
ggggagcgggggcccugccuu

SEQ ID NO: 35485 - RNA, 21 nt, Homo sapiens
gagcugcauccuggcuccggg

SEQ ID NO: 35486 - RNA, 18 nt, Homo sapiens
gaaaugagggccagcuga

SEQ ID NO: 35487 - RNA, 17 nt, Homo sapiens
gggagaggaggaggcga

SEQ ID NO: 35488 - RNA, 23 nt, Homo sapiens
aaaaugcagauuccuggacucca

SEQ ID NO: 35489 - RNA, 23 nt, Homo sapiens
gggagugaagacacggagccaga

SEQ ID NO: 35490 - RNA, 22 nt, Homo sapiens
ucaggaacugccuuucucucca

SEQ ID NO: 35491 - RNA, 22 nt, Homo sapiens
aagagggagacccaggcucgga

SEQ ID NO: 35492 - RNA, 21 nt, Homo sapiens
gcugaggucugggccaggucu

SEQ ID NO: 35493 - RNA, 25 nt, Homo sapiens
accaacggaccuacuucccuccgcc

SEQ ID NO: 35494 - RNA, 23 nt, Homo sapiens
gucacaucccucccaagacccuc

SEQ ID NO: 35495 - RNA, 22 nt, Homo sapiens
auagaugauaugcacaguacua

SEQ ID NO: 35496 - RNA, 22 nt, Homo sapiens
ucccucacacagaauuccagaa

SEQ ID NO: 35497 - RNA, 19 nt, Homo sapiens
ucccugauccaaaaaucca

SEQ ID NO: 35498 - RNA, 22 nt, Homo sapiens
augcuuuuugggguaagggcuu

SEQ ID NO: 35499 - RNA, 22 nt, Homo sapiens
uguaaaccaugaugugcugcua

SEQ ID NO: 35500 - RNA, 22 nt, Homo sapiens
agcaaaauccgcaaguacuuuu

SEQ ID NO: 35501 - RNA, 21 nt, Homo sapiens
caacugaugccuuuccaagua

SEQ ID NO: 35502 - RNA, 20 nt, Homo sapiens
cccgccgcgucgcccugggg

SEQ ID NO: 35503 - RNA, 23 nt, Homo sapiens
acaccccaaaaucgaagcacuuc

SEQ ID NO: 35504 - RNA, 21 nt, Homo sapiens
aaaacaaaaucucaccguuuu

SEQ ID NO: 35505 - RNA, 20 nt, Homo sapiens
ugggccaccgccgagcggac

SEQ ID NO: 35506 - RNA, 22 nt, Homo sapiens
cugcucaaacccuccaaugacu

SEQ ID NO: 35507 - RNA, 25 nt, Homo sapiens
accaacggaccuacuucccuccgcc

SEQ ID NO: 35508 - RNA, 21 nt, Homo sapiens
caucaccuuccuucuccucca

SEQ ID NO: 35509 - RNA, 22 nt, Homo sapiens
uauccacuacaccccgcugccu

SEQ ID NO: 35510 - RNA, 18 nt, Homo sapiens
gaaaugagggccagcuga

SEQ ID NO: 35511 - RNA, 17 nt, Homo sapiens
gacagccucucccccac

SEQ ID NO: 35512 - RNA, 22 nt, Homo sapiens
cacgaccgacgccacgccgagu

SEQ ID NO: 35513 - RNA, 17 nt, Homo sapiens
aaacauggaagcaauua

SEQ ID NO: 35514 - RNA, 23 nt, Homo sapiens
aaaucagaaucacaccuggggga

SEQ ID NO: 35515 - RNA, 22 nt, Homo sapiens
ucaccauugcuaaagugcaauu

SEQ ID NO: 35516 - RNA, 22 nt, Homo sapiens
aguccagauucugugcccacca

SEQ ID NO: 35517 - RNA, 24 nt, Homo sapiens
acgcagagcccgaaagcccccagu

SEQ ID NO: 35518 - RNA, 22 nt, Homo sapiens
gcacauguucugcggcccacca

SEQ ID NO: 35519 - RNA, 22 nt, Homo sapiens
agcccaaaaggagaauucuuug

SEQ ID NO: 35520 - RNA, 21 nt, Homo sapiens
caugcacaugcacacauacau

SEQ ID NO: 35521 - RNA, 21 nt, Homo sapiens
ugcaaugcaacuacaaugcac

SEQ ID NO: 35522 - RNA, 23 nt, Homo sapiens
guucuguccuggaagaacauacu

SEQ ID NO: 35523 - RNA, 21 nt, Homo sapiens
ggacuauagaacuuucccccu

SEQ ID NO: 35524 - RNA, 21 nt, Homo sapiens
cugaggagagaggaggugggg

SEQ ID NO: 35525 - RNA, 24 nt, Homo sapiens
ucacagguuaaagggucucaggga

SEQ ID NO: 35526 - RNA, 22 nt, Homo sapiens
ucacaaguuagggucucaggga

SEQ ID NO: 35527 - RNA, 18 nt, Homo sapiens
ugguggcagaggugggau

SEQ ID NO: 35528 - RNA, 23 nt, Homo sapiens
agcccuguucuacagcccugagg

SEQ ID NO: 35529 - RNA, 17 nt, Homo sapiens
gggagaggaggaggcga

SEQ ID NO: 35530 - RNA, 22 nt, Homo sapiens
uccacauggaguugcuguuaca

SEQ ID NO: 35531 - RNA, 22 nt, Homo sapiens
cuguuccugcugaacugagcca

SEQ ID NO: 35532 - RNA, 22 nt, Homo sapiens
auaaaugacaccuccuugugaa

SEQ ID NO: 35533 - RNA, 19 nt, Homo sapiens
uagcauacagauacgccca

SEQ ID NO: 35534 - RNA, 21 nt, Homo sapiens
caucaccuuccuucuccucca

SEQ ID NO: 35535 - RNA, 22 nt, Homo sapiens
gcugaggcuguggggcuggagu

SEQ ID NO: 35536 - RNA, 22 nt, Homo sapiens
cagcugguugaaggggaccaaa

SEQ ID NO: 35537 - RNA, 19 nt, Homo sapiens
aagccaaagccuuauccau

SEQ ID NO: 35538 - RNA, 19 nt, Homo sapiens
ucccugauccaaaaaucca

SEQ ID NO: 35539 - RNA, 23 nt, Homo sapiens
aggagaaggcaccaugggauuua

SEQ ID NO: 35540 - RNA, 20 nt, Homo sapiens
acaaugagaacccauggucu

SEQ ID NO: 35541 - RNA, 22 nt, Homo sapiens
caaacaccauugucacacucca

SEQ ID NO: 35542 - RNA, 21 nt, Homo sapiens
gagcugcauccuggcuccggg

SEQ ID NO: 35543 - RNA, 22 nt, Homo sapiens
caaacaccauugucacacucca

SEQ ID NO: 35544 - RNA, 22 nt, Homo sapiens
gcacaaaucuccagaccaccca

SEQ ID NO: 35545 - RNA, 22 nt, Homo sapiens
gcgaacgcgccacggaccaccu

SEQ ID NO: 35546 - RNA, 25 nt, Homo sapiens
accaacggaccuacuucccuccgcc

SEQ ID NO: 35547 - RNA, 24 nt, Homo sapiens
acgcgcaggccagagacccaggca

SEQ ID NO: 35548 - RNA, 22 nt, Homo sapiens
gcggucccgcggcgccccgccu

SEQ ID NO: 35549 - RNA, 24 nt, Homo sapiens
ucacagguuaaagggucucaggga

SEQ ID NO: 35550 - RNA, 22 nt, Homo sapiens
ucacaaguuagggucucaggga

SEQ ID NO: 35551 - RNA, 22 nt, Homo sapiens
ccacacacuuccuuacauucca

SEQ ID NO: 35552 - RNA, 23 nt, Homo sapiens
agcccuguucuacagcccugagg

SEQ ID NO: 35553 - RNA, 18 nt, Homo sapiens
uggcgccugaacagggac

SEQ ID NO: 35554 - RNA, 22 nt, Homo sapiens
aggucucacuuuguugcccaga

SEQ ID NO: 35555 - RNA, 22 nt, Homo sapiens
accuaauauaucaaacauauca

SEQ ID NO: 35556 - RNA, 23 nt, Homo sapiens
cgugagcuccuggaggacaggga

SEQ ID NO: 35557 - RNA, 22 nt, Homo sapiens
agccacaaucaccuucugaucu

SEQ ID NO: 35558 - RNA, 23 nt, Homo sapiens
aagaaucuugucccgcagguccu

SEQ ID NO: 35559 - RNA, 21 nt, Homo sapiens
acuuuccaggauucauuaacu

SEQ ID NO: 35560 - RNA, 25 nt, Homo sapiens
aaggagcucagaagcccugcccagc

SEQ ID NO: 35561 - RNA, 22 nt, Homo sapiens
ccucaggcacggccgggccacc

SEQ ID NO: 35562 - RNA, 22 nt, Homo sapiens
ucaguggcucagguucguugca

SEQ ID NO: 35563 - RNA, 22 nt, Homo sapiens
aaccauacaaccuacuaccuca

SEQ ID NO: 35564 - RNA, 22 nt, Homo sapiens
aggucucacuuuguugcccaga

SEQ ID NO: 35565 - RNA, 22 nt, Homo sapiens
cggugagcacccggccccugcg

SEQ ID NO: 35566 - RNA, 22 nt, Homo sapiens
uggcagcagcggagggggcaga

SEQ ID NO: 35567 - RNA, 22 nt, Homo sapiens
ugagccacugugccuggccuga

SEQ ID NO: 35568 - RNA, 22 nt, Homo sapiens
acugccugucugugccugcugu

SEQ ID NO: 35569 - RNA, 22 nt, Homo sapiens
acaguucuucaacuggcagcuu

SEQ ID NO: 35570 - RNA, 20 nt, Homo sapiens
ccagcagcaccuggggcagu

SEQ ID NO: 35571 - RNA, 22 nt, Homo sapiens
accagguuccaccccagcaggc

SEQ ID NO: 35572 - RNA, 22 nt, Homo sapiens
aucgggaggggacugagccuga

SEQ ID NO: 35573 - RNA, 25 nt, Homo sapiens
aaggagcucagaagcccugcccagc

SEQ ID NO: 35574 - RNA, 24 nt, Homo sapiens
acgcgcaggccagagacccaggca

SEQ ID NO: 35575 - RNA, 22 nt, Homo sapiens
gcugaggcuguggggcuggagu

SEQ ID NO: 35576 - RNA, 20 nt, Homo sapiens
cucaaagcaaacccugcaga

SEQ ID NO: 35577 - RNA, 22 nt, Homo sapiens
cuagggaacacagggcugguga

SEQ ID NO: 35578 - RNA, 22 nt, Homo sapiens
caaacaccauugucacacucca

SEQ ID NO: 35579 - RNA, 21 nt, Homo sapiens
cugggggacggagcagaagga

SEQ ID NO: 35580 - RNA, 23 nt, Homo sapiens
cggccugauucacaacaccagcu

SEQ ID NO: 35581 - RNA, 23 nt, Homo sapiens
cuaccugcacuguaagcacuuug

SEQ ID NO: 35582 - RNA, 22 nt, Homo sapiens
acccuuaucaguucuccgucca

SEQ ID NO: 35583 - RNA, 21 nt, Homo sapiens
gaccaaucgccguccccgccg

SEQ ID NO: 35584 - RNA, 21 nt, Homo sapiens
aagugucagacacgguggugg

SEQ ID NO: 35585 - RNA, 22 nt, Homo sapiens
ucagaccgagacaagugcaaug

SEQ ID NO: 35586 - RNA, 24 nt, Homo sapiens
ugggagaaccucccugcuucugcu

SEQ ID NO: 35587 - RNA, 22 nt, Homo sapiens
caugauugccacgucugcagua

SEQ ID NO: 35588 - RNA, 21 nt, Homo sapiens
ugauugccacugucugcagua

SEQ ID NO: 35589 - RNA, 21 nt, Homo sapiens
cacucugaagggaagcgcuuu

SEQ ID NO: 35590 - RNA, 22 nt, Homo sapiens
aguccagauucugugcccacca

SEQ ID NO: 35591 - RNA, 22 nt, Homo sapiens
gaacuugcuaaaaaugcagaau

SEQ ID NO: 35592 - RNA, 22 nt, Homo sapiens
gcacauguucugcggcccacca

SEQ ID NO: 35593 - RNA, 22 nt, Homo sapiens
gcggucccgcggcgccccgccu

SEQ ID NO: 35594 - RNA, 22 nt, Homo sapiens
ugcuguuagcccuagccccgca

SEQ ID NO: 35595 - RNA, 21 nt, Homo sapiens
ggggagcgggggcccugccuu

SEQ ID NO: 35596 - RNA, 19 nt, Homo sapiens
ccugcuccaaaaauccauu

SEQ ID NO: 35597 - RNA, 21 nt, Homo sapiens
auguaggccuuuagaucacuu

SEQ ID NO: 35598 - RNA, 22 nt, Homo sapiens
augggacauccuacauaugcaa

SEQ ID NO: 35599 - RNA, 23 nt, Homo sapiens
gggcucuuacucccucaggcacu

SEQ ID NO: 35600 - RNA, 17 nt, Homo sapiens
gggagaggaggaggcga

SEQ ID NO: 35601 - RNA, 21 nt, Homo sapiens
cggggugcacgggcggagggc

SEQ ID NO: 35602 - RNA, 22 nt, Homo sapiens
acaccuggcuccacacgcgggc

SEQ ID NO: 35603 - RNA, 22 nt, Homo sapiens
ucaggaacugccuuucucucca

SEQ ID NO: 35604 - RNA, 21 nt, Homo sapiens
gaccaaucgccguccccgccg

SEQ ID NO: 35605 - RNA, 23 nt, Homo sapiens
aaagucucgcucucugccccuca

SEQ ID NO: 35606 - RNA, 19 nt, Homo sapiens
gccugcugacaccgugccu

SEQ ID NO: 35607 - RNA, 25 nt, Homo sapiens
accaacggaccuacuucccuccgcc

SEQ ID NO: 35608 - RNA, 22 nt, Homo sapiens
gcggucccgcggcgccccgccu

SEQ ID NO: 35609 - RNA, 22 nt, Homo sapiens
ugcuguuagcccuagccccgca

SEQ ID NO: 35610 - RNA, 21 nt, Homo sapiens
agcgccuuuggcagcuagagu

SEQ ID NO: 35611 - RNA, 23 nt, Homo sapiens
gggagugaagacacggagccaga

SEQ ID NO: 35612 - RNA, 21 nt, Homo sapiens
gggcaucugggacgcgcagga

SEQ ID NO: 35613 - RNA, 22 nt, Homo sapiens
cggugagcacccggccccugcg

SEQ ID NO: 35614 - RNA, 23 nt, Homo sapiens
cccaacagacauggcgguacuca

SEQ ID NO: 35615 - RNA, 22 nt, Homo sapiens
ccuggcacacaguagaccuuca

SEQ ID NO: 35616 - RNA, 22 nt, Homo sapiens
agcucagaacccagaggucuca

SEQ ID NO: 35617 - RNA, 17 nt, Homo sapiens
gggagaggaggaggcga

SEQ ID NO: 35618 - RNA, 23 nt, Homo sapiens
aaaaugcagauuccuggacucca

SEQ ID NO: 35619 - RNA, 20 nt, Homo sapiens
acagcaaggagggcaggagg

SEQ ID NO: 35620 - RNA, 22 nt, Homo sapiens
acugccugucugugccugcugu

SEQ ID NO: 35621 - RNA, 22 nt, Homo sapiens
accagguuccaccccagcaggc

SEQ ID NO: 35622 - RNA, 22 nt, Homo sapiens
aggaaaccagcaaguguugacg

SEQ ID NO: 35623 - RNA, 21 nt, Homo sapiens
caaaaaccacaaauaccuuug

SEQ ID NO: 35624 - RNA, 22 nt, Homo sapiens
gcugaggcuguggggcuggagu

SEQ ID NO: 35625 - RNA, 22 nt, Homo sapiens
caaacaccauugucacacucca

SEQ ID NO: 35626 - RNA, 22 nt, Homo sapiens
ugaagaagggggggaagggcgu

SEQ ID NO: 35627 - RNA, 22 nt, Homo sapiens
ccaguagcacggcucaguccag

SEQ ID NO: 35628 - RNA, 22 nt, Homo sapiens
augcccuuuuaacauugcacug

SEQ ID NO: 35629 - RNA, 22 nt, Homo sapiens
augcccuuucaucauugcacug

SEQ ID NO: 35630 - RNA, 20 nt, Homo sapiens
uacugcuuccacagcucccc

SEQ ID NO: 35631 - RNA, 23 nt, Homo sapiens
agggauuccugggaaaacuggac

SEQ ID NO: 35632 - RNA, 22 nt, Homo sapiens
acaaaguucuguagugcacuga

SEQ ID NO: 35633 - RNA, 22 nt, Homo sapiens
acaaaguucugugaugcacuga

SEQ ID NO: 35634 - RNA, 21 nt, Homo sapiens
ccaaguucugucaugcacuga

SEQ ID NO: 35635 - RNA, 18 nt, Homo sapiens
ggagaggagggcacugga

SEQ ID NO: 35636 - RNA, 23 nt, Homo sapiens
cagcugcuuuugggauuccguug

SEQ ID NO: 35637 - RNA, 21 nt, Homo sapiens
ggcugucaauucauaggucag

SEQ ID NO: 35638 - RNA, 21 nt, Homo sapiens
gucugucaauucauaggucau

SEQ ID NO: 35639 - RNA, 22 nt, Homo sapiens
ucagaccgagacaagugcaaug

SEQ ID NO: 35640 - RNA, 23 nt, Homo sapiens
gcuuugacaauacuauugcacug

SEQ ID NO: 35641 - RNA, 23 nt, Homo sapiens
gcuuugacaauaucauugcacug

SEQ ID NO: 35642 - RNA, 22 nt, Homo sapiens
ugcaacuuaguaaugugcaaua

SEQ ID NO: 35643 - RNA, 22 nt, Homo sapiens
uacagauggauaccgugcaauu

SEQ ID NO: 35644 - RNA, 22 nt, Homo sapiens
ucaccauugcuaaagugcaauu

SEQ ID NO: 35645 - RNA, 21 nt, Homo sapiens
ccuucugacuccaaguccagu

SEQ ID NO: 35646 - RNA, 22 nt, Homo sapiens
gccuucugacccuaaguccagu

SEQ ID NO: 35647 - RNA, 23 nt, Homo sapiens
acccuauaagcaauauugcacua

SEQ ID NO: 35648 - RNA, 21 nt, Homo sapiens
guguauaugcccauggacugc

SEQ ID NO: 35649 - RNA, 21 nt, Homo sapiens
agacacaccacggcacacuuc

SEQ ID NO: 35650 - RNA, 20 nt, Homo sapiens
agagaugagagaaacacccu

SEQ ID NO: 35651 - RNA, 25 nt, Homo sapiens
accaacggaccuacuucccuccgcc

SEQ ID NO: 35652 - RNA, 22 nt, Homo sapiens
acaggccgggacaagugcaaua

SEQ ID NO: 35653 - RNA, 22 nt, Homo sapiens
ggaggccgggacgagugcaaua

SEQ ID NO: 35654 - RNA, 21 nt, Homo sapiens
gcugaggucugggccaggucu

SEQ ID NO: 35655 - RNA, 22 nt, Homo sapiens
gugggguggguggucaggccga

SEQ ID NO: 35656 - RNA, 22 nt, Homo sapiens
ucccucacacagaauuccagaa

SEQ ID NO: 35657 - RNA, 23 nt, Homo sapiens
cuaccugcacuaugagcacuuug

SEQ ID NO: 35658 - RNA, 22 nt, Homo sapiens
ucagaccgagacaagugcaaug

SEQ ID NO: 35659 - RNA, 22 nt, Homo sapiens
auguaugugggacgguaaacca

SEQ ID NO: 35660 - RNA, 23 nt, Homo sapiens
aaagucucgcucucugccccuca

SEQ ID NO: 35661 - RNA, 22 nt, Homo sapiens
aggaaaccagcaaguguugacg

SEQ ID NO: 35662 - RNA, 18 nt, Homo sapiens
acccucugaaaggaagca

SEQ ID NO: 35663 - RNA, 22 nt, Homo sapiens
aaagugcuucuuaccuccagau

SEQ ID NO: 35664 - RNA, 23 nt, Homo sapiens
acacucuaaagagaagcgcuuug

SEQ ID NO: 35665 - RNA, 21 nt, Homo sapiens
cacucugaagggaagcgcuuu

SEQ ID NO: 35666 - RNA, 21 nt, Homo sapiens
agaaaguacuucccucuggag

SEQ ID NO: 35667 - RNA, 21 nt, Homo sapiens
agaaagugcaucccucuggag

SEQ ID NO: 35668 - RNA, 21 nt, Homo sapiens
acuagacugugagcuccucga

SEQ ID NO: 35669 - RNA, 22 nt, Homo sapiens
acaguucuucaacuggcagcuu

SEQ ID NO: 35670 - RNA, 21 nt, Homo sapiens
aagugucagacacgguggugg

SEQ ID NO: 35671 - RNA, 21 nt, Homo sapiens
aagacgggaggagaggaguga

SEQ ID NO: 35672 - RNA, 23 nt, Homo sapiens
agcaaaaaugugcuagugccaaa

SEQ ID NO: 35673 - RNA, 17 nt, Homo sapiens
gggagaggaggaggcga

SEQ ID NO: 35674 - RNA, 21 nt, Homo sapiens
gaccaaucgccguccccgccg

SEQ ID NO: 35675 - RNA, 23 nt, Homo sapiens
acgggugcgauuucugugugaga

SEQ ID NO: 35676 - RNA, 22 nt, Homo sapiens
gagcccuggacuaggagucagc

SEQ ID NO: 35677 - RNA, 22 nt, Homo sapiens
gcgaauauaacacggucgaucu

SEQ ID NO: 35678 - RNA, 23 nt, Homo sapiens
gggccgcagcugucgcccguguc

SEQ ID NO: 35679 - RNA, 25 nt, Homo sapiens
aggccgccacccgcccgcgaucccu

SEQ ID NO: 35680 - RNA, 22 nt, Homo sapiens
gcggucccgcggcgccccgccu

SEQ ID NO: 35681 - RNA, 23 nt, Homo sapiens
cuccagccccuccagggcuuccu

SEQ ID NO: 35682 - RNA, 22 nt, Homo sapiens
ugcuguuagcccuagccccgca

SEQ ID NO: 35683 - RNA, 22 nt, Homo sapiens
ggcagagagucagagcgcggau

SEQ ID NO: 35684 - RNA, 22 nt, Homo sapiens
gaccucagcuaugacagcacuu

SEQ ID NO: 35685 - RNA, 22 nt, Homo sapiens
ucaggaacugccuuucucucca

SEQ ID NO: 35686 - RNA, 21 nt, Homo sapiens
gagcugcauccuggcuccggg

SEQ ID NO: 35687 - RNA, 22 nt, Homo sapiens
caaacaccauugucacacucca

SEQ ID NO: 35688 - RNA, 22 nt, Homo sapiens
caaacaccauugucacacucca

SEQ ID NO: 35689 - RNA, 21 nt, Homo sapiens
gaccaaucgccguccccgccg

SEQ ID NO: 35690 - RNA, 21 nt, Homo sapiens
gaccaaucgccguccccgccg

SEQ ID NO: 35691 - RNA, 23 nt, Homo sapiens
aggagaaggcaccaugggauuua

SEQ ID NO: 35692 - RNA, 21 nt, Homo sapiens
cugcugggccacaacguggga

SEQ ID NO: 35693 - RNA, 22 nt, Homo sapiens
gcggucccgcggcgccccgccu

SEQ ID NO: 35694 - RNA, 22 nt, Homo sapiens
gcggucccgcggcgccccgccu

SEQ ID NO: 35695 - RNA, 22 nt, Homo sapiens
ugcuguuagcccuagccccgca

SEQ ID NO: 35696 - RNA, 23 nt, Homo sapiens
ggaagccaucaagucgcugcagg

SEQ ID NO: 35697 - RNA, 23 nt, Homo sapiens
ggaagccaucaagucgcugcagg

SEQ ID NO: 35698 - RNA, 24 nt, Homo sapiens
gaagucacucccaggcagcugcaa

SEQ ID NO: 35699 - RNA, 21 nt, Homo sapiens
gggcaucugggacgcgcagga

SEQ ID NO: 35700 - RNA, 21 nt, Homo sapiens
gaccaaucgccguccccgccg

SEQ ID NO: 35701 - RNA, 22 nt, Homo sapiens
uggcagcagcggagggggcaga

SEQ ID NO: 35702 - RNA, 22 nt, Homo sapiens
acaguucuucaacuggcagcuu

SEQ ID NO: 35703 - RNA, 22 nt, Homo sapiens
agcugaguguaggauguuuaca

SEQ ID NO: 35704 - RNA, 20 nt, Homo sapiens
ccagcagcaccuggggcagu

SEQ ID NO: 35705 - RNA, 23 nt, Homo sapiens
cggcucugucgucgaggcgcuca

SEQ ID NO: 35706 - RNA, 21 nt, Homo sapiens
auccuguacugagcugccccg

SEQ ID NO: 35707 - RNA, 21 nt, Homo sapiens
cccgaggagccgggcaggcuu

SEQ ID NO: 35708 - RNA, 22 nt, Homo sapiens
gcggucccgcggcgccccgccu

SEQ ID NO: 35709 - RNA, 22 nt, Homo sapiens
ugcuguuagcccuagccccgca

SEQ ID NO: 35710 - RNA, 21 nt, Homo sapiens
caucaccuuccuucuccucca

SEQ ID NO: 35711 - RNA, 22 nt, Homo sapiens
ggaggccgggacgagugcaaua

SEQ ID NO: 35712 - RNA, 17 nt, Homo sapiens
gggagaggaggaggcga

SEQ ID NO: 35713 - RNA, 18 nt, Homo sapiens
aucacauucaccucccug

SEQ ID NO: 35714 - RNA, 22 nt, Homo sapiens
ucaggaacugccuuucucucca

SEQ ID NO: 35715 - RNA, 22 nt, Homo sapiens
ucaggaacugccuuucucucca

SEQ ID NO: 35716 - RNA, 20 nt, Homo sapiens
acagcaaggagggcaggagg

SEQ ID NO: 35717 - RNA, 22 nt, Homo sapiens
ucagaccgagacaagugcaaug

SEQ ID NO: 35718 - RNA, 22 nt, Homo sapiens
ucgcccucucaacccagcuuuu

SEQ ID NO: 35719 - RNA, 22 nt, Homo sapiens
uugcccucucaacccagcuuuu

SEQ ID NO: 35720 - RNA, 20 nt, Homo sapiens
acccucucaacccagcuuuu

SEQ ID NO: 35721 - RNA, 19 nt, Homo sapiens
uccucucaacccagcuuuu

SEQ ID NO: 35722 - RNA, 22 nt, Homo sapiens
gaauucaucacggccagccucu

SEQ ID NO: 35723 - RNA, 22 nt, Homo sapiens
aggaaaccagcaaguguugacg

SEQ ID NO: 35724 - RNA, 25 nt, Homo sapiens
accaacggaccuacuucccuccgcc

SEQ ID NO: 35725 - RNA, 22 nt, Homo sapiens
ugcuguuagcccuagccccgca

SEQ ID NO: 35726 - RNA, 21 nt, Homo sapiens
caucaccuuccuucuccucca

SEQ ID NO: 35727 - RNA, 22 nt, Homo sapiens
caaacaccauugucacacucca

SEQ ID NO: 35728 - RNA, 21 nt, Homo sapiens
gaccaaucgccguccccgccg

SEQ ID NO: 35729 - RNA, 22 nt, Homo sapiens
uccacauggaguugcuguuaca

SEQ ID NO: 35730 - RNA, 23 nt, Homo sapiens
uauucucgcacggacuacaacca

SEQ ID NO: 35731 - RNA, 22 nt, Homo sapiens
ccuggcacacaguagaccuuca

SEQ ID NO: 35732 - RNA, 22 nt, Homo sapiens
acacaccaaggauaauuucucc

SEQ ID NO: 35733 - RNA, 21 nt, Homo sapiens
cugaaaccaaguaugggucgc

SEQ ID NO: 35734 - RNA, 22 nt, Homo sapiens
gcggucccgcggcgccccgccu

SEQ ID NO: 35735 - RNA, 20 nt, Homo sapiens
uacugcuuccacagcucccc

SEQ ID NO: 35736 - RNA, 24 nt, Homo sapiens
cacccccagagccucagcucccca

SEQ ID NO: 35737 - RNA, 23 nt, Homo sapiens
cacaaauucgguucuacagggua

SEQ ID NO: 35738 - RNA, 21 nt, Homo sapiens
ccaaccaaugaaagaaugcuu

SEQ ID NO: 35739 - RNA, 22 nt, Homo sapiens
acaaaguucuguagugcacuga

SEQ ID NO: 35740 - RNA, 22 nt, Homo sapiens
acaaaguucugugaugcacuga

SEQ ID NO: 35741 - RNA, 21 nt, Homo sapiens
ccaaguucugucaugcacuga

SEQ ID NO: 35742 - RNA, 22 nt, Homo sapiens
ucaggaacugccuuucucucca

SEQ ID NO: 35743 - RNA, 21 nt, Homo sapiens
gaccaaucgccguccccgccg

SEQ ID NO: 35744 - RNA, 19 nt, Homo sapiens
guccugaauuccgcagccu

SEQ ID NO: 35745 - RNA, 22 nt, Homo sapiens
gcggucccgcggcgccccgccu

SEQ ID NO: 35746 - RNA, 22 nt, Homo sapiens
ugcuguuagcccuagccccgca

SEQ ID NO: 35747 - RNA, 21 nt, Homo sapiens
ccccucccagccucccugcca

SEQ ID NO: 35748 - RNA, 23 nt, Homo sapiens
gucagaccccgagggguccucgc

SEQ ID NO: 35749 - RNA, 18 nt, Homo sapiens
ugguggcagaggugggau

SEQ ID NO: 35750 - RNA, 19 nt, Homo sapiens
ucccugauccaaaaaucca

SEQ ID NO: 35751 - RNA, 23 nt, Homo sapiens
gggagugaagacacggagccaga

SEQ ID NO: 35752 - RNA, 22 nt, Homo sapiens
gcaaaaguaauugagauuuuug

SEQ ID NO: 35753 - RNA, 21 nt, Homo sapiens
aucagagguucagcuuacccu

SEQ ID NO: 35754 - RNA, 25 nt, Homo sapiens
acggagcugucccaacaccaccccu

SEQ ID NO: 35755 - RNA, 21 nt, Homo sapiens
ggggagcgggggcccugccuu

SEQ ID NO: 35756 - RNA, 22 nt, Homo sapiens
acacacccacgcgagccggaaa

SEQ ID NO: 35757 - RNA, 21 nt, Homo sapiens
cggcucggguggcggcgacgg

SEQ ID NO: 35758 - RNA, 21 nt, Homo sapiens
auaauggagaccaggccacga

SEQ ID NO: 35759 - RNA, 19 nt, Homo sapiens
ccaccucccgaguccucac

SEQ ID NO: 35760 - RNA, 18 nt, Homo sapiens
cccccaccaccacgcccg

SEQ ID NO: 35761 - RNA, 24 nt, Homo sapiens
acugcuggucuucagucagggcca

SEQ ID NO: 35762 - RNA, 21 nt, Homo sapiens
uucuaggauaggcccaggggc

SEQ ID NO: 35763 - RNA, 23 nt, Homo sapiens
ggacauuguuucagugcccaagu

SEQ ID NO: 35764 - RNA, 22 nt, Homo sapiens
ccucaggcacggccgggccacc

SEQ ID NO: 35765 - RNA, 23 nt, Homo sapiens
cuccagccccuccagggcuuccu

SEQ ID NO: 35766 - RNA, 21 nt, Homo sapiens
aucugcacugucagcacuuua

SEQ ID NO: 35767 - RNA, 21 nt, Homo sapiens
gagcugcauccuggcuccggg

SEQ ID NO: 35768 - RNA, 22 nt, Homo sapiens
aggucucacuuuguugcccaga

SEQ ID NO: 35769 - RNA, 21 nt, Homo sapiens
gggcaucugggacgcgcagga

SEQ ID NO: 35770 - RNA, 23 nt, Homo sapiens
ucucacccagguagcaaggauua

SEQ ID NO: 35771 - RNA, 22 nt, Homo sapiens
aggaaaccagcaaguguugacg

SEQ ID NO: 35772 - RNA, 22 nt, Homo sapiens
gaacuugcuaaaaaugcagaau

SEQ ID NO: 35773 - RNA, 22 nt, Homo sapiens
gcaaagguaauugcuguuuucg

SEQ ID NO: 35774 - RNA, 25 nt, Homo sapiens
aaggagcucagaagcccugcccagc

SEQ ID NO: 35775 - RNA, 23 nt, Homo sapiens
ggacauuguuucagugcccaagu

SEQ ID NO: 35776 - RNA, 23 nt, Homo sapiens
cuccagccccuccagggcuuccu

SEQ ID NO: 35777 - RNA, 22 nt, Homo sapiens
gggagaggucucccugcgcaca

SEQ ID NO: 35778 - RNA, 17 nt, Homo sapiens
gggagaggaggaggcga

SEQ ID NO: 35779 - RNA, 21 nt, Homo sapiens
agggcucaucuugguccugca

SEQ ID NO: 35780 - RNA, 25 nt, Homo sapiens
cagcgucugccggaacccguuccca

SEQ ID NO: 35781 - RNA, 21 nt, Homo sapiens
gaccaaucgccguccccgccg

SEQ ID NO: 35782 - RNA, 25 nt, Homo sapiens
accaacggaccuacuucccuccgcc

SEQ ID NO: 35783 - RNA, 22 nt, Homo sapiens
gcggucccgcggcgccccgccu

SEQ ID NO: 35784 - RNA, 20 nt, Homo sapiens
uccccacagacccagagccg

SEQ ID NO: 35785 - RNA, 21 nt, Homo sapiens
caucaccuuccuucuccucca

SEQ ID NO: 35786 - RNA, 21 nt, Homo sapiens
auaauggagaccaggccacga

SEQ ID NO: 35787 - RNA, 21 nt, Homo sapiens
cggggugcacgggcggagggc

SEQ ID NO: 35788 - RNA, 20 nt, Homo sapiens
acagcaaggagggcaggagg

SEQ ID NO: 35789 - RNA, 23 nt, Homo sapiens
gaaacccagcagacaauguagcu

SEQ ID NO: 35790 - RNA, 21 nt, Homo sapiens
ggaaaucccuggcaaugugau

SEQ ID NO: 35791 - RNA, 21 nt, Homo sapiens
gguaaucccuggcaaugugau

SEQ ID NO: 35792 - RNA, 22 nt, Homo sapiens
uacagauggauaccgugcaauu

SEQ ID NO: 35793 - RNA, 23 nt, Homo sapiens
aagaaucuugucccgcagguccu

SEQ ID NO: 35794 - RNA, 21 nt, Homo sapiens
guucuaacccauuguggccaa

SEQ ID NO: 35795 - RNA, 21 nt, Homo sapiens
guucuaacccauuguggccaa

SEQ ID NO: 35796 - RNA, 25 nt, Homo sapiens
acggagcugucccaacaccaccccu

SEQ ID NO: 35797 - RNA, 21 nt, Homo sapiens
gcugaggucugggccaggucu

SEQ ID NO: 35798 - RNA, 20 nt, Homo sapiens
cccugcgccaucuccucuac

SEQ ID NO: 35799 - RNA, 21 nt, Homo sapiens
cuacgcagaaaggacacagug

SEQ ID NO: 35800 - RNA, 23 nt, Homo sapiens
gcacaugugcacacagccgggug

SEQ ID NO: 35801 - RNA, 20 nt, Homo sapiens
cucaaagcaaacccugcaga

SEQ ID NO: 35802 - RNA, 20 nt, Homo sapiens
cucaaagcaaacccugcaga

SEQ ID NO: 35803 - RNA, 20 nt, Homo sapiens
ggggcagacagacgaggaag

SEQ ID NO: 35804 - RNA, 20 nt, Homo sapiens
ggcauucaccgcgugccuua

SEQ ID NO: 35805 - RNA, 22 nt, Homo sapiens
gcuggguggagaagguggugaa

SEQ ID NO: 35806 - RNA, 21 nt, Homo sapiens
agcuaugccagcaucuugccu

SEQ ID NO: 35807 - RNA, 22 nt, Homo sapiens
cgauguaguccaaaggcacaua

SEQ ID NO: 35808 - RNA, 21 nt, Homo sapiens
ucuacucagaagggugccuua

SEQ ID NO: 35809 - RNA, 18 nt, Homo sapiens
acccucugaaaggaagca

SEQ ID NO: 35810 - RNA, 23 nt, Homo sapiens
gaaagugcuucuuuccucgagaa

SEQ ID NO: 35811 - RNA, 22 nt, Homo sapiens
aaagugcuucuuaccuccagau

SEQ ID NO: 35812 - RNA, 19 nt, Homo sapiens
auuuugguacagcagcuca

SEQ ID NO: 35813 - RNA, 21 nt, Homo sapiens
gcugaggucugggccaggucu

SEQ ID NO: 35814 - RNA, 19 nt, Homo sapiens
gccucagaggcagcugcuu

SEQ ID NO: 35815 - RNA, 21 nt, Homo sapiens
ugacugacagcuuuuugagua

SEQ ID NO: 35816 - RNA, 21 nt, Homo sapiens
cacaaccucaguguuuccagg

SEQ ID NO: 35817 - RNA, 18 nt, Homo sapiens
ccacugaaccacccaugc

SEQ ID NO: 35818 - RNA, 22 nt, Homo sapiens
cacugguacaaggguugggaga

SEQ ID NO: 35819 - RNA, 22 nt, Homo sapiens
ucaggaacugccuuucucucca

SEQ ID NO: 35820 - RNA, 21 nt, Homo sapiens
aggcggcaggcacaggacugg

SEQ ID NO: 35821 - RNA, 22 nt, Homo sapiens
uccacauggaguugcuguuaca

SEQ ID NO: 35822 - RNA, 22 nt, Homo sapiens
ugggguauuugacaaacugaca

SEQ ID NO: 35823 - RNA, 21 nt, Homo sapiens
aucugcacugucagcacuuua

SEQ ID NO: 35824 - RNA, 23 nt, Homo sapiens
gcuuugacaauaucauugcacug

SEQ ID NO: 35825 - RNA, 23 nt, Homo sapiens
gaaaaacgcccccuggcuugaaa

SEQ ID NO: 35826 - RNA, 24 nt, Homo sapiens
gaggugacucuauccuaugucuuu

SEQ ID NO: 35827 - RNA, 23 nt, Homo sapiens
gucacaucccucccaagacccuc

SEQ ID NO: 35828 - RNA, 21 nt, Homo sapiens
agcgccuuuggcagcuagagu

SEQ ID NO: 35829 - RNA, 23 nt, Homo sapiens
gggagugaagacacggagccaga

SEQ ID NO: 35830 - RNA, 23 nt, Homo sapiens
cuaucugcacuagaugcaccuua

SEQ ID NO: 35831 - RNA, 22 nt, Homo sapiens
agcgggacuuugagggccaguu

SEQ ID NO: 35832 - RNA, 22 nt, Homo sapiens
gaaccuaucuccccucuggacc

SEQ ID NO: 35833 - RNA, 21 nt, Homo sapiens
gcggaacuuagccacugugaa

SEQ ID NO: 35834 - RNA, 21 nt, Homo sapiens
gcagaacuuagccacugugaa

SEQ ID NO: 35835 - RNA, 22 nt, Homo sapiens
ucgcccucucaacccagcuuuu

SEQ ID NO: 35836 - RNA, 22 nt, Homo sapiens
uugcccucucaacccagcuuuu

SEQ ID NO: 35837 - RNA, 20 nt, Homo sapiens
acccucucaacccagcuuuu

SEQ ID NO: 35838 - RNA, 19 nt, Homo sapiens
uccucucaacccagcuuuu

SEQ ID NO: 35839 - RNA, 22 nt, Homo sapiens
uauucaggaacauauugcaaaa

SEQ ID NO: 35840 - RNA, 22 nt, Homo sapiens
guacaaaaguaauuacaguuuu

SEQ ID NO: 35841 - RNA, 21 nt, Homo sapiens
cugaaaccaaguaugggucgc

SEQ ID NO: 35842 - RNA, 19 nt, Homo sapiens
gccucagaggcagcugcuu

SEQ ID NO: 35843 - RNA, 23 nt, Homo sapiens
uguaggcuggggauaaaugaaua

SEQ ID NO: 35844 - RNA, 20 nt, Homo sapiens
cccugcgccaucuccucuac

SEQ ID NO: 35845 - RNA, 21 nt, Homo sapiens
agaaguagaccauguguccua

SEQ ID NO: 35846 - RNA, 22 nt, Homo sapiens
gugggguggguggucaggccga

SEQ ID NO: 35847 - RNA, 17 nt, Homo sapiens
gacagccucucccccac

SEQ ID NO: 35848 - RNA, 21 nt, Homo sapiens
acuagacugugagcuccucga

SEQ ID NO: 35849 - RNA, 22 nt, Homo sapiens
uggcagcagcggagggggcaga

SEQ ID NO: 35850 - RNA, 20 nt, Homo sapiens
acagcaaggagggcaggagg

SEQ ID NO: 35851 - RNA, 20 nt, Homo sapiens
ccagcagcaccuggggcagu

SEQ ID NO: 35852 - RNA, 23 nt, Homo sapiens
aaaucagaaucacaccuggggga

SEQ ID NO: 35853 - RNA, 22 nt, Homo sapiens
acaaaaguugccuuugugugau

SEQ ID NO: 35854 - RNA, 21 nt, Homo sapiens
auccuguacugagcugccccg

SEQ ID NO: 35855 - RNA, 23 nt, Homo sapiens
cugcagaacuguucccgcugcua

SEQ ID NO: 35856 - RNA, 23 nt, Homo sapiens
aaucgcgguuuauaccaaaugaa

SEQ ID NO: 35857 - RNA, 21 nt, Homo sapiens
aguucucccaacguaaaccca

SEQ ID NO: 35858 - RNA, 24 nt, Homo sapiens
acgcagagcccgaaagcccccagu

SEQ ID NO: 35859 - RNA, 24 nt, Homo sapiens
acgcgcaggccagagacccaggca

SEQ ID NO: 35860 - RNA, 21 nt, Homo sapiens
caucaccuuccuucuccucca

SEQ ID NO: 35861 - RNA, 22 nt, Homo sapiens
gcugaggcuguggggcuggagu

SEQ ID NO: 35862 - RNA, 22 nt, Homo sapiens
uauggaugcaaaaugaucccaa

SEQ ID NO: 35863 - RNA, 23 nt, Homo sapiens
aaccaagaccccggagaucccag

SEQ ID NO: 35864 - RNA, 21 nt, Homo sapiens
cggcucggguggcggcgacgg

SEQ ID NO: 35865 - RNA, 17 nt, Homo sapiens
gggagaggaggaggcga

SEQ ID NO: 35866 - RNA, 22 nt, Homo sapiens
cacgaccgacgccacgccgagu

SEQ ID NO: 35867 - RNA, 20 nt, Homo sapiens
acagcaaggagggcaggagg

SEQ ID NO: 35868 - RNA, 22 nt, Homo sapiens
aagagggagacccaggcucgga

SEQ ID NO: 35869 - RNA, 23 nt, Homo sapiens
guagugggccgagccgagugaca

SEQ ID NO: 35870 - RNA, 20 nt, Homo sapiens
ggggggcgaggcagguguga

SEQ ID NO: 35871 - RNA, 23 nt, Homo sapiens
aaaaugcagauuccuggacucca

SEQ ID NO: 35872 - RNA, 23 nt, Homo sapiens
aggaacagcagcagcccgggccg

SEQ ID NO: 35873 - RNA, 22 nt, Homo sapiens
uggcagcagcggagggggcaga

SEQ ID NO: 35874 - RNA, 22 nt, Homo sapiens
acugccugucugugccugcugu

SEQ ID NO: 35875 - RNA, 21 nt, Homo sapiens
acaggauugagggggggcccu

SEQ ID NO: 35876 - RNA, 20 nt, Homo sapiens
ccagcagcaccuggggcagu

SEQ ID NO: 35877 - RNA, 22 nt, Homo sapiens
accagguuccaccccagcaggc

SEQ ID NO: 35878 - RNA, 21 nt, Homo sapiens
auccuguacugagcugccccg

SEQ ID NO: 35879 - RNA, 18 nt, Homo sapiens
augacaccucccugugaa

SEQ ID NO: 35880 - RNA, 19 nt, Homo sapiens
gcucuaagaaagccacacu

SEQ ID NO: 35881 - RNA, 22 nt, Homo sapiens
gcggucccgcggcgccccgccu

SEQ ID NO: 35882 - RNA, 22 nt, Homo sapiens
ugcuguuagcccuagccccgca

SEQ ID NO: 35883 - RNA, 22 nt, Homo sapiens
agccaagcucagacggauccga

SEQ ID NO: 35884 - RNA, 21 nt, Homo sapiens
ucacccagaucugcggccuaa

SEQ ID NO: 35885 - RNA, 18 nt, Homo sapiens
aucacauucaccucccug

SEQ ID NO: 35886 - RNA, 23 nt, Homo sapiens
gggagugaagacacggagccaga

SEQ ID NO: 35887 - RNA, 21 nt, Homo sapiens
gaccaaucgccguccccgccg

SEQ ID NO: 35888 - RNA, 22 nt, Homo sapiens
acaguucuucaacuggcagcuu

SEQ ID NO: 35889 - RNA, 23 nt, Homo sapiens
ucaacgggagugaucgugucauu

SEQ ID NO: 35890 - RNA, 23 nt, Homo sapiens
ucucgugacaugaugauccccga

SEQ ID NO: 35891 - RNA, 22 nt, Homo sapiens
acaguggucaucgagugacaca

SEQ ID NO: 35892 - RNA, 25 nt, Homo sapiens
acggagcugucccaacaccaccccu

SEQ ID NO: 35893 - RNA, 22 nt, Homo sapiens
gcggucccgcggcgccccgccu

SEQ ID NO: 35894 - RNA, 21 nt, Homo sapiens
uucaguuaucacaguacugua

SEQ ID NO: 35895 - RNA, 23 nt, Homo sapiens
cugugggagggcaguggugagag

SEQ ID NO: 35896 - RNA, 22 nt, Homo sapiens
gcaaagguaauugcuguuuucg

SEQ ID NO: 35897 - RNA, 20 nt, Homo sapiens
acaaugagaacccauggucu

SEQ ID NO: 35898 - RNA, 22 nt, Homo sapiens
caaacaccauugucacacucca

SEQ ID NO: 35899 - RNA, 21 nt, Homo sapiens
auaauggagaccaggccacga

SEQ ID NO: 35900 - RNA, 19 nt, Homo sapiens
ccaccucccgaguccucac

SEQ ID NO: 35901 - RNA, 21 nt, Homo sapiens
ggucagaacccaucauucacu

SEQ ID NO: 35902 - RNA, 18 nt, Homo sapiens
aucacauucaccucccug

SEQ ID NO: 35903 - RNA, 23 nt, Homo sapiens
gggagugaagacacggagccaga

SEQ ID NO: 35904 - RNA, 22 nt, Homo sapiens
uccacauggaguugcuguuaca

SEQ ID NO: 35905 - RNA, 21 nt, Homo sapiens
ugcaugacggccugcaagaca

SEQ ID NO: 35906 - RNA, 22 nt, Homo sapiens
cagcauggaguccuccagguug

SEQ ID NO: 35907 - RNA, 23 nt, Homo sapiens
cuccagccccuccagggcuuccu

SEQ ID NO: 35908 - RNA, 22 nt, Homo sapiens
gguuaguggaccaggucacaaa

SEQ ID NO: 35909 - RNA, 22 nt, Homo sapiens
aggucucacuuuguugcccaga

SEQ ID NO: 35910 - RNA, 22 nt, Homo sapiens
cacaaaccauuaugugcugcua

SEQ ID NO: 35911 - RNA, 22 nt, Homo sapiens
uguaaaccaugaugugcugcua

SEQ ID NO: 35912 - RNA, 22 nt, Homo sapiens
cgccaauauuuacgugcugcua

SEQ ID NO: 35913 - RNA, 22 nt, Homo sapiens
ucaggaacugccuuucucucca

SEQ ID NO: 35914 - RNA, 21 nt, Homo sapiens
gccaauauuucugugcugcua

SEQ ID NO: 35915 - RNA, 22 nt, Homo sapiens
cccaacaacaggaaacuaccua

SEQ ID NO: 35916 - RNA, 23 nt, Homo sapiens
gaaacccagcagacaauguagcu

SEQ ID NO: 35917 - RNA, 23 nt, Homo sapiens
ucucugcaggccgugugcuuugc

SEQ ID NO: 35918 - RNA, 22 nt, Homo sapiens
uucaaaacaugaauugcugcug

SEQ ID NO: 35919 - RNA, 21 nt, Homo sapiens
acaaaccacagugugcugcug

SEQ ID NO: 35920 - RNA, 18 nt, Homo sapiens
acccucugaaaggaagca

SEQ ID NO: 35921 - RNA, 22 nt, Homo sapiens
aaagugcuucuuaccuccagau

SEQ ID NO: 35922 - RNA, 22 nt, Homo sapiens
gcacacaauaaauguuugcuga

SEQ ID NO: 35923 - RNA, 23 nt, Homo sapiens
gagcaaggcucuugucuguaagu

SEQ ID NO: 35924 - RNA, 25 nt, Homo sapiens
aaggagcucagaagcccugcccagc

SEQ ID NO: 35925 - RNA, 21 nt, Homo sapiens
gcugaggucugggccaggucu

SEQ ID NO: 35926 - RNA, 19 nt, Homo sapiens
gccucagaggcagcugcuu

SEQ ID NO: 35927 - RNA, 22 nt, Homo sapiens
ucaguggcucagguucguugca

SEQ ID NO: 35928 - RNA, 21 nt, Homo sapiens
aucugcacugucagcacuuua

SEQ ID NO: 35929 - RNA, 17 nt, Homo sapiens
gggagaggaggaggcga

SEQ ID NO: 35930 - RNA, 21 nt, Homo sapiens
gggcaucugggacgcgcagga

SEQ ID NO: 35931 - RNA, 22 nt, Homo sapiens
cagaagugggccgggcacaggg

SEQ ID NO: 35932 - RNA, 23 nt, Homo sapiens
cuaccugcacuaugagcacuuug

SEQ ID NO: 35933 - RNA, 20 nt, Homo sapiens
uacugcuuccacagcucccc

SEQ ID NO: 35934 - RNA, 18 nt, Homo sapiens
caccaccagagccaacgu

SEQ ID NO: 35935 - RNA, 22 nt, Homo sapiens
uagcagaagcauuuccgcacac

SEQ ID NO: 35936 - RNA, 21 nt, Homo sapiens
gggcaucugggacgcgcagga

SEQ ID NO: 35937 - RNA, 22 nt, Homo sapiens
uggcagcagcggagggggcaga

SEQ ID NO: 35938 - RNA, 22 nt, Homo sapiens
cagaagugggccgggcacaggg

SEQ ID NO: 35939 - RNA, 22 nt, Homo sapiens
acaagcuuuuugcucgucuuau

SEQ ID NO: 35940 - RNA, 22 nt, Homo sapiens
acaaaccuuuuguucgucuuau

SEQ ID NO: 35941 - RNA, 22 nt, Homo sapiens
acugccugucugugccugcugu

SEQ ID NO: 35942 - RNA, 22 nt, Homo sapiens
ucagaccgagacaagugcaaug

SEQ ID NO: 35943 - RNA, 24 nt, Homo sapiens
ugggagaaccucccugcuucugcu

SEQ ID NO: 35944 - RNA, 20 nt, Homo sapiens
ccagcagcaccuggggcagu

SEQ ID NO: 35945 - RNA, 22 nt, Homo sapiens
accagguuccaccccagcaggc

SEQ ID NO: 35946 - RNA, 21 nt, Homo sapiens
auccuguacugagcugccccg

SEQ ID NO: 35947 - RNA, 23 nt, Homo sapiens
aagaaucuugucccgcagguccu

SEQ ID NO: 35948 - RNA, 21 nt, Homo sapiens
gguggagcccugagaaccgga

SEQ ID NO: 35949 - RNA, 21 nt, Homo sapiens
aggagacucacaaguuccugc

SEQ ID NO: 35950 - RNA, 22 nt, Homo sapiens
uucacacugcaugcucugggua

SEQ ID NO: 35951 - RNA, 22 nt, Homo sapiens
cuguuccugcugaacugagcca

SEQ ID NO: 35952 - RNA, 20 nt, Homo sapiens
cuggaggaagggcccagagg

SEQ ID NO: 35953 - RNA, 22 nt, Homo sapiens
gccuaagacacaggcccagaga

SEQ ID NO: 35954 - RNA, 23 nt, Homo sapiens
aaagucucgcucucugccccuca

SEQ ID NO: 35955 - RNA, 21 nt, Homo sapiens
auaauggagaccaggccacga

SEQ ID NO: 35956 - RNA, 22 nt, Homo sapiens
cugggggcggcacaggggcuca

SEQ ID NO: 35957 - RNA, 22 nt, Homo sapiens
cacgaccgacgccacgccgagu

SEQ ID NO: 35958 - RNA, 22 nt, Homo sapiens
acaaaaguugccuuugugugau

SEQ ID NO: 35959 - RNA, 22 nt, Homo sapiens
aagauguggaccauauuacaua

SEQ ID NO: 35960 - RNA, 19 nt, Homo sapiens
gggaaacguaugucaaccu

SEQ ID NO: 35961 - RNA, 22 nt, Homo sapiens
aagagggagacccaggcucgga

SEQ ID NO: 35962 - RNA, 22 nt, Homo sapiens
cugcucaaacccuccaaugacu

SEQ ID NO: 35963 - RNA, 22 nt, Homo sapiens
uaaaugaauucaauuuccuucu

SEQ ID NO: 35964 - RNA, 21 nt, Homo sapiens
ugcaggcugaucuucuucucu

SEQ ID NO: 35965 - RNA, 22 nt, Homo sapiens
cacaaaccauuaugugcugcua

SEQ ID NO: 35966 - RNA, 22 nt, Homo sapiens
uguaaaccaugaugugcugcua

SEQ ID NO: 35967 - RNA, 22 nt, Homo sapiens
cgccaauauuuacgugcugcua

SEQ ID NO: 35968 - RNA, 22 nt, Homo sapiens
uccacauggaguugcuguuaca

SEQ ID NO: 35969 - RNA, 21 nt, Homo sapiens
gccaauauuucugugcugcua

SEQ ID NO: 35970 - RNA, 22 nt, Homo sapiens
uagucaagugaagcagugggag

SEQ ID NO: 35971 - RNA, 21 nt, Homo sapiens
aucugcacugucagcacuuua

SEQ ID NO: 35972 - RNA, 23 nt, Homo sapiens
gcuuugacaauaucauugcacug

SEQ ID NO: 35973 - RNA, 22 nt, Homo sapiens
uucaaaacaugaauugcugcug

SEQ ID NO: 35974 - RNA, 21 nt, Homo sapiens
acaaaccacagugugcugcug

SEQ ID NO: 35975 - RNA, 23 nt, Homo sapiens
caugagugacgcccucuggagua

SEQ ID NO: 35976 - RNA, 22 nt, Homo sapiens
gaccucagcuaugacagcacuu

SEQ ID NO: 35977 - RNA, 18 nt, Homo sapiens
acccucugaaaggaagca

SEQ ID NO: 35978 - RNA, 22 nt, Homo sapiens
aaagugcuucuuaccuccagau

SEQ ID NO: 35979 - RNA, 22 nt, Homo sapiens
aaagugcuucuuaccuccagau

SEQ ID NO: 35980 - RNA, 23 nt, Homo sapiens
acacucuaaagagaagcgcuuug

SEQ ID NO: 35981 - RNA, 21 nt, Homo sapiens
agaaaguacuucccucuggag

SEQ ID NO: 35982 - RNA, 21 nt, Homo sapiens
agaaagugcaucccucuggag

SEQ ID NO: 35983 - RNA, 22 nt, Homo sapiens
ugcaagccuugggugugggagg

SEQ ID NO: 35984 - RNA, 19 nt, Homo sapiens
gcuccuguccaacuggcuc

SEQ ID NO: 35985 - RNA, 23 nt, Homo sapiens
agaaaccaugggguaugagcaga

SEQ ID NO: 35986 - RNA, 22 nt, Homo sapiens
ucuacccagaaaggagccagug

SEQ ID NO: 35987 - RNA, 22 nt, Homo sapiens
cacauggccaaaacagagaaga

SEQ ID NO: 35988 - RNA, 21 nt, Homo sapiens
aucugcacugucagcacuuua

SEQ ID NO: 35989 - RNA, 22 nt, Homo sapiens
gaaccuaucuccccucuggacc

SEQ ID NO: 35990 - RNA, 22 nt, Homo sapiens
ucagaccgagacaagugcaaug

SEQ ID NO: 35991 - RNA, 23 nt, Homo sapiens
acacucuaaagagaagcgcuuug

SEQ ID NO: 35992 - RNA, 21 nt, Homo sapiens
agaaaguacuucccucuggag

SEQ ID NO: 35993 - RNA, 21 nt, Homo sapiens
agaaagugcaucccucuggag

SEQ ID NO: 35994 - RNA, 22 nt, Homo sapiens
ucggucccucgggccagggcag

SEQ ID NO: 35995 - RNA, 21 nt, Homo sapiens
cacaaccucaguguuuccagg

SEQ ID NO: 35996 - RNA, 20 nt, Homo sapiens
uacugcuuccacagcucccc

SEQ ID NO: 35997 - RNA, 22 nt, Homo sapiens
acacacccacgcgagccggaaa

SEQ ID NO: 35998 - RNA, 21 nt, Homo sapiens
agcgccuuuggcagcuagagu

SEQ ID NO: 35999 - RNA, 22 nt, Homo sapiens
uaaaugaauucaauuuccuucu

SEQ ID NO: 36000 - RNA, 22 nt, Homo sapiens
augcccuuucaucauugcacug

SEQ ID NO: 36001 - RNA, 22 nt, Homo sapiens
gagauuggccauguaauacuca

SEQ ID NO: 36002 - RNA, 21 nt, Homo sapiens
guaaugggaccuuccucuuug

SEQ ID NO: 36003 - RNA, 25 nt, Homo sapiens
accaacggaccuacuucccuccgcc

SEQ ID NO: 36004 - RNA, 22 nt, Homo sapiens
ggaggccgggacgagugcaaua

SEQ ID NO: 36005 - RNA, 22 nt, Homo sapiens
ggcagagagucagagcgcggau

SEQ ID NO: 36006 - RNA, 22 nt, Homo sapiens
cugggggcggcacaggggcuca

SEQ ID NO: 36007 - RNA, 22 nt, Homo sapiens
ugggguauuugacaaacugaca

SEQ ID NO: 36008 - RNA, 22 nt, Homo sapiens
acaaccagcuaagacacugcca

SEQ ID NO: 36009 - RNA, 23 nt, Homo sapiens
gcaaucagcuaacuacacugccu

SEQ ID NO: 36010 - RNA, 22 nt, Homo sapiens
guaccccuggagauucugauaa

SEQ ID NO: 36011 - RNA, 22 nt, Homo sapiens
cacuuaucagguuguauuauaa

SEQ ID NO: 36012 - RNA, 22 nt, Homo sapiens
accagcuaacaauacacugcca

SEQ ID NO: 36013 - RNA, 22 nt, Homo sapiens
gccagcuaacaauacacugccu

SEQ ID NO: 36014 - RNA, 23 nt, Homo sapiens
acacacucacacacacacacuca

SEQ ID NO: 36015 - RNA, 22 nt, Homo sapiens
gcaaaaguaauugcagugugug

SEQ ID NO: 36016 - RNA, 20 nt, Homo sapiens
uccccacagacccagagccg

SEQ ID NO: 36017 - RNA, 23 nt, Homo sapiens
gacguaguccuauucucugcugc

SEQ ID NO: 36018 - RNA, 22 nt, Homo sapiens
gggagaggucucccugcgcaca

SEQ ID NO: 36019 - RNA, 22 nt, Homo sapiens
gugggguggguggucaggccga

SEQ ID NO: 36020 - RNA, 17 nt, Homo sapiens
gggagaggaggaggcga

SEQ ID NO: 36021 - RNA, 21 nt, Homo sapiens
agggcucaucuugguccugca

SEQ ID NO: 36022 - RNA, 18 nt, Homo sapiens
auucaaucuacugccuca

SEQ ID NO: 36023 - RNA, 22 nt, Homo sapiens
uggcagcagcggagggggcaga

SEQ ID NO: 36024 - RNA, 20 nt, Homo sapiens
acagcaaggagggcaggagg

SEQ ID NO: 36025 - RNA, 20 nt, Homo sapiens
ccagcagcaccuggggcagu

SEQ ID NO: 36026 - RNA, 23 nt, Homo sapiens
aaaucagaaucacaccuggggga

SEQ ID NO: 36027 - RNA, 21 nt, Homo sapiens
auccuguacugagcugccccg

SEQ ID NO: 36028 - RNA, 24 nt, Homo sapiens
acgcagagcccgaaagcccccagu

SEQ ID NO: 36029 - RNA, 21 nt, Homo sapiens
guccugagagcgcugccuccu

SEQ ID NO: 36030 - RNA, 22 nt, Homo sapiens
gcggucccgcggcgccccgccu

SEQ ID NO: 36031 - RNA, 21 nt, Homo sapiens
ggggagcgggggcccugccuu

SEQ ID NO: 36032 - RNA, 21 nt, Homo sapiens
cugggggacggagcagaagga

SEQ ID NO: 36033 - RNA, 22 nt, Homo sapiens
ccaguagcacggcucaguccag

SEQ ID NO: 36034 - RNA, 21 nt, Homo sapiens
ccuucugacuccaaguccagu

SEQ ID NO: 36035 - RNA, 22 nt, Homo sapiens
gccuucugacccuaaguccagu

SEQ ID NO: 36036 - RNA, 22 nt, Homo sapiens
acacucuaaaaggaugcacuuu

SEQ ID NO: 36037 - RNA, 22 nt, Homo sapiens
acacucuaaaaggaugcacuuu

SEQ ID NO: 36038 - RNA, 22 nt, Homo sapiens
aaccucuaaaaggaugcacuuu

SEQ ID NO: 36039 - RNA, 22 nt, Homo sapiens
aaccucuaaaaggaugcacuuu

SEQ ID NO: 36040 - RNA, 22 nt, Homo sapiens
auccucuaaaaagaugcacuuu

SEQ ID NO: 36041 - RNA, 22 nt, Homo sapiens
auccucuaaaaagaugcacuuu

SEQ ID NO: 36042 - RNA, 22 nt, Homo sapiens
acaguggucaucgagugacaca

SEQ ID NO: 36043 - RNA, 20 nt, Homo sapiens
gcagcuguccgcccagacac

SEQ ID NO: 36044 - RNA, 22 nt, Homo sapiens
ucaggaacugccuuucucucca

SEQ ID NO: 36045 - RNA, 21 nt, Homo sapiens
gaccaaucgccguccccgccg

SEQ ID NO: 36046 - RNA, 20 nt, Homo sapiens
cccgccgcgucgcccugggg

SEQ ID NO: 36047 - RNA, 22 nt, Homo sapiens
cccaacaacaggaaacuaccua

SEQ ID NO: 36048 - RNA, 21 nt, Homo sapiens
uucuaggauaggcccaggggc

SEQ ID NO: 36049 - RNA, 23 nt, Homo sapiens
cggcucugucgucgaggcgcuca

SEQ ID NO: 36050 - RNA, 22 nt, Homo sapiens
ucaccauugcuaaagugcaauu

SEQ ID NO: 36051 - RNA, 23 nt, Homo sapiens
acugaggggccucagaccgagcu

SEQ ID NO: 36052 - RNA, 22 nt, Homo sapiens
gauccgagcaccggggaccccc

SEQ ID NO: 36053 - RNA, 19 nt, Homo sapiens
aagacauuuucagacagcu

SEQ ID NO: 36054 - RNA, 22 nt, Homo sapiens
gcggucccgcggcgccccgccu

SEQ ID NO: 36055 - RNA, 24 nt, Homo sapiens
ucacagguuaaagggucucaggga

SEQ ID NO: 36056 - RNA, 22 nt, Homo sapiens
ucacaaguuagggucucaggga

SEQ ID NO: 36057 - RNA, 23 nt, Homo sapiens
agcccuguucuacagcccugagg

SEQ ID NO: 36058 - RNA, 22 nt, Homo sapiens
cacgaccgacgccacgccgagu

SEQ ID NO: 36059 - RNA, 21 nt, Homo sapiens
aaagugucagauacggugugg

SEQ ID NO: 36060 - RNA, 23 nt, Homo sapiens
gcgcccaauuaaugucuguugau

SEQ ID NO: 36061 - RNA, 22 nt, Homo sapiens
gugauugccacucuccugagua

SEQ ID NO: 36062 - RNA, 23 nt, Homo sapiens
gucagaccccgagggguccucgc

SEQ ID NO: 36063 - RNA, 23 nt, Homo sapiens
accacaggagucugagcauuuga

SEQ ID NO: 36064 - RNA, 22 nt, Homo sapiens
cagcugguugaaggggaccaaa

SEQ ID NO: 36065 - RNA, 22 nt, Homo sapiens
uagcugguugaaggggaccaaa

SEQ ID NO: 36066 - RNA, 23 nt, Homo sapiens
aggaacagcagcagcccgggccg

SEQ ID NO: 36067 - RNA, 21 nt, Homo sapiens
gaccaaucgccguccccgccg

SEQ ID NO: 36068 - RNA, 20 nt, Homo sapiens
cuggaggaagggcccagagg

SEQ ID NO: 36069 - RNA, 22 nt, Homo sapiens
gccuaagacacaggcccagaga

SEQ ID NO: 36070 - RNA, 21 nt, Homo sapiens
ccuucugacuccaaguccagu

SEQ ID NO: 36071 - RNA, 23 nt, Homo sapiens
acugaggggccucagaccgagcu

SEQ ID NO: 36072 - RNA, 21 nt, Homo sapiens
agacacaccacggcacacuuc

SEQ ID NO: 36073 - RNA, 19 nt, Homo sapiens
accagugcccugcacacuu

SEQ ID NO: 36074 - RNA, 22 nt, Homo sapiens
gcggucccgcggcgccccgccu

SEQ ID NO: 36075 - RNA, 22 nt, Homo sapiens
ugcuguuagcccuagccccgca

SEQ ID NO: 36076 - RNA, 23 nt, Homo sapiens
agcagcauuguacagggcuauga

SEQ ID NO: 36077 - RNA, 22 nt, Homo sapiens
gcacaaaucuccagaccaccca

SEQ ID NO: 36078 - RNA, 22 nt, Homo sapiens
cacugguacaaggguugggaga

SEQ ID NO: 36079 - RNA, 20 nt, Homo sapiens
acagcaaggagggcaggagg

SEQ ID NO: 36080 - RNA, 25 nt, Homo sapiens
acggagcugucccaacaccaccccu

SEQ ID NO: 36081 - RNA, 25 nt, Homo sapiens
acggagcugucccaacaccaccccu

SEQ ID NO: 36082 - RNA, 21 nt, Homo sapiens
caucaccuuccuucuccucca

SEQ ID NO: 36083 - RNA, 23 nt, Homo sapiens
cggcucugucgucgaggcgcuca

SEQ ID NO: 36084 - RNA, 21 nt, Homo sapiens
cggcucggguggcggcgacgg

SEQ ID NO: 36085 - RNA, 21 nt, Homo sapiens
ccccucccagccucccugcca

SEQ ID NO: 36086 - RNA, 17 nt, Homo sapiens
gggagaggaggaggcga

SEQ ID NO: 36087 - RNA, 18 nt, Homo sapiens
aucacauucaccucccug

SEQ ID NO: 36088 - RNA, 21 nt, Homo sapiens
acuagacugugagcuccucga

SEQ ID NO: 36089 - RNA, 22 nt, Homo sapiens
gaaccuaucuccccucuggacc

SEQ ID NO: 36090 - RNA, 18 nt, Homo sapiens
acccucugaaaggaagca

SEQ ID NO: 36091 - RNA, 22 nt, Homo sapiens
aaagugcuucuuaccuccagau

SEQ ID NO: 36092 - RNA, 23 nt, Homo sapiens
acacucuaaagagaagcgcuuug

SEQ ID NO: 36093 - RNA, 21 nt, Homo sapiens
agaaaguacuucccucuggag

SEQ ID NO: 36094 - RNA, 21 nt, Homo sapiens
agaaagugcaucccucuggag

SEQ ID NO: 36095 - RNA, 19 nt, Homo sapiens
auuuugguacagcagcuca

SEQ ID NO: 36096 - RNA, 19 nt, Homo sapiens
guccugaauuccgcagccu

SEQ ID NO: 36097 - RNA, 19 nt, Homo sapiens
gccucagaggcagcugcuu

SEQ ID NO: 36098 - RNA, 21 nt, Homo sapiens
aagggucaguaagcacccgcg

SEQ ID NO: 36099 - RNA, 22 nt, Homo sapiens
ggcagagagucagagcgcggau

SEQ ID NO: 36100 - RNA, 18 nt, Homo sapiens
cccccaccaccacgcccg

SEQ ID NO: 36101 - RNA, 22 nt, Homo sapiens
cagcugguugaaggggaccaaa

SEQ ID NO: 36102 - RNA, 22 nt, Homo sapiens
uagcugguugaaggggaccaaa

SEQ ID NO: 36103 - RNA, 22 nt, Homo sapiens
cccaacaacaugaaacuaccua

SEQ ID NO: 36104 - RNA, 22 nt, Homo sapiens
cucaauagacugugagcuccuu

SEQ ID NO: 36105 - RNA, 22 nt, Homo sapiens
agcugaguguaggauguuuaca

SEQ ID NO: 36106 - RNA, 22 nt, Homo sapiens
ugacgaugacaacgaugacgua

SEQ ID NO: 36107 - RNA, 21 nt, Homo sapiens
cacaacccuaguggcgccauu

SEQ ID NO: 36108 - RNA, 23 nt, Homo sapiens
cccagcuagauuguaagcuccuu

SEQ ID NO: 36109 - RNA, 21 nt, Homo sapiens
caucaccuuccuucuccucca

SEQ ID NO: 36110 - RNA, 22 nt, Homo sapiens
acacacccacgcgagccggaaa

SEQ ID NO: 36111 - RNA, 21 nt, Homo sapiens
aaaggccacauccagcaccgu

SEQ ID NO: 36112 - RNA, 21 nt, Homo sapiens
ggucagaacccaucauucacu

SEQ ID NO: 36113 - RNA, 23 nt, Homo sapiens
ucacauaggaauaaaaagccaua

SEQ ID NO: 36114 - RNA, 23 nt, Homo sapiens
ucacauaggaaugaaaagccaua

SEQ ID NO: 36115 - RNA, 23 nt, Homo sapiens
cccaacagacauggcgguacuca

SEQ ID NO: 36116 - RNA, 22 nt, Homo sapiens
ucaguuuccucugcaaacaguu

SEQ ID NO: 36117 - RNA, 22 nt, Homo sapiens
ccucauggaaggguuccccacu

SEQ ID NO: 36118 - RNA, 23 nt, Homo sapiens
gaaagugcuucuuuccucgagaa

SEQ ID NO: 36119 - RNA, 22 nt, Homo sapiens
uggggacccucccugaaccaag

SEQ ID NO: 36120 - RNA, 22 nt, Homo sapiens
ggaggccgggacgagugcaaua

SEQ ID NO: 36121 - RNA, 22 nt, Homo sapiens
caaacaccauugucacacucca

SEQ ID NO: 36122 - RNA, 22 nt, Homo sapiens
uggcagcagcggagggggcaga

SEQ ID NO: 36123 - RNA, 23 nt, Homo sapiens
cuacuaaaacauggaagcacuua

SEQ ID NO: 36124 - RNA, 23 nt, Homo sapiens
acacucaaacauggaagcacuua

SEQ ID NO: 36125 - RNA, 20 nt, Homo sapiens
ccagcagcaccuggggcagu

SEQ ID NO: 36126 - RNA, 23 nt, Homo sapiens
cggcucugucgucgaggcgcuca

SEQ ID NO: 36127 - RNA, 21 nt, Homo sapiens
auccuguacugagcugccccg

SEQ ID NO: 36128 - RNA, 22 nt, Homo sapiens
uauccacuacaccccgcugccu

SEQ ID NO: 36129 - RNA, 18 nt, Homo sapiens
caccaccagagccaacgu

SEQ ID NO: 36130 - RNA, 21 nt, Homo sapiens
gggcaucugggacgcgcagga

SEQ ID NO: 36131 - RNA, 21 nt, Homo sapiens
gaccaaucgccguccccgccg

SEQ ID NO: 36132 - RNA, 23 nt, Homo sapiens
cggcucugucgucgaggcgcuca

SEQ ID NO: 36133 - RNA, 23 nt, Homo sapiens
ucaacgggagugaucgugucauu

SEQ ID NO: 36134 - RNA, 23 nt, Homo sapiens
cugcagaacuguucccgcugcua

SEQ ID NO: 36135 - RNA, 23 nt, Homo sapiens
acccucuauagggaagcgcguuc

SEQ ID NO: 36136 - RNA, 22 nt, Homo sapiens
gcaaaaguaauugccaguuuug

SEQ ID NO: 36137 - RNA, 22 nt, Homo sapiens
ugcaaaaguagucucaguuuuu

SEQ ID NO: 36138 - RNA, 19 nt, Homo sapiens
aaaaguaauuacaguuuuu

SEQ ID NO: 36139 - RNA, 19 nt, Homo sapiens
guugggaucacaggcgccc

SEQ ID NO: 36140 - RNA, 19 nt, Homo sapiens
guugggaucacaggcgccc

SEQ ID NO: 36141 - RNA, 22 nt, Homo sapiens
gguucaguuguucaaccaguua

SEQ ID NO: 36142 - RNA, 22 nt, Homo sapiens
acaucaucgcauauugacacaa

SEQ ID NO: 36143 - RNA, 21 nt, Homo sapiens
cacaacccuaguggcgccauu

SEQ ID NO: 36144 - RNA, 22 nt, Homo sapiens
gcggucccgcggcgccccgccu

SEQ ID NO: 36145 - RNA, 20 nt, Homo sapiens
uccccacagacccagagccg

SEQ ID NO: 36146 - RNA, 21 nt, Homo sapiens
ugcaggcugaucuucuucucu

SEQ ID NO: 36147 - RNA, 18 nt, Homo sapiens
aucacauucaccucccug

SEQ ID NO: 36148 - RNA, 21 nt, Homo sapiens
ggcugucaauucauaggucag

SEQ ID NO: 36149 - RNA, 21 nt, Homo sapiens
gucugucaauucauaggucau

SEQ ID NO: 36150 - RNA, 23 nt, Homo sapiens
ggaagccaucaagucgcugcagg

SEQ ID NO: 36151 - RNA, 20 nt, Homo sapiens
cucaaagcaaacccugcaga

SEQ ID NO: 36152 - RNA, 18 nt, Homo sapiens
caccaccagagccaacgu

SEQ ID NO: 36153 - RNA, 21 nt, Homo sapiens
gaccaaucgccguccccgccg

SEQ ID NO: 36154 - RNA, 22 nt, Homo sapiens
acaguucuucaacuggcagcuu

SEQ ID NO: 36155 - RNA, 23 nt, Homo sapiens
acccucuauagggaagcgcguuc

SEQ ID NO: 36156 - RNA, 19 nt, Homo sapiens
auuuugguacagcagcuca

SEQ ID NO: 36157 - RNA, 24 nt, Homo sapiens
acgcgcaggccagagacccaggca

SEQ ID NO: 36158 - RNA, 22 nt, Homo sapiens
gcggucccgcggcgccccgccu

SEQ ID NO: 36159 - RNA, 22 nt, Homo sapiens
acacacccacgcgagccggaaa

SEQ ID NO: 36160 - RNA, 21 nt, Homo sapiens
cggcucggguggcggcgacgg

SEQ ID NO: 36161 - RNA, 21 nt, Homo sapiens
ugcaggcugaucuucuucucu

SEQ ID NO: 36162 - RNA, 17 nt, Homo sapiens
gggagaggaggaggcga

SEQ ID NO: 36163 - RNA, 21 nt, Homo sapiens
agggcucaucuugguccugca

SEQ ID NO: 36164 - RNA, 21 nt, Homo sapiens
gggcaucugggacgcgcagga

SEQ ID NO: 36165 - RNA, 22 nt, Homo sapiens
uggcagcagcggagggggcaga

SEQ ID NO: 36166 - RNA, 25 nt, Homo sapiens
agcuagucaagcgcgguuguggggg

SEQ ID NO: 36167 - RNA, 20 nt, Homo sapiens
ccagcagcaccuggggcagu

SEQ ID NO: 36168 - RNA, 21 nt, Homo sapiens
auccuguacugagcugccccg

SEQ ID NO: 36169 - RNA, 22 nt, Homo sapiens
aggucucacuuuguugcccaga

SEQ ID NO: 36170 - RNA, 22 nt, Homo sapiens
ucagaccgagacaagugcaaug

SEQ ID NO: 36171 - RNA, 22 nt, Homo sapiens
aucgggaggggacugagccuga

SEQ ID NO: 36172 - RNA, 25 nt, Homo sapiens
aaggagcucagaagcccugcccagc

SEQ ID NO: 36173 - RNA, 21 nt, Homo sapiens
gcuccaaccucagcagacugu

SEQ ID NO: 36174 - RNA, 21 nt, Homo sapiens
gaaggaagugagugcagccac

SEQ ID NO: 36175 - RNA, 24 nt, Homo sapiens
acgcgcaggccagagacccaggca

SEQ ID NO: 36176 - RNA, 22 nt, Homo sapiens
acacacccacgcgagccggaaa

SEQ ID NO: 36177 - RNA, 22 nt, Homo sapiens
acacacccacgcgagccggaaa

SEQ ID NO: 36178 - RNA, 22 nt, Homo sapiens
cagaaagugcuucccucuagag

SEQ ID NO: 36179 - RNA, 22 nt, Homo sapiens
ucaacaucagucugauaagcua

SEQ ID NO: 36180 - RNA, 22 nt, Homo sapiens
acaaccagcuaagacacugcca

SEQ ID NO: 36181 - RNA, 22 nt, Homo sapiens
gcaaaaguaauugccaguuuug

SEQ ID NO: 36182 - RNA, 22 nt, Homo sapiens
ugcaaaaguagucucaguuuuu

SEQ ID NO: 36183 - RNA, 19 nt, Homo sapiens
aaaaguaauuacaguuuuu

SEQ ID NO: 36184 - RNA, 19 nt, Homo sapiens
guugggaucacaggcgccc

SEQ ID NO: 36185 - RNA, 19 nt, Homo sapiens
guccugaauuccgcagccu

SEQ ID NO: 36186 - RNA, 22 nt, Homo sapiens
aagagggagacccaggcucgga

SEQ ID NO: 36187 - RNA, 22 nt, Homo sapiens
gccaccuucaaaugggaagucu

SEQ ID NO: 36188 - RNA, 20 nt, Homo sapiens
ggcauucaccgcgugccuua

SEQ ID NO: 36189 - RNA, 22 nt, Homo sapiens
uccggggacgaacgggacgggu

SEQ ID NO: 36190 - RNA, 22 nt, Homo sapiens
ucaggaacugccuuucucucca

SEQ ID NO: 36191 - RNA, 21 nt, Homo sapiens
gaccaaucgccguccccgccg

SEQ ID NO: 36192 - RNA, 22 nt, Homo sapiens
uccacauggaguugcuguuaca

SEQ ID NO: 36193 - RNA, 22 nt, Homo sapiens
cuguuccugcugaacugagcca

SEQ ID NO: 36194 - RNA, 23 nt, Homo sapiens
aaaucagaaucacaccuggggga

SEQ ID NO: 36195 - RNA, 21 nt, Homo sapiens
ucuacucagaagggugccuua

SEQ ID NO: 36196 - RNA, 19 nt, Homo sapiens
gccugcugacaccgugccu

SEQ ID NO: 36197 - RNA, 19 nt, Homo sapiens
guugggaucacaggcgccc

SEQ ID NO: 36198 - RNA, 22 nt, Homo sapiens
aagagggagacccaggcucgga

SEQ ID NO: 36199 - RNA, 24 nt, Homo sapiens
acgcagagcccgaaagcccccagu

SEQ ID NO: 36200 - RNA, 24 nt, Homo sapiens
acgcgcaggccagagacccaggca

SEQ ID NO: 36201 - RNA, 22 nt, Homo sapiens
gcggucccgcggcgccccgccu

SEQ ID NO: 36202 - RNA, 22 nt, Homo sapiens
ugcuguuagcccuagccccgca

SEQ ID NO: 36203 - RNA, 22 nt, Homo sapiens
ggaggccgggacgagugcaaua

SEQ ID NO: 36204 - RNA, 22 nt, Homo sapiens
auacauacuucuuuacauucca

SEQ ID NO: 36205 - RNA, 22 nt, Homo sapiens
cugggggcggcacaggggcuca

SEQ ID NO: 36206 - RNA, 22 nt, Homo sapiens
cugggggcggcacaggggcuca

SEQ ID NO: 36207 - RNA, 20 nt, Homo sapiens
ggggggcgaggcagguguga

SEQ ID NO: 36208 - RNA, 20 nt, Homo sapiens
cccgccgcgucgcccugggg

SEQ ID NO: 36209 - RNA, 22 nt, Homo sapiens
ccacacacuuccuuacauucca

SEQ ID NO: 36210 - RNA, 22 nt, Homo sapiens
acugccugucugugccugcugu

SEQ ID NO: 36211 - RNA, 21 nt, Homo sapiens
acaggauugagggggggcccu

SEQ ID NO: 36212 - RNA, 20 nt, Homo sapiens
cuggaggaagggcccagagg

SEQ ID NO: 36213 - RNA, 22 nt, Homo sapiens
aaagagguuaaccagguguguu

SEQ ID NO: 36214 - RNA, 22 nt, Homo sapiens
gccuaagacacaggcccagaga

SEQ ID NO: 36215 - RNA, 21 nt, Homo sapiens
uucuaggauaggcccaggggc

SEQ ID NO: 36216 - RNA, 22 nt, Homo sapiens
ugaauccuugaauagguguguu

SEQ ID NO: 36217 - RNA, 22 nt, Homo sapiens
accagguuccaccccagcaggc

SEQ ID NO: 36218 - RNA, 20 nt, Homo sapiens
ggcaaagaaggaacauuccu

SEQ ID NO: 36219 - RNA, 20 nt, Homo sapiens
uccccacagacccagagccg

SEQ ID NO: 36220 - RNA, 22 nt, Homo sapiens
augcccuuucaucauugcacug

SEQ ID NO: 36221 - RNA, 22 nt, Homo sapiens
acaacuguaacuagacgguuuu

SEQ ID NO: 36222 - RNA, 24 nt, Homo sapiens
agugugaguucuaccauugccaaa

SEQ ID NO: 36223 - RNA, 23 nt, Homo sapiens
ucaguuuugcauagauuugcaca

SEQ ID NO: 36224 - RNA, 22 nt, Homo sapiens
cacucagcaccaggauauuguu

SEQ ID NO: 36225 - RNA, 22 nt, Homo sapiens
aacuaugcaaccuacuaccucu

SEQ ID NO: 36226 - RNA, 22 nt, Homo sapiens
gaacuugcuaaaaaugcagaau

SEQ ID NO: 36227 - RNA, 21 nt, Homo sapiens
guaaugggaccuuccucuuug

SEQ ID NO: 36228 - RNA, 21 nt, Homo sapiens
gaaggaagugagugcagccac

SEQ ID NO: 36229 - RNA, 22 nt, Homo sapiens
caaacaccauugucacacucca

SEQ ID NO: 36230 - RNA, 17 nt, Homo sapiens
gacagccucucccccac

SEQ ID NO: 36231 - RNA, 22 nt, Homo sapiens
aaucagucucauugcuuuauaa

SEQ ID NO: 36232 - RNA, 22 nt, Homo sapiens
cucccuucuuuccucccgucuu

SEQ ID NO: 36233 - RNA, 22 nt, Homo sapiens
gaauucaucacggccagccucu

SEQ ID NO: 36234 - RNA, 22 nt, Homo sapiens
uccagcaaagggaagcgcuuuc

SEQ ID NO: 36235 - RNA, 22 nt, Homo sapiens
accucuaaaggggagcgcuuug

SEQ ID NO: 36236 - RNA, 23 nt, Homo sapiens
acacucuaaagagaagcgcuuug

SEQ ID NO: 36237 - RNA, 21 nt, Homo sapiens
gcuccaaagggaagcgcuuug

SEQ ID NO: 36238 - RNA, 21 nt, Homo sapiens
cacucugaagggaagcgcuuu

SEQ ID NO: 36239 - RNA, 21 nt, Homo sapiens
ccucuaaagagaagcgcuuuc

SEQ ID NO: 36240 - RNA, 21 nt, Homo sapiens
caucaccuuccuucuccucca

SEQ ID NO: 36241 - RNA, 21 nt, Homo sapiens
aagggucaguaagcacccgcg

SEQ ID NO: 36242 - RNA, 20 nt, Homo sapiens
uacugcuuccacagcucccc

SEQ ID NO: 36243 - RNA, 21 nt, Homo sapiens
cuagggaagaacagugagcaa

SEQ ID NO: 36244 - RNA, 19 nt, Homo sapiens
ccaccucccgaguccucac

SEQ ID NO: 36245 - RNA, 24 nt, Homo sapiens
acugcuggucuucagucagggcca

SEQ ID NO: 36246 - RNA, 18 nt, Homo sapiens
aucacauucaccucccug

SEQ ID NO: 36247 - RNA, 22 nt, Homo sapiens
acuccaacagggccgcgucucc

SEQ ID NO: 36248 - RNA, 23 nt, Homo sapiens
gggagugaagacacggagccaga

SEQ ID NO: 36249 - RNA, 21 nt, Homo sapiens
acaggauugagggggggcccu

SEQ ID NO: 36250 - RNA, 22 nt, Homo sapiens
uaaccgauuucagauggugcua

SEQ ID NO: 36251 - RNA, 23 nt, Homo sapiens
aaagucucgcucucugccccuca

SEQ ID NO: 36252 - RNA, 19 nt, Homo sapiens
guccugaauuccgcagccu

SEQ ID NO: 36253 - RNA, 22 nt, Homo sapiens
auacauacuucuuuacauucca

SEQ ID NO: 36254 - RNA, 23 nt, Homo sapiens
gucacaucccucccaagacccuc

SEQ ID NO: 36255 - RNA, 22 nt, Homo sapiens
uaaaugaauucaauuuccuucu

SEQ ID NO: 36256 - RNA, 21 nt, Homo sapiens
cggggugcacgggcggagggc

SEQ ID NO: 36257 - RNA, 23 nt, Homo sapiens
gggagugaagacacggagccaga

SEQ ID NO: 36258 - RNA, 22 nt, Homo sapiens
ucaucucgcccgcaaagaccca

SEQ ID NO: 36259 - RNA, 22 nt, Homo sapiens
ccacacacuuccuuacauucca

SEQ ID NO: 36260 - RNA, 21 nt, Homo sapiens
ugcaaugcaacuacaaugcac

SEQ ID NO: 36261 - RNA, 22 nt, Homo sapiens
uacagauggauaccgugcaauu

SEQ ID NO: 36262 - RNA, 22 nt, Homo sapiens
gauagagugcagaccagggucu

SEQ ID NO: 36263 - RNA, 22 nt, Homo sapiens
aagaagugcaccgcgaauguuu

SEQ ID NO: 36264 - RNA, 22 nt, Homo sapiens
aaagaugagcuaaugguaauau

SEQ ID NO: 36265 - RNA, 22 nt, Homo sapiens
gcaaagguaauugcuguuuucg

SEQ ID NO: 36266 - RNA, 21 nt, Homo sapiens
guucuaacccauuguggccaa

SEQ ID NO: 36267 - RNA, 25 nt, Homo sapiens
acggagcugucccaacaccaccccu

SEQ ID NO: 36268 - RNA, 20 nt, Homo sapiens
ggcaaagaaggaacauuccu

SEQ ID NO: 36269 - RNA, 22 nt, Homo sapiens
aagagggagacccaggcucgga

SEQ ID NO: 36270 - RNA, 19 nt, Homo sapiens
gcucuaagaaagccacacu

SEQ ID NO: 36271 - RNA, 23 nt, Homo sapiens
accacaggagucugagcauuuga

SEQ ID NO: 36272 - RNA, 21 nt, Homo sapiens
ccccucccagccucccugcca

SEQ ID NO: 36273 - RNA, 22 nt, Homo sapiens
gugggguggguggucaggccga

SEQ ID NO: 36274 - RNA, 24 nt, Homo sapiens
acugcuggucuucagucagggcca

SEQ ID NO: 36275 - RNA, 21 nt, Homo sapiens
gaccaaucgccguccccgccg

SEQ ID NO: 36276 - RNA, 22 nt, Homo sapiens
cagaagugggccgggcacaggg

SEQ ID NO: 36277 - RNA, 22 nt, Homo sapiens
ggagagccuccacccaacccuc

SEQ ID NO: 36278 - RNA, 21 nt, Homo sapiens
acaggauugagggggggcccu

SEQ ID NO: 36279 - RNA, 23 nt, Homo sapiens
aaaucagaaucacaccuggggga

SEQ ID NO: 36280 - RNA, 23 nt, Homo sapiens
aaaucagaaucacaccuggggga

SEQ ID NO: 36281 - RNA, 22 nt, Homo sapiens
aguccagauucugugcccacca

SEQ ID NO: 36282 - RNA, 21 nt, Homo sapiens
uugucuaaccagucaccuguu

SEQ ID NO: 36283 - RNA, 24 nt, Homo sapiens
acgcagagcccgaaagcccccagu

SEQ ID NO: 36284 - RNA, 24 nt, Homo sapiens
acgcagagcccgaaagcccccagu

SEQ ID NO: 36285 - RNA, 22 nt, Homo sapiens
gcacauguucugcggcccacca

SEQ ID NO: 36286 - RNA, 22 nt, Homo sapiens
gcggucccgcggcgccccgccu

SEQ ID NO: 36287 - RNA, 22 nt, Homo sapiens
ugcuguuagcccuagccccgca

SEQ ID NO: 36288 - RNA, 22 nt, Homo sapiens
cacucuaaagggaggcacuuug

SEQ ID NO: 36289 - RNA, 22 nt, Homo sapiens
gggagaggucucccugcgcaca

SEQ ID NO: 36290 - RNA, 22 nt, Homo sapiens
cacgaccgacgccacgccgagu

SEQ ID NO: 36291 - RNA, 21 nt, Homo sapiens
gaccaaucgccguccccgccg

SEQ ID NO: 36292 - RNA, 22 nt, Homo sapiens
acaaccagcuaagacacugcca

SEQ ID NO: 36293 - RNA, 19 nt, Homo sapiens
uagcauacagauacgccca

SEQ ID NO: 36294 - RNA, 21 nt, Homo sapiens
guucuaacccauuguggccaa

SEQ ID NO: 36295 - RNA, 22 nt, Homo sapiens
gcggucccgcggcgccccgccu

SEQ ID NO: 36296 - RNA, 22 nt, Homo sapiens
ugcuguuagcccuagccccgca

SEQ ID NO: 36297 - RNA, 22 nt, Homo sapiens
ggcagagagucagagcgcggau

SEQ ID NO: 36298 - RNA, 22 nt, Homo sapiens
caaacaccauugucacacucca

SEQ ID NO: 36299 - RNA, 23 nt, Homo sapiens
aggaacagcagcagcccgggccg

SEQ ID NO: 36300 - RNA, 21 nt, Homo sapiens
gaccaaucgccguccccgccg

SEQ ID NO: 36301 - RNA, 25 nt, Homo sapiens
acggagcugucccaacaccaccccu

SEQ ID NO: 36302 - RNA, 22 nt, Homo sapiens
gcggucccgcggcgccccgccu

SEQ ID NO: 36303 - RNA, 22 nt, Homo sapiens
ugcuguuagcccuagccccgca

SEQ ID NO: 36304 - RNA, 21 nt, Homo sapiens
aaaggccacauccagcaccgu

SEQ ID NO: 36305 - RNA, 21 nt, Homo sapiens
gggcaucugggacgcgcagga

SEQ ID NO: 36306 - RNA, 22 nt, Homo sapiens
ucagaccgagacaagugcaaug

SEQ ID NO: 36307 - RNA, 21 nt, Homo sapiens
cguacgcuauacggucuacua

SEQ ID NO: 36308 - RNA, 23 nt, Homo sapiens
ccacccaaugaccuacuccaaga

SEQ ID NO: 36309 - RNA, 21 nt, Homo sapiens
caacugaugccuuuccaagua

SEQ ID NO: 36310 - RNA, 22 nt, Homo sapiens
ccagugucuccaguaguagaca

SEQ ID NO: 36311 - RNA, 23 nt, Homo sapiens
gucacaucccucccaagacccuc

SEQ ID NO: 36312 - RNA, 22 nt, Homo sapiens
caaacaccauugucacacucca

SEQ ID NO: 36313 - RNA, 22 nt, Homo sapiens
uacaucuggacagccgaaugaa

SEQ ID NO: 36314 - RNA, 21 nt, Homo sapiens
ugcaaacccugcaugugggag

SEQ ID NO: 36315 - RNA, 22 nt, Homo sapiens
ucaucucgcccgcaaagaccca

SEQ ID NO: 36316 - RNA, 18 nt, Homo sapiens
augacaccucccugugaa

SEQ ID NO: 36317 - RNA, 23 nt, Homo sapiens
acaacaaaaucacuagucuucca

SEQ ID NO: 36318 - RNA, 21 nt, Homo sapiens
aggagacucacaaguuccugc

SEQ ID NO: 36319 - RNA, 22 nt, Homo sapiens
ggaggccgggacgagugcaaua

SEQ ID NO: 36320 - RNA, 21 nt, Homo sapiens
gagcugcauccuggcuccggg

SEQ ID NO: 36321 - RNA, 21 nt, Homo sapiens
ccccucccagccucccugcca

SEQ ID NO: 36322 - RNA, 23 nt, Homo sapiens
aaaaugcagauuccuggacucca

SEQ ID NO: 36323 - RNA, 21 nt, Homo sapiens
cggggugcacgggcggagggc

SEQ ID NO: 36324 - RNA, 21 nt, Homo sapiens
gaccaaucgccguccccgccg

SEQ ID NO: 36325 - RNA, 22 nt, Homo sapiens
cggugagcacccggccccugcg

SEQ ID NO: 36326 - RNA, 22 nt, Homo sapiens
uggcagcagcggagggggcaga

SEQ ID NO: 36327 - RNA, 22 nt, Homo sapiens
ucagaccgagacaagugcaaug

SEQ ID NO: 36328 - RNA, 20 nt, Homo sapiens
ccagcagcaccuggggcagu

SEQ ID NO: 36329 - RNA, 21 nt, Homo sapiens
auccuguacugagcugccccg

SEQ ID NO: 36330 - RNA, 20 nt, Homo sapiens
ugggccaccgccgagcggac

SEQ ID NO: 36331 - RNA, 21 nt, Homo sapiens
gcugaggucugggccaggucu

SEQ ID NO: 36332 - RNA, 25 nt, Homo sapiens
accaacggaccuacuucccuccgcc

SEQ ID NO: 36333 - RNA, 22 nt, Homo sapiens
gcggucccgcggcgccccgccu

SEQ ID NO: 36334 - RNA, 22 nt, Homo sapiens
ugcuguuagcccuagccccgca

SEQ ID NO: 36335 - RNA, 24 nt, Homo sapiens
cacccccagagccucagcucccca

SEQ ID NO: 36336 - RNA, 22 nt, Homo sapiens
cacaaguucggaucuacggguu

SEQ ID NO: 36337 - RNA, 22 nt, Homo sapiens
cuagggaacacagggcugguga

SEQ ID NO: 36338 - RNA, 22 nt, Homo sapiens
aucagagcccucugagcuucag

SEQ ID NO: 36339 - RNA, 22 nt, Homo sapiens
augcccuuuuaacauugcacug

SEQ ID NO: 36340 - RNA, 23 nt, Homo sapiens
cggccugauucacaacaccagcu

SEQ ID NO: 36341 - RNA, 22 nt, Homo sapiens
cccaacaacaggaaacuaccua

SEQ ID NO: 36342 - RNA, 22 nt, Homo sapiens
ucaacaucagucugauaagcua

SEQ ID NO: 36343 - RNA, 21 nt, Homo sapiens
ggaaaucccuggcaaugugau

SEQ ID NO: 36344 - RNA, 21 nt, Homo sapiens
gguaaucccuggcaaugugau

SEQ ID NO: 36345 - RNA, 20 nt, Homo sapiens
uacugcuuccacagcucccc

SEQ ID NO: 36346 - RNA, 22 nt, Homo sapiens
cuggagagacaaggggaagagg

SEQ ID NO: 36347 - RNA, 19 nt, Homo sapiens
gcuccuguccaacuggcuc

SEQ ID NO: 36348 - RNA, 22 nt, Homo sapiens
gauuccaauuuuuccacaucuu

SEQ ID NO: 36349 - RNA, 20 nt, Homo sapiens
cccugcgccaucuccucuac

SEQ ID NO: 36350 - RNA, 22 nt, Homo sapiens
ucuacccagaaaggagccagug

SEQ ID NO: 36351 - RNA, 24 nt, Homo sapiens
cacccccagagccucagcucccca

SEQ ID NO: 36352 - RNA, 23 nt, Homo sapiens
acacuuacuggacaccuacuagg

SEQ ID NO: 36353 - RNA, 22 nt, Homo sapiens
acuucaaggaucuuaaacuuug

SEQ ID NO: 36354 - RNA, 22 nt, Homo sapiens
cucagucccaggcaaaccauaa

SEQ ID NO: 36355 - RNA, 21 nt, Homo sapiens
aguucucccaacguaaaccca

SEQ ID NO: 36356 - RNA, 17 nt, Homo sapiens
gggagaggaggaggcga

SEQ ID NO: 36357 - RNA, 17 nt, Homo sapiens
gggagaggaggaggcga

SEQ ID NO: 36358 - RNA, 20 nt, Homo sapiens
aagcagaaaaaggcaaacga

SEQ ID NO: 36359 - RNA, 23 nt, Homo sapiens
gggagugaagacacggagccaga

SEQ ID NO: 36360 - RNA, 21 nt, Homo sapiens
gaccaaucgccguccccgccg

SEQ ID NO: 36361 - RNA, 23 nt, Homo sapiens
cagcugcuuuugggauuccguug

SEQ ID NO: 36362 - RNA, 22 nt, Homo sapiens
ucagaccgagacaagugcaaug

SEQ ID NO: 36363 - RNA, 22 nt, Homo sapiens
aggaaaccagcaaguguugacg

SEQ ID NO: 36364 - RNA, 19 nt, Homo sapiens
gcuccuguccaacuggcuc

SEQ ID NO: 36365 - RNA, 21 nt, Homo sapiens
ggacuauagaacuuucccccu

SEQ ID NO: 36366 - RNA, 25 nt, Homo sapiens
accaacggaccuacuucccuccgcc

SEQ ID NO: 36367 - RNA, 22 nt, Homo sapiens
gcggucccgcggcgccccgccu

SEQ ID NO: 36368 - RNA, 21 nt, Homo sapiens
aagggucaguaagcacccgcg

SEQ ID NO: 36369 - RNA, 22 nt, Homo sapiens
ucuacccagaaaggagccagug

SEQ ID NO: 36370 - RNA, 22 nt, Homo sapiens
cggugagcacccggccccugcg

SEQ ID NO: 36371 - RNA, 22 nt, Homo sapiens
ucaucucgcccgcaaagaccca

SEQ ID NO: 36372 - RNA, 22 nt, Homo sapiens
gauccgagcaccggggaccccc

SEQ ID NO: 36373 - RNA, 22 nt, Homo sapiens
cugggggcggcacaggggcuca

SEQ ID NO: 36374 - RNA, 21 nt, Homo sapiens
cggggugcacgggcggagggc

SEQ ID NO: 36375 - RNA, 23 nt, Homo sapiens
gggagugaagacacggagccaga

SEQ ID NO: 36376 - RNA, 22 nt, Homo sapiens
uggcagcagcggagggggcaga

SEQ ID NO: 36377 - RNA, 22 nt, Homo sapiens
acugccugucugugccugcugu

SEQ ID NO: 36378 - RNA, 22 nt, Homo sapiens
agcugaguguaggauguuuaca

SEQ ID NO: 36379 - RNA, 20 nt, Homo sapiens
ccagcagcaccuggggcagu

SEQ ID NO: 36380 - RNA, 22 nt, Homo sapiens
accagguuccaccccagcaggc

SEQ ID NO: 36381 - RNA, 21 nt, Homo sapiens
auccuguacugagcugccccg

SEQ ID NO: 36382 - RNA, 22 nt, Homo sapiens
aagagggagacccaggcucgga

SEQ ID NO: 36383 - RNA, 22 nt, Homo sapiens
caacuccgauaugcaaugggua

SEQ ID NO: 36384 - RNA, 24 nt, Homo sapiens
acgcgcaggccagagacccaggca

SEQ ID NO: 36385 - RNA, 23 nt, Homo sapiens
ccgcuugagcuaacuccgacccg

SEQ ID NO: 36386 - RNA, 21 nt, Homo sapiens
aacauacaaaggguauccucu

SEQ ID NO: 36387 - RNA, 22 nt, Homo sapiens
caaacaccauugucacacucca

SEQ ID NO: 36388 - RNA, 22 nt, Homo sapiens
ccaguagcacggcucaguccag

SEQ ID NO: 36389 - RNA, 22 nt, Homo sapiens
cgaaggcaacacggauaaccua

SEQ ID NO: 36390 - RNA, 23 nt, Homo sapiens
gaaacccagcagacaauguagcu

SEQ ID NO: 36391 - RNA, 21 nt, Homo sapiens
acccaguagccagauguagcu

SEQ ID NO: 36392 - RNA, 21 nt, Homo sapiens
guguauaugcccauggacugc

SEQ ID NO: 36393 - RNA, 23 nt, Homo sapiens
aguaacugguugaacaacuguaa

SEQ ID NO: 36394 - RNA, 23 nt, Homo sapiens
ggacauuguuucagugcccaagu

SEQ ID NO: 36395 - RNA, 22 nt, Homo sapiens
gugggguggguggucaggccga

SEQ ID NO: 36396 - RNA, 17 nt, Homo sapiens
gggagaggaggaggcga

SEQ ID NO: 36397 - RNA, 22 nt, Homo sapiens
gacucgaaccacugauccagca

SEQ ID NO: 36398 - RNA, 23 nt, Homo sapiens
gaaacccagcagacaauguagcu

SEQ ID NO: 36399 - RNA, 23 nt, Homo sapiens
cggcucugucgucgaggcgcuca

SEQ ID NO: 36400 - RNA, 22 nt, Homo sapiens
gagcccuggacuaggagucagc

SEQ ID NO: 36401 - RNA, 22 nt, Homo sapiens
gaauucaucacggccagccucu

SEQ ID NO: 36402 - RNA, 20 nt, Homo sapiens
aggggccucagccuccuggu

SEQ ID NO: 36403 - RNA, 22 nt, Homo sapiens
gcugaggcuguggggcuggagu

SEQ ID NO: 36404 - RNA, 21 nt, Homo sapiens
auaauggagaccaggccacga

SEQ ID NO: 36405 - RNA, 22 nt, Homo sapiens
gugggguggguggucaggccga

SEQ ID NO: 36406 - RNA, 18 nt, Homo sapiens
cccccaccaccacgcccg

SEQ ID NO: 36407 - RNA, 21 nt, Homo sapiens
gaccaaucgccguccccgccg

SEQ ID NO: 36408 - RNA, 21 nt, Homo sapiens
gaccaaucgccguccccgccg

SEQ ID NO: 36409 - RNA, 22 nt, Homo sapiens
cggugagcacccggccccugcg

SEQ ID NO: 36410 - RNA, 23 nt, Homo sapiens
aaagucucgcucucugccccuca

SEQ ID NO: 36411 - RNA, 22 nt, Homo sapiens
acacaccaaggauaauuucucc

SEQ ID NO: 36412 - RNA, 22 nt, Homo sapiens
gcggucccgcggcgccccgccu

SEQ ID NO: 36413 - RNA, 22 nt, Homo sapiens
gcggucccgcggcgccccgccu

SEQ ID NO: 36414 - RNA, 23 nt, Homo sapiens
ccgcuugagcuaacuccgacccg

SEQ ID NO: 36415 - RNA, 22 nt, Homo sapiens
cuggagagacaaggggaagagg

SEQ ID NO: 36416 - RNA, 22 nt, Homo sapiens
aacccauggaauucaguucuca

SEQ ID NO: 36417 - RNA, 21 nt, Homo sapiens
aagugucagacacgguggugg

SEQ ID NO: 36418 - RNA, 22 nt, Homo sapiens
gagcccuggacuaggagucagc

SEQ ID NO: 36419 - RNA, 22 nt, Homo sapiens
gccagcuaacaauacacugccu

SEQ ID NO: 36420 - RNA, 22 nt, Homo sapiens
aggaaaccagcaaguguugacg

SEQ ID NO: 36421 - RNA, 25 nt, Homo sapiens
acggagcugucccaacaccaccccu

SEQ ID NO: 36422 - RNA, 19 nt, Homo sapiens
ucagcaguaccagccuaga

SEQ ID NO: 36423 - RNA, 21 nt, Homo sapiens
caucaccuuccuucuccucca

SEQ ID NO: 36424 - RNA, 20 nt, Homo sapiens
cccugcgccaucuccucuac

SEQ ID NO: 36425 - RNA, 22 nt, Homo sapiens
cacucuaaagggaggcacuuug

SEQ ID NO: 36426 - RNA, 20 nt, Homo sapiens
aagcagaaaaaggcaaacga

SEQ ID NO: 36427 - RNA, 23 nt, Homo sapiens
agggauuccugggaaaacuggac

SEQ ID NO: 36428 - RNA, 21 nt, Homo sapiens
gaccaaucgccguccccgccg

SEQ ID NO: 36429 - RNA, 22 nt, Homo sapiens
ucagaccgagacaagugcaaug

SEQ ID NO: 36430 - RNA, 22 nt, Homo sapiens
gcggucccgcggcgccccgccu

SEQ ID NO: 36431 - RNA, 22 nt, Homo sapiens
ugcuguuagcccuagccccgca

SEQ ID NO: 36432 - RNA, 22 nt, Homo sapiens
cacucuaaagggaggcacuuug

SEQ ID NO: 36433 - RNA, 22 nt, Homo sapiens
auacauacuucuuuacauucca

SEQ ID NO: 36434 - RNA, 21 nt, Homo sapiens
aaaggccacauccagcaccgu

SEQ ID NO: 36435 - RNA, 23 nt, Homo sapiens
agggauuccugggaaaacuggac

SEQ ID NO: 36436 - RNA, 22 nt, Homo sapiens
ccacacacuuccuuacauucca

SEQ ID NO: 36437 - RNA, 21 nt, Homo sapiens
ggaaaucccuggcaaugugau

SEQ ID NO: 36438 - RNA, 21 nt, Homo sapiens
gguaaucccuggcaaugugau

SEQ ID NO: 36439 - RNA, 21 nt, Homo sapiens
gagcuacagugcuucaucuca

SEQ ID NO: 36440 - RNA, 21 nt, Homo sapiens
cguacgcuauacggucuacua

SEQ ID NO: 36441 - RNA, 22 nt, Homo sapiens
agccacaaucaccuucugaucu

SEQ ID NO: 36442 - RNA, 22 nt, Homo sapiens
agggguucaccgagcaacauuc

SEQ ID NO: 36443 - RNA, 22 nt, Homo sapiens
auaaacgacaccuccuugagaa

SEQ ID NO: 36444 - RNA, 23 nt, Homo sapiens
acagaaagugcuucccucaagag

SEQ ID NO: 36445 - RNA, 22 nt, Homo sapiens
aagaagugcaccgcgaauguuu

SEQ ID NO: 36446 - RNA, 20 nt, Homo sapiens
ggcaaagaaggaacauuccu

SEQ ID NO: 36447 - RNA, 21 nt, Homo sapiens
aggagacucacaaguuccugc

SEQ ID NO: 36448 - RNA, 23 nt, Homo sapiens
gucacaucccucccaagacccuc

SEQ ID NO: 36449 - RNA, 22 nt, Homo sapiens
ccaucuuuaccagacaguguua

SEQ ID NO: 36450 - RNA, 24 nt, Homo sapiens
agugugaguucuaccauugccaaa

SEQ ID NO: 36451 - RNA, 18 nt, Homo sapiens
auucaaucuacugccuca

SEQ ID NO: 36452 - RNA, 21 nt, Homo sapiens
ugcaaacccugcaugugggag

SEQ ID NO: 36453 - RNA, 22 nt, Homo sapiens
acaucguuaccagacaguguua

SEQ ID NO: 36454 - RNA, 22 nt, Homo sapiens
aggcauaggaugacaaagggaa

SEQ ID NO: 36455 - RNA, 23 nt, Homo sapiens
cuaccugcacuaugagcacuuug

SEQ ID NO: 36456 - RNA, 22 nt, Homo sapiens
aggcgaaggaugacaaagggaa

SEQ ID NO: 36457 - RNA, 22 nt, Homo sapiens
acaguucuucaacuggcagcuu

SEQ ID NO: 36458 - RNA, 20 nt, Homo sapiens
gcaaugcaacagcaaugcac

SEQ ID NO: 36459 - RNA, 22 nt, Homo sapiens
gaauucaucacggccagccucu

SEQ ID NO: 36460 - RNA, 22 nt, Homo sapiens
ccucauggaaggguuccccacu

SEQ ID NO: 36461 - RNA, 22 nt, Homo sapiens
ucucacccagggacaaaggauu

SEQ ID NO: 36462 - RNA, 22 nt, Homo sapiens
gauagagugcagaccagggucu

SEQ ID NO: 36463 - RNA, 22 nt, Homo sapiens
aacgcuccaaaagaaggcacuc

SEQ ID NO: 36464 - RNA, 22 nt, Homo sapiens
aacacucuaaaaggaggcacuu

SEQ ID NO: 36465 - RNA, 19 nt, Homo sapiens
auuuugguacagcagcuca

SEQ ID NO: 36466 - RNA, 19 nt, Homo sapiens
agaaaccccagcagagaca

SEQ ID NO: 36467 - RNA, 22 nt, Homo sapiens
cuccuccaacaauccuagacca

SEQ ID NO: 36468 - RNA, 25 nt, Homo sapiens
acggagcugucccaacaccaccccu

SEQ ID NO: 36469 - RNA, 20 nt, Homo sapiens
uacugcuuccacagcucccc

SEQ ID NO: 36470 - RNA, 22 nt, Homo sapiens
cuggagagacaaggggaagagg

SEQ ID NO: 36471 - RNA, 22 nt, Homo sapiens
uaaaugaauucaauuuccuucu

SEQ ID NO: 36472 - RNA, 22 nt, Homo sapiens
agaaaaugccccucaguuuuga

SEQ ID NO: 36473 - RNA, 20 nt, Homo sapiens
gcagaagcauuuccacacac

SEQ ID NO: 36474 - RNA, 23 nt, Homo sapiens
gggagugaagacacggagccaga

SEQ ID NO: 36475 - RNA, 23 nt, Homo sapiens
gaacagguagucugaacacuggg

SEQ ID NO: 36476 - RNA, 23 nt, Homo sapiens
gaacagauagucuaaacacuggg

SEQ ID NO: 36477 - RNA, 23 nt, Homo sapiens
ucaguuuugcauagauuugcaca

SEQ ID NO: 36478 - RNA, 22 nt, Homo sapiens
cacucagcaccaggauauuguu

SEQ ID NO: 36479 - RNA, 22 nt, Homo sapiens
aacuaugcaaccuacuaccucu

SEQ ID NO: 36480 - RNA, 23 nt, Homo sapiens
aaaucagaaucacaccuggggga

SEQ ID NO: 36481 - RNA, 22 nt, Homo sapiens
gcaaaaguaacugcaguuuugg

SEQ ID NO: 36482 - RNA, 24 nt, Homo sapiens
acgcagagcccgaaagcccccagu

SEQ ID NO: 36483 - RNA, 22 nt, Homo sapiens
gacucuugaacaacacagguuu

SEQ ID NO: 36484 - RNA, 22 nt, Homo sapiens
cacauggccaaaacagagaaga

SEQ ID NO: 36485 - RNA, 21 nt, Homo sapiens
ugcaggcugaucuucuucucu

SEQ ID NO: 36486 - RNA, 18 nt, Homo sapiens
aucacauucaccucccug

SEQ ID NO: 36487 - RNA, 23 nt, Homo sapiens
ucacauaggaauaaaaagccaua

SEQ ID NO: 36488 - RNA, 25 nt, Homo sapiens
agcuagucaagcgcgguuguggggg

SEQ ID NO: 36489 - RNA, 21 nt, Homo sapiens
acaggauugagggggggcccu

SEQ ID NO: 36490 - RNA, 21 nt, Homo sapiens
acaggauugagggggggcccu

SEQ ID NO: 36491 - RNA, 22 nt, Homo sapiens
cucccuucuuuccucccgucuu

SEQ ID NO: 36492 - RNA, 18 nt, Homo sapiens
acccucugaaaggaagca

SEQ ID NO: 36493 - RNA, 22 nt, Homo sapiens
aaagugcuucuuaccuccagau

SEQ ID NO: 36494 - RNA, 21 nt, Homo sapiens
agguaauaccaauaccuugug

SEQ ID NO: 36495 - RNA, 23 nt, Homo sapiens
acaacaaaaucacuagucuucca

SEQ ID NO: 36496 - RNA, 20 nt, Homo sapiens
cccugcgccaucuccucuac

SEQ ID NO: 36497 - RNA, 22 nt, Homo sapiens
ucucucccauuagaguugaaaa

SEQ ID NO: 36498 - RNA, 22 nt, Homo sapiens
cacgaccgacgccacgccgagu

SEQ ID NO: 36499 - RNA, 18 nt, Homo sapiens
aucacauucaccucccug

SEQ ID NO: 36500 - RNA, 23 nt, Homo sapiens
gggagugaagacacggagccaga

SEQ ID NO: 36501 - RNA, 23 nt, Homo sapiens
gggagugaagacacggagccaga

SEQ ID NO: 36502 - RNA, 21 nt, Homo sapiens
ugcaaacccugcaugugggag

SEQ ID NO: 36503 - RNA, 22 nt, Homo sapiens
ucagccgcugucacacgcacag

SEQ ID NO: 36504 - RNA, 22 nt, Homo sapiens
cgggacguccagacucaacucu

SEQ ID NO: 36505 - RNA, 22 nt, Homo sapiens
ucagaccgagacaagugcaaug

SEQ ID NO: 36506 - RNA, 22 nt, Homo sapiens
cucaauagacugugagcuccuu

SEQ ID NO: 36507 - RNA, 22 nt, Homo sapiens
aagcgguuuaccaucccacaua

SEQ ID NO: 36508 - RNA, 22 nt, Homo sapiens
gauuccaauuuuuccacaucuu

SEQ ID NO: 36509 - RNA, 21 nt, Homo sapiens
acugaucuagagaacacaaga

SEQ ID NO: 36510 - RNA, 20 nt, Homo sapiens
aggggccucagccuccuggu

SEQ ID NO: 36511 - RNA, 23 nt, Homo sapiens
cccagcuagauuguaagcuccuu

SEQ ID NO: 36512 - RNA, 20 nt, Homo sapiens
uccccacagacccagagccg

SEQ ID NO: 36513 - RNA, 22 nt, Homo sapiens
ucagaccgagacaagugcaaug

SEQ ID NO: 36514 - RNA, 23 nt, Homo sapiens
acauuuuucguuauugcucuuga

SEQ ID NO: 36515 - RNA, 23 nt, Homo sapiens
aaaucagaaucacaccuggggga

SEQ ID NO: 36516 - RNA, 21 nt, Homo sapiens
aagacgggaggagaggaguga

SEQ ID NO: 36517 - RNA, 24 nt, Homo sapiens
cagaaagugcuuucuuuuggagaa

SEQ ID NO: 36518 - RNA, 18 nt, Homo sapiens
acccucugaaaggaagca

SEQ ID NO: 36519 - RNA, 22 nt, Homo sapiens
aaagugcuucuuaccuccagau

SEQ ID NO: 36520 - RNA, 22 nt, Homo sapiens
aacacucuaaaaggaggcacuu

SEQ ID NO: 36521 - RNA, 21 nt, Homo sapiens
gcugaggucugggccaggucu

SEQ ID NO: 36522 - RNA, 24 nt, Homo sapiens
acgcagagcccgaaagcccccagu

SEQ ID NO: 36523 - RNA, 23 nt, Homo sapiens
guagugggccgagccgagugaca

SEQ ID NO: 36524 - RNA, 21 nt, Homo sapiens
caucaccuuccuucuccucca

SEQ ID NO: 36525 - RNA, 19 nt, Homo sapiens
aagccaaagccuuauccau

SEQ ID NO: 36526 - RNA, 18 nt, Homo sapiens
uggcgccugaacagggac

SEQ ID NO: 36527 - RNA, 17 nt, Homo sapiens
uggcgcccgaacaggga

SEQ ID NO: 36528 - RNA, 22 nt, Homo sapiens
agaaaaugccccucaguuuuga

SEQ ID NO: 36529 - RNA, 22 nt, Homo sapiens
uccacauggaguugcuguuaca

SEQ ID NO: 36530 - RNA, 22 nt, Homo sapiens
aaucagucucauugcuuuauaa

SEQ ID NO: 36531 - RNA, 22 nt, Homo sapiens
uuucaguuaucaaucugucaca

SEQ ID NO: 36532 - RNA, 22 nt, Homo sapiens
gcaaaaguaauugccaguuuug

SEQ ID NO: 36533 - RNA, 22 nt, Homo sapiens
ugcaaaaguagucucaguuuuu

SEQ ID NO: 36534 - RNA, 19 nt, Homo sapiens
aaaaguaauuacaguuuuu

SEQ ID NO: 36535 - RNA, 22 nt, Homo sapiens
guacaaaaguaauuacaguuuu

SEQ ID NO: 36536 - RNA, 22 nt, Homo sapiens
gcaaaaguaacugcaguuuugg

SEQ ID NO: 36537 - RNA, 21 nt, Homo sapiens
agacacaccacggcacacuuc

SEQ ID NO: 36538 - RNA, 20 nt, Homo sapiens
agagaugagagaaacacccu

SEQ ID NO: 36539 - RNA, 22 nt, Homo sapiens
ccccccacugggccguacccac

SEQ ID NO: 36540 - RNA, 22 nt, Homo sapiens
acucaguaugccaggguaccau

SEQ ID NO: 36541 - RNA, 18 nt, Homo sapiens
cccccaccaccacgcccg

SEQ ID NO: 36542 - RNA, 17 nt, Homo sapiens
uggcgcccgaacaggga

SEQ ID NO: 36543 - RNA, 24 nt, Homo sapiens
acugcuggucuucagucagggcca

SEQ ID NO: 36544 - RNA, 22 nt, Homo sapiens
ccagaacugaguccacagggca

SEQ ID NO: 36545 - RNA, 21 nt, Homo sapiens
gaccaaucgccguccccgccg

SEQ ID NO: 36546 - RNA, 22 nt, Homo sapiens
cccaacaacaugaaacuaccua

SEQ ID NO: 36547 - RNA, 22 nt, Homo sapiens
ucaacaucagucugauaagcua

SEQ ID NO: 36548 - RNA, 23 nt, Homo sapiens
aaaucagaaucacaccuggggga

SEQ ID NO: 36549 - RNA, 22 nt, Homo sapiens
ucaccauugcuaaagugcaauu

SEQ ID NO: 36550 - RNA, 21 nt, Homo sapiens
aaaacaaaaucucaccguuuu

SEQ ID NO: 36551 - RNA, 21 nt, Homo sapiens
cagguaccaauauuuuaucua

SEQ ID NO: 36552 - RNA, 24 nt, Homo sapiens
acgcagagcccgaaagcccccagu

SEQ ID NO: 36553 - RNA, 22 nt, Homo sapiens
gcggucccgcggcgccccgccu

SEQ ID NO: 36554 - RNA, 22 nt, Homo sapiens
ugcuguuagcccuagccccgca

SEQ ID NO: 36555 - RNA, 21 nt, Homo sapiens
ggggagcgggggcccugccuu

SEQ ID NO: 36556 - RNA, 21 nt, Homo sapiens
cggcucggguggcggcgacgg

SEQ ID NO: 36557 - RNA, 21 nt, Homo sapiens
cugaggagagaggaggugggg

SEQ ID NO: 36558 - RNA, 22 nt, Homo sapiens
cugggggcggcacaggggcuca

SEQ ID NO: 36559 - RNA, 22 nt, Homo sapiens
gugggguggguggucaggccga

SEQ ID NO: 36560 - RNA, 22 nt, Homo sapiens
ugaagaagggggggaagggcgu

SEQ ID NO: 36561 - RNA, 22 nt, Homo sapiens
acaaccagcuaagacacugcca

SEQ ID NO: 36562 - RNA, 23 nt, Homo sapiens
gcaaucagcuaacuacacugccu

SEQ ID NO: 36563 - RNA, 22 nt, Homo sapiens
accagcuaacaauacacugcca

SEQ ID NO: 36564 - RNA, 22 nt, Homo sapiens
gccagcuaacaauacacugccu

SEQ ID NO: 36565 - RNA, 19 nt, Homo sapiens
uagcauacagauacgccca

SEQ ID NO: 36566 - RNA, 25 nt, Homo sapiens
acggagcugucccaacaccaccccu

SEQ ID NO: 36567 - RNA, 20 nt, Homo sapiens
uccccacagacccagagccg

SEQ ID NO: 36568 - RNA, 23 nt, Homo sapiens
agaaaccaugggguaugagcaga

SEQ ID NO: 36569 - RNA, 20 nt, Homo sapiens
uacugcuuccacagcucccc

SEQ ID NO: 36570 - RNA, 20 nt, Homo sapiens
uacugcuuccacagcucccc

SEQ ID NO: 36571 - RNA, 22 nt, Homo sapiens
ggcucccaagaaccucaccugu

SEQ ID NO: 36572 - RNA, 22 nt, Homo sapiens
auaaggauuuuuaggggcauua

SEQ ID NO: 36573 - RNA, 22 nt, Homo sapiens
cacuuagcagguuguauuauau

SEQ ID NO: 36574 - RNA, 21 nt, Homo sapiens
gaccaagaaauagccuuucaa

SEQ ID NO: 36575 - RNA, 22 nt, Homo sapiens
cagcauggaguccuccagguug

SEQ ID NO: 36576 - RNA, 22 nt, Homo sapiens
gcaaagguaauugcuguuuucg

SEQ ID NO: 36577 - RNA, 22 nt, Homo sapiens
gccaccuucaaaugggaagucu

SEQ ID NO: 36578 - RNA, 24 nt, Homo sapiens
acugggcacaaacauguccagguc

SEQ ID NO: 36579 - RNA, 23 nt, Homo sapiens
acccaacagccccugcaagggau

SEQ ID NO: 36580 - RNA, 21 nt, Homo sapiens
agguaauaccaauaccuugug

SEQ ID NO: 36581 - RNA, 20 nt, Homo sapiens
uacugcuuccacagcucccc

SEQ ID NO: 36582 - RNA, 20 nt, Homo sapiens
cucaaagcaaacccugcaga

SEQ ID NO: 36583 - RNA, 22 nt, Homo sapiens
ccaucuuuaccagacaguguua

SEQ ID NO: 36584 - RNA, 22 nt, Homo sapiens
ccagaacugaguccacagggca

SEQ ID NO: 36585 - RNA, 22 nt, Homo sapiens
cggugagcacccggccccugcg

SEQ ID NO: 36586 - RNA, 22 nt, Homo sapiens
acugggacuuuguaggccaguu

SEQ ID NO: 36587 - RNA, 22 nt, Homo sapiens
agcgggacuuugagggccaguu

SEQ ID NO: 36588 - RNA, 22 nt, Homo sapiens
cccaacaacaugaaacuaccua

SEQ ID NO: 36589 - RNA, 22 nt, Homo sapiens
acaucguuaccagacaguguua

SEQ ID NO: 36590 - RNA, 22 nt, Homo sapiens
agucuucacaacagcccugugu

SEQ ID NO: 36591 - RNA, 22 nt, Homo sapiens
cuuccagucgaggauguuuaca

SEQ ID NO: 36592 - RNA, 22 nt, Homo sapiens
cuuccagucggggauguuuaca

SEQ ID NO: 36593 - RNA, 22 nt, Homo sapiens
cuuccagucaaggauguuuaca

SEQ ID NO: 36594 - RNA, 18 nt, Homo sapiens
augacaccucccugugaa

SEQ ID NO: 36595 - RNA, 21 nt, Homo sapiens
cccgaggagccgggcaggcuu

SEQ ID NO: 36596 - RNA, 23 nt, Homo sapiens
ggacauuguuucagugcccaagu

SEQ ID NO: 36597 - RNA, 22 nt, Homo sapiens
ugcuguuagcccuagccccgca

SEQ ID NO: 36598 - RNA, 20 nt, Homo sapiens
uccccacagacccagagccg

SEQ ID NO: 36599 - RNA, 22 nt, Homo sapiens
ucggucccucgggccagggcag

SEQ ID NO: 36600 - RNA, 21 nt, Homo sapiens
cugaggagagaggaggugggg

SEQ ID NO: 36601 - RNA, 18 nt, Homo sapiens
ugguggcagaggugggau

SEQ ID NO: 36602 - RNA, 21 nt, Homo sapiens
cggggugcacgggcggagggc

SEQ ID NO: 36603 - RNA, 22 nt, Homo sapiens
acaaaguucuguagugcacuga

SEQ ID NO: 36604 - RNA, 22 nt, Homo sapiens
acaaaguucugugaugcacuga

SEQ ID NO: 36605 - RNA, 23 nt, Homo sapiens
gggagugaagacacggagccaga

SEQ ID NO: 36606 - RNA, 21 nt, Homo sapiens
ccaaguucugucaugcacuga

SEQ ID NO: 36607 - RNA, 22 nt, Homo sapiens
ucaggaacugccuuucucucca

SEQ ID NO: 36608 - RNA, 22 nt, Homo sapiens
cuagugguccuaaacauuucac

SEQ ID NO: 36609 - RNA, 22 nt, Homo sapiens
cagacuccgguggaaugaagga

SEQ ID NO: 36610 - RNA, 22 nt, Homo sapiens
cuuccagucgaggauguuuaca

SEQ ID NO: 36611 - RNA, 22 nt, Homo sapiens
cuuccagucggggauguuuaca

SEQ ID NO: 36612 - RNA, 22 nt, Homo sapiens
cuuccagucaaggauguuuaca

SEQ ID NO: 36613 - RNA, 22 nt, Homo sapiens
auaaggauuuuuaggggcauua

SEQ ID NO: 36614 - RNA, 23 nt, Homo sapiens
ccacccaaugaccuacuccaaga

SEQ ID NO: 36615 - RNA, 20 nt, Homo sapiens
gaaagggcuucccuuugcag

SEQ ID NO: 36616 - RNA, 20 nt, Homo sapiens
gaaagggcuucccuuugcag

SEQ ID NO: 36617 - RNA, 22 nt, Homo sapiens
ugcaagccuugggugugggagg

SEQ ID NO: 36618 - RNA, 20 nt, Homo sapiens
uccccacagacccagagccg

SEQ ID NO: 36619 - RNA, 21 nt, Homo sapiens
cggcucggguggcggcgacgg

SEQ ID NO: 36620 - RNA, 23 nt, Homo sapiens
ggaagccaucaagucgcugcagg

SEQ ID NO: 36621 - RNA, 20 nt, Homo sapiens
cucaaagcaaacccugcaga

SEQ ID NO: 36622 - RNA, 18 nt, Homo sapiens
gaaaugagggccagcuga

SEQ ID NO: 36623 - RNA, 21 nt, Homo sapiens
gaccaaucgccguccccgccg

SEQ ID NO: 36624 - RNA, 23 nt, Homo sapiens
ucaacgggagugaucgugucauu

SEQ ID NO: 36625 - RNA, 23 nt, Homo sapiens
ugcgggcgggacgagcaagcaca

SEQ ID NO: 36626 - RNA, 24 nt, Homo sapiens
acgcgcaggccagagacccaggca

SEQ ID NO: 36627 - RNA, 22 nt, Homo sapiens
gcggucccgcggcgccccgccu

SEQ ID NO: 36628 - RNA, 22 nt, Homo sapiens
ugcuguuagcccuagccccgca

SEQ ID NO: 36629 - RNA, 22 nt, Homo sapiens
uauccacuacaccccgcugccu

SEQ ID NO: 36630 - RNA, 20 nt, Homo sapiens
ggcauucaccgcgugccuua

SEQ ID NO: 36631 - RNA, 22 nt, Homo sapiens
uaaaugaauucaauuuccuucu

SEQ ID NO: 36632 - RNA, 22 nt, Homo sapiens
uacaucuggacagccgaaugaa

SEQ ID NO: 36633 - RNA, 20 nt, Homo sapiens
acagcaaggagggcaggagg

SEQ ID NO: 36634 - RNA, 22 nt, Homo sapiens
cagacuccgguggaaugaagga

SEQ ID NO: 36635 - RNA, 20 nt, Homo sapiens
acauuacuguuaucaaaaca

SEQ ID NO: 36636 - RNA, 22 nt, Homo sapiens
acugccugucugugccugcugu

SEQ ID NO: 36637 - RNA, 21 nt, Homo sapiens
gcggaacuuagccacugugaa

SEQ ID NO: 36638 - RNA, 21 nt, Homo sapiens
gcagaacuuagccacugugaa

SEQ ID NO: 36639 - RNA, 22 nt, Homo sapiens
aaucagucucauugcuuuauaa

SEQ ID NO: 36640 - RNA, 22 nt, Homo sapiens
accagguuccaccccagcaggc

SEQ ID NO: 36641 - RNA, 23 nt, Homo sapiens
acaccccaaaaucgaagcacuuc

SEQ ID NO: 36642 - RNA, 22 nt, Homo sapiens
cgauguaguccaaaggcacaua

SEQ ID NO: 36643 - RNA, 21 nt, Homo sapiens
ucuacucagaagggugccuua

SEQ ID NO: 36644 - RNA, 22 nt, Homo sapiens
cugcucaaacccuccaaugacu

SEQ ID NO: 36645 - RNA, 21 nt, Homo sapiens
caucaccuuccuucuccucca

SEQ ID NO: 36646 - RNA, 21 nt, Homo sapiens
ugacugacagcuuuuugagua

SEQ ID NO: 36647 - RNA, 22 nt, Homo sapiens
gggagaggucucccugcgcaca

SEQ ID NO: 36648 - RNA, 21 nt, Homo sapiens
cugaggagagaggaggugggg

SEQ ID NO: 36649 - RNA, 22 nt, Homo sapiens
ggcucccaagaaccucaccugu

SEQ ID NO: 36650 - RNA, 23 nt, Homo sapiens
gggagugaagacacggagccaga

SEQ ID NO: 36651 - RNA, 21 nt, Homo sapiens
uugucuaaccagucaccuguu

SEQ ID NO: 36652 - RNA, 20 nt, Homo sapiens
ugucuccacagggcucuuua

SEQ ID NO: 36653 - RNA, 22 nt, Homo sapiens
agugaauucuaccagugccaua

SEQ ID NO: 36654 - RNA, 23 nt, Homo sapiens
aagaaucuugucccgcagguccu

SEQ ID NO: 36655 - RNA, 22 nt, Homo sapiens
cuacccacagacguaccaauca

SEQ ID NO: 36656 - RNA, 19 nt, Homo sapiens
gccugcugacaccgugccu

SEQ ID NO: 36657 - RNA, 20 nt, Homo sapiens
uccccacagacccagagccg

SEQ ID NO: 36658 - RNA, 21 nt, Homo sapiens
caucaccuuccuucuccucca

SEQ ID NO: 36659 - RNA, 17 nt, Homo sapiens
gggagaggaggaggcga

SEQ ID NO: 36660 - RNA, 21 nt, Homo sapiens
agggcucaucuugguccugca

SEQ ID NO: 36661 - RNA, 22 nt, Homo sapiens
cacgaccgacgccacgccgagu

SEQ ID NO: 36662 - RNA, 22 nt, Homo sapiens
ggagcccgcgccccgcgccgag

SEQ ID NO: 36663 - RNA, 21 nt, Homo sapiens
cggggugcacgggcggagggc

SEQ ID NO: 36664 - RNA, 23 nt, Homo sapiens
gggagugaagacacggagccaga

SEQ ID NO: 36665 - RNA, 21 nt, Homo sapiens
gaccaaucgccguccccgccg

SEQ ID NO: 36666 - RNA, 22 nt, Homo sapiens
cagaagugggccgggcacaggg

SEQ ID NO: 36667 - RNA, 22 nt, Homo sapiens
ucagaccgagacaagugcaaug

SEQ ID NO: 36668 - RNA, 22 nt, Homo sapiens
gauccgagcaccggggaccccc

SEQ ID NO: 36669 - RNA, 25 nt, Homo sapiens
accaacggaccuacuucccuccgcc

SEQ ID NO: 36670 - RNA, 22 nt, Homo sapiens
gcggucccgcggcgccccgccu

SEQ ID NO: 36671 - RNA, 22 nt, Homo sapiens
ugcuguuagcccuagccccgca

SEQ ID NO: 36672 - RNA, 21 nt, Homo sapiens
aagggucaguaagcacccgcg

SEQ ID NO: 36673 - RNA, 23 nt, Homo sapiens
agggauuccugggaaaacuggac

SEQ ID NO: 36674 - RNA, 23 nt, Homo sapiens
gggagugaagacacggagccaga

SEQ ID NO: 36675 - RNA, 22 nt, Homo sapiens
agcugaguguaggauguuuaca

SEQ ID NO: 36676 - RNA, 23 nt, Homo sapiens
aaagucucgcucucugccccuca

SEQ ID NO: 36677 - RNA, 22 nt, Homo sapiens
ugcaagccuugggugugggagg

SEQ ID NO: 36678 - RNA, 21 nt, Homo sapiens
cugcugggccacaacguggga

SEQ ID NO: 36679 - RNA, 23 nt, Homo sapiens
ccgcuugagcuaacuccgacccg

SEQ ID NO: 36680 - RNA, 22 nt, Homo sapiens
cacucuaaagggaggcacuuug

SEQ ID NO: 36681 - RNA, 27 nt, Homo sapiens
uuuagcacagugcuuauacaagaaggu

SEQ ID NO: 36682 - RNA, 23 nt, Homo sapiens
aaaaugcagauuccuggacucca

SEQ ID NO: 36683 - RNA, 22 nt, Homo sapiens
ucccucacacagaauuccagaa

SEQ ID NO: 36684 - RNA, 22 nt, Homo sapiens
augcuuuuugggguaagggcuu

SEQ ID NO: 36685 - RNA, 23 nt, Homo sapiens
gggagugaagacacggagccaga

SEQ ID NO: 36686 - RNA, 22 nt, Homo sapiens
uauucaggaacauauugcaaaa

SEQ ID NO: 36687 - RNA, 21 nt, Homo sapiens
acaauccuagagcacaagaag

SEQ ID NO: 36688 - RNA, 22 nt, Homo sapiens
caagacacauuuggagagggac

SEQ ID NO: 36689 - RNA, 22 nt, Homo sapiens
ugcuguuagcccuagccccgca

SEQ ID NO: 36690 - RNA, 18 nt, Homo sapiens
gaaaugagggccagcuga

SEQ ID NO: 36691 - RNA, 23 nt, Homo sapiens
cuaucugcacuagaugcaccuua

SEQ ID NO: 36692 - RNA, 21 nt, Homo sapiens
gaccaaucgccguccccgccg

SEQ ID NO: 36693 - RNA, 22 nt, Homo sapiens
acaguucuucaacuggcagcuu

SEQ ID NO: 36694 - RNA, 21 nt, Homo sapiens
ucaaucacagauagcaccccu

SEQ ID NO: 36695 - RNA, 22 nt, Homo sapiens
cucagagcagacgugguucuca

SEQ ID NO: 36696 - RNA, 22 nt, Homo sapiens
gcggucccgcggcgccccgccu

SEQ ID NO: 36697 - RNA, 23 nt, Homo sapiens
cacugugggcccucuccgcacca

SEQ ID NO: 36698 - RNA, 22 nt, Homo sapiens
aucagagcccucugagcuucag

SEQ ID NO: 36699 - RNA, 23 nt, Homo sapiens
cuacgcguauucuuaagcaauaa

SEQ ID NO: 36700 - RNA, 22 nt, Homo sapiens
acaaaguucuguagugcacuga

SEQ ID NO: 36701 - RNA, 22 nt, Homo sapiens
agagagagucugcccuuguaua

SEQ ID NO: 36702 - RNA, 21 nt, Homo sapiens
acguggauuuuccucuaugau

SEQ ID NO: 36703 - RNA, 22 nt, Homo sapiens
acagagagcuugcccuuguaua

SEQ ID NO: 36704 - RNA, 20 nt, Homo sapiens
uaugaacaauuucuaggaau

SEQ ID NO: 36705 - RNA, 23 nt, Homo sapiens
acacucuaaagagaagcgcuuug

SEQ ID NO: 36706 - RNA, 21 nt, Homo sapiens
agaaaguacuucccucuggag

SEQ ID NO: 36707 - RNA, 21 nt, Homo sapiens
agaaagugcaucccucuggag

SEQ ID NO: 36708 - RNA, 22 nt, Homo sapiens
cuaccugagcuagcauacaagu

SEQ ID NO: 36709 - RNA, 22 nt, Homo sapiens
cucauccgauguacaauaauuu

SEQ ID NO: 36710 - RNA, 22 nt, Homo sapiens
caaacaccauugucacacucca

SEQ ID NO: 36711 - RNA, 17 nt, Homo sapiens
gggagaggaggaggcga

SEQ ID NO: 36712 - RNA, 20 nt, Homo sapiens
aagcagaaaaaggcaaacga

SEQ ID NO: 36713 - RNA, 21 nt, Homo sapiens
gaccaaucgccguccccgccg

SEQ ID NO: 36714 - RNA, 22 nt, Homo sapiens
ucagaccgagacaagugcaaug

SEQ ID NO: 36715 - RNA, 22 nt, Homo sapiens
aagagggagacccaggcucgga

SEQ ID NO: 36716 - RNA, 22 nt, Homo sapiens
gauccgagcaccggggaccccc

SEQ ID NO: 36717 - RNA, 25 nt, Homo sapiens
accaacggaccuacuucccuccgcc

SEQ ID NO: 36718 - RNA, 22 nt, Homo sapiens
gcggucccgcggcgccccgccu

SEQ ID NO: 36719 - RNA, 20 nt, Homo sapiens
aggggccucagccuccuggu

SEQ ID NO: 36720 - RNA, 22 nt, Homo sapiens
ugcuguuagcccuagccccgca

SEQ ID NO: 36721 - RNA, 23 nt, Homo sapiens
ccgcuugagcuaacuccgacccg

SEQ ID NO: 36722 - RNA, 17 nt, Homo sapiens
ggguggcagcgguggga

SEQ ID NO: 36723 - RNA, 21 nt, Homo sapiens
ucaaucacagauagcaccccu

SEQ ID NO: 36724 - RNA, 23 nt, Homo sapiens
cugcagaacuguucccgcugcua

SEQ ID NO: 36725 - RNA, 23 nt, Homo sapiens
acagcgcucgcaaccgcagcgau

SEQ ID NO: 36726 - RNA, 23 nt, Homo sapiens
cacugugggcccucuccgcacca

SEQ ID NO: 36727 - RNA, 17 nt, Homo sapiens
uggaggccccagcgaga

SEQ ID NO: 36728 - RNA, 22 nt, Homo sapiens
ugcuguuagcccuagccccgca

SEQ ID NO: 36729 - RNA, 21 nt, Homo sapiens
caucaccuuccuucuccucca

SEQ ID NO: 36730 - RNA, 20 nt, Homo sapiens
uacugcuuccacagcucccc

SEQ ID NO: 36731 - RNA, 21 nt, Homo sapiens
uucaguuaucacaguacugua

SEQ ID NO: 36732 - RNA, 23 nt, Homo sapiens
ggaagccaucaagucgcugcagg

SEQ ID NO: 36733 - RNA, 21 nt, Homo sapiens
cucccccacugcagcuggcac

SEQ ID NO: 36734 - RNA, 20 nt, Homo sapiens
cucaaagcaaacccugcaga

SEQ ID NO: 36735 - RNA, 18 nt, Homo sapiens
gaaaugagggccagcuga

SEQ ID NO: 36736 - RNA, 18 nt, Homo sapiens
gaaaugagggccagcuga

SEQ ID NO: 36737 - RNA, 20 nt, Homo sapiens
cugcgggaggacagggcuca

SEQ ID NO: 36738 - RNA, 22 nt, Homo sapiens
ucaggaacugccuuucucucca

SEQ ID NO: 36739 - RNA, 23 nt, Homo sapiens
cagcugcuuuugggauuccguug

SEQ ID NO: 36740 - RNA, 23 nt, Homo sapiens
uccaucauuacccggcaguauua

SEQ ID NO: 36741 - RNA, 24 nt, Homo sapiens
acucacaccuagguuccaaggauu

SEQ ID NO: 36742 - RNA, 21 nt, Homo sapiens
uagcacccagauagcaaggau

SEQ ID NO: 36743 - RNA, 23 nt, Homo sapiens
gggcucuuacucccucaggcacu

SEQ ID NO: 36744 - RNA, 17 nt, Homo sapiens
uggaggccccagcgaga

SEQ ID NO: 36745 - RNA, 22 nt, Homo sapiens
gcugaggcuguggggcuggagu

SEQ ID NO: 36746 - RNA, 20 nt, Homo sapiens
ugucuccacagggcucuuua

SEQ ID NO: 36747 - RNA, 22 nt, Homo sapiens
cacaucucacuguagccucaaa

SEQ ID NO: 36748 - RNA, 22 nt, Homo sapiens
augcccuuucaucauugcacug

SEQ ID NO: 36749 - RNA, 21 nt, Homo sapiens
cggggugcacgggcggagggc

SEQ ID NO: 36750 - RNA, 21 nt, Homo sapiens
ugcaaacccugcaugugggag

SEQ ID NO: 36751 - RNA, 20 nt, Homo sapiens
cccgccgcgucgcccugggg

SEQ ID NO: 36752 - RNA, 22 nt, Homo sapiens
ggagagccuccacccaacccuc

SEQ ID NO: 36753 - RNA, 21 nt, Homo sapiens
acaggauugagggggggcccu

SEQ ID NO: 36754 - RNA, 22 nt, Homo sapiens
aagcgguuuaccaucccacaua

SEQ ID NO: 36755 - RNA, 22 nt, Homo sapiens
auaaggauuuuuaggggcauua

SEQ ID NO: 36756 - RNA, 18 nt, Homo sapiens
acccucugaaaggaagca

SEQ ID NO: 36757 - RNA, 22 nt, Homo sapiens
aaagugcuucuuaccuccagau

SEQ ID NO: 36758 - RNA, 19 nt, Homo sapiens
auuuugguacagcagcuca

SEQ ID NO: 36759 - RNA, 25 nt, Homo sapiens
acggagcugucccaacaccaccccu

SEQ ID NO: 36760 - RNA, 23 nt, Homo sapiens
cuccagccccuccagggcuuccu

SEQ ID NO: 36761 - RNA, 22 nt, Homo sapiens
cacucuaaagggaggcacuuug

SEQ ID NO: 36762 - RNA, 20 nt, Homo sapiens
uacugcuuccacagcucccc

SEQ ID NO: 36763 - RNA, 21 nt, Homo sapiens
cucccccacugcagcuggcac

SEQ ID NO: 36764 - RNA, 20 nt, Homo sapiens
cucaaagcaaacccugcaga

SEQ ID NO: 36765 - RNA, 20 nt, Homo sapiens
cucaaagcaaacccugcaga

SEQ ID NO: 36766 - RNA, 21 nt, Homo sapiens
cugaggagagaggaggugggg

SEQ ID NO: 36767 - RNA, 20 nt, Homo sapiens
cugcgggaggacagggcuca

SEQ ID NO: 36768 - RNA, 21 nt, Homo sapiens
cugggggacggagcagaagga

SEQ ID NO: 36769 - RNA, 21 nt, Homo sapiens
aguagugcuuucuacuuuaug

SEQ ID NO: 36770 - RNA, 23 nt, Homo sapiens
gggagugaagacacggagccaga

SEQ ID NO: 36771 - RNA, 23 nt, Homo sapiens
cuaucugcacuagaugcaccuua

SEQ ID NO: 36772 - RNA, 22 nt, Homo sapiens
ccucauggaaggguuccccacu

SEQ ID NO: 36773 - RNA, 21 nt, Homo sapiens
cccgaggagccgggcaggcuu

SEQ ID NO: 36774 - RNA, 21 nt, Homo sapiens
gaaggaagugagugcagccac

SEQ ID NO: 36775 - RNA, 20 nt, Homo sapiens
uacugcuuccacagcucccc

SEQ ID NO: 36776 - RNA, 21 nt, Homo sapiens
gagcugcauccuggcuccggg

SEQ ID NO: 36777 - RNA, 18 nt, Homo sapiens
ugguggcagaggugggau

SEQ ID NO: 36778 - RNA, 22 nt, Homo sapiens
cacgaccgacgccacgccgagu

SEQ ID NO: 36779 - RNA, 22 nt, Homo sapiens
ggagcccgcgccccgcgccgag

SEQ ID NO: 36780 - RNA, 23 nt, Homo sapiens
aggaacagcagcagcccgggccg

SEQ ID NO: 36781 - RNA, 21 nt, Homo sapiens
gggcaucugggacgcgcagga

SEQ ID NO: 36782 - RNA, 22 nt, Homo sapiens
cggugagcacccggccccugcg

SEQ ID NO: 36783 - RNA, 22 nt, Homo sapiens
ucagaccgagacaagugcaaug

SEQ ID NO: 36784 - RNA, 19 nt, Homo sapiens
auuuugguacagcagcuca

SEQ ID NO: 36785 - RNA, 25 nt, Homo sapiens
acggagcugucccaacaccaccccu

SEQ ID NO: 36786 - RNA, 23 nt, Homo sapiens
cugugggagggcaguggugagag

SEQ ID NO: 36787 - RNA, 22 nt, Homo sapiens
cuggagagacaaggggaagagg

SEQ ID NO: 36788 - RNA, 22 nt, Homo sapiens
ucccucacacagaauuccagaa

SEQ ID NO: 36789 - RNA, 22 nt, Homo sapiens
augcuuuuugggguaagggcuu

SEQ ID NO: 36790 - RNA, 18 nt, Homo sapiens
cagcagccuccuucucaa

SEQ ID NO: 36791 - RNA, 22 nt, Homo sapiens
aagauguggaccauauuacaua

SEQ ID NO: 36792 - RNA, 23 nt, Homo sapiens
ucucacccagguagcaaggauua

SEQ ID NO: 36793 - RNA, 21 nt, Homo sapiens
uagcacccagauagcaaggau

SEQ ID NO: 36794 - RNA, 22 nt, Homo sapiens
aguccagauucugugcccacca

SEQ ID NO: 36795 - RNA, 19 nt, Homo sapiens
gggaaacguaugucaaccu

SEQ ID NO: 36796 - RNA, 22 nt, Homo sapiens
ucggucccucgggccagggcag

SEQ ID NO: 36797 - RNA, 22 nt, Homo sapiens
ugaauuacuuuguaaaccacca

SEQ ID NO: 36798 - RNA, 17 nt, Homo sapiens
gggagaggaggaggcga

SEQ ID NO: 36799 - RNA, 21 nt, Homo sapiens
gaccaaucgccguccccgccg

SEQ ID NO: 36800 - RNA, 21 nt, Homo sapiens
uucuaggauaggcccaggggc

SEQ ID NO: 36801 - RNA, 22 nt, Homo sapiens
aguccagauucugugcccacca

SEQ ID NO: 36802 - RNA, 19 nt, Homo sapiens
guccugaauuccgcagccu

SEQ ID NO: 36803 - RNA, 25 nt, Homo sapiens
acggagcugucccaacaccaccccu

SEQ ID NO: 36804 - RNA, 22 nt, Homo sapiens
gcacauguucugcggcccacca

SEQ ID NO: 36805 - RNA, 22 nt, Homo sapiens
gcggucccgcggcgccccgccu

SEQ ID NO: 36806 - RNA, 23 nt, Homo sapiens
cacugugggcccucuccgcacca

SEQ ID NO: 36807 - RNA, 22 nt, Homo sapiens
ugcuguuagcccuagccccgca

SEQ ID NO: 36808 - RNA, 21 nt, Homo sapiens
caucaccuuccuucuccucca

SEQ ID NO: 36809 - RNA, 21 nt, Homo sapiens
aagggucaguaagcacccgcg

SEQ ID NO: 36810 - RNA, 19 nt, Homo sapiens
guugggaucacaggcgccc

SEQ ID NO: 36811 - RNA, 23 nt, Homo sapiens
acagcgcucgcaaccgcagcgau

SEQ ID NO: 36812 - RNA, 22 nt, Homo sapiens
ugcuguuagcccuagccccgca

SEQ ID NO: 36813 - RNA, 20 nt, Homo sapiens
uccccacagacccagagccg

SEQ ID NO: 36814 - RNA, 21 nt, Homo sapiens
aucugcacugucagcacuuua

SEQ ID NO: 36815 - RNA, 21 nt, Homo sapiens
cuagggaagaacagugagcaa

SEQ ID NO: 36816 - RNA, 18 nt, Homo sapiens
cccccaccaccacgcccg

SEQ ID NO: 36817 - RNA, 22 nt, Homo sapiens
acaccuggcuccacacgcgggc

SEQ ID NO: 36818 - RNA, 18 nt, Homo sapiens
ggagaggagggcacugga

SEQ ID NO: 36819 - RNA, 21 nt, Homo sapiens
gaccaaucgccguccccgccg

SEQ ID NO: 36820 - RNA, 22 nt, Homo sapiens
cggugagcacccggccccugcg

SEQ ID NO: 36821 - RNA, 19 nt, Homo sapiens
gcuccuguccaacuggcuc

SEQ ID NO: 36822 - RNA, 21 nt, Homo sapiens
gaaggaagugagugcagccac

SEQ ID NO: 36823 - RNA, 22 nt, Homo sapiens
gcggucccgcggcgccccgccu

SEQ ID NO: 36824 - RNA, 22 nt, Homo sapiens
ugcuguuagcccuagccccgca

SEQ ID NO: 36825 - RNA, 22 nt, Homo sapiens
ugcuguuagcccuagccccgca

SEQ ID NO: 36826 - RNA, 23 nt, Homo sapiens
agaaaccaugggguaugagcaga

SEQ ID NO: 36827 - RNA, 22 nt, Homo sapiens
ucuacccagaaaggagccagug

SEQ ID NO: 36828 - RNA, 22 nt, Homo sapiens
augcccuuuuaacauugcacug

SEQ ID NO: 36829 - RNA, 22 nt, Homo sapiens
acaaaguucuguagugcacuga

SEQ ID NO: 36830 - RNA, 22 nt, Homo sapiens
acaaaguucugugaugcacuga

SEQ ID NO: 36831 - RNA, 21 nt, Homo sapiens
ccaaguucugucaugcacuga

SEQ ID NO: 36832 - RNA, 23 nt, Homo sapiens
acucaccgacagcguugaauguu

SEQ ID NO: 36833 - RNA, 23 nt, Homo sapiens
acccaccgacagcaaugaauguu

SEQ ID NO: 36834 - RNA, 22 nt, Homo sapiens
acucaccgacagguugaauguu

SEQ ID NO: 36835 - RNA, 23 nt, Homo sapiens
acccaccgacaacaaugaauguu

SEQ ID NO: 36836 - RNA, 21 nt, Homo sapiens
ggaaaucccuggcaaugugau

SEQ ID NO: 36837 - RNA, 21 nt, Homo sapiens
gguaaucccuggcaaugugau

SEQ ID NO: 36838 - RNA, 22 nt, Homo sapiens
acggaagggcagagagggccag

SEQ ID NO: 36839 - RNA, 21 nt, Homo sapiens
ugcaaugcaacuacaaugcac

SEQ ID NO: 36840 - RNA, 20 nt, Homo sapiens
gcaaugcaacagcaaugcac

SEQ ID NO: 36841 - RNA, 21 nt, Homo sapiens
guuauagaucuggauuugaac

SEQ ID NO: 36842 - RNA, 21 nt, Homo sapiens
caucaccuuccuucuccucca

SEQ ID NO: 36843 - RNA, 20 nt, Homo sapiens
uacugcuuccacagcucccc

SEQ ID NO: 36844 - RNA, 22 nt, Homo sapiens
cacgaccgacgccacgccgagu

SEQ ID NO: 36845 - RNA, 19 nt, Homo sapiens
cagcaucagcagcaucauc

SEQ ID NO: 36846 - RNA, 22 nt, Homo sapiens
ucagaccgagacaagugcaaug

SEQ ID NO: 36847 - RNA, 22 nt, Homo sapiens
acaaccagcuaagacacugcca

SEQ ID NO: 36848 - RNA, 22 nt, Homo sapiens
caacuccgauaugcaaugggua

SEQ ID NO: 36849 - RNA, 22 nt, Homo sapiens
ccucaggcacggccgggccacc

SEQ ID NO: 36850 - RNA, 20 nt, Homo sapiens
aggggccucagccuccuggu

SEQ ID NO: 36851 - RNA, 20 nt, Homo sapiens
ugggccaccgccgagcggac

SEQ ID NO: 36852 - RNA, 26 nt, Homo sapiens
aaccaucucauacaaaccaacuacuu

SEQ ID NO: 36853 - RNA, 22 nt, Homo sapiens
cuaccauaggguaaaaccacug

SEQ ID NO: 36854 - RNA, 21 nt, Homo sapiens
ugcaaugcaacuacaaugcac

SEQ ID NO: 36855 - RNA, 20 nt, Homo sapiens
gcaaugcaacagcaaugcac

SEQ ID NO: 36856 - RNA, 22 nt, Homo sapiens
gagguuucccguguauguuuca

SEQ ID NO: 36857 - RNA, 22 nt, Homo sapiens
aacgcuccaaaagaaggcacuc

SEQ ID NO: 36858 - RNA, 22 nt, Homo sapiens
aacacucuaaaaggaggcacuu

SEQ ID NO: 36859 - RNA, 22 nt, Homo sapiens
cucagagcagacgugguucuca

SEQ ID NO: 36860 - RNA, 21 nt, Homo sapiens
aucuuugauuuucaguaguuu

SEQ ID NO: 36861 - RNA, 23 nt, Homo sapiens
ucauacagcuagauaaccaaaga

SEQ ID NO: 36862 - RNA, 21 nt, Homo sapiens
auaauggagaccaggccacga

SEQ ID NO: 36863 - RNA, 22 nt, Homo sapiens
augcccuuucaucauugcacug

SEQ ID NO: 36864 - RNA, 22 nt, Homo sapiens
ucaggaacugccuuucucucca

SEQ ID NO: 36865 - RNA, 21 nt, Homo sapiens
gaccaaucgccguccccgccg

SEQ ID NO: 36866 - RNA, 21 nt, Homo sapiens
uagaaaggcuaggaccaaacc

SEQ ID NO: 36867 - RNA, 22 nt, Homo sapiens
caacaaaaucacugaugcugga

SEQ ID NO: 36868 - RNA, 23 nt, Homo sapiens
augcaaaguugcucggguaaccu

SEQ ID NO: 36869 - RNA, 23 nt, Homo sapiens
acagcgcucgcaaccgcagcgau

SEQ ID NO: 36870 - RNA, 22 nt, Homo sapiens
gcggucccgcggcgccccgccu

SEQ ID NO: 36871 - RNA, 23 nt, Homo sapiens
ccgcuugagcuaacuccgacccg

SEQ ID NO: 36872 - RNA, 22 nt, Homo sapiens
cugggggcggcacaggggcuca

SEQ ID NO: 36873 - RNA, 18 nt, Homo sapiens
uggcgccugaacagggac

SEQ ID NO: 36874 - RNA, 25 nt, Homo sapiens
agcuagucaagcgcgguuguggggg

SEQ ID NO: 36875 - RNA, 22 nt, Homo sapiens
ucacauuugccugcagagauuu

SEQ ID NO: 36876 - RNA, 22 nt, Homo sapiens
ugggguauuugacaaacugaca

SEQ ID NO: 36877 - RNA, 22 nt, Homo sapiens
cuguuccugcugaacugagcca

SEQ ID NO: 36878 - RNA, 21 nt, Homo sapiens
gcggaacuuagccacugugaa

SEQ ID NO: 36879 - RNA, 23 nt, Homo sapiens
cgugagcuccuggaggacaggga

SEQ ID NO: 36880 - RNA, 22 nt, Homo sapiens
gcacacaauaaauguuugcuga

SEQ ID NO: 36881 - RNA, 21 nt, Homo sapiens
ugacugacagcuuuuugagua

SEQ ID NO: 36882 - RNA, 18 nt, Homo sapiens
aucacauucaccucccug

SEQ ID NO: 36883 - RNA, 23 nt, Homo sapiens
gggagugaagacacggagccaga

SEQ ID NO: 36884 - RNA, 22 nt, Homo sapiens
aagauguggaccauauuacaua

SEQ ID NO: 36885 - RNA, 22 nt, Homo sapiens
gaauucaucacggccagccucu

SEQ ID NO: 36886 - RNA, 19 nt, Homo sapiens
gggaaacguaugucaaccu

SEQ ID NO: 36887 - RNA, 19 nt, Homo sapiens
guccugaauuccgcagccu

SEQ ID NO: 36888 - RNA, 23 nt, Homo sapiens
gucagaccccgagggguccucgc

SEQ ID NO: 36889 - RNA, 22 nt, Homo sapiens
gauccgagcaccggggaccccc

SEQ ID NO: 36890 - RNA, 21 nt, Homo sapiens
gaaggaagugagugcagccac

SEQ ID NO: 36891 - RNA, 21 nt, Homo sapiens
cugaggagagaggaggugggg

SEQ ID NO: 36892 - RNA, 22 nt, Homo sapiens
caaacaccauugucacacucca

SEQ ID NO: 36893 - RNA, 22 nt, Homo sapiens
agugaauucuaccagugccaua

SEQ ID NO: 36894 - RNA, 22 nt, Homo sapiens
uccacauggaguugcuguuaca

SEQ ID NO: 36895 - RNA, 22 nt, Homo sapiens
acaaaaguugccuuugugugau

SEQ ID NO: 36896 - RNA, 23 nt, Homo sapiens
ccacccaaugaccuacuccaaga

SEQ ID NO: 36897 - RNA, 22 nt, Homo sapiens
cgauguaguccaaaggcacaua

SEQ ID NO: 36898 - RNA, 22 nt, Homo sapiens
ccucauggaaggguuccccacu

SEQ ID NO: 36899 - RNA, 23 nt, Homo sapiens
gggccgcagcugucgcccguguc

SEQ ID NO: 36900 - RNA, 20 nt, Homo sapiens
uacugcuuccacagcucccc

SEQ ID NO: 36901 - RNA, 22 nt, Homo sapiens
cuagggaacacagggcugguga

SEQ ID NO: 36902 - RNA, 22 nt, Homo sapiens
ugaagaagggggggaagggcgu

SEQ ID NO: 36903 - RNA, 18 nt, Homo sapiens
cccccaccaccacgcccg

SEQ ID NO: 36904 - RNA, 23 nt, Homo sapiens
cggccugauucacaacaccagcu

SEQ ID NO: 36905 - RNA, 21 nt, Homo sapiens
gaccaaucgccguccccgccg

SEQ ID NO: 36906 - RNA, 25 nt, Homo sapiens
agcuagucaagcgcgguuguggggg

SEQ ID NO: 36907 - RNA, 22 nt, Homo sapiens
gaauucaucacggccagccucu

SEQ ID NO: 36908 - RNA, 23 nt, Homo sapiens
gggcucuuacucccucaggcacu

SEQ ID NO: 36909 - RNA, 24 nt, Homo sapiens
acgcgcaggccagagacccaggca

SEQ ID NO: 36910 - RNA, 22 nt, Homo sapiens
gcggucccgcggcgccccgccu

SEQ ID NO: 36911 - RNA, 22 nt, Homo sapiens
ugcuguuagcccuagccccgca

SEQ ID NO: 36912 - RNA, 22 nt, Homo sapiens
gcugaggcuguggggcuggagu

SEQ ID NO: 36913 - RNA, 21 nt, Homo sapiens
cugaggagagaggaggugggg

SEQ ID NO: 36914 - RNA, 19 nt, Homo sapiens
aagccaaagccuuauccau

SEQ ID NO: 36915 - RNA, 20 nt, Homo sapiens
gcagaagcauuuccacacac

SEQ ID NO: 36916 - RNA, 22 nt, Homo sapiens
cagaaagugcuucccucuagag

SEQ ID NO: 36917 - RNA, 21 nt, Homo sapiens
ugcaaacccugcaugugggag

SEQ ID NO: 36918 - RNA, 22 nt, Homo sapiens
cucaauagacugugagcuccuu

SEQ ID NO: 36919 - RNA, 22 nt, Homo sapiens
agcugaguguaggauguuuaca

SEQ ID NO: 36920 - RNA, 22 nt, Homo sapiens
caacaaaaucacugaugcugga

SEQ ID NO: 36921 - RNA, 22 nt, Homo sapiens
uauggaugcaaaaugaucccaa

SEQ ID NO: 36922 - RNA, 22 nt, Homo sapiens
guagaagggaaucuugcauaag

SEQ ID NO: 36923 - RNA, 22 nt, Homo sapiens
ccuggcacacaguagaccuuca

SEQ ID NO: 36924 - RNA, 22 nt, Homo sapiens
ugcaagccuugggugugggagg

SEQ ID NO: 36925 - RNA, 21 nt, Homo sapiens
uugucuaaccagucaccuguu

SEQ ID NO: 36926 - RNA, 22 nt, Homo sapiens
ccucaggcacggccgggccacc

SEQ ID NO: 36927 - RNA, 23 nt, Homo sapiens
cccagcuagauuguaagcuccuu

SEQ ID NO: 36928 - RNA, 21 nt, Homo sapiens
caucaccuuccuucuccucca

SEQ ID NO: 36929 - RNA, 23 nt, Homo sapiens
aaccaagaccccggagaucccag

SEQ ID NO: 36930 - RNA, 20 nt, Homo sapiens
uacugcuuccacagcucccc

SEQ ID NO: 36931 - RNA, 22 nt, Homo sapiens
auccuucuacaaauucacccau

SEQ ID NO: 36932 - RNA, 23 nt, Homo sapiens
ucacauaggaauaaaaagccaua

SEQ ID NO: 36933 - RNA, 22 nt, Homo sapiens
aacccauggaauucaguucuca

SEQ ID NO: 36934 - RNA, 22 nt, Homo sapiens
cucagagcagacgugguucuca

SEQ ID NO: 36935 - RNA, 23 nt, Homo sapiens
cccaacagacauggcgguacuca

SEQ ID NO: 36936 - RNA, 22 nt, Homo sapiens
ucaacaucagucugauaagcua

SEQ ID NO: 36937 - RNA, 22 nt, Homo sapiens
aucgggaggggacugagccuga

SEQ ID NO: 36938 - RNA, 24 nt, Homo sapiens
cagaaagugcuuucuuuuggagaa

SEQ ID NO: 36939 - RNA, 22 nt, Homo sapiens
aacacucuaaaaggaggcacuu

SEQ ID NO: 36940 - RNA, 21 nt, Homo sapiens
acuagcuuauacauaaaauua

SEQ ID NO: 36941 - RNA, 22 nt, Homo sapiens
cugcacuuuuaugaauaagcuc

SEQ ID NO: 36942 - RNA, 22 nt, Homo sapiens
cucauccgauguacaauaauuu

SEQ ID NO: 36943 - RNA, 17 nt, Homo sapiens
gggagaggaggaggcga

SEQ ID NO: 36944 - RNA, 18 nt, Homo sapiens
aucacauucaccucccug

SEQ ID NO: 36945 - RNA, 23 nt, Homo sapiens
gggagugaagacacggagccaga

SEQ ID NO: 36946 - RNA, 22 nt, Homo sapiens
cagaagugggccgggcacaggg

SEQ ID NO: 36947 - RNA, 22 nt, Homo sapiens
accagcuaacaauacacugcca

SEQ ID NO: 36948 - RNA, 22 nt, Homo sapiens
acggaagggcagagagggccag

SEQ ID NO: 36949 - RNA, 21 nt, Homo sapiens
aguucucccaacguaaaccca

SEQ ID NO: 36950 - RNA, 17 nt, Homo sapiens
uggaggccccagcgaga

SEQ ID NO: 36951 - RNA, 21 nt, Homo sapiens
auaauggagaccaggccacga

SEQ ID NO: 36952 - RNA, 19 nt, Homo sapiens
cagcaucagcagcaucauc

SEQ ID NO: 36953 - RNA, 22 nt, Homo sapiens
gaucacuuuugugacuaugcaa

SEQ ID NO: 36954 - RNA, 22 nt, Homo sapiens
auaaggauuuuuaggggcauua

SEQ ID NO: 36955 - RNA, 22 nt, Homo sapiens
aaagugcuucuuaccuccagau

SEQ ID NO: 36956 - RNA, 23 nt, Homo sapiens
guucuguccuggaagaacauacu

SEQ ID NO: 36957 - RNA, 23 nt, Homo sapiens
aacaggugcucaaauaagacuug

SEQ ID NO: 36958 - RNA, 21 nt, Homo sapiens
gcaagcccagaccgcaaaaag

SEQ ID NO: 36959 - RNA, 22 nt, Homo sapiens
gaucacuuuugugacuaugcaa

SEQ ID NO: 36960 - RNA, 22 nt, Homo sapiens
guagaagggaaucuugcauaag

SEQ ID NO: 36961 - RNA, 22 nt, Homo sapiens
agcaaaauccgcaaguacuuuu

SEQ ID NO: 36962 - RNA, 22 nt, Homo sapiens
aaaguaacugcaguuuuugcua

SEQ ID NO: 36963 - RNA, 23 nt, Homo sapiens
guucuguccuggaagaacauacu

SEQ ID NO: 36964 - RNA, 20 nt, Homo sapiens
cucaaagcaaacccugcaga

SEQ ID NO: 36965 - RNA, 20 nt, Homo sapiens
cuggggaaaaggguggcacg

SEQ ID NO: 36966 - RNA, 22 nt, Homo sapiens
cacaaaccauuaugugcugcua

SEQ ID NO: 36967 - RNA, 20 nt, Homo sapiens
cccgccgcgucgcccugggg

SEQ ID NO: 36968 - RNA, 22 nt, Homo sapiens
acugggacuuuguaggccaguu

SEQ ID NO: 36969 - RNA, 22 nt, Homo sapiens
agcgggacuuugagggccaguu

SEQ ID NO: 36970 - RNA, 23 nt, Homo sapiens
acggcuaguggaccaggugaagu

SEQ ID NO: 36971 - RNA, 22 nt, Homo sapiens
gccagcuaacaauacacugccu

SEQ ID NO: 36972 - RNA, 22 nt, Homo sapiens
ccuggcacacaguagaccuuca

SEQ ID NO: 36973 - RNA, 22 nt, Homo sapiens
uuucaguuaucaaucugucaca

SEQ ID NO: 36974 - RNA, 25 nt, Homo sapiens
acggagcugucccaacaccaccccu

SEQ ID NO: 36975 - RNA, 23 nt, Homo sapiens
guagugggccgagccgagugaca

SEQ ID NO: 36976 - RNA, 18 nt, Homo sapiens
gaaaugagggccagcuga

SEQ ID NO: 36977 - RNA, 23 nt, Homo sapiens
aaaaugcagauuccuggacucca

SEQ ID NO: 36978 - RNA, 23 nt, Homo sapiens
agggauuccugggaaaacuggac

SEQ ID NO: 36979 - RNA, 21 nt, Homo sapiens
cacaaccucaguguuuccagg

SEQ ID NO: 36980 - RNA, 23 nt, Homo sapiens
aggaacagcagcagcccgggccg

SEQ ID NO: 36981 - RNA, 23 nt, Homo sapiens
aaagucucgcucucugccccuca

SEQ ID NO: 36982 - RNA, 19 nt, Homo sapiens
guugggaucacaggcgccc

SEQ ID NO: 36983 - RNA, 22 nt, Homo sapiens
ugcuguuagcccuagccccgca

SEQ ID NO: 36984 - RNA, 22 nt, Homo sapiens
ccccccacugggccguacccac

SEQ ID NO: 36985 - RNA, 19 nt, Homo sapiens
cagcaucagcagcaucauc

SEQ ID NO: 36986 - RNA, 22 nt, Homo sapiens
ucaggaacugccuuucucucca

SEQ ID NO: 36987 - RNA, 22 nt, Homo sapiens
cccaacaacaugaaacuaccua

SEQ ID NO: 36988 - RNA, 22 nt, Homo sapiens
cccaacaacaggaaacuaccua

SEQ ID NO: 36989 - RNA, 23 nt, Homo sapiens
ucaccaaaacauggaagcacuua

SEQ ID NO: 36990 - RNA, 23 nt, Homo sapiens
cuacuaaaacauggaagcacuua

SEQ ID NO: 36991 - RNA, 23 nt, Homo sapiens
ccacugaaacauggaagcacuua

SEQ ID NO: 36992 - RNA, 23 nt, Homo sapiens
acacucaaacauggaagcacuua

SEQ ID NO: 36993 - RNA, 17 nt, Homo sapiens
aagcauggaagcacuua

SEQ ID NO: 36994 - RNA, 22 nt, Homo sapiens
gagcccuggacuaggagucagc

SEQ ID NO: 36995 - RNA, 23 nt, Homo sapiens
acgcucaaaugucgcagcacuuu

SEQ ID NO: 36996 - RNA, 23 nt, Homo sapiens
acaccccaaaaucgaagcacuuc

SEQ ID NO: 36997 - RNA, 21 nt, Homo sapiens
ccuucugacuccaaguccagu

SEQ ID NO: 36998 - RNA, 22 nt, Homo sapiens
aucgggaggggacugagccuga

SEQ ID NO: 36999 - RNA, 22 nt, Homo sapiens
acaguccaaagggaagcacuuu

SEQ ID NO: 37000 - RNA, 21 nt, Homo sapiens
cccucuaaaaggaagcacuuu

SEQ ID NO: 37001 - RNA, 22 nt, Homo sapiens
acccucuaaaaggaagcacuuu

SEQ ID NO: 37002 - RNA, 22 nt, Homo sapiens
acccaccaaagagaagcacuuu

SEQ ID NO: 37003 - RNA, 21 nt, Homo sapiens
cccucaaaaaggaagcacuuu

SEQ ID NO: 37004 - RNA, 22 nt, Homo sapiens
aacccucuaaaaggaagcacuu

SEQ ID NO: 37005 - RNA, 22 nt, Homo sapiens
ugacgaugacaacgaugacgua

SEQ ID NO: 37006 - RNA, 23 nt, Homo sapiens
gagcaaggcucuugucuguaagu

SEQ ID NO: 37007 - RNA, 20 nt, Homo sapiens
uccccacagacccagagccg

SEQ ID NO: 37008 - RNA, 22 nt, Homo sapiens
uauccacuacaccccgcugccu

SEQ ID NO: 37009 - RNA, 22 nt, Homo sapiens
acacacccacgcgagccggaaa

SEQ ID NO: 37010 - RNA, 24 nt, Homo sapiens
ucacagguuaaagggucucaggga

SEQ ID NO: 37011 - RNA, 22 nt, Homo sapiens
ucacaaguuagggucucaggga

SEQ ID NO: 37012 - RNA, 23 nt, Homo sapiens
agcccuguucuacagcccugagg

SEQ ID NO: 37013 - RNA, 17 nt, Homo sapiens
gggagaggaggaggcga

SEQ ID NO: 37014 - RNA, 22 nt, Homo sapiens
cuaccauaggguaaaaccacug

SEQ ID NO: 37015 - RNA, 21 nt, Homo sapiens
gggcaucugggacgcgcagga

SEQ ID NO: 37016 - RNA, 22 nt, Homo sapiens
cuguuccugcugaacugagcca

SEQ ID NO: 37017 - RNA, 20 nt, Homo sapiens
cuggaggaagggcccagagg

SEQ ID NO: 37018 - RNA, 22 nt, Homo sapiens
gccuaagacacaggcccagaga

SEQ ID NO: 37019 - RNA, 25 nt, Homo sapiens
accaacggaccuacuucccuccgcc

SEQ ID NO: 37020 - RNA, 22 nt, Homo sapiens
gcugaggcuguggggcuggagu

SEQ ID NO: 37021 - RNA, 22 nt, Homo sapiens
uauccacuacaccccgcugccu

SEQ ID NO: 37022 - RNA, 24 nt, Homo sapiens
cacccccagagccucagcucccca

SEQ ID NO: 37023 - RNA, 22 nt, Homo sapiens
ucaggaacugccuuucucucca

SEQ ID NO: 37024 - RNA, 21 nt, Homo sapiens
gaccaaucgccguccccgccg

SEQ ID NO: 37025 - RNA, 22 nt, Homo sapiens
agcgggacuuugagggccaguu

SEQ ID NO: 37026 - RNA, 25 nt, Homo sapiens
agcuagucaagcgcgguuguggggg

SEQ ID NO: 37027 - RNA, 22 nt, Homo sapiens
cacucagcggccguuuccccaa

SEQ ID NO: 37028 - RNA, 21 nt, Homo sapiens
aacggaaccacuagugacuug

SEQ ID NO: 37029 - RNA, 23 nt, Homo sapiens
cggcucugucgucgaggcgcuca

SEQ ID NO: 37030 - RNA, 22 nt, Homo sapiens
acacucuaaagggaaccauuuu

SEQ ID NO: 37031 - RNA, 22 nt, Homo sapiens
gcggucccgcggcgccccgccu

SEQ ID NO: 37032 - RNA, 22 nt, Homo sapiens
gugggguggguggucaggccga

SEQ ID NO: 37033 - RNA, 24 nt, Homo sapiens
acugcuggucuucagucagggcca

SEQ ID NO: 37034 - RNA, 22 nt, Homo sapiens
ucaggaacugccuuucucucca

SEQ ID NO: 37035 - RNA, 21 nt, Homo sapiens
gaccaaucgccguccccgccg

SEQ ID NO: 37036 - RNA, 21 nt, Homo sapiens
ggcugucaauucauaggucag

SEQ ID NO: 37037 - RNA, 21 nt, Homo sapiens
acaggauugagggggggcccu

SEQ ID NO: 37038 - RNA, 23 nt, Homo sapiens
aaagucucgcucucugccccuca

SEQ ID NO: 37039 - RNA, 22 nt, Homo sapiens
gcggucccgcggcgccccgccu

SEQ ID NO: 37040 - RNA, 22 nt, Homo sapiens
ugcuguuagcccuagccccgca

SEQ ID NO: 37041 - RNA, 21 nt, Homo sapiens
caucaccuuccuucuccucca

SEQ ID NO: 37042 - RNA, 20 nt, Homo sapiens
uacugcuuccacagcucccc

SEQ ID NO: 37043 - RNA, 22 nt, Homo sapiens
auccuucuacaaauucacccau

SEQ ID NO: 37044 - RNA, 22 nt, Homo sapiens
aaaauacauauauaucuacgua

SEQ ID NO: 37045 - RNA, 17 nt, Homo sapiens
ggguggcagcgguggga

SEQ ID NO: 37046 - RNA, 22 nt, Homo sapiens
aggucucacuuuguugcccaga

SEQ ID NO: 37047 - RNA, 22 nt, Homo sapiens
uggcagcagcggagggggcaga

SEQ ID NO: 37048 - RNA, 23 nt, Homo sapiens
cagcugcuuuugggauuccguug

SEQ ID NO: 37049 - RNA, 22 nt, Homo sapiens
aggcauaggaugacaaagggaa

SEQ ID NO: 37050 - RNA, 22 nt, Homo sapiens
aggcgaaggaugacaaagggaa

SEQ ID NO: 37051 - RNA, 22 nt, Homo sapiens
ucaacaucagucugauaagcua

SEQ ID NO: 37052 - RNA, 20 nt, Homo sapiens
ccagcagcaccuggggcagu

SEQ ID NO: 37053 - RNA, 20 nt, Homo sapiens
cuggaggaagggcccagagg

SEQ ID NO: 37054 - RNA, 22 nt, Homo sapiens
gccuaagacacaggcccagaga

SEQ ID NO: 37055 - RNA, 23 nt, Homo sapiens
acggcuaguggaccaggugaagu

SEQ ID NO: 37056 - RNA, 21 nt, Homo sapiens
auccuguacugagcugccccg

SEQ ID NO: 37057 - RNA, 22 nt, Homo sapiens
gcugccguauaugugaugucac

SEQ ID NO: 37058 - RNA, 22 nt, Homo sapiens
agcacagacuugcugugauguu

SEQ ID NO: 37059 - RNA, 21 nt, Homo sapiens
uagcacccagauagcaaggau

SEQ ID NO: 37060 - RNA, 19 nt, Homo sapiens
guccugaauuccgcagccu

SEQ ID NO: 37061 - RNA, 25 nt, Homo sapiens
aaggagcucagaagcccugcccagc

SEQ ID NO: 37062 - RNA, 22 nt, Homo sapiens
ccucuaguaaauaugucagcau

SEQ ID NO: 37063 - RNA, 23 nt, Homo sapiens
aacaggugcucaaauaagacuug

SEQ ID NO: 37064 - RNA, 22 nt, Homo sapiens
gaucacuuuugugacuaugcaa

SEQ ID NO: 37065 - RNA, 22 nt, Homo sapiens
auaaggauuuuuaggggcauua

SEQ ID NO: 37066 - RNA, 22 nt, Homo sapiens
gguaaaacucgcaauuacuuuu

SEQ ID NO: 37067 - RNA, 22 nt, Homo sapiens
ggccaaaaccacaauuacuuuu

SEQ ID NO: 37068 - RNA, 22 nt, Homo sapiens
ggcaaaaaccgcaauuacuuuu

SEQ ID NO: 37069 - RNA, 22 nt, Homo sapiens
ggcaaaaaccacaauuacuuuu

SEQ ID NO: 37070 - RNA, 22 nt, Homo sapiens
gacaaaaaccgcgauuacuuuu

SEQ ID NO: 37071 - RNA, 22 nt, Homo sapiens
ggcaaaauccgcaauuacuuuu

SEQ ID NO: 37072 - RNA, 22 nt, Homo sapiens
accaaagaccgcaauuacuuuu

SEQ ID NO: 37073 - RNA, 21 nt, Homo sapiens
uuuuggugcauauuuacuuua

SEQ ID NO: 37074 - RNA, 23 nt, Homo sapiens
guucuguccuggaagaacauacu

SEQ ID NO: 37075 - RNA, 22 nt, Homo sapiens
aaggugauggucagcagacaua

SEQ ID NO: 37076 - RNA, 23 nt, Homo sapiens
gucacaucccucccaagacccuc

SEQ ID NO: 37077 - RNA, 21 nt, Homo sapiens
gaccaaucgccguccccgccg

SEQ ID NO: 37078 - RNA, 24 nt, Homo sapiens
ugggagaaccucccugcuucugcu

SEQ ID NO: 37079 - RNA, 18 nt, Homo sapiens
acccucugaaaggaagca

SEQ ID NO: 37080 - RNA, 22 nt, Homo sapiens
aaagugcuucuuaccuccagau

SEQ ID NO: 37081 - RNA, 19 nt, Homo sapiens
guccugaauuccgcagccu

SEQ ID NO: 37082 - RNA, 22 nt, Homo sapiens
gcggucccgcggcgccccgccu

SEQ ID NO: 37083 - RNA, 20 nt, Homo sapiens
cuggggaaaaggguggcacg

SEQ ID NO: 37084 - RNA, 24 nt, Homo sapiens
acugcaggcuccagcuuccaggcu

SEQ ID NO: 37085 - RNA, 17 nt, Homo sapiens
gacagccucucccccac

SEQ ID NO: 37086 - RNA, 18 nt, Homo sapiens
aucacauucaccucccug

SEQ ID NO: 37087 - RNA, 21 nt, Homo sapiens
gagcuacagugcuucaucuca

SEQ ID NO: 37088 - RNA, 22 nt, Homo sapiens
aacccauggaauucaguucuca

SEQ ID NO: 37089 - RNA, 23 nt, Homo sapiens
gggagugaagacacggagccaga

SEQ ID NO: 37090 - RNA, 22 nt, Homo sapiens
ucaggaacugccuuucucucca

SEQ ID NO: 37091 - RNA, 25 nt, Homo sapiens
agcuagucaagcgcgguuguggggg

SEQ ID NO: 37092 - RNA, 22 nt, Homo sapiens
cagacuccgguggaaugaagga

SEQ ID NO: 37093 - RNA, 22 nt, Homo sapiens
ucaacaucagucugauaagcua

SEQ ID NO: 37094 - RNA, 24 nt, Homo sapiens
ugggagaaccucccugcuucugcu

SEQ ID NO: 37095 - RNA, 22 nt, Homo sapiens
cacuuagcagguuguauuauau

SEQ ID NO: 37096 - RNA, 21 nt, Homo sapiens
aagacgggaggagaggaguga

SEQ ID NO: 37097 - RNA, 23 nt, Homo sapiens
caugagugacgcccucuggagua

SEQ ID NO: 37098 - RNA, 21 nt, Homo sapiens
gaaggaagugagugcagccac

SEQ ID NO: 37099 - RNA, 21 nt, Homo sapiens
gggcaucugggacgcgcagga

SEQ ID NO: 37100 - RNA, 21 nt, Homo sapiens
gaccaaucgccguccccgccg

SEQ ID NO: 37101 - RNA, 22 nt, Homo sapiens
uggcagcagcggagggggcaga

SEQ ID NO: 37102 - RNA, 20 nt, Homo sapiens
ccagcagcaccuggggcagu

SEQ ID NO: 37103 - RNA, 21 nt, Homo sapiens
auccuguacugagcugccccg

SEQ ID NO: 37104 - RNA, 22 nt, Homo sapiens
gcggucccgcggcgccccgccu

SEQ ID NO: 37105 - RNA, 22 nt, Homo sapiens
ggcagagagucagagcgcggau

SEQ ID NO: 37106 - RNA, 18 nt, Homo sapiens
ugguggcagaggugggau

SEQ ID NO: 37107 - RNA, 17 nt, Homo sapiens
gacagccucucccccac

SEQ ID NO: 37108 - RNA, 17 nt, Homo sapiens
gggagaggaggaggcga

SEQ ID NO: 37109 - RNA, 21 nt, Homo sapiens
acuagacugugagcuccucga

SEQ ID NO: 37110 - RNA, 21 nt, Homo sapiens
gaccaaucgccguccccgccg

SEQ ID NO: 37111 - RNA, 20 nt, Homo sapiens
acagcaaggagggcaggagg

SEQ ID NO: 37112 - RNA, 22 nt, Homo sapiens
ucagaccgagacaagugcaaug

SEQ ID NO: 37113 - RNA, 22 nt, Homo sapiens
agcugaguguaggauguuuaca

SEQ ID NO: 37114 - RNA, 22 nt, Homo sapiens
ugcaagccuugggugugggagg

SEQ ID NO: 37115 - RNA, 25 nt, Homo sapiens
accaacggaccuacuucccuccgcc

SEQ ID NO: 37116 - RNA, 21 nt, Homo sapiens
caucaccuuccuucuccucca

SEQ ID NO: 37117 - RNA, 24 nt, Homo sapiens
cacccccagagccucagcucccca

SEQ ID NO: 37118 - RNA, 21 nt, Homo sapiens
agaaguagaccauguguccua

SEQ ID NO: 37119 - RNA, 19 nt, Homo sapiens
ccaccucccgaguccucac

SEQ ID NO: 37120 - RNA, 20 nt, Homo sapiens
cuggggaaaaggguggcacg

SEQ ID NO: 37121 - RNA, 22 nt, Homo sapiens
cuaccauaggguaaaaccacug

SEQ ID NO: 37122 - RNA, 22 nt, Homo sapiens
accuaauauaucaaacauauca

SEQ ID NO: 37123 - RNA, 22 nt, Homo sapiens
cagacuccgguggaaugaagga

SEQ ID NO: 37124 - RNA, 22 nt, Homo sapiens
ucacauuugccugcagagauuu

SEQ ID NO: 37125 - RNA, 21 nt, Homo sapiens
caugcacaugcacacauacau

SEQ ID NO: 37126 - RNA, 22 nt, Homo sapiens
agagaggagagccguguaugac

SEQ ID NO: 37127 - RNA, 23 nt, Homo sapiens
ccuucucagaaaggugaaauuua

SEQ ID NO: 37128 - RNA, 18 nt, Homo sapiens
uggcgccugaacagggac

SEQ ID NO: 37129 - RNA, 18 nt, Homo sapiens
aucacauucaccucccug

SEQ ID NO: 37130 - RNA, 23 nt, Homo sapiens
aggaacagcagcagcccgggccg

SEQ ID NO: 37131 - RNA, 22 nt, Homo sapiens
ucaggaacugccuuucucucca

SEQ ID NO: 37132 - RNA, 23 nt, Homo sapiens
aaaucagaaucacaccuggggga

SEQ ID NO: 37133 - RNA, 23 nt, Homo sapiens
acugaggggccucagaccgagcu

SEQ ID NO: 37134 - RNA, 22 nt, Homo sapiens
ccucauggaaggguuccccacu

SEQ ID NO: 37135 - RNA, 22 nt, Homo sapiens
acacaccaaggauaauuucucc

SEQ ID NO: 37136 - RNA, 22 nt, Homo sapiens
aagagggagacccaggcucgga

SEQ ID NO: 37137 - RNA, 24 nt, Homo sapiens
acgcagagcccgaaagcccccagu

SEQ ID NO: 37138 - RNA, 24 nt, Homo sapiens
acgcgcaggccagagacccaggca

SEQ ID NO: 37139 - RNA, 21 nt, Homo sapiens
cugcugggccacaacguggga

SEQ ID NO: 37140 - RNA, 22 nt, Homo sapiens
caaacaccauugucacacucca

SEQ ID NO: 37141 - RNA, 22 nt, Homo sapiens
uccggggacgaacgggacgggu

SEQ ID NO: 37142 - RNA, 18 nt, Homo sapiens
cccccaccaccacgcccg

SEQ ID NO: 37143 - RNA, 21 nt, Homo sapiens
cggggugcacgggcggagggc

SEQ ID NO: 37144 - RNA, 23 nt, Homo sapiens
gggagugaagacacggagccaga

SEQ ID NO: 37145 - RNA, 21 nt, Homo sapiens
gaccaaucgccguccccgccg

SEQ ID NO: 37146 - RNA, 23 nt, Homo sapiens
gaaacccagcagacaauguagcu

SEQ ID NO: 37147 - RNA, 22 nt, Homo sapiens
ucagaccgagacaagugcaaug

SEQ ID NO: 37148 - RNA, 22 nt, Homo sapiens
gaauucaucacggccagccucu

SEQ ID NO: 37149 - RNA, 22 nt, Homo sapiens
acacaccaaggauaauuucucc

SEQ ID NO: 37150 - RNA, 22 nt, Homo sapiens
aguccagauucugugcccacca

SEQ ID NO: 37151 - RNA, 21 nt, Homo sapiens
guaaugggaccuuccucuuug

SEQ ID NO: 37152 - RNA, 25 nt, Homo sapiens
acggagcugucccaacaccaccccu

SEQ ID NO: 37153 - RNA, 22 nt, Homo sapiens
gcacauguucugcggcccacca

SEQ ID NO: 37154 - RNA, 25 nt, Homo sapiens
accaacggaccuacuucccuccgcc

SEQ ID NO: 37155 - RNA, 22 nt, Homo sapiens
gcggucccgcggcgccccgccu

SEQ ID NO: 37156 - RNA, 20 nt, Homo sapiens
aggggccucagccuccuggu

SEQ ID NO: 37157 - RNA, 21 nt, Homo sapiens
caucaccuuccuucuccucca

SEQ ID NO: 37158 - RNA, 21 nt, Homo sapiens
cggcucggguggcggcgacgg

SEQ ID NO: 37159 - RNA, 22 nt, Homo sapiens
ggagauggagccagggcccuaa

SEQ ID NO: 37160 - RNA, 19 nt, Homo sapiens
cagcaucagcagcaucauc

SEQ ID NO: 37161 - RNA, 21 nt, Homo sapiens
gaccaaucgccguccccgccg

SEQ ID NO: 37162 - RNA, 23 nt, Homo sapiens
acauuuuucguuauugcucuuga

SEQ ID NO: 37163 - RNA, 23 nt, Homo sapiens
aaaucagaaucacaccuggggga

SEQ ID NO: 37164 - RNA, 22 nt, Homo sapiens
cucccuucuuuccucccgucuu

SEQ ID NO: 37165 - RNA, 25 nt, Homo sapiens
acggagcugucccaacaccaccccu

SEQ ID NO: 37166 - RNA, 24 nt, Homo sapiens
acgcagagcccgaaagcccccagu

SEQ ID NO: 37167 - RNA, 24 nt, Homo sapiens
acgcgcaggccagagacccaggca

SEQ ID NO: 37168 - RNA, 22 nt, Homo sapiens
gcggucccgcggcgccccgccu

SEQ ID NO: 37169 - RNA, 23 nt, Homo sapiens
acaacaaaaucacuagucuucca

SEQ ID NO: 37170 - RNA, 20 nt, Homo sapiens
uacugcuuccacagcucccc

SEQ ID NO: 37171 - RNA, 21 nt, Homo sapiens
auaauggagaccaggccacga

SEQ ID NO: 37172 - RNA, 24 nt, Homo sapiens
acugcuggucuucagucagggcca

SEQ ID NO: 37173 - RNA, 19 nt, Homo sapiens
cagcaucagcagcaucauc

SEQ ID NO: 37174 - RNA, 23 nt, Homo sapiens
aggaacagcagcagcccgggccg

SEQ ID NO: 37175 - RNA, 21 nt, Homo sapiens
acaggauugagggggggcccu

SEQ ID NO: 37176 - RNA, 23 nt, Homo sapiens
aaaucagaaucacaccuggggga

SEQ ID NO: 37177 - RNA, 25 nt, Homo sapiens
aggccgccacccgcccgcgaucccu

SEQ ID NO: 37178 - RNA, 22 nt, Homo sapiens
ggaggccgggacgagugcaaua

SEQ ID NO: 37179 - RNA, 22 nt, Homo sapiens
gacucgaaccacugauccagca

SEQ ID NO: 37180 - RNA, 22 nt, Homo sapiens
ucagccgcugucacacgcacag

SEQ ID NO: 37181 - RNA, 21 nt, Homo sapiens
acccaguagccagauguagcu

SEQ ID NO: 37182 - RNA, 22 nt, Homo sapiens
uaaccgauuucagauggugcua

SEQ ID NO: 37183 - RNA, 22 nt, Homo sapiens
aucgggaggggacugagccuga

SEQ ID NO: 37184 - RNA, 18 nt, Homo sapiens
augacaccucccugugaa

SEQ ID NO: 37185 - RNA, 22 nt, Homo sapiens
acacaccaaggauaauuucucc

SEQ ID NO: 37186 - RNA, 21 nt, Homo sapiens
caucaccuuccuucuccucca

SEQ ID NO: 37187 - RNA, 22 nt, Homo sapiens
uggugauucacaaagaaaucca

SEQ ID NO: 37188 - RNA, 21 nt, Homo sapiens
ccccucccagccucccugcca

SEQ ID NO: 37189 - RNA, 21 nt, Homo sapiens
uggggauuacacuucaacagg

SEQ ID NO: 37190 - RNA, 22 nt, Homo sapiens
ucccucacacagaauuccagaa

SEQ ID NO: 37191 - RNA, 22 nt, Homo sapiens
augcuuuuugggguaagggcuu

SEQ ID NO: 37192 - RNA, 23 nt, Homo sapiens
ucaccaaaacauggaagcacuua

SEQ ID NO: 37193 - RNA, 23 nt, Homo sapiens
cuacuaaaacauggaagcacuua

SEQ ID NO: 37194 - RNA, 23 nt, Homo sapiens
ccacugaaacauggaagcacuua

SEQ ID NO: 37195 - RNA, 23 nt, Homo sapiens
acacucaaacauggaagcacuua

SEQ ID NO: 37196 - RNA, 17 nt, Homo sapiens
aagcauggaagcacuua

SEQ ID NO: 37197 - RNA, 23 nt, Homo sapiens
acgcucaaaugucgcagcacuuu

SEQ ID NO: 37198 - RNA, 23 nt, Homo sapiens
acaccccaaaaucgaagcacuuc

SEQ ID NO: 37199 - RNA, 23 nt, Homo sapiens
gcgcccaauuaaugucuguugau

SEQ ID NO: 37200 - RNA, 22 nt, Homo sapiens
aggaaaccagcaaguguugacg

SEQ ID NO: 37201 - RNA, 23 nt, Homo sapiens
acacucuaaagagaagcgcuuug

SEQ ID NO: 37202 - RNA, 22 nt, Homo sapiens
acaguccaaagggaagcacuuu

SEQ ID NO: 37203 - RNA, 21 nt, Homo sapiens
agaaaguacuucccucuggag

SEQ ID NO: 37204 - RNA, 21 nt, Homo sapiens
cccucuaaaaggaagcacuuu

SEQ ID NO: 37205 - RNA, 22 nt, Homo sapiens
acccucuaaaaggaagcacuuu

SEQ ID NO: 37206 - RNA, 22 nt, Homo sapiens
acccaccaaagagaagcacuuu

SEQ ID NO: 37207 - RNA, 21 nt, Homo sapiens
cccucaaaaaggaagcacuuu

SEQ ID NO: 37208 - RNA, 22 nt, Homo sapiens
aacccucuaaaaggaagcacuu

SEQ ID NO: 37209 - RNA, 21 nt, Homo sapiens
agaaagugcaucccucuggag

SEQ ID NO: 37210 - RNA, 22 nt, Homo sapiens
ucggucccucgggccagggcag

SEQ ID NO: 37211 - RNA, 21 nt, Homo sapiens
ggggagcgggggcccugccuu

SEQ ID NO: 37212 - RNA, 22 nt, Homo sapiens
gugggguggguggucaggccga

SEQ ID NO: 37213 - RNA, 17 nt, Homo sapiens
gggagaggaggaggcga

SEQ ID NO: 37214 - RNA, 22 nt, Homo sapiens
cacgaccgacgccacgccgagu

SEQ ID NO: 37215 - RNA, 22 nt, Homo sapiens
ggagcccgcgccccgcgccgag

SEQ ID NO: 37216 - RNA, 21 nt, Homo sapiens
acuagacugugagcuccucga

SEQ ID NO: 37217 - RNA, 22 nt, Homo sapiens
cucccuucuuuccucccgucuu

SEQ ID NO: 37218 - RNA, 22 nt, Homo sapiens
aguccagauucugugcccacca

SEQ ID NO: 37219 - RNA, 22 nt, Homo sapiens
gccaccuucaaaugggaagucu

SEQ ID NO: 37220 - RNA, 22 nt, Homo sapiens
gcacauguucugcggcccacca

SEQ ID NO: 37221 - RNA, 23 nt, Homo sapiens
cccagcuagauuguaagcuccuu

SEQ ID NO: 37222 - RNA, 21 nt, Homo sapiens
caucaccuuccuucuccucca

SEQ ID NO: 37223 - RNA, 18 nt, Homo sapiens
gaaaugagggccagcuga

SEQ ID NO: 37224 - RNA, 21 nt, Homo sapiens
ccccucccagccucccugcca

SEQ ID NO: 37225 - RNA, 22 nt, Homo sapiens
agccaagcucagacggauccga

SEQ ID NO: 37226 - RNA, 23 nt, Homo sapiens
cuaucugcacuagaugcaccuua

SEQ ID NO: 37227 - RNA, 21 nt, Homo sapiens
gaccaaucgccguccccgccg

SEQ ID NO: 37228 - RNA, 21 nt, Homo sapiens
ucaaucacagauagcaccccu

SEQ ID NO: 37229 - RNA, 22 nt, Homo sapiens
gauagagugcagaccagggucu

SEQ ID NO: 37230 - RNA, 25 nt, Homo sapiens
acggagcugucccaacaccaccccu

SEQ ID NO: 37231 - RNA, 22 nt, Homo sapiens
gcggucccgcggcgccccgccu

SEQ ID NO: 37232 - RNA, 22 nt, Homo sapiens
ugcuguuagcccuagccccgca

SEQ ID NO: 37233 - RNA, 22 nt, Homo sapiens
ugcuguuagcccuagccccgca

SEQ ID NO: 37234 - RNA, 20 nt, Homo sapiens
uacugcuuccacagcucccc

SEQ ID NO: 37235 - RNA, 23 nt, Homo sapiens
agggauuccugggaaaacuggac

SEQ ID NO: 37236 - RNA, 22 nt, Homo sapiens
ccagaacugaguccacagggca

SEQ ID NO: 37237 - RNA, 21 nt, Homo sapiens
ugcaaacccugcaugugggag

SEQ ID NO: 37238 - RNA, 21 nt, Homo sapiens
aggcggcaggcacaggacugg

SEQ ID NO: 37239 - RNA, 21 nt, Homo sapiens
aggcggcaggcacaggacugg

SEQ ID NO: 37240 - RNA, 23 nt, Homo sapiens
ccacccaaugaccuacuccaaga

SEQ ID NO: 37241 - RNA, 22 nt, Homo sapiens
uauggaugcaaaaugaucccaa

SEQ ID NO: 37242 - RNA, 23 nt, Homo sapiens
aaccaagaccccggagaucccag

SEQ ID NO: 37243 - RNA, 20 nt, Homo sapiens
uacugcuuccacagcucccc

SEQ ID NO: 37244 - RNA, 20 nt, Homo sapiens
cucaaagcaaacccugcaga

SEQ ID NO: 37245 - RNA, 17 nt, Homo sapiens
gggagaggaggaggcga

SEQ ID NO: 37246 - RNA, 22 nt, Homo sapiens
aggucucacuuuguugcccaga

SEQ ID NO: 37247 - RNA, 22 nt, Homo sapiens
agcugaguguaggauguuuaca

SEQ ID NO: 37248 - RNA, 22 nt, Homo sapiens
cagcauggaguccuccagguug

SEQ ID NO: 37249 - RNA, 22 nt, Homo sapiens
aggaaaccagcaaguguugacg

SEQ ID NO: 37250 - RNA, 25 nt, Homo sapiens
acggagcugucccaacaccaccccu

SEQ ID NO: 37251 - RNA, 25 nt, Homo sapiens
aaggagcucagaagcccugcccagc

SEQ ID NO: 37252 - RNA, 21 nt, Homo sapiens
cucccccacugcagcuggcac

SEQ ID NO: 37253 - RNA, 20 nt, Homo sapiens
cugcgggaggacagggcuca

SEQ ID NO: 37254 - RNA, 23 nt, Homo sapiens
cccaacagacauggcgguacuca

SEQ ID NO: 37255 - RNA, 20 nt, Homo sapiens
gcaaugcaacagcaaugcac

SEQ ID NO: 37256 - RNA, 22 nt, Homo sapiens
guaccccuggagauucugauaa

SEQ ID NO: 37257 - RNA, 20 nt, Homo sapiens
uaugaacaauuucuaggaau

SEQ ID NO: 37258 - RNA, 22 nt, Homo sapiens
ccuggcacacaguagaccuuca

SEQ ID NO: 37259 - RNA, 22 nt, Homo sapiens
aacgcuccaaaagaaggcacuc

SEQ ID NO: 37260 - RNA, 22 nt, Homo sapiens
aaagugcuucuuaccuccagau

SEQ ID NO: 37261 - RNA, 23 nt, Homo sapiens
acacucuaaagagaagcgcuuug

SEQ ID NO: 37262 - RNA, 22 nt, Homo sapiens
aacacucuaaaaggaggcacuu

SEQ ID NO: 37263 - RNA, 21 nt, Homo sapiens
agaaaguacuucccucuggag

SEQ ID NO: 37264 - RNA, 21 nt, Homo sapiens
agaaagugcaucccucuggag

SEQ ID NO: 37265 - RNA, 19 nt, Homo sapiens
guugggaucacaggcgccc

SEQ ID NO: 37266 - RNA, 19 nt, Homo sapiens
aagacauuuucagacagcu

SEQ ID NO: 37267 - RNA, 19 nt, Homo sapiens
ucccacaggaagcagacac

SEQ ID NO: 37268 - RNA, 21 nt, Homo sapiens
caguagagauuguuucaacac

SEQ ID NO: 37269 - RNA, 20 nt, Homo sapiens
uccccacagacccagagccg

SEQ ID NO: 37270 - RNA, 22 nt, Homo sapiens
cacauggccaaaacagagaaga

SEQ ID NO: 37271 - RNA, 22 nt, Homo sapiens
ucccucacacagaauuccagaa

SEQ ID NO: 37272 - RNA, 22 nt, Homo sapiens
acaaaguucugugaugcacuga

SEQ ID NO: 37273 - RNA, 22 nt, Homo sapiens
acugccugucugugccugcugu

SEQ ID NO: 37274 - RNA, 23 nt, Homo sapiens
cgugagcuccuggaggacaggga

SEQ ID NO: 37275 - RNA, 22 nt, Homo sapiens
accagguuccaccccagcaggc

SEQ ID NO: 37276 - RNA, 22 nt, Homo sapiens
cugcucaaacccuccaaugacu

SEQ ID NO: 37277 - RNA, 20 nt, Homo sapiens
aggggccucagccuccuggu

SEQ ID NO: 37278 - RNA, 21 nt, Homo sapiens
cacaaccucaguguuuccagg

SEQ ID NO: 37279 - RNA, 24 nt, Homo sapiens
acugcaggcuccagcuuccaggcu

SEQ ID NO: 37280 - RNA, 23 nt, Homo sapiens
acacagcucuuccauaucuccag

SEQ ID NO: 37281 - RNA, 22 nt, Homo sapiens
cgggacguccagacucaacucu

SEQ ID NO: 37282 - RNA, 21 nt, Homo sapiens
ggaaaucccuggcaaugugau

SEQ ID NO: 37283 - RNA, 21 nt, Homo sapiens
gguaaucccuggcaaugugau

SEQ ID NO: 37284 - RNA, 23 nt, Homo sapiens
acauuuuucguuauugcucuuga

SEQ ID NO: 37285 - RNA, 22 nt, Homo sapiens
aucgggaggggacugagccuga

SEQ ID NO: 37286 - RNA, 22 nt, Homo sapiens
gaacuugcuaaaaaugcagaau

SEQ ID NO: 37287 - RNA, 23 nt, Homo sapiens
acacacucacacacacacacuca

SEQ ID NO: 37288 - RNA, 22 nt, Homo sapiens
gcaaaaguaauugcagugugug

SEQ ID NO: 37289 - RNA, 20 nt, Homo sapiens
auuucuauaucuaucuccau

SEQ ID NO: 37290 - RNA, 24 nt, Homo sapiens
acgcgcaggccagagacccaggca

SEQ ID NO: 37291 - RNA, 17 nt, Homo sapiens
gggagaggaggaggcga

SEQ ID NO: 37292 - RNA, 21 nt, Homo sapiens
cggggugcacgggcggagggc

SEQ ID NO: 37293 - RNA, 23 nt, Homo sapiens
acccucuauagggaagcgcguuc

SEQ ID NO: 37294 - RNA, 23 nt, Homo sapiens
ucucgugacaugaugauccccga

SEQ ID NO: 37295 - RNA, 21 nt, Homo sapiens
cucacucagauggccaacuca

SEQ ID NO: 37296 - RNA, 25 nt, Homo sapiens
accaacggaccuacuucccuccgcc

SEQ ID NO: 37297 - RNA, 20 nt, Homo sapiens
uccccacagacccagagccg

SEQ ID NO: 37298 - RNA, 21 nt, Homo sapiens
caucaccuuccuucuccucca

SEQ ID NO: 37299 - RNA, 22 nt, Homo sapiens
ggcagagagucagagcgcggau

SEQ ID NO: 37300 - RNA, 24 nt, Homo sapiens
cacccccagagccucagcucccca

SEQ ID NO: 37301 - RNA, 21 nt, Homo sapiens
aacauacaaaggguauccucu

SEQ ID NO: 37302 - RNA, 22 nt, Homo sapiens
auccuucuacaaauucacccau

SEQ ID NO: 37303 - RNA, 22 nt, Homo sapiens
agacaacaaugccaaccucaca

SEQ ID NO: 37304 - RNA, 23 nt, Homo sapiens
ucacauaggaauaaaaagccaua

SEQ ID NO: 37305 - RNA, 23 nt, Homo sapiens
ucacauaggaaugaaaagccaua

SEQ ID NO: 37306 - RNA, 23 nt, Homo sapiens
gggagugaagacacggagccaga

SEQ ID NO: 37307 - RNA, 22 nt, Homo sapiens
agcccaaaaggagaauucuuug

SEQ ID NO: 37308 - RNA, 22 nt, Homo sapiens
cggugagcacccggccccugcg

SEQ ID NO: 37309 - RNA, 22 nt, Homo sapiens
gcaaaaguaauugcagugugug

SEQ ID NO: 37310 - RNA, 20 nt, Homo sapiens
aggggccucagccuccuggu

SEQ ID NO: 37311 - RNA, 22 nt, Homo sapiens
acacacccacgcgagccggaaa

SEQ ID NO: 37312 - RNA, 22 nt, Homo sapiens
acacacccacgcgagccggaaa

SEQ ID NO: 37313 - RNA, 21 nt, Homo sapiens
ccccucccagccucccugcca

SEQ ID NO: 37314 - RNA, 21 nt, Homo sapiens
ccccucccagccucccugcca

SEQ ID NO: 37315 - RNA, 22 nt, Homo sapiens
uccggggacgaacgggacgggu

SEQ ID NO: 37316 - RNA, 18 nt, Homo sapiens
cccccaccaccacgcccg

SEQ ID NO: 37317 - RNA, 21 nt, Homo sapiens
gaccaaucgccguccccgccg

SEQ ID NO: 37318 - RNA, 22 nt, Homo sapiens
cggugagcacccggccccugcg

SEQ ID NO: 37319 - RNA, 22 nt, Homo sapiens
acacucuaaagggaagugcguu

SEQ ID NO: 37320 - RNA, 22 nt, Homo sapiens
gcggucccgcggcgccccgccu

SEQ ID NO: 37321 - RNA, 22 nt, Homo sapiens
ggaggccgggacgagugcaaua

SEQ ID NO: 37322 - RNA, 21 nt, Homo sapiens
ggggagcgggggcccugccuu

SEQ ID NO: 37323 - RNA, 23 nt, Homo sapiens
gggagugaagacacggagccaga

SEQ ID NO: 37324 - RNA, 22 nt, Homo sapiens
cccaacaacaggaaacuaccua

SEQ ID NO: 37325 - RNA, 21 nt, Homo sapiens
acaggauugagggggggcccu

SEQ ID NO: 37326 - RNA, 23 nt, Homo sapiens
aaagucucgcucucugccccuca

SEQ ID NO: 37327 - RNA, 22 nt, Homo sapiens
ccucauggaaggguuccccacu

SEQ ID NO: 37328 - RNA, 20 nt, Homo sapiens
aggggccucagccuccuggu

SEQ ID NO: 37329 - RNA, 20 nt, Homo sapiens
uacugcuuccacagcucccc

SEQ ID NO: 37330 - RNA, 20 nt, Homo sapiens
uacugcuuccacagcucccc

SEQ ID NO: 37331 - RNA, 22 nt, Homo sapiens
aaccauacaaccuacuaccuca

SEQ ID NO: 37332 - RNA, 21 nt, Homo sapiens
cccuccaccaugcaagggaug

SEQ ID NO: 37333 - RNA, 21 nt, Homo sapiens
aggcggcaggcacaggacugg

SEQ ID NO: 37334 - RNA, 22 nt, Homo sapiens
aggcauaggaugacaaagggaa

SEQ ID NO: 37335 - RNA, 22 nt, Homo sapiens
aggcgaaggaugacaaagggaa

SEQ ID NO: 37336 - RNA, 23 nt, Homo sapiens
ucucugcaggccgugugcuuugc

SEQ ID NO: 37337 - RNA, 21 nt, Homo sapiens
ccuucugacuccaaguccagu

SEQ ID NO: 37338 - RNA, 22 nt, Homo sapiens
gcacacaauaaauguuugcuga

SEQ ID NO: 37339 - RNA, 22 nt, Homo sapiens
gguaaaacucgcaauuacuuuu

SEQ ID NO: 37340 - RNA, 22 nt, Homo sapiens
ggccaaaaccacaauuacuuuu

SEQ ID NO: 37341 - RNA, 22 nt, Homo sapiens
ggcaaaaaccgcaauuacuuuu

SEQ ID NO: 37342 - RNA, 22 nt, Homo sapiens
ggcaaaaaccacaauuacuuuu

SEQ ID NO: 37343 - RNA, 22 nt, Homo sapiens
gacaaaaaccgcgauuacuuuu

SEQ ID NO: 37344 - RNA, 22 nt, Homo sapiens
ggcaaaauccgcaauuacuuuu

SEQ ID NO: 37345 - RNA, 22 nt, Homo sapiens
accaaagaccgcaauuacuuuu

SEQ ID NO: 37346 - RNA, 22 nt, Homo sapiens
acaaaauccacaauuacuuuug

SEQ ID NO: 37347 - RNA, 21 nt, Homo sapiens
uuuuggugcauauuuacuuua

SEQ ID NO: 37348 - RNA, 21 nt, Homo sapiens
caucaccuuccuucuccucca

SEQ ID NO: 37349 - RNA, 21 nt, Homo sapiens
cuacgcagaaaggacacagug

SEQ ID NO: 37350 - RNA, 26 nt, Homo sapiens
uuucagaauuugcugccaucaucauc

SEQ ID NO: 37351 - RNA, 22 nt, Homo sapiens
cgaccauggcuguagacuguua

SEQ ID NO: 37352 - RNA, 21 nt, Homo sapiens
ggccgugacuggagacuguua

SEQ ID NO: 37353 - RNA, 22 nt, Homo sapiens
gagguuucccguguauguuuca

SEQ ID NO: 37354 - RNA, 22 nt, Homo sapiens
gacaaaacccgcaaauacuuuu

SEQ ID NO: 37355 - RNA, 21 nt, Homo sapiens
aucagagguucagcuuacccu

SEQ ID NO: 37356 - RNA, 21 nt, Homo sapiens
acaauccuagagcacaagaag

SEQ ID NO: 37357 - RNA, 21 nt, Homo sapiens
cuggaggacggcaacagucag

SEQ ID NO: 37358 - RNA, 22 nt, Homo sapiens
aacccauggaauucaguucuca

SEQ ID NO: 37359 - RNA, 23 nt, Homo sapiens
cccaacagacauggcgguacuca

SEQ ID NO: 37360 - RNA, 22 nt, Homo sapiens
cgaauccaccacgaacaacuuc

SEQ ID NO: 37361 - RNA, 22 nt, Homo sapiens
gagauuggccauguaauacuca

SEQ ID NO: 37362 - RNA, 22 nt, Homo sapiens
gacaaaacccgcaaauacuuuu

SEQ ID NO: 37363 - RNA, 21 nt, Homo sapiens
ccccucccagccucccugcca

SEQ ID NO: 37364 - RNA, 22 nt, Homo sapiens
ggcucccaagaaccucaccugu

SEQ ID NO: 37365 - RNA, 17 nt, Homo sapiens
ggguggcagcgguggga

SEQ ID NO: 37366 - RNA, 18 nt, Homo sapiens
aucacauucaccucccug

SEQ ID NO: 37367 - RNA, 22 nt, Homo sapiens
cacugguacaaggguugggaga

SEQ ID NO: 37368 - RNA, 22 nt, Homo sapiens
cggugagcacccggccccugcg

SEQ ID NO: 37369 - RNA, 22 nt, Homo sapiens
caaacaccauugucacacucca

SEQ ID NO: 37370 - RNA, 24 nt, Homo sapiens
acugcuggucuucagucagggcca

SEQ ID NO: 37371 - RNA, 22 nt, Homo sapiens
augcccuuucaucauugcacug

SEQ ID NO: 37372 - RNA, 21 nt, Homo sapiens
gaccaaucgccguccccgccg

SEQ ID NO: 37373 - RNA, 20 nt, Homo sapiens
cccgccgcgucgcccugggg

SEQ ID NO: 37374 - RNA, 23 nt, Homo sapiens
guaaauagagguuuaauuaacac

SEQ ID NO: 37375 - RNA, 21 nt, Homo sapiens
acaggauugagggggggcccu

SEQ ID NO: 37376 - RNA, 22 nt, Homo sapiens
agcaaaauccgcaaguacuuuu

SEQ ID NO: 37377 - RNA, 21 nt, Homo sapiens
guaaugggaccuuccucuuug

SEQ ID NO: 37378 - RNA, 22 nt, Homo sapiens
gcggucccgcggcgccccgccu

SEQ ID NO: 37379 - RNA, 22 nt, Homo sapiens
ugcuguuagcccuagccccgca

SEQ ID NO: 37380 - RNA, 20 nt, Homo sapiens
uacugcuuccacagcucccc

SEQ ID NO: 37381 - RNA, 22 nt, Homo sapiens
cugggggcggcacaggggcuca

SEQ ID NO: 37382 - RNA, 22 nt, Homo sapiens
cacgaccgacgccacgccgagu

SEQ ID NO: 37383 - RNA, 22 nt, Homo sapiens
ucaggaacugccuuucucucca

SEQ ID NO: 37384 - RNA, 23 nt, Homo sapiens
acccucuauagggaagcgcguuc

SEQ ID NO: 37385 - RNA, 19 nt, Homo sapiens
guccugaauuccgcagccu

SEQ ID NO: 37386 - RNA, 22 nt, Homo sapiens
aagagggagacccaggcucgga

SEQ ID NO: 37387 - RNA, 23 nt, Homo sapiens
acagcgcucgcaaccgcagcgau

SEQ ID NO: 37388 - RNA, 22 nt, Homo sapiens
cugggggcggcacaggggcuca

SEQ ID NO: 37389 - RNA, 17 nt, Homo sapiens
gacagccucucccccac

SEQ ID NO: 37390 - RNA, 17 nt, Homo sapiens
ggguggcagcgguggga

SEQ ID NO: 37391 - RNA, 18 nt, Homo sapiens
aucacauucaccucccug

SEQ ID NO: 37392 - RNA, 23 nt, Homo sapiens
gggagugaagacacggagccaga

SEQ ID NO: 37393 - RNA, 22 nt, Homo sapiens
uacagauggauaccgugcaauu

SEQ ID NO: 37394 - RNA, 21 nt, Homo sapiens
ggacuauagaacuuucccccu

SEQ ID NO: 37395 - RNA, 22 nt, Homo sapiens
caagacacauuuggagagggac

SEQ ID NO: 37396 - RNA, 21 nt, Homo sapiens
gcaagcccagaccgcaaaaag

SEQ ID NO: 37397 - RNA, 22 nt, Homo sapiens
ucaggaacugccuuucucucca

SEQ ID NO: 37398 - RNA, 23 nt, Homo sapiens
aaagucucgcucucugccccuca

SEQ ID NO: 37399 - RNA, 18 nt, Homo sapiens
augacaccucccugugaa

SEQ ID NO: 37400 - RNA, 22 nt, Homo sapiens
gcaaaaguaauugagauuuuug

SEQ ID NO: 37401 - RNA, 22 nt, Homo sapiens
aaaguaacugcaguuuuugcua

SEQ ID NO: 37402 - RNA, 22 nt, Homo sapiens
gcugaggcuguggggcuggagu

SEQ ID NO: 37403 - RNA, 23 nt, Homo sapiens
accacaggagucugagcauuuga

SEQ ID NO: 37404 - RNA, 21 nt, Homo sapiens
gcaagcccagaccgcaaaaag

SEQ ID NO: 37405 - RNA, 23 nt, Homo sapiens
ucacauaggaauaaaaagccaua

SEQ ID NO: 37406 - RNA, 23 nt, Homo sapiens
accccuaucacgauuagcauuaa

SEQ ID NO: 37407 - RNA, 22 nt, Homo sapiens
cagacuccgguggaaugaagga

SEQ ID NO: 37408 - RNA, 18 nt, Homo sapiens
acccucugaaaggaagca

SEQ ID NO: 37409 - RNA, 22 nt, Homo sapiens
aaagugcuucuuaccuccagau

SEQ ID NO: 37410 - RNA, 22 nt, Homo sapiens
acgguccuacacucaaggcaug

SEQ ID NO: 37411 - RNA, 22 nt, Homo sapiens
aaaguaacugcaguuuuugcua

SEQ ID NO: 37412 - RNA, 23 nt, Homo sapiens
guucuguccuggaagaacauacu

SEQ ID NO: 37413 - RNA, 22 nt, Homo sapiens
cgcauuauuacucacgguacga

SEQ ID NO: 37414 - RNA, 18 nt, Homo sapiens
aucacauucaccucccug

SEQ ID NO: 37415 - RNA, 21 nt, Homo sapiens
acuagacugugagcuccucga

SEQ ID NO: 37416 - RNA, 21 nt, Homo sapiens
gggcaucugggacgcgcagga

SEQ ID NO: 37417 - RNA, 21 nt, Homo sapiens
gaccaaucgccguccccgccg

SEQ ID NO: 37418 - RNA, 22 nt, Homo sapiens
cggugagcacccggccccugcg

SEQ ID NO: 37419 - RNA, 22 nt, Homo sapiens
agcgggacuuugagggccaguu

SEQ ID NO: 37420 - RNA, 22 nt, Homo sapiens
ucagaccgagacaagugcaaug

SEQ ID NO: 37421 - RNA, 21 nt, Homo sapiens
agcuaugccagcaucuugccu

SEQ ID NO: 37422 - RNA, 22 nt, Homo sapiens
uccagcaaagggaagcgcuuuc

SEQ ID NO: 37423 - RNA, 22 nt, Homo sapiens
accucuaaaggggagcgcuuug

SEQ ID NO: 37424 - RNA, 23 nt, Homo sapiens
acacucuaaagagaagcgcuuug

SEQ ID NO: 37425 - RNA, 21 nt, Homo sapiens
gcuccaaagggaagcgcuuug

SEQ ID NO: 37426 - RNA, 21 nt, Homo sapiens
ccucuaaagagaagcgcuuuc

SEQ ID NO: 37427 - RNA, 25 nt, Homo sapiens
accaacggaccuacuucccuccgcc

SEQ ID NO: 37428 - RNA, 22 nt, Homo sapiens
gcggucccgcggcgccccgccu

SEQ ID NO: 37429 - RNA, 20 nt, Homo sapiens
aggggccucagccuccuggu

SEQ ID NO: 37430 - RNA, 20 nt, Homo sapiens
uccccacagacccagagccg

SEQ ID NO: 37431 - RNA, 22 nt, Homo sapiens
acaaaaguugccuuugugugau

SEQ ID NO: 37432 - RNA, 22 nt, Homo sapiens
cuggagagacaaggggaagagg

SEQ ID NO: 37433 - RNA, 22 nt, Homo sapiens
ucccucacacagaauuccagaa

SEQ ID NO: 37434 - RNA, 22 nt, Homo sapiens
augcuuuuugggguaagggcuu

SEQ ID NO: 37435 - RNA, 22 nt, Homo sapiens
acaaaguucugugaugcacuga

SEQ ID NO: 37436 - RNA, 22 nt, Homo sapiens
cagaagugggccgggcacaggg

SEQ ID NO: 37437 - RNA, 22 nt, Homo sapiens
cacucagcggccguuuccccaa

SEQ ID NO: 37438 - RNA, 23 nt, Homo sapiens
cgugagcuccuggaggacaggga

SEQ ID NO: 37439 - RNA, 22 nt, Homo sapiens
aggaaaccagcaaguguugacg

SEQ ID NO: 37440 - RNA, 19 nt, Homo sapiens
agaaaccccagcagagaca

SEQ ID NO: 37441 - RNA, 21 nt, Homo sapiens
ggacuauagaacuuucccccu

SEQ ID NO: 37442 - RNA, 20 nt, Homo sapiens
cccugcgccaucuccucuac

SEQ ID NO: 37443 - RNA, 17 nt, Homo sapiens
ggguggcagcgguggga

SEQ ID NO: 37444 - RNA, 18 nt, Homo sapiens
acccucugaaaggaagca

SEQ ID NO: 37445 - RNA, 22 nt, Homo sapiens
aaagugcuucuuaccuccagau

SEQ ID NO: 37446 - RNA, 20 nt, Homo sapiens
uacugcuuccacagcucccc

SEQ ID NO: 37447 - RNA, 21 nt, Homo sapiens
cggcucggguggcggcgacgg

SEQ ID NO: 37448 - RNA, 22 nt, Homo sapiens
acuccaacagggccgcgucucc

SEQ ID NO: 37449 - RNA, 21 nt, Homo sapiens
gaccaaucgccguccccgccg

SEQ ID NO: 37450 - RNA, 22 nt, Homo sapiens
cccaacaacaggaaacuaccua

SEQ ID NO: 37451 - RNA, 22 nt, Homo sapiens
gcggucccgcggcgccccgccu

SEQ ID NO: 37452 - RNA, 22 nt, Homo sapiens
ucccucacacagaauuccagaa

SEQ ID NO: 37453 - RNA, 22 nt, Homo sapiens
augcuuuuugggguaagggcuu

SEQ ID NO: 37454 - RNA, 23 nt, Homo sapiens
ucacauaggaauaaaaagccaua

SEQ ID NO: 37455 - RNA, 22 nt, Homo sapiens
aacccauggaauucaguucuca

SEQ ID NO: 37456 - RNA, 22 nt, Homo sapiens
agccuauggaauucaguucuca

SEQ ID NO: 37457 - RNA, 23 nt, Homo sapiens
gggagugaagacacggagccaga

SEQ ID NO: 37458 - RNA, 22 nt, Homo sapiens
ucaggaacugccuuucucucca

SEQ ID NO: 37459 - RNA, 22 nt, Homo sapiens
ucaggaacugccuuucucucca

SEQ ID NO: 37460 - RNA, 20 nt, Homo sapiens
acauuacuguuaucaaaaca

SEQ ID NO: 37461 - RNA, 22 nt, Homo sapiens
ucagaccgagacaagugcaaug

SEQ ID NO: 37462 - RNA, 23 nt, Homo sapiens
gaaagugcccucaaggcugagug

SEQ ID NO: 37463 - RNA, 17 nt, Homo sapiens
uggaggccccagcgaga

SEQ ID NO: 37464 - RNA, 23 nt, Homo sapiens
uggcccugacacgugguacugga

SEQ ID NO: 37465 - RNA, 22 nt, Homo sapiens
gugggguggguggucaggccga

SEQ ID NO: 37466 - RNA, 22 nt, Homo sapiens
acucaguaugccaggguaccau

SEQ ID NO: 37467 - RNA, 22 nt, Homo sapiens
gcacaaaucuccagaccaccca

SEQ ID NO: 37468 - RNA, 21 nt, Homo sapiens
gaccaaucgccguccccgccg

SEQ ID NO: 37469 - RNA, 22 nt, Homo sapiens
ucaacaucagucugauaagcua

SEQ ID NO: 37470 - RNA, 22 nt, Homo sapiens
ucagaccgagacaagugcaaug

SEQ ID NO: 37471 - RNA, 23 nt, Homo sapiens
aaaucagaaucacaccuggggga

SEQ ID NO: 37472 - RNA, 19 nt, Homo sapiens
guugggaucacaggcgccc

SEQ ID NO: 37473 - RNA, 25 nt, Homo sapiens
acggagcugucccaacaccaccccu

SEQ ID NO: 37474 - RNA, 24 nt, Homo sapiens
acgcagagcccgaaagcccccagu

SEQ ID NO: 37475 - RNA, 22 nt, Homo sapiens
gcggucccgcggcgccccgccu

SEQ ID NO: 37476 - RNA, 25 nt, Homo sapiens
aagaaagagucuugcuuugucgccc

SEQ ID NO: 37477 - RNA, 23 nt, Homo sapiens
acaccccaaaaucgaagcacuuc

SEQ ID NO: 37478 - RNA, 22 nt, Homo sapiens
acaaaaguugccuuugugugau

SEQ ID NO: 37479 - RNA, 22 nt, Homo sapiens
cugcucaaacccuccaaugacu

SEQ ID NO: 37480 - RNA, 24 nt, Homo sapiens
acgcgcaggccagagacccaggca

SEQ ID NO: 37481 - RNA, 21 nt, Homo sapiens
ccccucccagccucccugcca

SEQ ID NO: 37482 - RNA, 22 nt, Homo sapiens
caaacaccauugucacacucca

SEQ ID NO: 37483 - RNA, 17 nt, Homo sapiens
gggagaggaggaggcga

SEQ ID NO: 37484 - RNA, 21 nt, Homo sapiens
gggcaucugggacgcgcagga

SEQ ID NO: 37485 - RNA, 21 nt, Homo sapiens
gaccaaucgccguccccgccg

SEQ ID NO: 37486 - RNA, 22 nt, Homo sapiens
cggugagcacccggccccugcg

SEQ ID NO: 37487 - RNA, 23 nt, Homo sapiens
cggcucugucgucgaggcgcuca

SEQ ID NO: 37488 - RNA, 19 nt, Homo sapiens
agaaaccccagcagagaca

SEQ ID NO: 37489 - RNA, 21 nt, Homo sapiens
cugcugggccacaacguggga

SEQ ID NO: 37490 - RNA, 22 nt, Homo sapiens
gcggucccgcggcgccccgccu

SEQ ID NO: 37491 - RNA, 23 nt, Homo sapiens
cuccagccccuccagggcuuccu

SEQ ID NO: 37492 - RNA, 22 nt, Homo sapiens
ugcuguuagcccuagccccgca

SEQ ID NO: 37493 - RNA, 22 nt, Homo sapiens
uccggggacgaacgggacgggu

SEQ ID NO: 37494 - RNA, 22 nt, Homo sapiens
agugaauucuaccagugccaua

SEQ ID NO: 37495 - RNA, 19 nt, Homo sapiens
uaugcuaccuuugcacggu

SEQ ID NO: 37496 - RNA, 22 nt, Homo sapiens
ucagaccgagacaagugcaaug

SEQ ID NO: 37497 - RNA, 23 nt, Homo sapiens
aaagucucgcucucugccccuca

SEQ ID NO: 37498 - RNA, 22 nt, Homo sapiens
aacacucuaaagggaugcacga

SEQ ID NO: 37499 - RNA, 22 nt, Homo sapiens
gcggucccgcggcgccccgccu

SEQ ID NO: 37500 - RNA, 22 nt, Homo sapiens
ugcuguuagcccuagccccgca

SEQ ID NO: 37501 - RNA, 21 nt, Homo sapiens
caucaccuuccuucuccucca

SEQ ID NO: 37502 - RNA, 21 nt, Homo sapiens
cacaaccucaguguuuccagg

SEQ ID NO: 37503 - RNA, 21 nt, Homo sapiens
ccccucccagccucccugcca

SEQ ID NO: 37504 - RNA, 22 nt, Homo sapiens
caaacaccauugucacacucca

SEQ ID NO: 37505 - RNA, 22 nt, Homo sapiens
uccggggacgaacgggacgggu

SEQ ID NO: 37506 - RNA, 21 nt, Homo sapiens
agcgccuuuggcagcuagagu

SEQ ID NO: 37507 - RNA, 24 nt, Homo sapiens
acugcuggucuucagucagggcca

SEQ ID NO: 37508 - RNA, 23 nt, Homo sapiens
gggagugaagacacggagccaga

SEQ ID NO: 37509 - RNA, 18 nt, Homo sapiens
auucaaucuacugccuca

SEQ ID NO: 37510 - RNA, 20 nt, Homo sapiens
cccgccgcgucgcccugggg

SEQ ID NO: 37511 - RNA, 22 nt, Homo sapiens
acaguucuucaacuggcagcuu

SEQ ID NO: 37512 - RNA, 22 nt, Homo sapiens
acggaagggcagagagggccag

SEQ ID NO: 37513 - RNA, 22 nt, Homo sapiens
uacagauggauaccgugcaauu

SEQ ID NO: 37514 - RNA, 23 nt, Homo sapiens
aaagucucgcucucugccccuca

SEQ ID NO: 37515 - RNA, 21 nt, Homo sapiens
cucacucagauggccaacuca

SEQ ID NO: 37516 - RNA, 21 nt, Homo sapiens
guccugagagcgcugccuccu

SEQ ID NO: 37517 - RNA, 22 nt, Homo sapiens
ggaggccgggacgagugcaaua

SEQ ID NO: 37518 - RNA, 22 nt, Homo sapiens
gggagaggucucccugcgcaca

SEQ ID NO: 37519 - RNA, 21 nt, Homo sapiens
ggggagcgggggcccugccuu

SEQ ID NO: 37520 - RNA, 22 nt, Homo sapiens
cacauggccaaaacagagaaga

SEQ ID NO: 37521 - RNA, 22 nt, Homo sapiens
acacacccacgcgagccggaaa

SEQ ID NO: 37522 - RNA, 22 nt, Homo sapiens
cuggagagacaaggggaagagg

SEQ ID NO: 37523 - RNA, 22 nt, Homo sapiens
acaccuggcuccacacgcgggc

SEQ ID NO: 37524 - RNA, 21 nt, Homo sapiens
aguucucccaacguaaaccca

SEQ ID NO: 37525 - RNA, 22 nt, Homo sapiens
caagacacauuuggagagggac

SEQ ID NO: 37526 - RNA, 20 nt, Homo sapiens
uccccacagacccagagccg

SEQ ID NO: 37527 - RNA, 20 nt, Homo sapiens
cccugcgccaucuccucuac

SEQ ID NO: 37528 - RNA, 25 nt, Homo sapiens
gaauccugguucugucccucacuag

SEQ ID NO: 37529 - RNA, 23 nt, Homo sapiens
gcacaugugcacacagccgggug

SEQ ID NO: 37530 - RNA, 22 nt, Homo sapiens
gaggcucagaauggcucaggag

SEQ ID NO: 37531 - RNA, 21 nt, Homo sapiens
agagcucauccauaguuguca

SEQ ID NO: 37532 - RNA, 22 nt, Homo sapiens
ggcaaaauccgcaauuacuuuu

SEQ ID NO: 37533 - RNA, 23 nt, Homo sapiens
acauuuuucguuauugcucuuga

SEQ ID NO: 37534 - RNA, 22 nt, Homo sapiens
ucaguuuccucugcaaacaguu

SEQ ID NO: 37535 - RNA, 22 nt, Homo sapiens
gagguuucccguguauguuuca

SEQ ID NO: 37536 - RNA, 20 nt, Homo sapiens
guuugauaaacugacacaac

SEQ ID NO: 37537 - RNA, 21 nt, Homo sapiens
aggagacucacaaguuccugc

SEQ ID NO: 37538 - RNA, 21 nt, Homo sapiens
acccaguagccagauguagcu

SEQ ID NO: 37539 - RNA, 22 nt, Homo sapiens
gugggguggguggucaggccga

SEQ ID NO: 37540 - RNA, 23 nt, Homo sapiens
aggaacagcagcagcccgggccg

SEQ ID NO: 37541 - RNA, 22 nt, Homo sapiens
cagaaagugcuucccucuagag

SEQ ID NO: 37542 - RNA, 22 nt, Homo sapiens
cuguuccugcugaacugagcca

SEQ ID NO: 37543 - RNA, 23 nt, Homo sapiens
ccuagagagggugagaaccugcc

SEQ ID NO: 37544 - RNA, 24 nt, Homo sapiens
acgcgcaggccagagacccaggca

SEQ ID NO: 37545 - RNA, 20 nt, Homo sapiens
uacugcuuccacagcucccc

SEQ ID NO: 37546 - RNA, 24 nt, Homo sapiens
cacccccagagccucagcucccca

SEQ ID NO: 37547 - RNA, 23 nt, Homo sapiens
gaaaaacgcccccuggcuugaaa

SEQ ID NO: 37548 - RNA, 17 nt, Homo sapiens
gggagaggaggaggcga

SEQ ID NO: 37549 - RNA, 18 nt, Homo sapiens
aucacauucaccucccug

SEQ ID NO: 37550 - RNA, 21 nt, Homo sapiens
cggggugcacgggcggagggc

SEQ ID NO: 37551 - RNA, 21 nt, Homo sapiens
gaccaaucgccguccccgccg

SEQ ID NO: 37552 - RNA, 22 nt, Homo sapiens
cgauguaguccaaaggcacaua

SEQ ID NO: 37553 - RNA, 22 nt, Homo sapiens
gcggucccgcggcgccccgccu

SEQ ID NO: 37554 - RNA, 22 nt, Homo sapiens
ugcuguuagcccuagccccgca

SEQ ID NO: 37555 - RNA, 21 nt, Homo sapiens
ggucagaacccaucauucacu

SEQ ID NO: 37556 - RNA, 22 nt, Homo sapiens
agaaaaugccccucaguuuuga

SEQ ID NO: 37557 - RNA, 22 nt, Homo sapiens
acaaaguucugugaugcacuga

SEQ ID NO: 37558 - RNA, 22 nt, Homo sapiens
acaaaguucugugaugcacuga

SEQ ID NO: 37559 - RNA, 23 nt, Homo sapiens
ucaguuuugcauagauuugcaca

SEQ ID NO: 37560 - RNA, 22 nt, Homo sapiens
cacucagcaccaggauauuguu

SEQ ID NO: 37561 - RNA, 22 nt, Homo sapiens
aacuaugcaaccuacuaccucu

SEQ ID NO: 37562 - RNA, 22 nt, Homo sapiens
ugggguauuugacaaacugaca

SEQ ID NO: 37563 - RNA, 22 nt, Homo sapiens
accagcuaacaauacacugcca

SEQ ID NO: 37564 - RNA, 22 nt, Homo sapiens
cacuuagcagguuguauuauau

SEQ ID NO: 37565 - RNA, 22 nt, Homo sapiens
gcaaaaguaacugcaguuuugg

SEQ ID NO: 37566 - RNA, 22 nt, Homo sapiens
aaaguaacugcaguuuuugcua

SEQ ID NO: 37567 - RNA, 22 nt, Homo sapiens
acuucaaggaucuuaaacuuug

SEQ ID NO: 37568 - RNA, 21 nt, Homo sapiens
ccccucccagccucccugcca

SEQ ID NO: 37569 - RNA, 24 nt, Homo sapiens
acugcaggcuccagcuuccaggcu

SEQ ID NO: 37570 - RNA, 22 nt, Homo sapiens
acaccuggcuccacacgcgggc

SEQ ID NO: 37571 - RNA, 21 nt, Homo sapiens
agagcucauccauaguuguca

SEQ ID NO: 37572 - RNA, 22 nt, Homo sapiens
auaaggauuuuuaggggcauua

SEQ ID NO: 37573 - RNA, 22 nt, Homo sapiens
cagcauggaguccuccagguug

SEQ ID NO: 37574 - RNA, 22 nt, Homo sapiens
ccuggcacacaguagaccuuca

SEQ ID NO: 37575 - RNA, 22 nt, Homo sapiens
agcaaaauccgcaaguacuuuu

SEQ ID NO: 37576 - RNA, 22 nt, Homo sapiens
acaaaauccacaauuacuuuug

SEQ ID NO: 37577 - RNA, 21 nt, Homo sapiens
cccgaggagccgggcaggcuu

SEQ ID NO: 37578 - RNA, 22 nt, Homo sapiens
gccaccuucaaaugggaagucu

SEQ ID NO: 37579 - RNA, 21 nt, Homo sapiens
ggggagcgggggcccugccuu

SEQ ID NO: 37580 - RNA, 21 nt, Homo sapiens
cugaggagagaggaggugggg

SEQ ID NO: 37581 - RNA, 24 nt, Homo sapiens
acugcaggcuccagcuuccaggcu

SEQ ID NO: 37582 - RNA, 23 nt, Homo sapiens
gggagugaagacacggagccaga

SEQ ID NO: 37583 - RNA, 23 nt, Homo sapiens
gggagugaagacacggagccaga

SEQ ID NO: 37584 - RNA, 23 nt, Homo sapiens
cuaucugcacuagaugcaccuua

SEQ ID NO: 37585 - RNA, 22 nt, Homo sapiens
cagaagugggccgggcacaggg

SEQ ID NO: 37586 - RNA, 20 nt, Homo sapiens
acagcaaggagggcaggagg

SEQ ID NO: 37587 - RNA, 22 nt, Homo sapiens
agucuucacaacagcccugugu

SEQ ID NO: 37588 - RNA, 22 nt, Homo sapiens
aucgggaggggacugagccuga

SEQ ID NO: 37589 - RNA, 22 nt, Homo sapiens
gaauucaucacggccagccucu

SEQ ID NO: 37590 - RNA, 21 nt, Homo sapiens
cccgaggagccgggcaggcuu

SEQ ID NO: 37591 - RNA, 23 nt, Homo sapiens
uguaggcuggggauaaaugaaua

SEQ ID NO: 37592 - RNA, 20 nt, Homo sapiens
uacugcuuccacagcucccc

SEQ ID NO: 37593 - RNA, 20 nt, Homo sapiens
ugucuccacagggcucuuua

SEQ ID NO: 37594 - RNA, 21 nt, Homo sapiens
gcaagcccagaccgcaaaaag

SEQ ID NO: 37595 - RNA, 22 nt, Homo sapiens
agagcaagaccccgucucuaaa

SEQ ID NO: 37596 - RNA, 22 nt, Homo sapiens
augcccuuucaucauugcacug

SEQ ID NO: 37597 - RNA, 22 nt, Homo sapiens
cuuccagucgaggauguuuaca

SEQ ID NO: 37598 - RNA, 22 nt, Homo sapiens
cuuccagucggggauguuuaca

SEQ ID NO: 37599 - RNA, 22 nt, Homo sapiens
cuuccagucaaggauguuuaca

SEQ ID NO: 37600 - RNA, 21 nt, Homo sapiens
ccuucugacuccaaguccagu

SEQ ID NO: 37601 - RNA, 22 nt, Homo sapiens
gugauugccacucuccugagua

SEQ ID NO: 37602 - RNA, 22 nt, Homo sapiens
uuucaguuaucaaucugucaca

SEQ ID NO: 37603 - RNA, 19 nt, Homo sapiens
agaaaccccagcagagaca

SEQ ID NO: 37604 - RNA, 22 nt, Homo sapiens
uccucuuuucuuagagacucac

SEQ ID NO: 37605 - RNA, 21 nt, Homo sapiens
caacugaugccuuuccaagua

SEQ ID NO: 37606 - RNA, 19 nt, Homo sapiens
ccaccucccgaguccucac

SEQ ID NO: 37607 - RNA, 22 nt, Homo sapiens
ucaggaacugccuuucucucca

SEQ ID NO: 37608 - RNA, 21 nt, Homo sapiens
aggcggcaggcacaggacugg

SEQ ID NO: 37609 - RNA, 22 nt, Homo sapiens
ucaacaucagucugauaagcua

SEQ ID NO: 37610 - RNA, 21 nt, Homo sapiens
aucugcacugucagcacuuua

SEQ ID NO: 37611 - RNA, 23 nt, Homo sapiens
gcuuugacaauaucauugcacug

SEQ ID NO: 37612 - RNA, 22 nt, Homo sapiens
cacuuaucagguuguauuauaa

SEQ ID NO: 37613 - RNA, 22 nt, Homo sapiens
cacuuagcagguuguauuauau

SEQ ID NO: 37614 - RNA, 22 nt, Homo sapiens
gcaaaaguaauugagauuuuug

SEQ ID NO: 37615 - RNA, 21 nt, Homo sapiens
acuagcuuauacauaaaauua

SEQ ID NO: 37616 - RNA, 22 nt, Homo sapiens
cugcacuuuuaugaauaagcuc

SEQ ID NO: 37617 - RNA, 22 nt, Homo sapiens
gacucuugaacaacacagguuu

SEQ ID NO: 37618 - RNA, 21 nt, Homo sapiens
agagguugacuguauaauauu

SEQ ID NO: 37619 - RNA, 21 nt, Homo sapiens
cugaggagagaggaggugggg

SEQ ID NO: 37620 - RNA, 22 nt, Homo sapiens
ccaguagcacggcucaguccag

SEQ ID NO: 37621 - RNA, 21 nt, Homo sapiens
ucuccagaucagggcagucca

SEQ ID NO: 37622 - RNA, 22 nt, Homo sapiens
augcccuuucaucauugcacug

SEQ ID NO: 37623 - RNA, 22 nt, Homo sapiens
cacaaaccauuaugugcugcua

SEQ ID NO: 37624 - RNA, 22 nt, Homo sapiens
uguaaaccaugaugugcugcua

SEQ ID NO: 37625 - RNA, 22 nt, Homo sapiens
cgccaauauuuacgugcugcua

SEQ ID NO: 37626 - RNA, 23 nt, Homo sapiens
cuaccugcacuguaagcacuuug

SEQ ID NO: 37627 - RNA, 22 nt, Homo sapiens
ucaggaacugccuuucucucca

SEQ ID NO: 37628 - RNA, 23 nt, Homo sapiens
cccaacagacauggcgguacuca

SEQ ID NO: 37629 - RNA, 21 nt, Homo sapiens
gccaauauuucugugcugcua

SEQ ID NO: 37630 - RNA, 23 nt, Homo sapiens
gaaacccagcagacaauguagcu

SEQ ID NO: 37631 - RNA, 21 nt, Homo sapiens
ccuucugacuccaaguccagu

SEQ ID NO: 37632 - RNA, 22 nt, Homo sapiens
gccuucugacccuaaguccagu

SEQ ID NO: 37633 - RNA, 22 nt, Homo sapiens
uucaaaacaugaauugcugcug

SEQ ID NO: 37634 - RNA, 21 nt, Homo sapiens
guguauaugcccauggacugc

SEQ ID NO: 37635 - RNA, 21 nt, Homo sapiens
acaaaccacagugugcugcug

SEQ ID NO: 37636 - RNA, 21 nt, Homo sapiens
uagcacccagauagcaaggau

SEQ ID NO: 37637 - RNA, 24 nt, Homo sapiens
acugggcacaaacauguccagguc

SEQ ID NO: 37638 - RNA, 21 nt, Homo sapiens
gcugaggucugggccaggucu

SEQ ID NO: 37639 - RNA, 22 nt, Homo sapiens
agcucagaacccagaggucuca

SEQ ID NO: 37640 - RNA, 20 nt, Homo sapiens
cccugcgccaucuccucuac

SEQ ID NO: 37641 - RNA, 20 nt, Homo sapiens
uacugcuuccacagcucccc

SEQ ID NO: 37642 - RNA, 21 nt, Homo sapiens
ggggagcgggggcccugccuu

SEQ ID NO: 37643 - RNA, 18 nt, Homo sapiens
aucacauucaccucccug

SEQ ID NO: 37644 - RNA, 21 nt, Homo sapiens
cggggugcacgggcggagggc

SEQ ID NO: 37645 - RNA, 23 nt, Homo sapiens
gggagugaagacacggagccaga

SEQ ID NO: 37646 - RNA, 21 nt, Homo sapiens
gaccaaucgccguccccgccg

SEQ ID NO: 37647 - RNA, 22 nt, Homo sapiens
aggcauaggaugacaaagggaa

SEQ ID NO: 37648 - RNA, 22 nt, Homo sapiens
aggcgaaggaugacaaagggaa

SEQ ID NO: 37649 - RNA, 22 nt, Homo sapiens
ucagaccgagacaagugcaaug

SEQ ID NO: 37650 - RNA, 21 nt, Homo sapiens
gcagaacuuagccacugugaa

SEQ ID NO: 37651 - RNA, 21 nt, Homo sapiens
cacucugaagggaagcgcuuu

SEQ ID NO: 37652 - RNA, 25 nt, Homo sapiens
accaacggaccuacuucccuccgcc

SEQ ID NO: 37653 - RNA, 22 nt, Homo sapiens
gcggucccgcggcgccccgccu

SEQ ID NO: 37654 - RNA, 24 nt, Homo sapiens
cacccccagagccucagcucccca

SEQ ID NO: 37655 - RNA, 21 nt, Homo sapiens
cggcucggguggcggcgacgg

SEQ ID NO: 37656 - RNA, 22 nt, Homo sapiens
cuggagagacaaggggaagagg

SEQ ID NO: 37657 - RNA, 22 nt, Homo sapiens
uagcagaagcauuuccgcacac

SEQ ID NO: 37658 - RNA, 22 nt, Homo sapiens
cagaagugggccgggcacaggg

SEQ ID NO: 37659 - RNA, 23 nt, Homo sapiens
acauuuuucguuauugcucuuga

SEQ ID NO: 37660 - RNA, 25 nt, Homo sapiens
aggccgccacccgcccgcgaucccu

SEQ ID NO: 37661 - RNA, 25 nt, Homo sapiens
accaacggaccuacuucccuccgcc

SEQ ID NO: 37662 - RNA, 18 nt, Homo sapiens
gaaaugagggccagcuga

SEQ ID NO: 37663 - RNA, 21 nt, Homo sapiens
cugaggagagaggaggugggg

SEQ ID NO: 37664 - RNA, 19 nt, Homo sapiens
ccaccucccgaguccucac

SEQ ID NO: 37665 - RNA, 18 nt, Homo sapiens
ugguggcagaggugggau

SEQ ID NO: 37666 - RNA, 21 nt, Homo sapiens
gaccaaucgccguccccgccg

SEQ ID NO: 37667 - RNA, 20 nt, Homo sapiens
cccgccgcgucgcccugggg

SEQ ID NO: 37668 - RNA, 22 nt, Homo sapiens
uccacauggaguugcuguuaca

SEQ ID NO: 37669 - RNA, 22 nt, Homo sapiens
ucaacaucagucugauaagcua

SEQ ID NO: 37670 - RNA, 21 nt, Homo sapiens
acaggauugagggggggcccu

SEQ ID NO: 37671 - RNA, 22 nt, Homo sapiens
acaaccagcuaagacacugcca

SEQ ID NO: 37672 - RNA, 22 nt, Homo sapiens
auggcaguggaguuagugauug

SEQ ID NO: 37673 - RNA, 23 nt, Homo sapiens
gcaaucagcuaacuacacugccu

SEQ ID NO: 37674 - RNA, 22 nt, Homo sapiens
accagcuaacaauacacugcca

SEQ ID NO: 37675 - RNA, 22 nt, Homo sapiens
gccagcuaacaauacacugccu

SEQ ID NO: 37676 - RNA, 22 nt, Homo sapiens
gcggucccgcggcgccccgccu

SEQ ID NO: 37677 - RNA, 22 nt, Homo sapiens
ugcuguuagcccuagccccgca

SEQ ID NO: 37678 - RNA, 20 nt, Homo sapiens
uacugcuuccacagcucccc

SEQ ID NO: 37679 - RNA, 21 nt, Homo sapiens
cucccccacugcagcuggcac

SEQ ID NO: 37680 - RNA, 20 nt, Homo sapiens
uccgccugucugaacaguga

SEQ ID NO: 37681 - RNA, 24 nt, Homo sapiens
acugcaggcuccagcuuccaggcu

SEQ ID NO: 37682 - RNA, 24 nt, Homo sapiens
acugcuggucuucagucagggcca

SEQ ID NO: 37683 - RNA, 22 nt, Homo sapiens
augcccuuuuaacauugcacug

SEQ ID NO: 37684 - RNA, 22 nt, Homo sapiens
augcccuuucaucauugcacug

SEQ ID NO: 37685 - RNA, 22 nt, Homo sapiens
ccagaacugaguccacagggca

SEQ ID NO: 37686 - RNA, 22 nt, Homo sapiens
cagaagugggccgggcacaggg

SEQ ID NO: 37687 - RNA, 22 nt, Homo sapiens
agucuucacaacagcccugugu

SEQ ID NO: 37688 - RNA, 23 nt, Homo sapiens
gcuuugacaauacuauugcacug

SEQ ID NO: 37689 - RNA, 23 nt, Homo sapiens
gcuuugacaauaucauugcacug

SEQ ID NO: 37690 - RNA, 22 nt, Homo sapiens
acggaagggcagagagggccag

SEQ ID NO: 37691 - RNA, 22 nt, Homo sapiens
caacaaaaucacugaugcugga

SEQ ID NO: 37692 - RNA, 20 nt, Homo sapiens
uaugaacaauuucuaggaau

SEQ ID NO: 37693 - RNA, 22 nt, Homo sapiens
ucaguuuccucugcaaacaguu

SEQ ID NO: 37694 - RNA, 23 nt, Homo sapiens
acccuauaagcaauauugcacua

SEQ ID NO: 37695 - RNA, 22 nt, Homo sapiens
gaauucaucacggccagccucu

SEQ ID NO: 37696 - RNA, 20 nt, Homo sapiens
acaaugagaacccauggucu

SEQ ID NO: 37697 - RNA, 21 nt, Homo sapiens
cccgaggagccgggcaggcuu

SEQ ID NO: 37698 - RNA, 23 nt, Homo sapiens
accacaggagucugagcauuuga

SEQ ID NO: 37699 - RNA, 20 nt, Homo sapiens
cucaaagcaaacccugcaga

SEQ ID NO: 37700 - RNA, 21 nt, Homo sapiens
cugaggagagaggaggugggg

SEQ ID NO: 37701 - RNA, 20 nt, Homo sapiens
gcagcuguccgcccagacac

SEQ ID NO: 37702 - RNA, 24 nt, Homo sapiens
acugcaggcuccagcuuccaggcu

SEQ ID NO: 37703 - RNA, 23 nt, Homo sapiens
aaucuacuuucuuugcucauccu

SEQ ID NO: 37704 - RNA, 22 nt, Homo sapiens
aaccacuuucuuugcucauccg

SEQ ID NO: 37705 - RNA, 22 nt, Homo sapiens
ccaguagcacggcucaguccag

SEQ ID NO: 37706 - RNA, 21 nt, Homo sapiens
ucuccagaucagggcagucca

SEQ ID NO: 37707 - RNA, 22 nt, Homo sapiens
cacaaaccauuaugugcugcua

SEQ ID NO: 37708 - RNA, 22 nt, Homo sapiens
uguaaaccaugaugugcugcua

SEQ ID NO: 37709 - RNA, 22 nt, Homo sapiens
cgccaauauuuacgugcugcua

SEQ ID NO: 37710 - RNA, 23 nt, Homo sapiens
cuaccugcacuguaagcacuuug

SEQ ID NO: 37711 - RNA, 18 nt, Homo sapiens
auucaaucuacugccuca

SEQ ID NO: 37712 - RNA, 21 nt, Homo sapiens
gccaauauuucugugcugcua

SEQ ID NO: 37713 - RNA, 21 nt, Homo sapiens
ccuucugacuccaaguccagu

SEQ ID NO: 37714 - RNA, 22 nt, Homo sapiens
gccuucugacccuaaguccagu

SEQ ID NO: 37715 - RNA, 22 nt, Homo sapiens
uucaaaacaugaauugcugcug

SEQ ID NO: 37716 - RNA, 21 nt, Homo sapiens
guguauaugcccauggacugc

SEQ ID NO: 37717 - RNA, 22 nt, Homo sapiens
gaauucaucacggccagccucu

SEQ ID NO: 37718 - RNA, 21 nt, Homo sapiens
acaaaccacagugugcugcug

SEQ ID NO: 37719 - RNA, 21 nt, Homo sapiens
uagcacccagauagcaaggau

SEQ ID NO: 37720 - RNA, 22 nt, Homo sapiens
caugauugccacgucugcagua

SEQ ID NO: 37721 - RNA, 21 nt, Homo sapiens
ugauugccacugucugcagua

SEQ ID NO: 37722 - RNA, 22 nt, Homo sapiens
acacucuaaaaggaugcacuuu

SEQ ID NO: 37723 - RNA, 22 nt, Homo sapiens
aaccucuaaaaggaugcacuuu

SEQ ID NO: 37724 - RNA, 22 nt, Homo sapiens
auccucuaaaaagaugcacuuu

SEQ ID NO: 37725 - RNA, 22 nt, Homo sapiens
caagacacauuuggagagggac

SEQ ID NO: 37726 - RNA, 22 nt, Homo sapiens
aaggugauggucagcagacaua

SEQ ID NO: 37727 - RNA, 20 nt, Homo sapiens
cccugcgccaucuccucuac

SEQ ID NO: 37728 - RNA, 21 nt, Homo sapiens
ggggagcgggggcccugccuu

SEQ ID NO: 37729 - RNA, 21 nt, Homo sapiens
cugaggagagaggaggugggg

SEQ ID NO: 37730 - RNA, 21 nt, Homo sapiens
gaccaaucgccguccccgccg

SEQ ID NO: 37731 - RNA, 23 nt, Homo sapiens
cccaacagacauggcgguacuca

SEQ ID NO: 37732 - RNA, 22 nt, Homo sapiens
uggcagcagcggagggggcaga

SEQ ID NO: 37733 - RNA, 20 nt, Homo sapiens
ccagcagcaccuggggcagu

SEQ ID NO: 37734 - RNA, 21 nt, Homo sapiens
auccuguacugagcugccccg

SEQ ID NO: 37735 - RNA, 22 nt, Homo sapiens
aguccagauucugugcccacca

SEQ ID NO: 37736 - RNA, 19 nt, Homo sapiens
guugggaucacaggcgccc

SEQ ID NO: 37737 - RNA, 22 nt, Homo sapiens
gcacauguucugcggcccacca

SEQ ID NO: 37738 - RNA, 22 nt, Homo sapiens
gcggucccgcggcgccccgccu

SEQ ID NO: 37739 - RNA, 21 nt, Homo sapiens
caucaccuuccuucuccucca

SEQ ID NO: 37740 - RNA, 21 nt, Homo sapiens
aagggucaguaagcacccgcg

SEQ ID NO: 37741 - RNA, 20 nt, Homo sapiens
uacugcuuccacagcucccc

SEQ ID NO: 37742 - RNA, 17 nt, Homo sapiens
caccugaauuacuugaa

SEQ ID NO: 37743 - RNA, 22 nt, Homo sapiens
agagcaagaccccgucucuaaa

SEQ ID NO: 37744 - RNA, 24 nt, Homo sapiens
gaaagugcauagaauucugucugg

SEQ ID NO: 37745 - RNA, 22 nt, Homo sapiens
uguaaaccaugaugugcugcua

SEQ ID NO: 37746 - RNA, 22 nt, Homo sapiens
agccuauccuggauuacuugaa

SEQ ID NO: 37747 - RNA, 21 nt, Homo sapiens
accuauccugaauuacuugaa

SEQ ID NO: 37748 - RNA, 21 nt, Homo sapiens
caugcacaugcacacauacau

SEQ ID NO: 37749 - RNA, 22 nt, Homo sapiens
cacuuagcagguuguauuauau

SEQ ID NO: 37750 - RNA, 22 nt, Homo sapiens
guacaaaaguaauuacaguuuu

SEQ ID NO: 37751 - RNA, 23 nt, Homo sapiens
guucuguccuggaagaacauacu

SEQ ID NO: 37752 - RNA, 22 nt, Homo sapiens
aaggugauggucagcagacaua

SEQ ID NO: 37753 - RNA, 23 nt, Homo sapiens
agcaaaaaugugcuagugccaaa

SEQ ID NO: 37754 - RNA, 22 nt, Homo sapiens
ucaggaacugccuuucucucca

SEQ ID NO: 37755 - RNA, 22 nt, Homo sapiens
agcugaguguaggauguuuaca

SEQ ID NO: 37756 - RNA, 22 nt, Homo sapiens
ucaguggcucagguucguugca

SEQ ID NO: 37757 - RNA, 22 nt, Homo sapiens
ggaggccgggacgagugcaaua

SEQ ID NO: 37758 - RNA, 21 nt, Homo sapiens
cugaggagagaggaggugggg

SEQ ID NO: 37759 - RNA, 18 nt, Homo sapiens
ugguggcagaggugggau

SEQ ID NO: 37760 - RNA, 22 nt, Homo sapiens
ucaggaacugccuuucucucca

SEQ ID NO: 37761 - RNA, 22 nt, Homo sapiens
cggugagcacccggccccugcg

SEQ ID NO: 37762 - RNA, 22 nt, Homo sapiens
ucaucucgcccgcaaagaccca

SEQ ID NO: 37763 - RNA, 21 nt, Homo sapiens
aagugucagacacgguggugg

SEQ ID NO: 37764 - RNA, 21 nt, Homo sapiens
aucugcacugucagcacuuua

SEQ ID NO: 37765 - RNA, 23 nt, Homo sapiens
gcuuugacaauaucauugcacug

SEQ ID NO: 37766 - RNA, 21 nt, Homo sapiens
ucaaucacagauagcaccccu

SEQ ID NO: 37767 - RNA, 22 nt, Homo sapiens
uacagauggauaccgugcaauu

SEQ ID NO: 37768 - RNA, 22 nt, Homo sapiens
acacucuaaagggaugcacgau

SEQ ID NO: 37769 - RNA, 22 nt, Homo sapiens
acacucuaaaaggaugcacgau

SEQ ID NO: 37770 - RNA, 22 nt, Homo sapiens
uuucaguuaucaaucugucaca

SEQ ID NO: 37771 - RNA, 25 nt, Homo sapiens
acggagcugucccaacaccaccccu

SEQ ID NO: 37772 - RNA, 18 nt, Homo sapiens
gaaaugagggccagcuga

SEQ ID NO: 37773 - RNA, 22 nt, Homo sapiens
cgcauuauuacucacgguacga

SEQ ID NO: 37774 - RNA, 18 nt, Homo sapiens
uggcgccugaacagggac

SEQ ID NO: 37775 - RNA, 24 nt, Homo sapiens
acugcuggucuucagucagggcca

SEQ ID NO: 37776 - RNA, 24 nt, Homo sapiens
agugugaguucuaccauugccaaa

SEQ ID NO: 37777 - RNA, 21 nt, Homo sapiens
ggcugucaauucauaggucag

SEQ ID NO: 37778 - RNA, 21 nt, Homo sapiens
aucugcacugucagcacuuua

SEQ ID NO: 37779 - RNA, 23 nt, Homo sapiens
gcuuugacaauaucauugcacug

SEQ ID NO: 37780 - RNA, 22 nt, Homo sapiens
auaaggauuuuuaggggcauua

SEQ ID NO: 37781 - RNA, 22 nt, Homo sapiens
cucagagcagacgugguucuca

SEQ ID NO: 37782 - RNA, 23 nt, Homo sapiens
gagcaaggcucuugucuguaagu

SEQ ID NO: 37783 - RNA, 23 nt, Homo sapiens
gggccgcagcugucgcccguguc

SEQ ID NO: 37784 - RNA, 22 nt, Homo sapiens
cucauccgauguacaauaauuu

SEQ ID NO: 37785 - RNA, 21 nt, Homo sapiens
ccccucccagccucccugcca

SEQ ID NO: 37786 - RNA, 23 nt, Homo sapiens
cuaucugcacuagaugcaccuua

SEQ ID NO: 37787 - RNA, 22 nt, Homo sapiens
cggugagcacccggccccugcg

SEQ ID NO: 37788 - RNA, 22 nt, Homo sapiens
ucaucucgcccgcaaagaccca

SEQ ID NO: 37789 - RNA, 23 nt, Homo sapiens
uccaucauuacccggcaguauua

SEQ ID NO: 37790 - RNA, 22 nt, Homo sapiens
cuguuccugcugaacugagcca

SEQ ID NO: 37791 - RNA, 21 nt, Homo sapiens
aucugcacugucagcacuuua

SEQ ID NO: 37792 - RNA, 23 nt, Homo sapiens
gcuuugacaauaucauugcacug

SEQ ID NO: 37793 - RNA, 18 nt, Homo sapiens
acccucugaaaggaagca

SEQ ID NO: 37794 - RNA, 22 nt, Homo sapiens
aaagugcuucuuaccuccagau

SEQ ID NO: 37795 - RNA, 23 nt, Homo sapiens
gggcucuuacucccucaggcacu

SEQ ID NO: 37796 - RNA, 22 nt, Homo sapiens
ucggucccucgggccagggcag

SEQ ID NO: 37797 - RNA, 23 nt, Homo sapiens
gggagugaagacacggagccaga

SEQ ID NO: 37798 - RNA, 23 nt, Homo sapiens
aggaacagcagcagcccgggccg

SEQ ID NO: 37799 - RNA, 21 nt, Homo sapiens
gaccaaucgccguccccgccg

SEQ ID NO: 37800 - RNA, 22 nt, Homo sapiens
cggugagcacccggccccugcg

SEQ ID NO: 37801 - RNA, 23 nt, Homo sapiens
cccaacagacauggcgguacuca

SEQ ID NO: 37802 - RNA, 22 nt, Homo sapiens
aggaaaccagcaaguguugacg

SEQ ID NO: 37803 - RNA, 22 nt, Homo sapiens
aacccucuaaaaggaagcacuu

SEQ ID NO: 37804 - RNA, 22 nt, Homo sapiens
gcggucccgcggcgccccgccu

SEQ ID NO: 37805 - RNA, 17 nt, Homo sapiens
gggagaggaggaggcga

SEQ ID NO: 37806 - RNA, 24 nt, Homo sapiens
acugcuggucuucagucagggcca

SEQ ID NO: 37807 - RNA, 23 nt, Homo sapiens
cggcucugucgucgaggcgcuca

SEQ ID NO: 37808 - RNA, 22 nt, Homo sapiens
ugcuguuagcccuagccccgca

SEQ ID NO: 37809 - RNA, 21 nt, Homo sapiens
gaccaaucgccguccccgccg

SEQ ID NO: 37810 - RNA, 22 nt, Homo sapiens
gcggucccgcggcgccccgccu

SEQ ID NO: 37811 - RNA, 18 nt, Homo sapiens
gaaaugagggccagcuga

SEQ ID NO: 37812 - RNA, 21 nt, Homo sapiens
ccccucccagccucccugcca

SEQ ID NO: 37813 - RNA, 24 nt, Homo sapiens
acugcuggucuucagucagggcca

SEQ ID NO: 37814 - RNA, 18 nt, Homo sapiens
aucacauucaccucccug

SEQ ID NO: 37815 - RNA, 23 nt, Homo sapiens
gggagugaagacacggagccaga

SEQ ID NO: 37816 - RNA, 21 nt, Homo sapiens
aggcggcaggcacaggacugg

SEQ ID NO: 37817 - RNA, 22 nt, Homo sapiens
ggagagccuccacccaacccuc

SEQ ID NO: 37818 - RNA, 23 nt, Homo sapiens
ccacccaaugaccuacuccaaga

SEQ ID NO: 37819 - RNA, 19 nt, Homo sapiens
uagcauacagauacgccca

SEQ ID NO: 37820 - RNA, 22 nt, Homo sapiens
gauccgagcaccggggaccccc

SEQ ID NO: 37821 - RNA, 22 nt, Homo sapiens
caagacacauuuggagagggac

SEQ ID NO: 37822 - RNA, 22 nt, Homo sapiens
caaacaccauugucacacucca

SEQ ID NO: 37823 - RNA, 21 nt, Homo sapiens
caucaccuuccuucuccucca

SEQ ID NO: 37824 - RNA, 22 nt, Homo sapiens
uauccacuacaccccgcugccu

SEQ ID NO: 37825 - RNA, 22 nt, Homo sapiens
uccggggacgaacgggacgggu

SEQ ID NO: 37826 - RNA, 21 nt, Homo sapiens
ucuccagaucagggcagucca

SEQ ID NO: 37827 - RNA, 23 nt, Homo sapiens
aggaacagcagcagcccgggccg

SEQ ID NO: 37828 - RNA, 22 nt, Homo sapiens
cggugagcacccggccccugcg

SEQ ID NO: 37829 - RNA, 23 nt, Homo sapiens
aaagucucgcucucugccccuca

SEQ ID NO: 37830 - RNA, 21 nt, Homo sapiens
auccuguacugagcugccccg

SEQ ID NO: 37831 - RNA, 24 nt, Homo sapiens
acgcgcaggccagagacccaggca

SEQ ID NO: 37832 - RNA, 20 nt, Homo sapiens
uccccacagacccagagccg

SEQ ID NO: 37833 - RNA, 21 nt, Homo sapiens
auaauggagaccaggccacga

SEQ ID NO: 37834 - RNA, 22 nt, Homo sapiens
caaacaccauugucacacucca

SEQ ID NO: 37835 - RNA, 22 nt, Homo sapiens
ugaagaagggggggaagggcgu

SEQ ID NO: 37836 - RNA, 21 nt, Homo sapiens
gaccaaucgccguccccgccg

SEQ ID NO: 37837 - RNA, 22 nt, Homo sapiens
cacucagcggccguuuccccaa

SEQ ID NO: 37838 - RNA, 23 nt, Homo sapiens
cgugagcuccuggaggacaggga

SEQ ID NO: 37839 - RNA, 19 nt, Homo sapiens
agaaaccccagcagagaca

SEQ ID NO: 37840 - RNA, 25 nt, Homo sapiens
acggagcugucccaacaccaccccu

SEQ ID NO: 37841 - RNA, 21 nt, Homo sapiens
agguaagcgcuguugcuagcc

SEQ ID NO: 37842 - RNA, 22 nt, Homo sapiens
gcggucccgcggcgccccgccu

SEQ ID NO: 37843 - RNA, 22 nt, Homo sapiens
ugcuguuagcccuagccccgca

SEQ ID NO: 37844 - RNA, 20 nt, Homo sapiens
uacugcuuccacagcucccc

SEQ ID NO: 37845 - RNA, 22 nt, Homo sapiens
cugggggcggcacaggggcuca

SEQ ID NO: 37846 - RNA, 20 nt, Homo sapiens
gcagcuguccgcccagacac

SEQ ID NO: 37847 - RNA, 21 nt, Homo sapiens
agggcucaucuugguccugca

SEQ ID NO: 37848 - RNA, 21 nt, Homo sapiens
uuuagcauaaguaugucccaa

SEQ ID NO: 37849 - RNA, 21 nt, Homo sapiens
ccgugguucuacccuguggua

SEQ ID NO: 37850 - RNA, 21 nt, Homo sapiens
gaccaaucgccguccccgccg

SEQ ID NO: 37851 - RNA, 21 nt, Homo sapiens
uucuaggauaggcccaggggc

SEQ ID NO: 37852 - RNA, 21 nt, Homo sapiens
ugcaugacggccugcaagaca

SEQ ID NO: 37853 - RNA, 23 nt, Homo sapiens
aagaaucuugucccgcagguccu

SEQ ID NO: 37854 - RNA, 21 nt, Homo sapiens
ugacugcagagcaaaagacac

SEQ ID NO: 37855 - RNA, 22 nt, Homo sapiens
aagagggagacccaggcucgga

SEQ ID NO: 37856 - RNA, 19 nt, Homo sapiens
aagacauuuucagacagcu

SEQ ID NO: 37857 - RNA, 21 nt, Homo sapiens
cacaacccuaguggcgccauu

SEQ ID NO: 37858 - RNA, 22 nt, Homo sapiens
aaggugauggucagcagacaua

SEQ ID NO: 37859 - RNA, 22 nt, Homo sapiens
gcggucccgcggcgccccgccu

SEQ ID NO: 37860 - RNA, 22 nt, Homo sapiens
ccucaggcacggccgggccacc

SEQ ID NO: 37861 - RNA, 21 nt, Homo sapiens
cacaaccucaguguuuccagg

SEQ ID NO: 37862 - RNA, 22 nt, Homo sapiens
gaggcucagaauggcucaggag

SEQ ID NO: 37863 - RNA, 25 nt, Homo sapiens
aagaaagagucuugcuuugucgccc

SEQ ID NO: 37864 - RNA, 23 nt, Homo sapiens
ucacauaggaauaaaaagccaua

SEQ ID NO: 37865 - RNA, 23 nt, Homo sapiens
ucacauaggaaugaaaagccaua

SEQ ID NO: 37866 - RNA, 20 nt, Homo sapiens
acagcaaggagggcaggagg

SEQ ID NO: 37867 - RNA, 21 nt, Homo sapiens
aucugcacugucagcacuuua

SEQ ID NO: 37868 - RNA, 23 nt, Homo sapiens
gcuuugacaauaucauugcacug

SEQ ID NO: 37869 - RNA, 22 nt, Homo sapiens
aaucagucucauugcuuuauaa

SEQ ID NO: 37870 - RNA, 22 nt, Homo sapiens
gaauucaucacggccagccucu

SEQ ID NO: 37871 - RNA, 22 nt, Homo sapiens
cagcauggaguccuccagguug

SEQ ID NO: 37872 - RNA, 23 nt, Homo sapiens
gaaaaacgcccccuggcuugaaa

SEQ ID NO: 37873 - RNA, 22 nt, Homo sapiens
gugauugccacucuccugagua

SEQ ID NO: 37874 - RNA, 24 nt, Homo sapiens
acgcgcaggccagagacccaggca

SEQ ID NO: 37875 - RNA, 22 nt, Homo sapiens
gcugaggcuguggggcuggagu

SEQ ID NO: 37876 - RNA, 22 nt, Homo sapiens
caaacaccauugucacacucca

SEQ ID NO: 37877 - RNA, 22 nt, Homo sapiens
aacaacacuugaccacauccug

SEQ ID NO: 37878 - RNA, 24 nt, Homo sapiens
agugugaguucuaccauugccaaa

SEQ ID NO: 37879 - RNA, 22 nt, Homo sapiens
ccggcugcaacacaagacacga

SEQ ID NO: 37880 - RNA, 23 nt, Homo sapiens
ucaguuuugcauagauuugcaca

SEQ ID NO: 37881 - RNA, 22 nt, Homo sapiens
cacucagcaccaggauauuguu

SEQ ID NO: 37882 - RNA, 22 nt, Homo sapiens
aacuaugcaaccuacuaccucu

SEQ ID NO: 37883 - RNA, 21 nt, Homo sapiens
uucuaggauaggcccaggggc

SEQ ID NO: 37884 - RNA, 22 nt, Homo sapiens
gagguuucccguguauguuuca

SEQ ID NO: 37885 - RNA, 22 nt, Homo sapiens
gcacacaauaaauguuugcuga

SEQ ID NO: 37886 - RNA, 23 nt, Homo sapiens
aaucgcgguuuauaccaaaugaa

SEQ ID NO: 37887 - RNA, 21 nt, Homo sapiens
gaaggaagugagugcagccac

SEQ ID NO: 37888 - RNA, 20 nt, Homo sapiens
uacugcuuccacagcucccc

SEQ ID NO: 37889 - RNA, 21 nt, Homo sapiens
ucacccagaucugcggccuaa

SEQ ID NO: 37890 - RNA, 21 nt, Homo sapiens
gaccaaucgccguccccgccg

SEQ ID NO: 37891 - RNA, 23 nt, Homo sapiens
aaagucucgcucucugccccuca

SEQ ID NO: 37892 - RNA, 23 nt, Homo sapiens
ccaccuggcaagaacaggcguuc

SEQ ID NO: 37893 - RNA, 22 nt, Homo sapiens
gcggucccgcggcgccccgccu

SEQ ID NO: 37894 - RNA, 22 nt, Homo sapiens
ccucaggcacggccgggccacc

SEQ ID NO: 37895 - RNA, 22 nt, Homo sapiens
ugcuguuagcccuagccccgca

SEQ ID NO: 37896 - RNA, 21 nt, Homo sapiens
auaauggagaccaggccacga

SEQ ID NO: 37897 - RNA, 17 nt, Homo sapiens
gggagaggaggaggcga

SEQ ID NO: 37898 - RNA, 19 nt, Homo sapiens
cagcaucagcagcaucauc

SEQ ID NO: 37899 - RNA, 21 nt, Homo sapiens
gaccaaucgccguccccgccg

SEQ ID NO: 37900 - RNA, 21 nt, Homo sapiens
gaccaaucgccguccccgccg

SEQ ID NO: 37901 - RNA, 23 nt, Homo sapiens
aaagucucgcucucugccccuca

SEQ ID NO: 37902 - RNA, 23 nt, Homo sapiens
ccacccaaugaccuacuccaaga

SEQ ID NO: 37903 - RNA, 19 nt, Homo sapiens
guccugaauuccgcagccu

SEQ ID NO: 37904 - RNA, 22 nt, Homo sapiens
gauccgagcaccggggaccccc

SEQ ID NO: 37905 - RNA, 25 nt, Homo sapiens
aggccgccacccgcccgcgaucccu

SEQ ID NO: 37906 - RNA, 22 nt, Homo sapiens
gcggucccgcggcgccccgccu

SEQ ID NO: 37907 - RNA, 22 nt, Homo sapiens
gcggucccgcggcgccccgccu

SEQ ID NO: 37908 - RNA, 22 nt, Homo sapiens
ugcuguuagcccuagccccgca

SEQ ID NO: 37909 - RNA, 22 nt, Homo sapiens
cgcauuauuacucacgguacga

SEQ ID NO: 37910 - RNA, 20 nt, Homo sapiens
uacugcuuccacagcucccc

SEQ ID NO: 37911 - RNA, 23 nt, Homo sapiens
agggauuccugggaaaacuggac

SEQ ID NO: 37912 - RNA, 21 nt, Homo sapiens
uagaaaggcuaggaccaaacc

SEQ ID NO: 37913 - RNA, 23 nt, Homo sapiens
ucaguuuugcauagauuugcaca

SEQ ID NO: 37914 - RNA, 23 nt, Homo sapiens
ucaguuuugcauagauuugcaca

SEQ ID NO: 37915 - RNA, 23 nt, Homo sapiens
ucaguuuugcauggauuugcaca

SEQ ID NO: 37916 - RNA, 22 nt, Homo sapiens
cacucagcaccaggauauuguu

SEQ ID NO: 37917 - RNA, 22 nt, Homo sapiens
aacuaugcaaccuacuaccucu

SEQ ID NO: 37918 - RNA, 21 nt, Homo sapiens
uucacuccaaaaggugcaaaa

SEQ ID NO: 37919 - RNA, 23 nt, Homo sapiens
agacaaggcccacccgugcaaac

SEQ ID NO: 37920 - RNA, 20 nt, Homo sapiens
gcaaaugguacagcuacuuu

SEQ ID NO: 37921 - RNA, 21 nt, Homo sapiens
cacaaccucaguguuuccagg

SEQ ID NO: 37922 - RNA, 20 nt, Homo sapiens
ugucuccacagggcucuuua

SEQ ID NO: 37923 - RNA, 22 nt, Homo sapiens
agaaagcgcuuuccuuuguaga

SEQ ID NO: 37924 - RNA, 22 nt, Homo sapiens
acaaaguucuguagugcacuga

SEQ ID NO: 37925 - RNA, 21 nt, Homo sapiens
agaaguagaccauguguccua

SEQ ID NO: 37926 - RNA, 18 nt, Homo sapiens
gaaaugagggccagcuga

SEQ ID NO: 37927 - RNA, 18 nt, Homo sapiens
cagcagccuccuucucaa

SEQ ID NO: 37928 - RNA, 24 nt, Homo sapiens
gaaagugcauagaauucugucugg

SEQ ID NO: 37929 - RNA, 21 nt, Homo sapiens
caugcacaugcacacauacau

SEQ ID NO: 37930 - RNA, 21 nt, Homo sapiens
cacucugaagggaagcgcuuu

SEQ ID NO: 37931 - RNA, 22 nt, Homo sapiens
acaucaucgcauauugacacaa

SEQ ID NO: 37932 - RNA, 22 nt, Homo sapiens
acaguggucaucgagugacaca

SEQ ID NO: 37933 - RNA, 21 nt, Homo sapiens
gcuccaaccucagcagacugu

SEQ ID NO: 37934 - RNA, 22 nt, Homo sapiens
gguuaguggaccaggucacaaa

SEQ ID NO: 37935 - RNA, 22 nt, Homo sapiens
gcugaggcuguggggcuggagu

SEQ ID NO: 37936 - RNA, 22 nt, Homo sapiens
gaggcucagaauggcucaggag

SEQ ID NO: 37937 - RNA, 23 nt, Homo sapiens
gggagugaagacacggagccaga

SEQ ID NO: 37938 - RNA, 23 nt, Homo sapiens
gaacagguagucugaacacuggg

SEQ ID NO: 37939 - RNA, 23 nt, Homo sapiens
gaacagauagucuaaacacuggg

SEQ ID NO: 37940 - RNA, 19 nt, Homo sapiens
gcuccuguccaacuggcuc

SEQ ID NO: 37941 - RNA, 20 nt, Homo sapiens
aggggccucagccuccuggu

SEQ ID NO: 37942 - RNA, 22 nt, Homo sapiens
ucaguggcucagguucguugca

SEQ ID NO: 37943 - RNA, 22 nt, Homo sapiens
ucuacccagaaaggagccagug

SEQ ID NO: 37944 - RNA, 22 nt, Homo sapiens
cccaacaacaggaaacuaccua

SEQ ID NO: 37945 - RNA, 21 nt, Homo sapiens
acaggauugagggggggcccu

SEQ ID NO: 37946 - RNA, 19 nt, Homo sapiens
guccugaauuccgcagccu

SEQ ID NO: 37947 - RNA, 25 nt, Homo sapiens
accaacggaccuacuucccuccgcc

SEQ ID NO: 37948 - RNA, 22 nt, Homo sapiens
gcggucccgcggcgccccgccu

SEQ ID NO: 37949 - RNA, 23 nt, Homo sapiens
ccgcuugagcuaacuccgacccg

SEQ ID NO: 37950 - RNA, 22 nt, Homo sapiens
ggcagagagucagagcgcggau

SEQ ID NO: 37951 - RNA, 22 nt, Homo sapiens
cuagggaacacagggcugguga

SEQ ID NO: 37952 - RNA, 23 nt, Homo sapiens
cggccugauucacaacaccagcu

SEQ ID NO: 37953 - RNA, 23 nt, Homo sapiens
aggaacagcagcagcccgggccg

SEQ ID NO: 37954 - RNA, 21 nt, Homo sapiens
gggcaucugggacgcgcagga

SEQ ID NO: 37955 - RNA, 22 nt, Homo sapiens
ccucuaguaaauaugucagcau

SEQ ID NO: 37956 - RNA, 22 nt, Homo sapiens
gggagaggucucccugcgcaca

SEQ ID NO: 37957 - RNA, 22 nt, Homo sapiens
gggagaggucucccugcgcaca

SEQ ID NO: 37958 - RNA, 21 nt, Homo sapiens
cggcucggguggcggcgacgg

SEQ ID NO: 37959 - RNA, 20 nt, Homo sapiens
ggggggcgaggcagguguga

SEQ ID NO: 37960 - RNA, 22 nt, Homo sapiens
cuggagagacaaggggaagagg

SEQ ID NO: 37961 - RNA, 22 nt, Homo sapiens
cuggagagacaaggggaagagg

SEQ ID NO: 37962 - RNA, 21 nt, Homo sapiens
gaccaaucgccguccccgccg

SEQ ID NO: 37963 - RNA, 22 nt, Homo sapiens
ugacgaugacaacgaugacgua

SEQ ID NO: 37964 - RNA, 19 nt, Homo sapiens
gcucuaagaaagccacacu

SEQ ID NO: 37965 - RNA, 22 nt, Homo sapiens
gcggucccgcggcgccccgccu

SEQ ID NO: 37966 - RNA, 20 nt, Homo sapiens
uacugcuuccacagcucccc

SEQ ID NO: 37967 - RNA, 24 nt, Homo sapiens
cacccccagagccucagcucccca

SEQ ID NO: 37968 - RNA, 18 nt, Homo sapiens
gaaaugagggccagcuga

SEQ ID NO: 37969 - RNA, 22 nt, Homo sapiens
gcacaaaucuccagaccaccca

SEQ ID NO: 37970 - RNA, 22 nt, Homo sapiens
uggcagcagcggagggggcaga

SEQ ID NO: 37971 - RNA, 22 nt, Homo sapiens
gcgaacgcgccacggaccaccu

SEQ ID NO: 37972 - RNA, 20 nt, Homo sapiens
ccagcagcaccuggggcagu

SEQ ID NO: 37973 - RNA, 22 nt, Homo sapiens
acaaccagcuaagacacugcca

SEQ ID NO: 37974 - RNA, 23 nt, Homo sapiens
gcaaucagcuaacuacacugccu

SEQ ID NO: 37975 - RNA, 23 nt, Homo sapiens
aaaucagaaucacaccuggggga

SEQ ID NO: 37976 - RNA, 22 nt, Homo sapiens
accagcuaacaauacacugcca

SEQ ID NO: 37977 - RNA, 22 nt, Homo sapiens
gccagcuaacaauacacugccu

SEQ ID NO: 37978 - RNA, 21 nt, Homo sapiens
auccuguacugagcugccccg

SEQ ID NO: 37979 - RNA, 22 nt, Homo sapiens
gaccucagcuaugacagcacuu

SEQ ID NO: 37980 - RNA, 22 nt, Homo sapiens
gcaaaaguaauugcagugugug

SEQ ID NO: 37981 - RNA, 24 nt, Homo sapiens
acgcagagcccgaaagcccccagu

SEQ ID NO: 37982 - RNA, 23 nt, Homo sapiens
gucacaucccucccaagacccuc

SEQ ID NO: 37983 - RNA, 21 nt, Homo sapiens
cucccccacugcagcuggcac

SEQ ID NO: 37984 - RNA, 21 nt, Homo sapiens
ccccucccagccucccugcca

SEQ ID NO: 37985 - RNA, 21 nt, Homo sapiens
ccccucccagccucccugcca

SEQ ID NO: 37986 - RNA, 21 nt, Homo sapiens
cggggugcacgggcggagggc

SEQ ID NO: 37987 - RNA, 23 nt, Homo sapiens
cuaucugcacuagaugcaccuua

SEQ ID NO: 37988 - RNA, 22 nt, Homo sapiens
cggugagcacccggccccugcg

SEQ ID NO: 37989 - RNA, 22 nt, Homo sapiens
ucagaccgagacaagugcaaug

SEQ ID NO: 37990 - RNA, 23 nt, Homo sapiens
cggcucugucgucgaggcgcuca

SEQ ID NO: 37991 - RNA, 22 nt, Homo sapiens
ccucauggaaggguuccccacu

SEQ ID NO: 37992 - RNA, 25 nt, Homo sapiens
accaacggaccuacuucccuccgcc

SEQ ID NO: 37993 - RNA, 23 nt, Homo sapiens
ggaagccaucaagucgcugcagg

SEQ ID NO: 37994 - RNA, 21 nt, Homo sapiens
cugaggagagaggaggugggg

SEQ ID NO: 37995 - RNA, 24 nt, Homo sapiens
gaagucacucccaggcagcugcaa

SEQ ID NO: 37996 - RNA, 22 nt, Homo sapiens
acgguccuacacucaaggcaug

SEQ ID NO: 37997 - RNA, 19 nt, Homo sapiens
auuuugguacagcagcuca

SEQ ID NO: 37998 - RNA, 21 nt, Homo sapiens
cucacucagauggccaacuca

SEQ ID NO: 37999 - RNA, 23 nt, Homo sapiens
ggacauuguuucagugcccaagu

SEQ ID NO: 38000 - RNA, 20 nt, Homo sapiens
uacugcuuccacagcucccc

SEQ ID NO: 38001 - RNA, 24 nt, Homo sapiens
ugggagaaccucccugcuucugcu

SEQ ID NO: 38002 - RNA, 17 nt, Homo sapiens
ggguggcagcgguggga

SEQ ID NO: 38003 - RNA, 18 nt, Homo sapiens
aucacauucaccucccug

SEQ ID NO: 38004 - RNA, 21 nt, Homo sapiens
agagcucauccauaguuguca

SEQ ID NO: 38005 - RNA, 21 nt, Homo sapiens
ccuucugacuccaaguccagu

SEQ ID NO: 38006 - RNA, 22 nt, Homo sapiens
gaauucaucacggccagccucu

SEQ ID NO: 38007 - RNA, 21 nt, Homo sapiens
aaaacaaaaucucaccguuuu

SEQ ID NO: 38008 - RNA, 17 nt, Homo sapiens
uggaggccccagcgaga

SEQ ID NO: 38009 - RNA, 21 nt, Homo sapiens
caucaccuuccuucuccucca

SEQ ID NO: 38010 - RNA, 22 nt, Homo sapiens
cacaucucacuguagccucaaa

SEQ ID NO: 38011 - RNA, 22 nt, Homo sapiens
acugccugucugugccugcugu

SEQ ID NO: 38012 - RNA, 22 nt, Homo sapiens
gagcccuggacuaggagucagc

SEQ ID NO: 38013 - RNA, 22 nt, Homo sapiens
accagguuccaccccagcaggc

SEQ ID NO: 38014 - RNA, 23 nt, Homo sapiens
acaccccaaaaucgaagcacuuc

SEQ ID NO: 38015 - RNA, 21 nt, Homo sapiens
ugcaugacggccugcaagaca

SEQ ID NO: 38016 - RNA, 23 nt, Homo sapiens
caugagugacgcccucuggagua

SEQ ID NO: 38017 - RNA, 22 nt, Homo sapiens
gugauugccacucuccugagua

SEQ ID NO: 38018 - RNA, 22 nt, Homo sapiens
aaagugcuucuuaccuccagau

SEQ ID NO: 38019 - RNA, 23 nt, Homo sapiens
acacucuaaagagaagcgcuuug

SEQ ID NO: 38020 - RNA, 21 nt, Homo sapiens
agaaaguacuucccucuggag

SEQ ID NO: 38021 - RNA, 21 nt, Homo sapiens
agaaagugcaucccucuggag

SEQ ID NO: 38022 - RNA, 22 nt, Homo sapiens
aagagggagacccaggcucgga

SEQ ID NO: 38023 - RNA, 22 nt, Homo sapiens
cugcucaaacccuccaaugacu

SEQ ID NO: 38024 - RNA, 23 nt, Homo sapiens
agaaaccaugggguaugagcaga

SEQ ID NO: 38025 - RNA, 23 nt, Homo sapiens
cuaccugcacuguaagcacuuuu

SEQ ID NO: 38026 - RNA, 21 nt, Homo sapiens
aucugcacugucagcacuuua

SEQ ID NO: 38027 - RNA, 23 nt, Homo sapiens
cuaccugcacuguaagcacuuug

SEQ ID NO: 38028 - RNA, 22 nt, Homo sapiens
cagaagugggccgggcacaggg

SEQ ID NO: 38029 - RNA, 23 nt, Homo sapiens
cuaccugcacuauaagcacuuua

SEQ ID NO: 38030 - RNA, 23 nt, Homo sapiens
cuaccugcacuaugagcacuuug

SEQ ID NO: 38031 - RNA, 23 nt, Homo sapiens
cuaccugcacuaugagcacuuug

SEQ ID NO: 38032 - RNA, 21 nt, Homo sapiens
gugacagagccaagcacaaau

SEQ ID NO: 38033 - RNA, 22 nt, Homo sapiens
agucuucacaacagcccugugu

SEQ ID NO: 38034 - RNA, 21 nt, Homo sapiens
ggaaaucccuggcaaugugau

SEQ ID NO: 38035 - RNA, 21 nt, Homo sapiens
gguaaucccuggcaaugugau

SEQ ID NO: 38036 - RNA, 22 nt, Homo sapiens
aagaagugcaccauguuuguuu

SEQ ID NO: 38037 - RNA, 22 nt, Homo sapiens
acacucuaaaaggaugcacuuu

SEQ ID NO: 38038 - RNA, 22 nt, Homo sapiens
aaccucuaaaaggaugcacuuu

SEQ ID NO: 38039 - RNA, 22 nt, Homo sapiens
auccucuaaaaagaugcacuuu

SEQ ID NO: 38040 - RNA, 22 nt, Homo sapiens
cacucuaaagggaggcacuuug

SEQ ID NO: 38041 - RNA, 24 nt, Homo sapiens
acacucuaaagggaagcacuuugu

SEQ ID NO: 38042 - RNA, 22 nt, Homo sapiens
acucuaaagggaagcacuuugu

SEQ ID NO: 38043 - RNA, 23 nt, Homo sapiens
acagaaagugcuucccucaagag

SEQ ID NO: 38044 - RNA, 22 nt, Homo sapiens
acaaaagcaacugagguucuug

SEQ ID NO: 38045 - RNA, 22 nt, Homo sapiens
gacucuugaacaacacagguuu

SEQ ID NO: 38046 - RNA, 22 nt, Homo sapiens
ucggucccucgggccagggcag

SEQ ID NO: 38047 - RNA, 25 nt, Homo sapiens
gaauccugguucugucccucacuag

SEQ ID NO: 38048 - RNA, 23 nt, Homo sapiens
cuaccugcacgaacagcacuuug

SEQ ID NO: 38049 - RNA, 25 nt, Homo sapiens
cagcgucugccggaacccguuccca

SEQ ID NO: 38050 - RNA, 22 nt, Homo sapiens
acaaccagcuaagacacugcca

SEQ ID NO: 38051 - RNA, 22 nt, Homo sapiens
agccacaaucaccuucugaucu

SEQ ID NO: 38052 - RNA, 18 nt, Homo sapiens
augacaccucccugugaa

SEQ ID NO: 38053 - RNA, 22 nt, Homo sapiens
gcacacaauaaauguuugcuga

SEQ ID NO: 38054 - RNA, 23 nt, Homo sapiens
agcaaaaaugugcuagugccaaa

SEQ ID NO: 38055 - RNA, 21 nt, Homo sapiens
gcuuaaacaucuacaugaaca

SEQ ID NO: 38056 - RNA, 17 nt, Homo sapiens
gggagaggaggaggcga

SEQ ID NO: 38057 - RNA, 20 nt, Homo sapiens
acagcaaggagggcaggagg

SEQ ID NO: 38058 - RNA, 22 nt, Homo sapiens
agcugaguguaggauguuuaca

SEQ ID NO: 38059 - RNA, 22 nt, Homo sapiens
gauccgagcaccggggaccccc

SEQ ID NO: 38060 - RNA, 25 nt, Homo sapiens
accaacggaccuacuucccuccgcc

SEQ ID NO: 38061 - RNA, 23 nt, Homo sapiens
cacugugggcccucuccgcacca

SEQ ID NO: 38062 - RNA, 22 nt, Homo sapiens
ugcuguuagcccuagccccgca

SEQ ID NO: 38063 - RNA, 23 nt, Homo sapiens
gucacaucccucccaagacccuc

SEQ ID NO: 38064 - RNA, 22 nt, Homo sapiens
aggucucacuuuguugcccaga

SEQ ID NO: 38065 - RNA, 25 nt, Homo sapiens
aaggagcucagaagcccugcccagc

SEQ ID NO: 38066 - RNA, 21 nt, Homo sapiens
auaauggagaccaggccacga

SEQ ID NO: 38067 - RNA, 22 nt, Homo sapiens
cugggggcggcacaggggcuca

SEQ ID NO: 38068 - RNA, 20 nt, Homo sapiens
ggggggcgaggcagguguga

SEQ ID NO: 38069 - RNA, 22 nt, Homo sapiens
uccggggacgaacgggacgggu

SEQ ID NO: 38070 - RNA, 23 nt, Homo sapiens
aagaaucuugucccgcagguccu

SEQ ID NO: 38071 - RNA, 21 nt, Homo sapiens
gcugaggucugggccaggucu

SEQ ID NO: 38072 - RNA, 22 nt, Homo sapiens
caagacacauuuggagagggac

SEQ ID NO: 38073 - RNA, 21 nt, Homo sapiens
auaauggagaccaggccacga

SEQ ID NO: 38074 - RNA, 21 nt, Homo sapiens
ccccucccagccucccugcca

SEQ ID NO: 38075 - RNA, 19 nt, Homo sapiens
cagcaucagcagcaucauc

SEQ ID NO: 38076 - RNA, 21 nt, Homo sapiens
gggcaucugggacgcgcagga

SEQ ID NO: 38077 - RNA, 23 nt, Homo sapiens
cccaacagacauggcgguacuca

SEQ ID NO: 38078 - RNA, 22 nt, Homo sapiens
uggcagcagcggagggggcaga

SEQ ID NO: 38079 - RNA, 22 nt, Homo sapiens
ugagccacugugccuggccuga

SEQ ID NO: 38080 - RNA, 20 nt, Homo sapiens
ccagcagcaccuggggcagu

SEQ ID NO: 38081 - RNA, 20 nt, Homo sapiens
cuggaggaagggcccagagg

SEQ ID NO: 38082 - RNA, 22 nt, Homo sapiens
gccuaagacacaggcccagaga

SEQ ID NO: 38083 - RNA, 21 nt, Homo sapiens
ccuucugacuccaaguccagu

SEQ ID NO: 38084 - RNA, 21 nt, Homo sapiens
auccuguacugagcugccccg

SEQ ID NO: 38085 - RNA, 21 nt, Homo sapiens
acuccaaagggaagcgccuuc

SEQ ID NO: 38086 - RNA, 22 nt, Homo sapiens
cgcucuaaagggaagcgccuuc

SEQ ID NO: 38087 - RNA, 21 nt, Homo sapiens
aaaacaaaaucucaccguuuu

SEQ ID NO: 38088 - RNA, 19 nt, Homo sapiens
auuuugguacagcagcuca

SEQ ID NO: 38089 - RNA, 19 nt, Homo sapiens
gcuccuguccaacuggcuc

SEQ ID NO: 38090 - RNA, 19 nt, Homo sapiens
guccugaauuccgcagccu

SEQ ID NO: 38091 - RNA, 19 nt, Homo sapiens
gccucagaggcagcugcuu

SEQ ID NO: 38092 - RNA, 21 nt, Homo sapiens
gaaggaagugagugcagccac

SEQ ID NO: 38093 - RNA, 22 nt, Homo sapiens
ucuacccagaaaggagccagug

SEQ ID NO: 38094 - RNA, 23 nt, Homo sapiens
gaacagguagucugaacacuggg

SEQ ID NO: 38095 - RNA, 23 nt, Homo sapiens
gaacagauagucuaaacacuggg

SEQ ID NO: 38096 - RNA, 22 nt, Homo sapiens
ucagccgcugucacacgcacag

SEQ ID NO: 38097 - RNA, 23 nt, Homo sapiens
gggccgcagcugucgcccguguc

SEQ ID NO: 38098 - RNA, 19 nt, Homo sapiens
accagugcccugcacacuu

SEQ ID NO: 38099 - RNA, 20 nt, Homo sapiens
uacugcuuccacagcucccc

SEQ ID NO: 38100 - RNA, 22 nt, Homo sapiens
ggcagagagucagagcgcggau

SEQ ID NO: 38101 - RNA, 21 nt, Homo sapiens
cugaggagagaggaggugggg

SEQ ID NO: 38102 - RNA, 21 nt, Homo sapiens
gaccaaucgccguccccgccg

SEQ ID NO: 38103 - RNA, 22 nt, Homo sapiens
caaaagucaagcuuauccuaaa

SEQ ID NO: 38104 - RNA, 22 nt, Homo sapiens
gcggucccgcggcgccccgccu

SEQ ID NO: 38105 - RNA, 20 nt, Homo sapiens
uacugcuuccacagcucccc

SEQ ID NO: 38106 - RNA, 21 nt, Homo sapiens
cagcgaaacaggcaaacggag

SEQ ID NO: 38107 - RNA, 23 nt, Homo sapiens
cagcugcuuuugggauuccguug

SEQ ID NO: 38108 - RNA, 22 nt, Homo sapiens
cacuuaucagguuguauuauaa

SEQ ID NO: 38109 - RNA, 22 nt, Homo sapiens
cacuuagcagguuguauuauau

SEQ ID NO: 38110 - RNA, 22 nt, Homo sapiens
gccagcuaacaauacacugccu

SEQ ID NO: 38111 - RNA, 22 nt, Homo sapiens
aagaagugcaccauguuuguuu

SEQ ID NO: 38112 - RNA, 23 nt, Homo sapiens
aaucgcgguuuauaccaaaugaa

SEQ ID NO: 38113 - RNA, 22 nt, Homo sapiens
cucagucccaggcaaaccauaa

SEQ ID NO: 38114 - RNA, 21 nt, Homo sapiens
agagguugacuguauaauauu

SEQ ID NO: 38115 - RNA, 25 nt, Homo sapiens
gaauccugguucugucccucacuag

SEQ ID NO: 38116 - RNA, 18 nt, Homo sapiens
ugguggcagaggugggau

SEQ ID NO: 38117 - RNA, 22 nt, Homo sapiens
aggucucacuuuguugcccaga

SEQ ID NO: 38118 - RNA, 22 nt, Homo sapiens
ccaucuuuaccagacaguguua

SEQ ID NO: 38119 - RNA, 18 nt, Homo sapiens
ggagaggagggcacugga

SEQ ID NO: 38120 - RNA, 22 nt, Homo sapiens
cagaagugggccgggcacaggg

SEQ ID NO: 38121 - RNA, 22 nt, Homo sapiens
acaucguuaccagacaguguua

SEQ ID NO: 38122 - RNA, 23 nt, Homo sapiens
caugagugacgcccucuggagua

SEQ ID NO: 38123 - RNA, 21 nt, Homo sapiens
acuggcugagucaggacuagc

SEQ ID NO: 38124 - RNA, 19 nt, Homo sapiens
gcuccuguccaacuggcuc

SEQ ID NO: 38125 - RNA, 25 nt, Homo sapiens
acggagcugucccaacaccaccccu

SEQ ID NO: 38126 - RNA, 25 nt, Homo sapiens
aaggagcucagaagcccugcccagc

SEQ ID NO: 38127 - RNA, 19 nt, Homo sapiens
ucagcaguaccagccuaga

SEQ ID NO: 38128 - RNA, 22 nt, Homo sapiens
gcugaggcuguggggcuggagu

SEQ ID NO: 38129 - RNA, 23 nt, Homo sapiens
acaaggaugaaucuuuguuacug

SEQ ID NO: 38130 - RNA, 22 nt, Homo sapiens
ucuacccagaaaggagccagug

SEQ ID NO: 38131 - RNA, 22 nt, Homo sapiens
cacucuaaagggaggcacuuug

SEQ ID NO: 38132 - RNA, 22 nt, Homo sapiens
cacaaguucggaucuacggguu

SEQ ID NO: 38133 - RNA, 22 nt, Homo sapiens
cacaaguucggaucuacggguu

SEQ ID NO: 38134 - RNA, 19 nt, Homo sapiens
cagcaucagcagcaucauc

SEQ ID NO: 38135 - RNA, 22 nt, Homo sapiens
acaaaguucugugaugcacuga

SEQ ID NO: 38136 - RNA, 24 nt, Homo sapiens
acucacaccuagguuccaaggauu

SEQ ID NO: 38137 - RNA, 21 nt, Homo sapiens
acguggauuuuccucuaugau

SEQ ID NO: 38138 - RNA, 22 nt, Homo sapiens
aacauggauuuuccucuaugau

SEQ ID NO: 38139 - RNA, 23 nt, Homo sapiens
ucucacccagguagcaaggauua

SEQ ID NO: 38140 - RNA, 23 nt, Homo sapiens
caugagugacgcccucuggagua

SEQ ID NO: 38141 - RNA, 22 nt, Homo sapiens
aaagugcuucuuaccuccagau

SEQ ID NO: 38142 - RNA, 23 nt, Homo sapiens
acacucuaaagagaagcgcuuug

SEQ ID NO: 38143 - RNA, 21 nt, Homo sapiens
agaaaguacuucccucuggag

SEQ ID NO: 38144 - RNA, 21 nt, Homo sapiens
agaaagugcaucccucuggag

SEQ ID NO: 38145 - RNA, 22 nt, Homo sapiens
aguccagauucugugcccacca

SEQ ID NO: 38146 - RNA, 22 nt, Homo sapiens
acaaaagcaacugagguucuug

SEQ ID NO: 38147 - RNA, 21 nt, Homo sapiens
acaauccuagagcacaagaag

SEQ ID NO: 38148 - RNA, 20 nt, Homo sapiens
guuugauaaacugacacaac

SEQ ID NO: 38149 - RNA, 21 nt, Homo sapiens
agguaauaccaauaccuugug

SEQ ID NO: 38150 - RNA, 22 nt, Homo sapiens
auccuucuacaaauucacccau

SEQ ID NO: 38151 - RNA, 25 nt, Homo sapiens
cagcgucugccggaacccguuccca

SEQ ID NO: 38152 - RNA, 22 nt, Homo sapiens
cucaauagacugugagcuccuu

SEQ ID NO: 38153 - RNA, 22 nt, Homo sapiens
aacucaguaaugguaacgguuu

SEQ ID NO: 38154 - RNA, 20 nt, Homo sapiens
ugggccaccgccgagcggac

SEQ ID NO: 38155 - RNA, 25 nt, Homo sapiens
acggagcugucccaacaccaccccu

SEQ ID NO: 38156 - RNA, 22 nt, Homo sapiens
caacuccgauaugcaaugggua

SEQ ID NO: 38157 - RNA, 23 nt, Homo sapiens
cccagcuagauuguaagcuccuu

SEQ ID NO: 38158 - RNA, 22 nt, Homo sapiens
agaggcaggguaguguaaugga

SEQ ID NO: 38159 - RNA, 24 nt, Homo sapiens
cacccccagagccucagcucccca

SEQ ID NO: 38160 - RNA, 22 nt, Homo sapiens
aacagcacaaacuacuaccuca

SEQ ID NO: 38161 - RNA, 22 nt, Homo sapiens
caaacaccauugucacacucca

SEQ ID NO: 38162 - RNA, 22 nt, Homo sapiens
uccggggacgaacgggacgggu

SEQ ID NO: 38163 - RNA, 23 nt, Homo sapiens
acucaccgacagcguugaauguu

SEQ ID NO: 38164 - RNA, 21 nt, Homo sapiens
gaccaaucgccguccccgccg

SEQ ID NO: 38165 - RNA, 23 nt, Homo sapiens
cccaacagacauggcgguacuca

SEQ ID NO: 38166 - RNA, 19 nt, Homo sapiens
guccugaauuccgcagccu

SEQ ID NO: 38167 - RNA, 21 nt, Homo sapiens
aguucucccaacguaaaccca

SEQ ID NO: 38168 - RNA, 22 nt, Homo sapiens
gcggucccgcggcgccccgccu

SEQ ID NO: 38169 - RNA, 22 nt, Homo sapiens
gggagaggucucccugcgcaca

SEQ ID NO: 38170 - RNA, 25 nt, Homo sapiens
cagcgucugccggaacccguuccca

SEQ ID NO: 38171 - RNA, 22 nt, Homo sapiens
cacaaaccauuaugugcugcua

SEQ ID NO: 38172 - RNA, 23 nt, Homo sapiens
uccaaucaguuccugaugcagua

SEQ ID NO: 38173 - RNA, 23 nt, Homo sapiens
gagcaaggcucuugucuguaagu

SEQ ID NO: 38174 - RNA, 23 nt, Homo sapiens
uguaggcuggggauaaaugaaua

SEQ ID NO: 38175 - RNA, 21 nt, Homo sapiens
gagcugcauccuggcuccggg

SEQ ID NO: 38176 - RNA, 22 nt, Homo sapiens
cugggggcggcacaggggcuca

SEQ ID NO: 38177 - RNA, 24 nt, Homo sapiens
acugcuggucuucagucagggcca

SEQ ID NO: 38178 - RNA, 19 nt, Homo sapiens
guccugaauuccgcagccu

SEQ ID NO: 38179 - RNA, 22 nt, Homo sapiens
gcggucccgcggcgccccgccu

SEQ ID NO: 38180 - RNA, 22 nt, Homo sapiens
ugcuguuagcccuagccccgca

SEQ ID NO: 38181 - RNA, 22 nt, Homo sapiens
uauccacuacaccccgcugccu

SEQ ID NO: 38182 - RNA, 22 nt, Homo sapiens
aaagugcuucuuaccuccagau

SEQ ID NO: 38183 - RNA, 17 nt, Homo sapiens
uggcgcccgaacaggga

SEQ ID NO: 38184 - RNA, 23 nt, Homo sapiens
cccaacagacauggcgguacuca

SEQ ID NO: 38185 - RNA, 22 nt, Homo sapiens
aagauguggaccauauuacaua

SEQ ID NO: 38186 - RNA, 22 nt, Homo sapiens
cgaauccaccacgaacaacuuc

SEQ ID NO: 38187 - RNA, 21 nt, Homo sapiens
ugacugcagagcaaaagacac

SEQ ID NO: 38188 - RNA, 19 nt, Homo sapiens
gggaaacguaugucaaccu

SEQ ID NO: 38189 - RNA, 23 nt, Homo sapiens
cuaccugcacuguaagcacuuuu

SEQ ID NO: 38190 - RNA, 23 nt, Homo sapiens
cuaccugcacuguaagcacuuuu

SEQ ID NO: 38191 - RNA, 21 nt, Homo sapiens
aucugcacugucagcacuuua

SEQ ID NO: 38192 - RNA, 21 nt, Homo sapiens
aucugcacugucagcacuuua

SEQ ID NO: 38193 - RNA, 19 nt, Homo sapiens
ucccugauccaaaaaucca

SEQ ID NO: 38194 - RNA, 22 nt, Homo sapiens
cgaccauggcuguagacuguua

SEQ ID NO: 38195 - RNA, 23 nt, Homo sapiens
cuaccugcacuguaagcacuuug

SEQ ID NO: 38196 - RNA, 23 nt, Homo sapiens
cuaccugcacuguaagcacuuug

SEQ ID NO: 38197 - RNA, 25 nt, Homo sapiens
agcuagucaagcgcgguuguggggg

SEQ ID NO: 38198 - RNA, 23 nt, Homo sapiens
cuaccugcacuauaagcacuuua

SEQ ID NO: 38199 - RNA, 23 nt, Homo sapiens
cuaccugcacuauaagcacuuua

SEQ ID NO: 38200 - RNA, 23 nt, Homo sapiens
cuaccugcacuaugagcacuuug

SEQ ID NO: 38201 - RNA, 23 nt, Homo sapiens
cuaccugcacuaugagcacuuug

SEQ ID NO: 38202 - RNA, 21 nt, Homo sapiens
ggccgugacuggagacuguua

SEQ ID NO: 38203 - RNA, 21 nt, Homo sapiens
agagcucauccauaguuguca

SEQ ID NO: 38204 - RNA, 22 nt, Homo sapiens
cgggacguccagacucaacucu

SEQ ID NO: 38205 - RNA, 22 nt, Homo sapiens
cucaauagacugugagcuccuu

SEQ ID NO: 38206 - RNA, 23 nt, Homo sapiens
ucaccaaaacauggaagcacuua

SEQ ID NO: 38207 - RNA, 23 nt, Homo sapiens
cuacuaaaacauggaagcacuua

SEQ ID NO: 38208 - RNA, 23 nt, Homo sapiens
ccacugaaacauggaagcacuua

SEQ ID NO: 38209 - RNA, 23 nt, Homo sapiens
acacucaaacauggaagcacuua

SEQ ID NO: 38210 - RNA, 17 nt, Homo sapiens
aagcauggaagcacuua

SEQ ID NO: 38211 - RNA, 23 nt, Homo sapiens
acgcucaaaugucgcagcacuuu

SEQ ID NO: 38212 - RNA, 23 nt, Homo sapiens
acaccccaaaaucgaagcacuuc

SEQ ID NO: 38213 - RNA, 22 nt, Homo sapiens
ccucauggaaggguuccccacu

SEQ ID NO: 38214 - RNA, 23 nt, Homo sapiens
gaaaaacgcccccuggcuugaaa

SEQ ID NO: 38215 - RNA, 22 nt, Homo sapiens
acacucuaaaaggaugcacuuu

SEQ ID NO: 38216 - RNA, 22 nt, Homo sapiens
aaccucuaaaaggaugcacuuu

SEQ ID NO: 38217 - RNA, 22 nt, Homo sapiens
auccucuaaaaagaugcacuuu

SEQ ID NO: 38218 - RNA, 22 nt, Homo sapiens
cacucuaaagggaggcacuuug

SEQ ID NO: 38219 - RNA, 22 nt, Homo sapiens
cacucuaaagggaggcacuuug

SEQ ID NO: 38220 - RNA, 22 nt, Homo sapiens
acaguccaaagggaagcacuuu

SEQ ID NO: 38221 - RNA, 21 nt, Homo sapiens
cccucuaaaaggaagcacuuu

SEQ ID NO: 38222 - RNA, 22 nt, Homo sapiens
acccucuaaaaggaagcacuuu

SEQ ID NO: 38223 - RNA, 22 nt, Homo sapiens
acccaccaaagagaagcacuuu

SEQ ID NO: 38224 - RNA, 21 nt, Homo sapiens
cccucaaaaaggaagcacuuu

SEQ ID NO: 38225 - RNA, 23 nt, Homo sapiens
acagaaagugcuucccucaagag

SEQ ID NO: 38226 - RNA, 23 nt, Homo sapiens
acagaaagugcuucccucaagag

SEQ ID NO: 38227 - RNA, 23 nt, Homo sapiens
aggagaaggcaccaugggauuua

SEQ ID NO: 38228 - RNA, 22 nt, Homo sapiens
guccaaaguuggggugcugguu

SEQ ID NO: 38229 - RNA, 23 nt, Homo sapiens
cccagcuagauuguaagcuccuu

SEQ ID NO: 38230 - RNA, 23 nt, Homo sapiens
cuaccugcacgaacagcacuuug

SEQ ID NO: 38231 - RNA, 23 nt, Homo sapiens
cuaccugcacgaacagcacuuug

SEQ ID NO: 38232 - RNA, 21 nt, Homo sapiens
cuggaggacggcaacagucag

SEQ ID NO: 38233 - RNA, 22 nt, Homo sapiens
aacaacacuugaccacauccug

SEQ ID NO: 38234 - RNA, 22 nt, Homo sapiens
cagcugguugaaggggaccaaa

SEQ ID NO: 38235 - RNA, 22 nt, Homo sapiens
uagcugguugaaggggaccaaa

SEQ ID NO: 38236 - RNA, 20 nt, Homo sapiens
uacugcuuccacagcucccc

SEQ ID NO: 38237 - RNA, 22 nt, Homo sapiens
aagcgguuuaccaucccacaua

SEQ ID NO: 38238 - RNA, 20 nt, Homo sapiens
gcaaaugguacagcuacuuu

SEQ ID NO: 38239 - RNA, 23 nt, Homo sapiens
uguaggcuggggauaaaugaaua

SEQ ID NO: 38240 - RNA, 20 nt, Homo sapiens
uacugcuuccacagcucccc

SEQ ID NO: 38241 - RNA, 22 nt, Homo sapiens
gggagaggucucccugcgcaca

SEQ ID NO: 38242 - RNA, 22 nt, Homo sapiens
cacauggccaaaacagagaaga

SEQ ID NO: 38243 - RNA, 21 nt, Homo sapiens
gagcugcauccuggcuccggg

SEQ ID NO: 38244 - RNA, 18 nt, Homo sapiens
ugguggcagaggugggau

SEQ ID NO: 38245 - RNA, 23 nt, Homo sapiens
cuaucugcacuagaugcaccuua

SEQ ID NO: 38246 - RNA, 21 nt, Homo sapiens
gaccaaucgccguccccgccg

SEQ ID NO: 38247 - RNA, 21 nt, Homo sapiens
gaccaaucgccguccccgccg

SEQ ID NO: 38248 - RNA, 22 nt, Homo sapiens
uggcagcagcggagggggcaga

SEQ ID NO: 38249 - RNA, 22 nt, Homo sapiens
acugccugucugugccugcugu

SEQ ID NO: 38250 - RNA, 21 nt, Homo sapiens
acaggauugagggggggcccu

SEQ ID NO: 38251 - RNA, 21 nt, Homo sapiens
acaggauugagggggggcccu

SEQ ID NO: 38252 - RNA, 20 nt, Homo sapiens
ccagcagcaccuggggcagu

SEQ ID NO: 38253 - RNA, 22 nt, Homo sapiens
accagguuccaccccagcaggc

SEQ ID NO: 38254 - RNA, 23 nt, Homo sapiens
acugaggggccucagaccgagcu

SEQ ID NO: 38255 - RNA, 21 nt, Homo sapiens
auccuguacugagcugccccg

SEQ ID NO: 38256 - RNA, 18 nt, Homo sapiens
acccucugaaaggaagca

SEQ ID NO: 38257 - RNA, 22 nt, Homo sapiens
aaagugcuucuuaccuccagau

SEQ ID NO: 38258 - RNA, 24 nt, Homo sapiens
acgcgcaggccagagacccaggca

SEQ ID NO: 38259 - RNA, 22 nt, Homo sapiens
gcggucccgcggcgccccgccu

SEQ ID NO: 38260 - RNA, 22 nt, Homo sapiens
gcggucccgcggcgccccgccu

SEQ ID NO: 38261 - RNA, 22 nt, Homo sapiens
ugcuguuagcccuagccccgca

SEQ ID NO: 38262 - RNA, 22 nt, Homo sapiens
ucggucccucgggccagggcag

SEQ ID NO: 38263 - RNA, 24 nt, Homo sapiens
cacccccagagccucagcucccca

SEQ ID NO: 38264 - RNA, 22 nt, Homo sapiens
ccccucuggucaaccagucaca

SEQ ID NO: 38265 - RNA, 23 nt, Homo sapiens
acacuuacuggacaccuacuagg

SEQ ID NO: 38266 - RNA, 22 nt, Homo sapiens
aaguggaugacccuguacgauu

SEQ ID NO: 38267 - RNA, 23 nt, Homo sapiens
acagaaagugcuucccucaagag

SEQ ID NO: 38268 - RNA, 22 nt, Homo sapiens
agcucagaacccagaggucuca

SEQ ID NO: 38269 - RNA, 23 nt, Homo sapiens
uggcccugacacgugguacugga

SEQ ID NO: 38270 - RNA, 21 nt, Homo sapiens
cuggaggacggcaacagucag

SEQ ID NO: 38271 - RNA, 22 nt, Homo sapiens
uccggggacgaacgggacgggu

SEQ ID NO: 38272 - RNA, 23 nt, Homo sapiens
agggauuccugggaaaacuggac

SEQ ID NO: 38273 - RNA, 22 nt, Homo sapiens
aacccauggaauucaguucuca

SEQ ID NO: 38274 - RNA, 22 nt, Homo sapiens
agccuauggaauucaguucuca

SEQ ID NO: 38275 - RNA, 21 nt, Homo sapiens
gaccaaucgccguccccgccg

SEQ ID NO: 38276 - RNA, 22 nt, Homo sapiens
cggugagcacccggccccugcg

SEQ ID NO: 38277 - RNA, 23 nt, Homo sapiens
aaagucucgcucucugccccuca

SEQ ID NO: 38278 - RNA, 22 nt, Homo sapiens
gcggucccgcggcgccccgccu

SEQ ID NO: 38279 - RNA, 22 nt, Homo sapiens
ugcuguuagcccuagccccgca

SEQ ID NO: 38280 - RNA, 22 nt, Homo sapiens
ccacacacuuccuuacauucca

SEQ ID NO: 38281 - RNA, 23 nt, Homo sapiens
augcaaaguugcucggguaaccu

SEQ ID NO: 38282 - RNA, 23 nt, Homo sapiens
gaaagugcuucuuuccucgagaa

SEQ ID NO: 38283 - RNA, 23 nt, Homo sapiens
aguaacugguugaacaacuguaa

SEQ ID NO: 38284 - RNA, 22 nt, Homo sapiens
cucagagcagacgugguucuca

SEQ ID NO: 38285 - RNA, 21 nt, Homo sapiens
ccccucccagccucccugcca

SEQ ID NO: 38286 - RNA, 22 nt, Homo sapiens
aggucucacuuuguugcccaga

SEQ ID NO: 38287 - RNA, 21 nt, Homo sapiens
gaccaaucgccguccccgccg

SEQ ID NO: 38288 - RNA, 25 nt, Homo sapiens
aaggagcucagaagcccugcccagc

SEQ ID NO: 38289 - RNA, 22 nt, Homo sapiens
gcggucccgcggcgccccgccu

SEQ ID NO: 38290 - RNA, 21 nt, Homo sapiens
gguggagcccugagaaccgga

SEQ ID NO: 38291 - RNA, 22 nt, Homo sapiens
ugcuguuagcccuagccccgca

SEQ ID NO: 38292 - RNA, 24 nt, Homo sapiens
cacccccagagccucagcucccca

SEQ ID NO: 38293 - RNA, 22 nt, Homo sapiens
agcuagugagaagucaaugccu

SEQ ID NO: 38294 - RNA, 23 nt, Homo sapiens
cuacgcguauucuuaagcaauaa

SEQ ID NO: 38295 - RNA, 21 nt, Homo sapiens
auguaggccuuuagaucacuu

SEQ ID NO: 38296 - RNA, 21 nt, Homo sapiens
ugcaaacccugcaugugggag

SEQ ID NO: 38297 - RNA, 21 nt, Homo sapiens
gagcuacagugcuucaucuca

SEQ ID NO: 38298 - RNA, 21 nt, Homo sapiens
cguacgcuauacggucuacua

SEQ ID NO: 38299 - RNA, 22 nt, Homo sapiens
uauggaugcaaaaugaucccaa

SEQ ID NO: 38300 - RNA, 22 nt, Homo sapiens
agcacagacuugcugugauguu

SEQ ID NO: 38301 - RNA, 22 nt, Homo sapiens
acacaccaaggauaauuucucc

SEQ ID NO: 38302 - RNA, 22 nt, Homo sapiens
ccucuaguaaauaugucagcau

SEQ ID NO: 38303 - RNA, 23 nt, Homo sapiens
aaccaagaccccggagaucccag

SEQ ID NO: 38304 - RNA, 21 nt, Homo sapiens
gaccaaucgccguccccgccg

SEQ ID NO: 38305 - RNA, 21 nt, Homo sapiens
ugcaaugcaacuacaaugcac

SEQ ID NO: 38306 - RNA, 22 nt, Homo sapiens
uccagcaaagggaagcgcuuuc

SEQ ID NO: 38307 - RNA, 20 nt, Homo sapiens
gaaagggcuucccuuugcag

SEQ ID NO: 38308 - RNA, 22 nt, Homo sapiens
accucuaaaggggagcgcuuug

SEQ ID NO: 38309 - RNA, 23 nt, Homo sapiens
acacucuaaagagaagcgcuuug

SEQ ID NO: 38310 - RNA, 21 nt, Homo sapiens
gcuccaaagggaagcgcuuug

SEQ ID NO: 38311 - RNA, 21 nt, Homo sapiens
ccucuaaagagaagcgcuuuc

SEQ ID NO: 38312 - RNA, 21 nt, Homo sapiens
acuccaaagggaagcgccuuc

SEQ ID NO: 38313 - RNA, 22 nt, Homo sapiens
cgcucuaaagggaagcgccuuc

SEQ ID NO: 38314 - RNA, 20 nt, Homo sapiens
gaaagggcuucccuuugcag

SEQ ID NO: 38315 - RNA, 22 nt, Homo sapiens
gcggucccgcggcgccccgccu

SEQ ID NO: 38316 - RNA, 23 nt, Homo sapiens
gggagugaagacacggagccaga

SEQ ID NO: 38317 - RNA, 21 nt, Homo sapiens
gggcaucugggacgcgcagga

SEQ ID NO: 38318 - RNA, 21 nt, Homo sapiens
gaccaaucgccguccccgccg

SEQ ID NO: 38319 - RNA, 22 nt, Homo sapiens
cggugagcacccggccccugcg

SEQ ID NO: 38320 - RNA, 22 nt, Homo sapiens
gcggucccgcggcgccccgccu

SEQ ID NO: 38321 - RNA, 21 nt, Homo sapiens
gccaauauuucugugcugcua

SEQ ID NO: 38322 - RNA, 22 nt, Homo sapiens
acaaccagcuaagacacugcca

SEQ ID NO: 38323 - RNA, 22 nt, Homo sapiens
auggcaguggaguuagugauug

SEQ ID NO: 38324 - RNA, 23 nt, Homo sapiens
gcaaucagcuaacuacacugccu

SEQ ID NO: 38325 - RNA, 22 nt, Homo sapiens
accagcuaacaauacacugcca

SEQ ID NO: 38326 - RNA, 22 nt, Homo sapiens
gccagcuaacaauacacugccu

SEQ ID NO: 38327 - RNA, 22 nt, Homo sapiens
cagcauggaguccuccagguug

SEQ ID NO: 38328 - RNA, 19 nt, Homo sapiens
accagugcccugcacacuu

SEQ ID NO: 38329 - RNA, 22 nt, Homo sapiens
cugcgauuccucccucuacugu

SEQ ID NO: 38330 - RNA, 18 nt, Homo sapiens
cccccaccaccacgcccg

SEQ ID NO: 38331 - RNA, 18 nt, Homo sapiens
uggcgccugaacagggac

SEQ ID NO: 38332 - RNA, 22 nt, Homo sapiens
aggucucacuuuguugcccaga

SEQ ID NO: 38333 - RNA, 23 nt, Homo sapiens
cagcugcuuuugggauuccguug

SEQ ID NO: 38334 - RNA, 21 nt, Homo sapiens
acaggauugagggggggcccu

SEQ ID NO: 38335 - RNA, 23 nt, Homo sapiens
cgugagcuccuggaggacaggga

SEQ ID NO: 38336 - RNA, 23 nt, Homo sapiens
cugcagaacuguucccgcugcua

SEQ ID NO: 38337 - RNA, 25 nt, Homo sapiens
aaggagcucagaagcccugcccagc

SEQ ID NO: 38338 - RNA, 23 nt, Homo sapiens
ccgcuugagcuaacuccgacccg

SEQ ID NO: 38339 - RNA, 21 nt, Homo sapiens
cugaggagagaggaggugggg

SEQ ID NO: 38340 - RNA, 21 nt, Homo sapiens
uuccacgaccuaauccuaacu

SEQ ID NO: 38341 - RNA, 18 nt, Homo sapiens
ugguggcagaggugggau

SEQ ID NO: 38342 - RNA, 21 nt, Homo sapiens
cggggugcacgggcggagggc

SEQ ID NO: 38343 - RNA, 18 nt, Homo sapiens
auucaaucuacugccuca

SEQ ID NO: 38344 - RNA, 20 nt, Homo sapiens
cuggaggaagggcccagagg

SEQ ID NO: 38345 - RNA, 22 nt, Homo sapiens
gccuaagacacaggcccagaga

SEQ ID NO: 38346 - RNA, 22 nt, Homo sapiens
ccucauggaaggguuccccacu

SEQ ID NO: 38347 - RNA, 18 nt, Homo sapiens
acccucugaaaggaagca

SEQ ID NO: 38348 - RNA, 22 nt, Homo sapiens
aaagugcuucuuaccuccagau

SEQ ID NO: 38349 - RNA, 21 nt, Homo sapiens
gaaggaagugagugcagccac

SEQ ID NO: 38350 - RNA, 25 nt, Homo sapiens
accaacggaccuacuucccuccgcc

SEQ ID NO: 38351 - RNA, 23 nt, Homo sapiens
ucauagcccuguacaaugcugcu

SEQ ID NO: 38352 - RNA, 23 nt, Homo sapiens
ugauagcccuguacaaugcugcu

SEQ ID NO: 38353 - RNA, 23 nt, Homo sapiens
ggaagccaucaagucgcugcagg

SEQ ID NO: 38354 - RNA, 22 nt, Homo sapiens
ccccucuggucaaccagucaca

SEQ ID NO: 38355 - RNA, 22 nt, Homo sapiens
acaaaguucuguagugcacuga

SEQ ID NO: 38356 - RNA, 22 nt, Homo sapiens
acaaaguucugugaugcacuga

SEQ ID NO: 38357 - RNA, 21 nt, Homo sapiens
ccaaguucugucaugcacuga

SEQ ID NO: 38358 - RNA, 23 nt, Homo sapiens
acucaccgacagcguugaauguu

SEQ ID NO: 38359 - RNA, 23 nt, Homo sapiens
acccaccgacagcaaugaauguu

SEQ ID NO: 38360 - RNA, 22 nt, Homo sapiens
acucaccgacagguugaauguu

SEQ ID NO: 38361 - RNA, 23 nt, Homo sapiens
acccaccgacaacaaugaauguu

SEQ ID NO: 38362 - RNA, 23 nt, Homo sapiens
gaaacccagcagacaauguagcu

SEQ ID NO: 38363 - RNA, 21 nt, Homo sapiens
acccaguagccagauguagcu

SEQ ID NO: 38364 - RNA, 21 nt, Homo sapiens
ugcaaugcaacuacaaugcac

SEQ ID NO: 38365 - RNA, 22 nt, Homo sapiens
gagguuucccguguauguuuca

SEQ ID NO: 38366 - RNA, 22 nt, Homo sapiens
aagaagugcaccgcgaauguuu

SEQ ID NO: 38367 - RNA, 19 nt, Homo sapiens
ucccacaggaagcagacac

SEQ ID NO: 38368 - RNA, 23 nt, Homo sapiens
guagugggccgagccgagugaca

SEQ ID NO: 38369 - RNA, 22 nt, Homo sapiens
aacuauacaaccuacuaccuca

SEQ ID NO: 38370 - RNA, 22 nt, Homo sapiens
aaccacacaaccuacuaccuca

SEQ ID NO: 38371 - RNA, 19 nt, Homo sapiens
agaaaccccagcagagaca

SEQ ID NO: 38372 - RNA, 24 nt, Homo sapiens
acugcuggucuucagucagggcca

SEQ ID NO: 38373 - RNA, 23 nt, Homo sapiens
uauucucgcacggacuacaacca

SEQ ID NO: 38374 - RNA, 19 nt, Homo sapiens
auuuugguacagcagcuca

SEQ ID NO: 38375 - RNA, 21 nt, Homo sapiens
gagcuacagugcuucaucuca

SEQ ID NO: 38376 - RNA, 18 nt, Homo sapiens
auucaaucuacugccuca

SEQ ID NO: 38377 - RNA, 22 nt, Homo sapiens
ccggcugcaacacaagacacga

SEQ ID NO: 38378 - RNA, 22 nt, Homo sapiens
auggcaguggaguuagugauug

SEQ ID NO: 38379 - RNA, 22 nt, Homo sapiens
uuucaguuaucaaucugucaca

SEQ ID NO: 38380 - RNA, 22 nt, Homo sapiens
gcacacaauaaauguuugcuga

SEQ ID NO: 38381 - RNA, 19 nt, Homo sapiens
gccucagaggcagcugcuu

SEQ ID NO: 38382 - RNA, 19 nt, Homo sapiens
accagugcccugcacacuu

SEQ ID NO: 38383 - RNA, 21 nt, Homo sapiens
guccugagagcgcugccuccu

SEQ ID NO: 38384 - RNA, 21 nt, Homo sapiens
aggagacucacaaguuccugc

SEQ ID NO: 38385 - RNA, 21 nt, Homo sapiens
ggggagcgggggcccugccuu

SEQ ID NO: 38386 - RNA, 23 nt, Homo sapiens
ggaagccaucaagucgcugcagg

SEQ ID NO: 38387 - RNA, 20 nt, Homo sapiens
cucaaagcaaacccugcaga

SEQ ID NO: 38388 - RNA, 20 nt, Homo sapiens
cucaaagcaaacccugcaga

SEQ ID NO: 38389 - RNA, 21 nt, Homo sapiens
cugaggagagaggaggugggg

SEQ ID NO: 38390 - RNA, 22 nt, Homo sapiens
caaacaccauugucacacucca

SEQ ID NO: 38391 - RNA, 23 nt, Homo sapiens
cuaccugcacuguaagcacuuug

SEQ ID NO: 38392 - RNA, 22 nt, Homo sapiens
ucaggaacugccuuucucucca

SEQ ID NO: 38393 - RNA, 21 nt, Homo sapiens
gaccaaucgccguccccgccg

SEQ ID NO: 38394 - RNA, 21 nt, Homo sapiens
ccuucugacuccaaguccagu

SEQ ID NO: 38395 - RNA, 22 nt, Homo sapiens
gccuucugacccuaaguccagu

SEQ ID NO: 38396 - RNA, 22 nt, Homo sapiens
caugauugccacgucugcagua

SEQ ID NO: 38397 - RNA, 21 nt, Homo sapiens
ugauugccacugucugcagua

SEQ ID NO: 38398 - RNA, 21 nt, Homo sapiens
uugucuaaccagucaccuguu

SEQ ID NO: 38399 - RNA, 23 nt, Homo sapiens
uuuauugugguagauacuauuag

SEQ ID NO: 38400 - RNA, 22 nt, Homo sapiens
gcggucccgcggcgccccgccu

SEQ ID NO: 38401 - RNA, 21 nt, Homo sapiens
auaauggagaccaggccacga

SEQ ID NO: 38402 - RNA, 22 nt, Homo sapiens
caaacaccauugucacacucca

SEQ ID NO: 38403 - RNA, 22 nt, Homo sapiens
cuggagagacaaggggaagagg

SEQ ID NO: 38404 - RNA, 17 nt, Homo sapiens
gggagaggaggaggcga

SEQ ID NO: 38405 - RNA, 20 nt, Homo sapiens
cccgccgcgucgcccugggg

SEQ ID NO: 38406 - RNA, 22 nt, Homo sapiens
cucccuucuuuccucccgucuu

SEQ ID NO: 38407 - RNA, 25 nt, Homo sapiens
accaacggaccuacuucccuccgcc

SEQ ID NO: 38408 - RNA, 22 nt, Homo sapiens
ccucaggcacggccgggccacc

SEQ ID NO: 38409 - RNA, 23 nt, Homo sapiens
cacugugggcccucuccgcacca

SEQ ID NO: 38410 - RNA, 22 nt, Homo sapiens
uauccacuacaccccgcugccu

SEQ ID NO: 38411 - RNA, 20 nt, Homo sapiens
cucaaagcaaacccugcaga

SEQ ID NO: 38412 - RNA, 24 nt, Homo sapiens
ucacagguuaaagggucucaggga

SEQ ID NO: 38413 - RNA, 22 nt, Homo sapiens
ucacaaguuagggucucaggga

SEQ ID NO: 38414 - RNA, 23 nt, Homo sapiens
agcccuguucuacagcccugagg

SEQ ID NO: 38415 - RNA, 24 nt, Homo sapiens
acugcuggucuucagucagggcca

SEQ ID NO: 38416 - RNA, 23 nt, Homo sapiens
gggagugaagacacggagccaga

SEQ ID NO: 38417 - RNA, 23 nt, Homo sapiens
cuaucugcacuagaugcaccuua

SEQ ID NO: 38418 - RNA, 22 nt, Homo sapiens
cagaagugggccgggcacaggg

SEQ ID NO: 38419 - RNA, 20 nt, Homo sapiens
cccgccgcgucgcccugggg

SEQ ID NO: 38420 - RNA, 22 nt, Homo sapiens
ugagccacugugccuggccuga

SEQ ID NO: 38421 - RNA, 22 nt, Homo sapiens
acaguucuucaacuggcagcuu

SEQ ID NO: 38422 - RNA, 23 nt, Homo sapiens
gaaacccagcagacaauguagcu

SEQ ID NO: 38423 - RNA, 21 nt, Homo sapiens
ucaaucacagauagcaccccu

SEQ ID NO: 38424 - RNA, 20 nt, Homo sapiens
aggggccucagccuccuggu

SEQ ID NO: 38425 - RNA, 22 nt, Homo sapiens
ucggucccucgggccagggcag

SEQ ID NO: 38426 - RNA, 23 nt, Homo sapiens
gcacaugugcacacagccgggug

SEQ ID NO: 38427 - RNA, 22 nt, Homo sapiens
cacugguacaaggguugggaga

SEQ ID NO: 38428 - RNA, 22 nt, Homo sapiens
acuccaacagggccgcgucucc

SEQ ID NO: 38429 - RNA, 22 nt, Homo sapiens
cccaacaacaggaaacuaccua

SEQ ID NO: 38430 - RNA, 23 nt, Homo sapiens
uccaucauuacccggcaguauua

SEQ ID NO: 38431 - RNA, 22 nt, Homo sapiens
acaagcuuuuugcucgucuuau

SEQ ID NO: 38432 - RNA, 22 nt, Homo sapiens
acaaaccuuuuguucgucuuau

SEQ ID NO: 38433 - RNA, 22 nt, Homo sapiens
ucaacaucagucugauaagcua

SEQ ID NO: 38434 - RNA, 21 nt, Homo sapiens
acaggauugagggggggcccu

SEQ ID NO: 38435 - RNA, 23 nt, Homo sapiens
gggcucuuacucccucaggcacu

SEQ ID NO: 38436 - RNA, 19 nt, Homo sapiens
agaaaccccagcagagaca

SEQ ID NO: 38437 - RNA, 23 nt, Homo sapiens
ccgcuugagcuaacuccgacccg

SEQ ID NO: 38438 - RNA, 23 nt, Homo sapiens
gcacaugugcacacagccgggug

SEQ ID NO: 38439 - RNA, 22 nt, Homo sapiens
aacuauacaaccuacuaccuca

SEQ ID NO: 38440 - RNA, 22 nt, Homo sapiens
aaccacacaaccuacuaccuca

SEQ ID NO: 38441 - RNA, 19 nt, Homo sapiens
agaaaccccagcagagaca

SEQ ID NO: 38442 - RNA, 24 nt, Homo sapiens
ucacagguuaaagggucucaggga

SEQ ID NO: 38443 - RNA, 22 nt, Homo sapiens
ucacaaguuagggucucaggga

SEQ ID NO: 38444 - RNA, 23 nt, Homo sapiens
agcccuguucuacagcccugagg

SEQ ID NO: 38445 - RNA, 22 nt, Homo sapiens
cccaacaacaugaaacuaccua

SEQ ID NO: 38446 - RNA, 21 nt, Homo sapiens
caaaaaccacaaauaccuuug

SEQ ID NO: 38447 - RNA, 23 nt, Homo sapiens
aggagaaggcaccaugggauuua

SEQ ID NO: 38448 - RNA, 19 nt, Homo sapiens
ucagcaguaccagccuaga

SEQ ID NO: 38449 - RNA, 22 nt, Homo sapiens
ugcuguuagcccuagccccgca

SEQ ID NO: 38450 - RNA, 23 nt, Homo sapiens
agaaaccaugggguaugagcaga

SEQ ID NO: 38451 - RNA, 17 nt, Homo sapiens
gacagccucucccccac

SEQ ID NO: 38452 - RNA, 18 nt, Homo sapiens
auucaaucuacugccuca

SEQ ID NO: 38453 - RNA, 22 nt, Homo sapiens
acccuuaucaguucuccgucca

SEQ ID NO: 38454 - RNA, 22 nt, Homo sapiens
acugggacuuuguaggccaguu

SEQ ID NO: 38455 - RNA, 22 nt, Homo sapiens
agcgggacuuugagggccaguu

SEQ ID NO: 38456 - RNA, 25 nt, Homo sapiens
agcuagucaagcgcgguuguggggg

SEQ ID NO: 38457 - RNA, 23 nt, Homo sapiens
gaacagguagucugaacacuggg

SEQ ID NO: 38458 - RNA, 23 nt, Homo sapiens
gaacagauagucuaaacacuggg

SEQ ID NO: 38459 - RNA, 23 nt, Homo sapiens
ucucugcaggccgugugcuuugc

SEQ ID NO: 38460 - RNA, 22 nt, Homo sapiens
aggaaaccagcaaguguugacg

SEQ ID NO: 38461 - RNA, 23 nt, Homo sapiens
acacacucacacacacacacuca

SEQ ID NO: 38462 - RNA, 19 nt, Homo sapiens
agaaaccccagcagagaca

SEQ ID NO: 38463 - RNA, 23 nt, Homo sapiens
gacguaguccuauucucugcugc

SEQ ID NO: 38464 - RNA, 24 nt, Homo sapiens
cacccccagagccucagcucccca

SEQ ID NO: 38465 - RNA, 22 nt, Homo sapiens
caaacaccauugucacacucca

SEQ ID NO: 38466 - RNA, 18 nt, Homo sapiens
cccccaccaccacgcccg

SEQ ID NO: 38467 - RNA, 22 nt, Homo sapiens
ggagcccgcgccccgcgccgag

SEQ ID NO: 38468 - RNA, 21 nt, Homo sapiens
gggcaucugggacgcgcagga

SEQ ID NO: 38469 - RNA, 22 nt, Homo sapiens
cagaaagugcuucccucuagag

SEQ ID NO: 38470 - RNA, 22 nt, Homo sapiens
gcuggguggagaagguggugaa

SEQ ID NO: 38471 - RNA, 22 nt, Homo sapiens
ucagaccgagacaagugcaaug

SEQ ID NO: 38472 - RNA, 23 nt, Homo sapiens
acauuuuucguuauugcucuuga

SEQ ID NO: 38473 - RNA, 23 nt, Homo sapiens
acugaggggccucagaccgagcu

SEQ ID NO: 38474 - RNA, 19 nt, Homo sapiens
auuuugguacagcagcuca

SEQ ID NO: 38475 - RNA, 22 nt, Homo sapiens
aagagggagacccaggcucgga

SEQ ID NO: 38476 - RNA, 19 nt, Homo sapiens
gccucagaggcagcugcuu

SEQ ID NO: 38477 - RNA, 25 nt, Homo sapiens
accaacggaccuacuucccuccgcc

SEQ ID NO: 38478 - RNA, 23 nt, Homo sapiens
ccgcuugagcuaacuccgacccg

SEQ ID NO: 38479 - RNA, 21 nt, Homo sapiens
aucugcacugucagcacuuua

SEQ ID NO: 38480 - RNA, 22 nt, Homo sapiens
uagcagaagcauuuccgcacac

SEQ ID NO: 38481 - RNA, 23 nt, Homo sapiens
gggagugaagacacggagccaga

SEQ ID NO: 38482 - RNA, 18 nt, Homo sapiens
ggagaggagggcacugga

SEQ ID NO: 38483 - RNA, 22 nt, Homo sapiens
ucaggaacugccuuucucucca

SEQ ID NO: 38484 - RNA, 21 nt, Homo sapiens
gaccaaucgccguccccgccg

SEQ ID NO: 38485 - RNA, 17 nt, Homo sapiens
aaacauggaagcaauua

SEQ ID NO: 38486 - RNA, 23 nt, Homo sapiens
aaaucagaaucacaccuggggga

SEQ ID NO: 38487 - RNA, 23 nt, Homo sapiens
aaagucucgcucucugccccuca

SEQ ID NO: 38488 - RNA, 22 nt, Homo sapiens
ccucuaguaaauaugucagcau

SEQ ID NO: 38489 - RNA, 24 nt, Homo sapiens
acgcagagcccgaaagcccccagu

SEQ ID NO: 38490 - RNA, 22 nt, Homo sapiens
gcggucccgcggcgccccgccu

SEQ ID NO: 38491 - RNA, 22 nt, Homo sapiens
gggagaggucucccugcgcaca

SEQ ID NO: 38492 - RNA, 23 nt, Homo sapiens
ggaagccaucaagucgcugcagg

SEQ ID NO: 38493 - RNA, 23 nt, Homo sapiens
ggaagccaucaagucgcugcagg

SEQ ID NO: 38494 - RNA, 21 nt, Homo sapiens
ccccucccagccucccugcca

SEQ ID NO: 38495 - RNA, 21 nt, Homo sapiens
gaccaaucgccguccccgccg

SEQ ID NO: 38496 - RNA, 22 nt, Homo sapiens
cggugagcacccggccccugcg

SEQ ID NO: 38497 - RNA, 22 nt, Homo sapiens
agcugaguguaggauguuuaca

SEQ ID NO: 38498 - RNA, 22 nt, Homo sapiens
gcggucccgcggcgccccgccu

SEQ ID NO: 38499 - RNA, 21 nt, Homo sapiens
aagggucaguaagcacccgcg

SEQ ID NO: 38500 - RNA, 21 nt, Homo sapiens
cucccccacugcagcuggcac

SEQ ID NO: 38501 - RNA, 21 nt, Homo sapiens
ccccucccagccucccugcca

SEQ ID NO: 38502 - RNA, 24 nt, Homo sapiens
acugcaggcuccagcuuccaggcu

SEQ ID NO: 38503 - RNA, 18 nt, Homo sapiens
cccccaccaccacgcccg

SEQ ID NO: 38504 - RNA, 23 nt, Homo sapiens
acacagcucuuccauaucuccag

SEQ ID NO: 38505 - RNA, 23 nt, Homo sapiens
gggagugaagacacggagccaga

SEQ ID NO: 38506 - RNA, 22 nt, Homo sapiens
cggugagcacccggccccugcg

SEQ ID NO: 38507 - RNA, 22 nt, Homo sapiens
uaaccgauuucagauggugcua

SEQ ID NO: 38508 - RNA, 23 nt, Homo sapiens
aacacugauuucaaauggugcua

SEQ ID NO: 38509 - RNA, 22 nt, Homo sapiens
accagcuaacaauacacugcca

SEQ ID NO: 38510 - RNA, 22 nt, Homo sapiens
uaaccgauuucaaauggugcua

SEQ ID NO: 38511 - RNA, 23 nt, Homo sapiens
ccacccaaugaccuacuccaaga

SEQ ID NO: 38512 - RNA, 22 nt, Homo sapiens
gaauucaucacggccagccucu

SEQ ID NO: 38513 - RNA, 22 nt, Homo sapiens
aggaaaccagcaaguguugacg

SEQ ID NO: 38514 - RNA, 24 nt, Homo sapiens
cagaaagugcuuucuuuuggagaa

SEQ ID NO: 38515 - RNA, 22 nt, Homo sapiens
aacacucuaaaaggaggcacuu

SEQ ID NO: 38516 - RNA, 20 nt, Homo sapiens
auuucuauaucuaucuccau

SEQ ID NO: 38517 - RNA, 22 nt, Homo sapiens
gcugaggcuguggggcuggagu

SEQ ID NO: 38518 - RNA, 21 nt, Homo sapiens
ggggagcgggggcccugccuu

SEQ ID NO: 38519 - RNA, 21 nt, Homo sapiens
cugggggacggagcagaagga

SEQ ID NO: 38520 - RNA, 21 nt, Homo sapiens
ccccucccagccucccugcca

SEQ ID NO: 38521 - RNA, 24 nt, Homo sapiens
acugcaggcuccagcuuccaggcu

SEQ ID NO: 38522 - RNA, 21 nt, Homo sapiens
uuuagcauaaguaugucccaa

SEQ ID NO: 38523 - RNA, 21 nt, Homo sapiens
auguaggccuuuagaucacuu

SEQ ID NO: 38524 - RNA, 22 nt, Homo sapiens
cggugagcacccggccccugcg

SEQ ID NO: 38525 - RNA, 22 nt, Homo sapiens
uggcagcagcggagggggcaga

SEQ ID NO: 38526 - RNA, 22 nt, Homo sapiens
cuguuccugcugaacugagcca

SEQ ID NO: 38527 - RNA, 20 nt, Homo sapiens
ccagcagcaccuggggcagu

SEQ ID NO: 38528 - RNA, 22 nt, Homo sapiens
auaaggauuuuuaggggcauua

SEQ ID NO: 38529 - RNA, 22 nt, Homo sapiens
aucgggaggggacugagccuga

SEQ ID NO: 38530 - RNA, 21 nt, Homo sapiens
auccuguacugagcugccccg

SEQ ID NO: 38531 - RNA, 22 nt, Homo sapiens
aguccagauucugugcccacca

SEQ ID NO: 38532 - RNA, 25 nt, Homo sapiens
acggagcugucccaacaccaccccu

SEQ ID NO: 38533 - RNA, 22 nt, Homo sapiens
gcacauguucugcggcccacca

SEQ ID NO: 38534 - RNA, 22 nt, Homo sapiens
ugcuguuagcccuagccccgca

SEQ ID NO: 38535 - RNA, 21 nt, Homo sapiens
gcaagcccagaccgcaaaaag

SEQ ID NO: 38536 - RNA, 21 nt, Homo sapiens
acaggccaucuguguuauauu

SEQ ID NO: 38537 - RNA, 27 nt, Homo sapiens
ugcccacucucaccaucaccuacagug

SEQ ID NO: 38538 - RNA, 22 nt, Homo sapiens
cuagggaacacagggcugguga

SEQ ID NO: 38539 - RNA, 23 nt, Homo sapiens
cggccugauucacaacaccagcu

SEQ ID NO: 38540 - RNA, 22 nt, Homo sapiens
cuggagacacgugcacuguaga

SEQ ID NO: 38541 - RNA, 22 nt, Homo sapiens
cacaaaccauuaugugcugcua

SEQ ID NO: 38542 - RNA, 22 nt, Homo sapiens
uguaaaccaugaugugcugcua

SEQ ID NO: 38543 - RNA, 22 nt, Homo sapiens
cgccaauauuuacgugcugcua

SEQ ID NO: 38544 - RNA, 21 nt, Homo sapiens
gccaauauuucugugcugcua

SEQ ID NO: 38545 - RNA, 21 nt, Homo sapiens
ccuucugacuccaaguccagu

SEQ ID NO: 38546 - RNA, 22 nt, Homo sapiens
uucaaaacaugaauugcugcug

SEQ ID NO: 38547 - RNA, 22 nt, Homo sapiens
gagauuggccauguaauacuca

SEQ ID NO: 38548 - RNA, 21 nt, Homo sapiens
acaaaccacagugugcugcug

SEQ ID NO: 38549 - RNA, 23 nt, Homo sapiens
gaaaaacgcccccuggcuugaaa

SEQ ID NO: 38550 - RNA, 22 nt, Homo sapiens
gcacacaauaaauguuugcuga

SEQ ID NO: 38551 - RNA, 23 nt, Homo sapiens
aguaacugguugaacaacuguaa

SEQ ID NO: 38552 - RNA, 21 nt, Homo sapiens
acuagcuuauacauaaaauua

SEQ ID NO: 38553 - RNA, 25 nt, Homo sapiens
acggagcugucccaacaccaccccu

SEQ ID NO: 38554 - RNA, 22 nt, Homo sapiens
guccaaaguuggggugcugguu

SEQ ID NO: 38555 - RNA, 23 nt, Homo sapiens
gacguaguccuauucucugcugc

SEQ ID NO: 38556 - RNA, 23 nt, Homo sapiens
gcgguagcggaagcgguaacugg

SEQ ID NO: 38557 - RNA, 24 nt, Homo sapiens
acugcuggucuucagucagggcca

SEQ ID NO: 38558 - RNA, 22 nt, Homo sapiens
ccagaacugaguccacagggca

SEQ ID NO: 38559 - RNA, 21 nt, Homo sapiens
gggcaucugggacgcgcagga

SEQ ID NO: 38560 - RNA, 18 nt, Homo sapiens
auucaaucuacugccuca

SEQ ID NO: 38561 - RNA, 22 nt, Homo sapiens
cggugagcacccggccccugcg

SEQ ID NO: 38562 - RNA, 23 nt, Homo sapiens
cccaacagacauggcgguacuca

SEQ ID NO: 38563 - RNA, 22 nt, Homo sapiens
cagaagugggccgggcacaggg

SEQ ID NO: 38564 - RNA, 21 nt, Homo sapiens
aagugucagacacgguggugg

SEQ ID NO: 38565 - RNA, 23 nt, Homo sapiens
acaccaaugcccuaggggaugcg

SEQ ID NO: 38566 - RNA, 21 nt, Homo sapiens
guccugagagcgcugccuccu

SEQ ID NO: 38567 - RNA, 22 nt, Homo sapiens
uauccacuacaccccgcugccu

SEQ ID NO: 38568 - RNA, 23 nt, Homo sapiens
aggaacagcagcagcccgggccg

SEQ ID NO: 38569 - RNA, 22 nt, Homo sapiens
ucaguuuccucugcaaacaguu

SEQ ID NO: 38570 - RNA, 21 nt, Homo sapiens
gccaauauuucugugcugcua

SEQ ID NO: 38571 - RNA, 23 nt, Homo sapiens
ucaguuuugcauagauuugcaca

SEQ ID NO: 38572 - RNA, 23 nt, Homo sapiens
ucaguuuugcauggauuugcaca

SEQ ID NO: 38573 - RNA, 21 nt, Homo sapiens
uucacuccaaaaggugcaaaa

SEQ ID NO: 38574 - RNA, 23 nt, Homo sapiens
agacaaggcccacccgugcaaac

SEQ ID NO: 38575 - RNA, 23 nt, Homo sapiens
aaucgcgguuuauaccaaaugaa

SEQ ID NO: 38576 - RNA, 22 nt, Homo sapiens
cucagagcagacgugguucuca

SEQ ID NO: 38577 - RNA, 21 nt, Homo sapiens
gcuccaaccucagcagacugu

SEQ ID NO: 38578 - RNA, 20 nt, Homo sapiens
acaaugagaacccauggucu

SEQ ID NO: 38579 - RNA, 22 nt, Homo sapiens
caaacaccauugucacacucca

SEQ ID NO: 38580 - RNA, 22 nt, Homo sapiens
ucacauuugccugcagagauuu

SEQ ID NO: 38581 - RNA, 22 nt, Homo sapiens
acaaccagcuaagacacugcca

SEQ ID NO: 38582 - RNA, 22 nt, Homo sapiens
auggcaguggaguuagugauug

SEQ ID NO: 38583 - RNA, 23 nt, Homo sapiens
gcaaucagcuaacuacacugccu

SEQ ID NO: 38584 - RNA, 22 nt, Homo sapiens
cacuuaucagguuguauuauaa

SEQ ID NO: 38585 - RNA, 22 nt, Homo sapiens
cacuuagcagguuguauuauau

SEQ ID NO: 38586 - RNA, 20 nt, Homo sapiens
uaugaacaauuucuaggaau

SEQ ID NO: 38587 - RNA, 22 nt, Homo sapiens
accagcuaacaauacacugcca

SEQ ID NO: 38588 - RNA, 22 nt, Homo sapiens
gccagcuaacaauacacugccu

SEQ ID NO: 38589 - RNA, 21 nt, Homo sapiens
cagguaccaauauuuuaucua

SEQ ID NO: 38590 - RNA, 20 nt, Homo sapiens
acaaugagaacccauggucu

SEQ ID NO: 38591 - RNA, 22 nt, Homo sapiens
caaacaccauugucacacucca

SEQ ID NO: 38592 - RNA, 23 nt, Homo sapiens
cacaaauucgguucuacagggua

SEQ ID NO: 38593 - RNA, 21 nt, Homo sapiens
cggcucggguggcggcgacgg

SEQ ID NO: 38594 - RNA, 21 nt, Homo sapiens
ugcaggcugaucuucuucucu

SEQ ID NO: 38595 - RNA, 22 nt, Homo sapiens
cacgaccgacgccacgccgagu

SEQ ID NO: 38596 - RNA, 22 nt, Homo sapiens
ggagcccgcgccccgcgccgag

SEQ ID NO: 38597 - RNA, 18 nt, Homo sapiens
ggagaggagggcacugga

SEQ ID NO: 38598 - RNA, 23 nt, Homo sapiens
acauuuuucguuauugcucuuga

SEQ ID NO: 38599 - RNA, 22 nt, Homo sapiens
uccagcaaagggaagcgcuuuc

SEQ ID NO: 38600 - RNA, 22 nt, Homo sapiens
uccagcaaagggaagcgcuuuc

SEQ ID NO: 38601 - RNA, 22 nt, Homo sapiens
accucuaaaggggagcgcuuug

SEQ ID NO: 38602 - RNA, 22 nt, Homo sapiens
accucuaaaggggagcgcuuug

SEQ ID NO: 38603 - RNA, 23 nt, Homo sapiens
acacucuaaagagaagcgcuuug

SEQ ID NO: 38604 - RNA, 23 nt, Homo sapiens
acacucuaaagagaagcgcuuug

SEQ ID NO: 38605 - RNA, 21 nt, Homo sapiens
gcuccaaagggaagcgcuuug

SEQ ID NO: 38606 - RNA, 21 nt, Homo sapiens
gcuccaaagggaagcgcuuug

SEQ ID NO: 38607 - RNA, 21 nt, Homo sapiens
cacucugaagggaagcgcuuu

SEQ ID NO: 38608 - RNA, 21 nt, Homo sapiens
ccucuaaagagaagcgcuuuc

SEQ ID NO: 38609 - RNA, 21 nt, Homo sapiens
ccucuaaagagaagcgcuuuc

SEQ ID NO: 38610 - RNA, 23 nt, Homo sapiens
acagaaagugcuucccucaagag

SEQ ID NO: 38611 - RNA, 21 nt, Homo sapiens
aguucucccaacguaaaccca

SEQ ID NO: 38612 - RNA, 22 nt, Homo sapiens
acaaaguucuguagugcacuga

SEQ ID NO: 38613 - RNA, 22 nt, Homo sapiens
accuaauauaucaaacauauca

SEQ ID NO: 38614 - RNA, 22 nt, Homo sapiens
acggaagggcagagagggccag

SEQ ID NO: 38615 - RNA, 20 nt, Homo sapiens
guguguauacauuuauacau

SEQ ID NO: 38616 - RNA, 25 nt, Homo sapiens
acggagcugucccaacaccaccccu

SEQ ID NO: 38617 - RNA, 22 nt, Homo sapiens
cacucuaaagggaggcacuuug

SEQ ID NO: 38618 - RNA, 20 nt, Homo sapiens
uacugcuuccacagcucccc

SEQ ID NO: 38619 - RNA, 22 nt, Homo sapiens
caaacaccauugucacacucca

SEQ ID NO: 38620 - RNA, 18 nt, Homo sapiens
uggcgccugaacagggac

SEQ ID NO: 38621 - RNA, 18 nt, Homo sapiens
aucacauucaccucccug

SEQ ID NO: 38622 - RNA, 23 nt, Homo sapiens
gggagugaagacacggagccaga

SEQ ID NO: 38623 - RNA, 23 nt, Homo sapiens
cgugagcuccuggaggacaggga

SEQ ID NO: 38624 - RNA, 23 nt, Homo sapiens
cugcagaacuguucccgcugcua

SEQ ID NO: 38625 - RNA, 21 nt, Homo sapiens
ggacuauagaacuuucccccu

SEQ ID NO: 38626 - RNA, 23 nt, Homo sapiens
gacguaguccuauucucugcugc

SEQ ID NO: 38627 - RNA, 22 nt, Homo sapiens
cacucuaaagggaggcacuuug

SEQ ID NO: 38628 - RNA, 22 nt, Homo sapiens
cacauggccaaaacagagaaga

SEQ ID NO: 38629 - RNA, 22 nt, Homo sapiens
gugggguggguggucaggccga

SEQ ID NO: 38630 - RNA, 22 nt, Homo sapiens
cggugagcacccggccccugcg

SEQ ID NO: 38631 - RNA, 22 nt, Homo sapiens
uaaccgauuucagauggugcua

SEQ ID NO: 38632 - RNA, 23 nt, Homo sapiens
aacacugauuucaaauggugcua

SEQ ID NO: 38633 - RNA, 22 nt, Homo sapiens
uaaccgauuucaaauggugcua

SEQ ID NO: 38634 - RNA, 21 nt, Homo sapiens
acuggcugagucaggacuagc

SEQ ID NO: 38635 - RNA, 19 nt, Homo sapiens
guugggaucacaggcgccc

SEQ ID NO: 38636 - RNA, 22 nt, Homo sapiens
uggggacccucccugaaccaag

SEQ ID NO: 38637 - RNA, 21 nt, Homo sapiens
cugcugggccacaacguggga

SEQ ID NO: 38638 - RNA, 22 nt, Homo sapiens
ucggucccucgggccagggcag

SEQ ID NO: 38639 - RNA, 24 nt, Homo sapiens
agugugaguucuaccauugccaaa

SEQ ID NO: 38640 - RNA, 22 nt, Homo sapiens
ugcaacuuaguaaugugcaaua

SEQ ID NO: 38641 - RNA, 22 nt, Homo sapiens
ucaguuuccucugcaaacaguu

SEQ ID NO: 38642 - RNA, 24 nt, Homo sapiens
acgcgcaggccagagacccaggca

SEQ ID NO: 38643 - RNA, 22 nt, Homo sapiens
auacauacuucuuuacauucca

SEQ ID NO: 38644 - RNA, 18 nt, Homo sapiens
gaaaugagggccagcuga

SEQ ID NO: 38645 - RNA, 21 nt, Homo sapiens
ccccucccagccucccugcca

SEQ ID NO: 38646 - RNA, 24 nt, Homo sapiens
acugcuggucuucagucagggcca

SEQ ID NO: 38647 - RNA, 20 nt, Homo sapiens
gcagaagcauuuccacacac

SEQ ID NO: 38648 - RNA, 22 nt, Homo sapiens
cagacuccgguggaaugaagga

SEQ ID NO: 38649 - RNA, 22 nt, Homo sapiens
ccacacacuuccuuacauucca

SEQ ID NO: 38650 - RNA, 21 nt, Homo sapiens
aagugucagacacgguggugg

SEQ ID NO: 38651 - RNA, 23 nt, Homo sapiens
gaaagugcccucaaggcugagug

SEQ ID NO: 38652 - RNA, 22 nt, Homo sapiens
cucagagcagacgugguucuca

SEQ ID NO: 38653 - RNA, 22 nt, Homo sapiens
gcaaaaguaauugcagugugug

SEQ ID NO: 38654 - RNA, 20 nt, Homo sapiens
ggcaaagaaggaacauuccu

SEQ ID NO: 38655 - RNA, 18 nt, Homo sapiens
auucaaucuacugccuca

SEQ ID NO: 38656 - RNA, 20 nt, Homo sapiens
acagcaaggagggcaggagg

SEQ ID NO: 38657 - RNA, 22 nt, Homo sapiens
ucacaguugccagcugagauua

SEQ ID NO: 38658 - RNA, 23 nt, Homo sapiens
ucucugcaggccgugugcuuugc

SEQ ID NO: 38659 - RNA, 21 nt, Homo sapiens
aagacgggaggagaggaguga

SEQ ID NO: 38660 - RNA, 23 nt, Homo sapiens
aagaaucuugucccgcagguccu

SEQ ID NO: 38661 - RNA, 20 nt, Homo sapiens
aggggccucagccuccuggu

SEQ ID NO: 38662 - RNA, 21 nt, Homo sapiens
caucaccuuccuucuccucca

SEQ ID NO: 38663 - RNA, 23 nt, Homo sapiens
gacguaguccuauucucugcugc

SEQ ID NO: 38664 - RNA, 21 nt, Homo sapiens
cuagggaagaacagugagcaa

SEQ ID NO: 38665 - RNA, 22 nt, Homo sapiens
gaggcucagaauggcucaggag

SEQ ID NO: 38666 - RNA, 23 nt, Homo sapiens
gggagugaagacacggagccaga

SEQ ID NO: 38667 - RNA, 23 nt, Homo sapiens
gaacagguagucugaacacuggg

SEQ ID NO: 38668 - RNA, 23 nt, Homo sapiens
gaacagauagucuaaacacuggg

SEQ ID NO: 38669 - RNA, 23 nt, Homo sapiens
gaaacccagcagacaauguagcu

SEQ ID NO: 38670 - RNA, 22 nt, Homo sapiens
aggaaaccagcaaguguugacg

SEQ ID NO: 38671 - RNA, 22 nt, Homo sapiens
aguccagauucugugcccacca

SEQ ID NO: 38672 - RNA, 19 nt, Homo sapiens
gcuccuguccaacuggcuc

SEQ ID NO: 38673 - RNA, 22 nt, Homo sapiens
gcacauguucugcggcccacca

SEQ ID NO: 38674 - RNA, 23 nt, Homo sapiens
agaaaccaugggguaugagcaga

SEQ ID NO: 38675 - RNA, 22 nt, Homo sapiens
ucaguggcucagguucguugca

SEQ ID NO: 38676 - RNA, 22 nt, Homo sapiens
ucuacccagaaaggagccagug

SEQ ID NO: 38677 - RNA, 21 nt, Homo sapiens
gaccaaucgccguccccgccg

SEQ ID NO: 38678 - RNA, 22 nt, Homo sapiens
ucagaccgagacaagugcaaug

SEQ ID NO: 38679 - RNA, 23 nt, Homo sapiens
aaaucagaaucacaccuggggga

SEQ ID NO: 38680 - RNA, 22 nt, Homo sapiens
auaaggauuuuuaggggcauua

SEQ ID NO: 38681 - RNA, 22 nt, Homo sapiens
gauccgagcaccggggaccccc

SEQ ID NO: 38682 - RNA, 24 nt, Homo sapiens
acgcagagcccgaaagcccccagu

SEQ ID NO: 38683 - RNA, 22 nt, Homo sapiens
gcggucccgcggcgccccgccu

SEQ ID NO: 38684 - RNA, 22 nt, Homo sapiens
ggcagagagucagagcgcggau

SEQ ID NO: 38685 - RNA, 21 nt, Homo sapiens
gcaagcccagaccgcaaaaag

SEQ ID NO: 38686 - RNA, 22 nt, Homo sapiens
agugaauucuaccagugccaua

SEQ ID NO: 38687 - RNA, 23 nt, Homo sapiens
acauuuuucguuauugcucuuga

SEQ ID NO: 38688 - RNA, 22 nt, Homo sapiens
caacaaaaucacugaugcugga

SEQ ID NO: 38689 - RNA, 22 nt, Homo sapiens
auggcaguggaguuagugauug

SEQ ID NO: 38690 - RNA, 22 nt, Homo sapiens
auaaggauuuuuaggggcauua

SEQ ID NO: 38691 - RNA, 22 nt, Homo sapiens
uauucaggaacauauugcaaaa

SEQ ID NO: 38692 - RNA, 21 nt, Homo sapiens
ugacugcagagcaaaagacac

SEQ ID NO: 38693 - RNA, 22 nt, Homo sapiens
gcacacaauaaauguuugcuga

SEQ ID NO: 38694 - RNA, 22 nt, Homo sapiens
aaaguaacugcaguuuuugcua

SEQ ID NO: 38695 - RNA, 20 nt, Homo sapiens
acaaugagaacccauggucu

SEQ ID NO: 38696 - RNA, 22 nt, Homo sapiens
guccaaaguuggggugcugguu

SEQ ID NO: 38697 - RNA, 23 nt, Homo sapiens
gggagugaagacacggagccaga

SEQ ID NO: 38698 - RNA, 22 nt, Homo sapiens
cacugguacaaggguugggaga

SEQ ID NO: 38699 - RNA, 23 nt, Homo sapiens
aggaacagcagcagcccgggccg

SEQ ID NO: 38700 - RNA, 21 nt, Homo sapiens
gaccaaucgccguccccgccg

SEQ ID NO: 38701 - RNA, 22 nt, Homo sapiens
uccacauggaguugcuguuaca

SEQ ID NO: 38702 - RNA, 22 nt, Homo sapiens
ucagaccgagacaagugcaaug

SEQ ID NO: 38703 - RNA, 22 nt, Homo sapiens
agcugaguguaggauguuuaca

SEQ ID NO: 38704 - RNA, 23 nt, Homo sapiens
aaagucucgcucucugccccuca

SEQ ID NO: 38705 - RNA, 22 nt, Homo sapiens
ugcuguuagcccuagccccgca

SEQ ID NO: 38706 - RNA, 21 nt, Homo sapiens
cugaggagagaggaggugggg

SEQ ID NO: 38707 - RNA, 22 nt, Homo sapiens
cugggggcggcacaggggcuca

SEQ ID NO: 38708 - RNA, 23 nt, Homo sapiens
cugugggagggcaguggugagag

SEQ ID NO: 38709 - RNA, 22 nt, Homo sapiens
ccacacacuuccuuacauucca

SEQ ID NO: 38710 - RNA, 22 nt, Homo sapiens
ggagauggagccagggcccuaa

SEQ ID NO: 38711 - RNA, 23 nt, Homo sapiens
aggaacagcagcagcccgggccg

SEQ ID NO: 38712 - RNA, 22 nt, Homo sapiens
ucaggaacugccuuucucucca

SEQ ID NO: 38713 - RNA, 22 nt, Homo sapiens
ucaggaacugccuuucucucca

SEQ ID NO: 38714 - RNA, 21 nt, Homo sapiens
acaggauugagggggggcccu

SEQ ID NO: 38715 - RNA, 23 nt, Homo sapiens
augcaaaguugcucggguaaccu

SEQ ID NO: 38716 - RNA, 22 nt, Homo sapiens
aagagggagacccaggcucgga

SEQ ID NO: 38717 - RNA, 23 nt, Homo sapiens
uguaggcuggggauaaaugaaua

SEQ ID NO: 38718 - RNA, 21 nt, Homo sapiens
aagggucaguaagcacccgcg

SEQ ID NO: 38719 - RNA, 20 nt, Homo sapiens
uacugcuuccacagcucccc

SEQ ID NO: 38720 - RNA, 23 nt, Homo sapiens
gcacaugugcacacagccgggug

SEQ ID NO: 38721 - RNA, 22 nt, Homo sapiens
acacacccacgcgagccggaaa

SEQ ID NO: 38722 - RNA, 24 nt, Homo sapiens
ucagagcauguguuuaaucaggcu

SEQ ID NO: 38723 - RNA, 22 nt, Homo sapiens
gugggguggguggucaggccga

SEQ ID NO: 38724 - RNA, 18 nt, Homo sapiens
aucacauucaccucccug

SEQ ID NO: 38725 - RNA, 21 nt, Homo sapiens
gaccaaucgccguccccgccg

SEQ ID NO: 38726 - RNA, 22 nt, Homo sapiens
ugacgaugacaacgaugacgua

SEQ ID NO: 38727 - RNA, 22 nt, Homo sapiens
gcggucccgcggcgccccgccu

SEQ ID NO: 38728 - RNA, 22 nt, Homo sapiens
ugcuguuagcccuagccccgca

SEQ ID NO: 38729 - RNA, 22 nt, Homo sapiens
gcugaggcuguggggcuggagu

SEQ ID NO: 38730 - RNA, 17 nt, Homo sapiens
ggguggcagcgguggga

SEQ ID NO: 38731 - RNA, 22 nt, Homo sapiens
ccaucuuuaccagacaguguua

SEQ ID NO: 38732 - RNA, 21 nt, Homo sapiens
acuagacugugagcuccucga

SEQ ID NO: 38733 - RNA, 23 nt, Homo sapiens
aggaacagcagcagcccgggccg

SEQ ID NO: 38734 - RNA, 22 nt, Homo sapiens
acaucguuaccagacaguguua

SEQ ID NO: 38735 - RNA, 21 nt, Homo sapiens
aagugucagacacgguggugg

SEQ ID NO: 38736 - RNA, 22 nt, Homo sapiens
cuguuccugcugaacugagcca

SEQ ID NO: 38737 - RNA, 21 nt, Homo sapiens
ucaaucacagauagcaccccu

SEQ ID NO: 38738 - RNA, 23 nt, Homo sapiens
cacugugggcccucuccgcacca

SEQ ID NO: 38739 - RNA, 20 nt, Homo sapiens
uacugcuuccacagcucccc

SEQ ID NO: 38740 - RNA, 22 nt, Homo sapiens
aacagcacaaacuacuaccuca

SEQ ID NO: 38741 - RNA, 18 nt, Homo sapiens
aucacauucaccucccug

SEQ ID NO: 38742 - RNA, 22 nt, Homo sapiens
ucgcccucucaacccagcuuuu

SEQ ID NO: 38743 - RNA, 22 nt, Homo sapiens
uugcccucucaacccagcuuuu

SEQ ID NO: 38744 - RNA, 20 nt, Homo sapiens
acccucucaacccagcuuuu

SEQ ID NO: 38745 - RNA, 19 nt, Homo sapiens
uccucucaacccagcuuuu

SEQ ID NO: 38746 - RNA, 19 nt, Homo sapiens
guccugaauuccgcagccu

SEQ ID NO: 38747 - RNA, 22 nt, Homo sapiens
gauccgagcaccggggaccccc

SEQ ID NO: 38748 - RNA, 19 nt, Homo sapiens
gcucuaagaaagccacacu

SEQ ID NO: 38749 - RNA, 21 nt, Homo sapiens
gaaggaagugagugcagccac

SEQ ID NO: 38750 - RNA, 21 nt, Homo sapiens
guccugagagcgcugccuccu

SEQ ID NO: 38751 - RNA, 22 nt, Homo sapiens
ugcuguuagcccuagccccgca

SEQ ID NO: 38752 - RNA, 23 nt, Homo sapiens
gcacaugugcacacagccgggug

SEQ ID NO: 38753 - RNA, 22 nt, Homo sapiens
ucccucacacagaauuccagaa

SEQ ID NO: 38754 - RNA, 22 nt, Homo sapiens
augcuuuuugggguaagggcuu

SEQ ID NO: 38755 - RNA, 23 nt, Homo sapiens
aggaacagcagcagcccgggccg

SEQ ID NO: 38756 - RNA, 21 nt, Homo sapiens
gaccaaucgccguccccgccg

SEQ ID NO: 38757 - RNA, 23 nt, Homo sapiens
ggacauuguuucagugcccaagu

SEQ ID NO: 38758 - RNA, 22 nt, Homo sapiens
gcggucccgcggcgccccgccu

SEQ ID NO: 38759 - RNA, 23 nt, Homo sapiens
cuccagccccuccagggcuuccu

SEQ ID NO: 38760 - RNA, 22 nt, Homo sapiens
ugcuguuagcccuagccccgca

SEQ ID NO: 38761 - RNA, 22 nt, Homo sapiens
gcugaggcuguggggcuggagu

SEQ ID NO: 38762 - RNA, 20 nt, Homo sapiens
cccugcgccaucuccucuac

SEQ ID NO: 38763 - RNA, 20 nt, Homo sapiens
gcaagacaucacaagacucu

SEQ ID NO: 38764 - RNA, 22 nt, Homo sapiens
ggcagagagucagagcgcggau

SEQ ID NO: 38765 - RNA, 22 nt, Homo sapiens
aacccauggaauucaguucuca

SEQ ID NO: 38766 - RNA, 23 nt, Homo sapiens
gggagugaagacacggagccaga

SEQ ID NO: 38767 - RNA, 23 nt, Homo sapiens
cuaucugcacuagaugcaccuua

SEQ ID NO: 38768 - RNA, 22 nt, Homo sapiens
cggugagcacccggccccugcg

SEQ ID NO: 38769 - RNA, 20 nt, Homo sapiens
uucccaugcccuauaccucu

SEQ ID NO: 38770 - RNA, 22 nt, Homo sapiens
caccugauaaaacugagguaua

SEQ ID NO: 38771 - RNA, 20 nt, Homo sapiens
uacugcuuccacagcucccc

SEQ ID NO: 38772 - RNA, 18 nt, Homo sapiens
gaaaugagggccagcuga

SEQ ID NO: 38773 - RNA, 21 nt, Homo sapiens
cugggggacggagcagaagga

SEQ ID NO: 38774 - RNA, 23 nt, Homo sapiens
gggagugaagacacggagccaga

SEQ ID NO: 38775 - RNA, 23 nt, Homo sapiens
gggagugaagacacggagccaga

SEQ ID NO: 38776 - RNA, 22 nt, Homo sapiens
ucagaccgagacaagugcaaug

SEQ ID NO: 38777 - RNA, 22 nt, Homo sapiens
aggaaaccagcaaguguugacg

SEQ ID NO: 38778 - RNA, 22 nt, Homo sapiens
gugauugccacucuccugagua

SEQ ID NO: 38779 - RNA, 21 nt, Homo sapiens
cucacucagauggccaacuca

SEQ ID NO: 38780 - RNA, 21 nt, Homo sapiens
caucaccuuccuucuccucca

SEQ ID NO: 38781 - RNA, 22 nt, Homo sapiens
gcugaggcuguggggcuggagu

SEQ ID NO: 38782 - RNA, 23 nt, Homo sapiens
accacaggagucugagcauuuga

SEQ ID NO: 38783 - RNA, 22 nt, Homo sapiens
cuggagagacaaggggaagagg

SEQ ID NO: 38784 - RNA, 22 nt, Homo sapiens
aggcauaggaugacaaagggaa

SEQ ID NO: 38785 - RNA, 22 nt, Homo sapiens
aggcgaaggaugacaaagggaa

SEQ ID NO: 38786 - RNA, 22 nt, Homo sapiens
ggaccuaaaaauacaaugcaua

SEQ ID NO: 38787 - RNA, 22 nt, Homo sapiens
caagacacauuuggagagggac

SEQ ID NO: 38788 - RNA, 21 nt, Homo sapiens
gaaggaagugagugcagccac

SEQ ID NO: 38789 - RNA, 22 nt, Homo sapiens
ggagauggagccagggcccuaa

SEQ ID NO: 38790 - RNA, 18 nt, Homo sapiens
auucaaucuacugccuca

SEQ ID NO: 38791 - RNA, 23 nt, Homo sapiens
cuaacugcacuagaugcaccuua

SEQ ID NO: 38792 - RNA, 21 nt, Homo sapiens
aggcggcaggcacaggacugg

SEQ ID NO: 38793 - RNA, 22 nt, Homo sapiens
uggcagcagcggagggggcaga

SEQ ID NO: 38794 - RNA, 20 nt, Homo sapiens
cccgccgcgucgcccugggg

SEQ ID NO: 38795 - RNA, 22 nt, Homo sapiens
uuaacagcuaagcacccuaauc

SEQ ID NO: 38796 - RNA, 22 nt, Homo sapiens
uuaacagcuaagcacccuaauc

SEQ ID NO: 38797 - RNA, 20 nt, Homo sapiens
ccagcagcaccuggggcagu

SEQ ID NO: 38798 - RNA, 22 nt, Homo sapiens
acggaagggcagagagggccag

SEQ ID NO: 38799 - RNA, 21 nt, Homo sapiens
auccuguacugagcugccccg

SEQ ID NO: 38800 - RNA, 19 nt, Homo sapiens
ucagcaguaccagccuaga

SEQ ID NO: 38801 - RNA, 20 nt, Homo sapiens
uccccacagacccagagccg

SEQ ID NO: 38802 - RNA, 21 nt, Homo sapiens
ggggagcgggggcccugccuu

SEQ ID NO: 38803 - RNA, 21 nt, Homo sapiens
ccccucccagccucccugcca

SEQ ID NO: 38804 - RNA, 27 nt, Homo sapiens
uuuagcacagugcuuauacaagaaggu

SEQ ID NO: 38805 - RNA, 17 nt, Homo sapiens
gggagaggaggaggcga

SEQ ID NO: 38806 - RNA, 18 nt, Homo sapiens
cagcagccuccuucucaa

SEQ ID NO: 38807 - RNA, 18 nt, Homo sapiens
aucacauucaccucccug

SEQ ID NO: 38808 - RNA, 23 nt, Homo sapiens
gggagugaagacacggagccaga

SEQ ID NO: 38809 - RNA, 22 nt, Homo sapiens
uggcagcagcggagggggcaga

SEQ ID NO: 38810 - RNA, 20 nt, Homo sapiens
ccagcagcaccuggggcagu

SEQ ID NO: 38811 - RNA, 22 nt, Homo sapiens
auaaggauuuuuaggggcauua

SEQ ID NO: 38812 - RNA, 23 nt, Homo sapiens
aaagucucgcucucugccccuca

SEQ ID NO: 38813 - RNA, 21 nt, Homo sapiens
auccuguacugagcugccccg

SEQ ID NO: 38814 - RNA, 20 nt, Homo sapiens
aggggccucagccuccuggu

SEQ ID NO: 38815 - RNA, 21 nt, Homo sapiens
ccccucccagccucccugcca

SEQ ID NO: 38816 - RNA, 22 nt, Homo sapiens
cacgaccgacgccacgccgagu

SEQ ID NO: 38817 - RNA, 22 nt, Homo sapiens
ggagcccgcgccccgcgccgag

SEQ ID NO: 38818 - RNA, 21 nt, Homo sapiens
gaccaaucgccguccccgccg

SEQ ID NO: 38819 - RNA, 21 nt, Homo sapiens
gaccaaucgccguccccgccg

SEQ ID NO: 38820 - RNA, 22 nt, Homo sapiens
gcggucccgcggcgccccgccu

SEQ ID NO: 38821 - RNA, 22 nt, Homo sapiens
gcggucccgcggcgccccgccu

SEQ ID NO: 38822 - RNA, 22 nt, Homo sapiens
ugcuguuagcccuagccccgca

SEQ ID NO: 38823 - RNA, 22 nt, Homo sapiens
ugcuguuagcccuagccccgca

SEQ ID NO: 38824 - RNA, 21 nt, Homo sapiens
caucaccuuccuucuccucca

SEQ ID NO: 38825 - RNA, 21 nt, Homo sapiens
cucccccacugcagcuggcac

SEQ ID NO: 38826 - RNA, 18 nt, Homo sapiens
aucacauucaccucccug

SEQ ID NO: 38827 - RNA, 23 nt, Homo sapiens
gggagugaagacacggagccaga

SEQ ID NO: 38828 - RNA, 21 nt, Homo sapiens
gaccaaucgccguccccgccg

SEQ ID NO: 38829 - RNA, 23 nt, Homo sapiens
cagcugcuuuugggauuccguug

SEQ ID NO: 38830 - RNA, 22 nt, Homo sapiens
uccacauggaguugcuguuaca

SEQ ID NO: 38831 - RNA, 22 nt, Homo sapiens
uagucaagugaagcagugggag

SEQ ID NO: 38832 - RNA, 23 nt, Homo sapiens
uccaaucaguuccugaugcagua

SEQ ID NO: 38833 - RNA, 22 nt, Homo sapiens
acaguucuucaacuggcagcuu

SEQ ID NO: 38834 - RNA, 22 nt, Homo sapiens
agcugaguguaggauguuuaca

SEQ ID NO: 38835 - RNA, 22 nt, Homo sapiens
caacaaaaucacugaugcugga

SEQ ID NO: 38836 - RNA, 22 nt, Homo sapiens
acaaccagcuaagacacugcca

SEQ ID NO: 38837 - RNA, 23 nt, Homo sapiens
gcaaucagcuaacuacacugccu

SEQ ID NO: 38838 - RNA, 22 nt, Homo sapiens
accagcuaacaauacacugcca

SEQ ID NO: 38839 - RNA, 22 nt, Homo sapiens
gccagcuaacaauacacugccu

SEQ ID NO: 38840 - RNA, 22 nt, Homo sapiens
ugcaagccuugggugugggagg

SEQ ID NO: 38841 - RNA, 19 nt, Homo sapiens
auuuugguacagcagcuca

SEQ ID NO: 38842 - RNA, 25 nt, Homo sapiens
acggagcugucccaacaccaccccu

SEQ ID NO: 38843 - RNA, 21 nt, Homo sapiens
gcuccaaccucagcagacugu

SEQ ID NO: 38844 - RNA, 22 nt, Homo sapiens
gcggucccgcggcgccccgccu

SEQ ID NO: 38845 - RNA, 22 nt, Homo sapiens
uauccacuacaccccgcugccu

SEQ ID NO: 38846 - RNA, 20 nt, Homo sapiens
uacugcuuccacagcucccc

SEQ ID NO: 38847 - RNA, 22 nt, Homo sapiens
cugggggcggcacaggggcuca

SEQ ID NO: 38848 - RNA, 22 nt, Homo sapiens
uccggggacgaacgggacgggu

SEQ ID NO: 38849 - RNA, 25 nt, Homo sapiens
cagcgucugccggaacccguuccca

SEQ ID NO: 38850 - RNA, 22 nt, Homo sapiens
cagaaagugcuucccucuagag

SEQ ID NO: 38851 - RNA, 25 nt, Homo sapiens
agcuagucaagcgcgguuguggggg

SEQ ID NO: 38852 - RNA, 22 nt, Homo sapiens
aagcgguuuaccaucccacaua

SEQ ID NO: 38853 - RNA, 22 nt, Homo sapiens
aaagugcuucuuaccuccagau

SEQ ID NO: 38854 - RNA, 23 nt, Homo sapiens
acagaaagugcuucccucaagag

SEQ ID NO: 38855 - RNA, 21 nt, Homo sapiens
ggacuauagaacuuucccccu

SEQ ID NO: 38856 - RNA, 21 nt, Homo sapiens
acuccaaagggaagcgccuuc

SEQ ID NO: 38857 - RNA, 21 nt, Homo sapiens
ggcugucaauucauaggucag

SEQ ID NO: 38858 - RNA, 22 nt, Homo sapiens
uccacauggaguugcuguuaca

SEQ ID NO: 38859 - RNA, 21 nt, Homo sapiens
acaggccaucuguguuauauu

SEQ ID NO: 38860 - RNA, 22 nt, Homo sapiens
gcugccguauaugugaugucac

SEQ ID NO: 38861 - RNA, 20 nt, Homo sapiens
guguguauacauuuauacau

SEQ ID NO: 38862 - RNA, 23 nt, Homo sapiens
aaucgcgguuuauaccaaaugaa

SEQ ID NO: 38863 - RNA, 21 nt, Homo sapiens
acuagcuuauacauaaaauua

SEQ ID NO: 38864 - RNA, 23 nt, Homo sapiens
acaaggaugaaucuuuguuacug

SEQ ID NO: 38865 - RNA, 21 nt, Homo sapiens
agggcucaucuugguccugca

SEQ ID NO: 38866 - RNA, 22 nt, Homo sapiens
acccuuaucaguucuccgucca

SEQ ID NO: 38867 - RNA, 22 nt, Homo sapiens
ucaggaacugccuuucucucca

SEQ ID NO: 38868 - RNA, 22 nt, Homo sapiens
ucaucucgcccgcaaagaccca

SEQ ID NO: 38869 - RNA, 22 nt, Homo sapiens
ucgcccucucaacccagcuuuu

SEQ ID NO: 38870 - RNA, 22 nt, Homo sapiens
uugcccucucaacccagcuuuu

SEQ ID NO: 38871 - RNA, 20 nt, Homo sapiens
acccucucaacccagcuuuu

SEQ ID NO: 38872 - RNA, 19 nt, Homo sapiens
uccucucaacccagcuuuu

SEQ ID NO: 38873 - RNA, 23 nt, Homo sapiens
aaaucagaaucacaccuggggga

SEQ ID NO: 38874 - RNA, 22 nt, Homo sapiens
agcaaaauccgcaaguacuuuu

SEQ ID NO: 38875 - RNA, 24 nt, Homo sapiens
acgcagagcccgaaagcccccagu

SEQ ID NO: 38876 - RNA, 22 nt, Homo sapiens
caagacacauuuggagagggac

SEQ ID NO: 38877 - RNA, 20 nt, Homo sapiens
aggggccucagccuccuggu

SEQ ID NO: 38878 - RNA, 23 nt, Homo sapiens
cccaacagacauggcgguacuca

SEQ ID NO: 38879 - RNA, 21 nt, Homo sapiens
aaagugucagauacggugugg

SEQ ID NO: 38880 - RNA, 23 nt, Homo sapiens
gcgcccaauuaaugucuguugau

SEQ ID NO: 38881 - RNA, 22 nt, Homo sapiens
ucaguuuccucugcaaacaguu

SEQ ID NO: 38882 - RNA, 23 nt, Homo sapiens
ccuucucagaaaggugaaauuua

SEQ ID NO: 38883 - RNA, 19 nt, Homo sapiens
agaaaccccagcagagaca

SEQ ID NO: 38884 - RNA, 21 nt, Homo sapiens
ccccucccagccucccugcca

SEQ ID NO: 38885 - RNA, 18 nt, Homo sapiens
aucacauucaccucccug

SEQ ID NO: 38886 - RNA, 21 nt, Homo sapiens
acuagacugugagcuccucga

SEQ ID NO: 38887 - RNA, 22 nt, Homo sapiens
cacaaaccauuaugugcugcua

SEQ ID NO: 38888 - RNA, 22 nt, Homo sapiens
uguaaaccaugaugugcugcua

SEQ ID NO: 38889 - RNA, 22 nt, Homo sapiens
cgccaauauuuacgugcugcua

SEQ ID NO: 38890 - RNA, 21 nt, Homo sapiens
gccaauauuucugugcugcua

SEQ ID NO: 38891 - RNA, 22 nt, Homo sapiens
ucaacaucagucugauaagcua

SEQ ID NO: 38892 - RNA, 22 nt, Homo sapiens
acggaagggcagagagggccag

SEQ ID NO: 38893 - RNA, 22 nt, Homo sapiens
uucaaaacaugaauugcugcug

SEQ ID NO: 38894 - RNA, 21 nt, Homo sapiens
acaaaccacagugugcugcug

SEQ ID NO: 38895 - RNA, 18 nt, Homo sapiens
acccucugaaaggaagca

SEQ ID NO: 38896 - RNA, 22 nt, Homo sapiens
aaagugcuucuuaccuccagau

SEQ ID NO: 38897 - RNA, 21 nt, Homo sapiens
aguucucccaacguaaaccca

SEQ ID NO: 38898 - RNA, 21 nt, Homo sapiens
caucaccuuccuucuccucca

SEQ ID NO: 38899 - RNA, 23 nt, Homo sapiens
uggcccugacacgugguacugga

SEQ ID NO: 38900 - RNA, 21 nt, Homo sapiens
ggggagcgggggcccugccuu

SEQ ID NO: 38901 - RNA, 22 nt, Homo sapiens
cacuccuauaauugauccaguu

SEQ ID NO: 38902 - RNA, 18 nt, Homo sapiens
uggcgccugaacagggac

SEQ ID NO: 38903 - RNA, 18 nt, Homo sapiens
aucacauucaccucccug

SEQ ID NO: 38904 - RNA, 22 nt, Homo sapiens
gaaccuaucuccccucuggacc

SEQ ID NO: 38905 - RNA, 22 nt, Homo sapiens
acaaccagcuaagacacugcca

SEQ ID NO: 38906 - RNA, 22 nt, Homo sapiens
cucauauuacaaugagcucauc

SEQ ID NO: 38907 - RNA, 22 nt, Homo sapiens
gcaaaaguaauugcagugugug

SEQ ID NO: 38908 - RNA, 21 nt, Homo sapiens
guccugagagcgcugccuccu

SEQ ID NO: 38909 - RNA, 23 nt, Homo sapiens
uggcccugacacgugguacugga

SEQ ID NO: 38910 - RNA, 20 nt, Homo sapiens
cccugcgccaucuccucuac

SEQ ID NO: 38911 - RNA, 19 nt, Homo sapiens
ccaccucccgaguccucac

SEQ ID NO: 38912 - RNA, 25 nt, Homo sapiens
cagcgucugccggaacccguuccca

SEQ ID NO: 38913 - RNA, 23 nt, Homo sapiens
gggagugaagacacggagccaga

SEQ ID NO: 38914 - RNA, 22 nt, Homo sapiens
agcccaaaaggagaauucuuug

SEQ ID NO: 38915 - RNA, 25 nt, Homo sapiens
agcuagucaagcgcgguuguggggg

SEQ ID NO: 38916 - RNA, 22 nt, Homo sapiens
cacucagcggccguuuccccaa

SEQ ID NO: 38917 - RNA, 23 nt, Homo sapiens
cggcucugucgucgaggcgcuca

SEQ ID NO: 38918 - RNA, 25 nt, Homo sapiens
acggagcugucccaacaccaccccu

SEQ ID NO: 38919 - RNA, 20 nt, Homo sapiens
uacugcuuccacagcucccc

SEQ ID NO: 38920 - RNA, 23 nt, Homo sapiens
cacaaauucggaucuacagggua

SEQ ID NO: 38921 - RNA, 23 nt, Homo sapiens
cacaaauucgguucuacagggua

SEQ ID NO: 38922 - RNA, 22 nt, Homo sapiens
acuccaacagggccgcgucucc

SEQ ID NO: 38923 - RNA, 22 nt, Homo sapiens
agucuucacaacagcccugugu

SEQ ID NO: 38924 - RNA, 23 nt, Homo sapiens
aaaucagaaucacaccuggggga

SEQ ID NO: 38925 - RNA, 21 nt, Homo sapiens
ggacuauagaacuuucccccu

SEQ ID NO: 38926 - RNA, 24 nt, Homo sapiens
acgcagagcccgaaagcccccagu

SEQ ID NO: 38927 - RNA, 20 nt, Homo sapiens
aggggccucagccuccuggu

SEQ ID NO: 38928 - RNA, 21 nt, Homo sapiens
cacaaccucaguguuuccagg

SEQ ID NO: 38929 - RNA, 20 nt, Homo sapiens
uacugcuuccacagcucccc

SEQ ID NO: 38930 - RNA, 22 nt, Homo sapiens
cuggagagacaaggggaagagg

SEQ ID NO: 38931 - RNA, 22 nt, Homo sapiens
ucagaccgagacaagugcaaug

SEQ ID NO: 38932 - RNA, 18 nt, Homo sapiens
acccucugaaaggaagca

SEQ ID NO: 38933 - RNA, 22 nt, Homo sapiens
aaagugcuucuuaccuccagau

SEQ ID NO: 38934 - RNA, 23 nt, Homo sapiens
gucagaccccgagggguccucgc

SEQ ID NO: 38935 - RNA, 22 nt, Homo sapiens
gccaccuucaaaugggaagucu

SEQ ID NO: 38936 - RNA, 20 nt, Homo sapiens
cccugcgccaucuccucuac

SEQ ID NO: 38937 - RNA, 20 nt, Homo sapiens
gcaagacaucacaagacucu

SEQ ID NO: 38938 - RNA, 17 nt, Homo sapiens
gggagaggaggaggcga

SEQ ID NO: 38939 - RNA, 18 nt, Homo sapiens
aucacauucaccucccug

SEQ ID NO: 38940 - RNA, 23 nt, Homo sapiens
aggaacagcagcagcccgggccg

SEQ ID NO: 38941 - RNA, 23 nt, Homo sapiens
aggaacagcagcagcccgggccg

SEQ ID NO: 38942 - RNA, 21 nt, Homo sapiens
gaccaaucgccguccccgccg

SEQ ID NO: 38943 - RNA, 21 nt, Homo sapiens
acaggauugagggggggcccu

SEQ ID NO: 38944 - RNA, 23 nt, Homo sapiens
aaaucagaaucacaccuggggga

SEQ ID NO: 38945 - RNA, 23 nt, Homo sapiens
aaagucucgcucucugccccuca

SEQ ID NO: 38946 - RNA, 22 nt, Homo sapiens
aggaaaccagcaaguguugacg

SEQ ID NO: 38947 - RNA, 22 nt, Homo sapiens
cucagagcagacgugguucuca

SEQ ID NO: 38948 - RNA, 24 nt, Homo sapiens
acgcagagcccgaaagcccccagu

SEQ ID NO: 38949 - RNA, 23 nt, Homo sapiens
ccuagagagggugagaaccugcc

SEQ ID NO: 38950 - RNA, 22 nt, Homo sapiens
ugcuguuagcccuagccccgca

SEQ ID NO: 38951 - RNA, 23 nt, Homo sapiens
cuaccugcacuguaagcacuuuu

SEQ ID NO: 38952 - RNA, 26 nt, Homo sapiens
aaccaucucauacaaaccaacuacuu

SEQ ID NO: 38953 - RNA, 25 nt, Homo sapiens
aagaaagagucuugcuuugucgccc

SEQ ID NO: 38954 - RNA, 22 nt, Homo sapiens
cgaaggcaacacggauaaccua

SEQ ID NO: 38955 - RNA, 22 nt, Homo sapiens
uagucaagugaagcagugggag

SEQ ID NO: 38956 - RNA, 22 nt, Homo sapiens
uaaccaaugugcagacuacugu

SEQ ID NO: 38957 - RNA, 22 nt, Homo sapiens
uaaccaaugugcagacuacugu

SEQ ID NO: 38958 - RNA, 21 nt, Homo sapiens
acccaguagccagauguagcu

SEQ ID NO: 38959 - RNA, 22 nt, Homo sapiens
agccacaaucaccuucugaucu

SEQ ID NO: 38960 - RNA, 22 nt, Homo sapiens
agagaggagagccguguaugac

SEQ ID NO: 38961 - RNA, 22 nt, Homo sapiens
aacuggaugucccuguaugauu

SEQ ID NO: 38962 - RNA, 21 nt, Homo sapiens
aucuuugauuuucaguaguuu

SEQ ID NO: 38963 - RNA, 27 nt, Homo sapiens
uuuagcacagugcuuauacaagaaggu

SEQ ID NO: 38964 - RNA, 23 nt, Homo sapiens
gggagugaagacacggagccaga

SEQ ID NO: 38965 - RNA, 22 nt, Homo sapiens
ucaggaacugccuuucucucca

SEQ ID NO: 38966 - RNA, 23 nt, Homo sapiens
gaacagguagucugaacacuggg

SEQ ID NO: 38967 - RNA, 23 nt, Homo sapiens
gaacagauagucuaaacacuggg

SEQ ID NO: 38968 - RNA, 21 nt, Homo sapiens
aucugcacugucagcacuuua

SEQ ID NO: 38969 - RNA, 23 nt, Homo sapiens
gcuuugacaauaucauugcacug

SEQ ID NO: 38970 - RNA, 23 nt, Homo sapiens
acgggugcgauuucugugugaga

SEQ ID NO: 38971 - RNA, 22 nt, Homo sapiens
acacaccaaggauaauuucucc

SEQ ID NO: 38972 - RNA, 22 nt, Homo sapiens
caagacacauuuggagagggac

SEQ ID NO: 38973 - RNA, 20 nt, Homo sapiens
cccugcgccaucuccucuac

SEQ ID NO: 38974 - RNA, 22 nt, Homo sapiens
cacauggccaaaacagagaaga

SEQ ID NO: 38975 - RNA, 21 nt, Homo sapiens
agcgccuuuggcagcuagagu

SEQ ID NO: 38976 - RNA, 23 nt, Homo sapiens
aaucuacuuucuuugcucauccu

SEQ ID NO: 38977 - RNA, 22 nt, Homo sapiens
aaccacuuucuuugcucauccg

SEQ ID NO: 38978 - RNA, 22 nt, Homo sapiens
agaaaaugccccucaguuuuga

SEQ ID NO: 38979 - RNA, 23 nt, Homo sapiens
cagcugcuuuugggauuccguug

SEQ ID NO: 38980 - RNA, 22 nt, Homo sapiens
acaguucuucaacuggcagcuu

SEQ ID NO: 38981 - RNA, 21 nt, Homo sapiens
ugcaaugcaacuacaaugcac

SEQ ID NO: 38982 - RNA, 22 nt, Homo sapiens
gagguuucccguguauguuuca

SEQ ID NO: 38983 - RNA, 22 nt, Homo sapiens
gcaaaaguaacugcaguuuugg

SEQ ID NO: 38984 - RNA, 21 nt, Homo sapiens
acaauccuagagcacaagaag

SEQ ID NO: 38985 - RNA, 24 nt, Homo sapiens
acgcgcaggccagagacccaggca

SEQ ID NO: 38986 - RNA, 23 nt, Homo sapiens
cuccagccccuccagggcuuccu

SEQ ID NO: 38987 - RNA, 22 nt, Homo sapiens
ugcucaauaaauacccguugaa

SEQ ID NO: 38988 - RNA, 23 nt, Homo sapiens
ucauagcccuguacaaugcugcu

SEQ ID NO: 38989 - RNA, 23 nt, Homo sapiens
ugauagcccuguacaaugcugcu

SEQ ID NO: 38990 - RNA, 21 nt, Homo sapiens
cugaggagagaggaggugggg

SEQ ID NO: 38991 - RNA, 17 nt, Homo sapiens
gggagaggaggaggcga

SEQ ID NO: 38992 - RNA, 22 nt, Homo sapiens
ucagaccgagacaagugcaaug

SEQ ID NO: 38993 - RNA, 23 nt, Homo sapiens
cuacuaaaacauggaagcacuua

SEQ ID NO: 38994 - RNA, 23 nt, Homo sapiens
acacucaaacauggaagcacuua

SEQ ID NO: 38995 - RNA, 22 nt, Homo sapiens
agcugaguguaggauguuuaca

SEQ ID NO: 38996 - RNA, 22 nt, Homo sapiens
uccagcaaagggaagcgcuuuc

SEQ ID NO: 38997 - RNA, 22 nt, Homo sapiens
accucuaaaggggagcgcuuug

SEQ ID NO: 38998 - RNA, 23 nt, Homo sapiens
acacucuaaagagaagcgcuuug

SEQ ID NO: 38999 - RNA, 21 nt, Homo sapiens
gcuccaaagggaagcgcuuug

SEQ ID NO: 39000 - RNA, 21 nt, Homo sapiens
cacucugaagggaagcgcuuu

SEQ ID NO: 39001 - RNA, 21 nt, Homo sapiens
ccucuaaagagaagcgcuuuc

SEQ ID NO: 39002 - RNA, 22 nt, Homo sapiens
uccucuuuucuuagagacucac

SEQ ID NO: 39003 - RNA, 22 nt, Homo sapiens
cacauggccaaaacagagaaga

SEQ ID NO: 39004 - RNA, 24 nt, Homo sapiens
acugcuggucuucagucagggcca

SEQ ID NO: 39005 - RNA, 22 nt, Homo sapiens
cacgaccgacgccacgccgagu

SEQ ID NO: 39006 - RNA, 17 nt, Homo sapiens
uggcgcccgaacaggga

SEQ ID NO: 39007 - RNA, 22 nt, Homo sapiens
acaguucuucaacuggcagcuu

SEQ ID NO: 39008 - RNA, 21 nt, Homo sapiens
ugcaaugcaacuacaaugcac

SEQ ID NO: 39009 - RNA, 22 nt, Homo sapiens
gauagagugcagaccagggucu

SEQ ID NO: 39010 - RNA, 22 nt, Homo sapiens
acaucaucgcauauugacacaa

SEQ ID NO: 39011 - RNA, 22 nt, Homo sapiens
acaguggucaucgagugacaca

SEQ ID NO: 39012 - RNA, 17 nt, Homo sapiens
gggagaggaggaggcga

SEQ ID NO: 39013 - RNA, 21 nt, Homo sapiens
cggggugcacgggcggagggc

SEQ ID NO: 39014 - RNA, 23 nt, Homo sapiens
aggaacagcagcagcccgggccg

SEQ ID NO: 39015 - RNA, 21 nt, Homo sapiens
gaccaaucgccguccccgccg

SEQ ID NO: 39016 - RNA, 22 nt, Homo sapiens
ucagaccgagacaagugcaaug

SEQ ID NO: 39017 - RNA, 23 nt, Homo sapiens
cggcucugucgucgaggcgcuca

SEQ ID NO: 39018 - RNA, 25 nt, Homo sapiens
accaacggaccuacuucccuccgcc

SEQ ID NO: 39019 - RNA, 22 nt, Homo sapiens
gcggucccgcggcgccccgccu

SEQ ID NO: 39020 - RNA, 18 nt, Homo sapiens
aucacauucaccucccug

SEQ ID NO: 39021 - RNA, 22 nt, Homo sapiens
aacccauggaauucaguucuca

SEQ ID NO: 39022 - RNA, 23 nt, Homo sapiens
gggagugaagacacggagccaga

SEQ ID NO: 39023 - RNA, 22 nt, Homo sapiens
aggcauaggaugacaaagggaa

SEQ ID NO: 39024 - RNA, 22 nt, Homo sapiens
aggcgaaggaugacaaagggaa

SEQ ID NO: 39025 - RNA, 22 nt, Homo sapiens
ucacauuugccugcagagauuu

SEQ ID NO: 39026 - RNA, 23 nt, Homo sapiens
gaaacccagcagacaauguagcu

SEQ ID NO: 39027 - RNA, 21 nt, Homo sapiens
gcagaacuuagccacugugaa

SEQ ID NO: 39028 - RNA, 23 nt, Homo sapiens
caugagugacgcccucuggagua

SEQ ID NO: 39029 - RNA, 21 nt, Homo sapiens
aguucucccaacguaaaccca

SEQ ID NO: 39030 - RNA, 21 nt, Homo sapiens
aguucucccaacguaaaccca

SEQ ID NO: 39031 - RNA, 21 nt, Homo sapiens
caucaccuuccuucuccucca

SEQ ID NO: 39032 - RNA, 22 nt, Homo sapiens
cacaaguucggaucuacggguu

SEQ ID NO: 39033 - RNA, 21 nt, Homo sapiens
ccccucccagccucccugcca

SEQ ID NO: 39034 - RNA, 21 nt, Homo sapiens
cagcgaaacaggcaaacggag

SEQ ID NO: 39035 - RNA, 22 nt, Homo sapiens
ggagcccgcgccccgcgccgag

SEQ ID NO: 39036 - RNA, 21 nt, Homo sapiens
gggcaucugggacgcgcagga

SEQ ID NO: 39037 - RNA, 18 nt, Homo sapiens
auucaaucuacugccuca

SEQ ID NO: 39038 - RNA, 23 nt, Homo sapiens
gaaacccagcagacaauguagcu

SEQ ID NO: 39039 - RNA, 22 nt, Homo sapiens
ccuggcacacaguagaccuuca

SEQ ID NO: 39040 - RNA, 19 nt, Homo sapiens
guugggaucacaggcgccc

SEQ ID NO: 39041 - RNA, 21 nt, Homo sapiens
guccugagagcgcugccuccu

SEQ ID NO: 39042 - RNA, 22 nt, Homo sapiens
ucaguggcucagguucguugca

SEQ ID NO: 39043 - RNA, 20 nt, Homo sapiens
uacugcuuccacagcucccc

SEQ ID NO: 39044 - RNA, 21 nt, Homo sapiens
ggggagcgggggcccugccuu

SEQ ID NO: 39045 - RNA, 22 nt, Homo sapiens
cacaagaucggaucuacggguu

SEQ ID NO: 39046 - RNA, 22 nt, Homo sapiens
cgcaaggucgguucuacgggug

SEQ ID NO: 39047 - RNA, 18 nt, Homo sapiens
aucacauucaccucccug

SEQ ID NO: 39048 - RNA, 18 nt, Homo sapiens
aucacauucaccucccug

SEQ ID NO: 39049 - RNA, 23 nt, Homo sapiens
gggagugaagacacggagccaga

SEQ ID NO: 39050 - RNA, 22 nt, Homo sapiens
ucaggaacugccuuucucucca

SEQ ID NO: 39051 - RNA, 22 nt, Homo sapiens
acugccugucugugccugcugu

SEQ ID NO: 39052 - RNA, 22 nt, Homo sapiens
agcugaguguaggauguuuaca

SEQ ID NO: 39053 - RNA, 22 nt, Homo sapiens
accagguuccaccccagcaggc

SEQ ID NO: 39054 - RNA, 22 nt, Homo sapiens
cugggggcggcacaggggcuca

SEQ ID NO: 39055 - RNA, 20 nt, Homo sapiens
cuggggaaaaggguggcacg

SEQ ID NO: 39056 - RNA, 22 nt, Homo sapiens
cucaauagacugugagcuccuu

SEQ ID NO: 39057 - RNA, 22 nt, Homo sapiens
ccucauggaaggguuccccacu

SEQ ID NO: 39058 - RNA, 23 nt, Homo sapiens
cccagcuagauuguaagcuccuu

SEQ ID NO: 39059 - RNA, 21 nt, Homo sapiens
caucaccuuccuucuccucca

SEQ ID NO: 39060 - RNA, 22 nt, Homo sapiens
caaacaccauugucacacucca

SEQ ID NO: 39061 - RNA, 17 nt, Homo sapiens
gacagccucucccccac

SEQ ID NO: 39062 - RNA, 22 nt, Homo sapiens
agacaacaaugccaaccucaca

SEQ ID NO: 39063 - RNA, 22 nt, Homo sapiens
ucccucacacagaauuccagaa

SEQ ID NO: 39064 - RNA, 21 nt, Homo sapiens
acaggauugagggggggcccu

SEQ ID NO: 39065 - RNA, 22 nt, Homo sapiens
caacaaaaucacugaugcugga

SEQ ID NO: 39066 - RNA, 23 nt, Homo sapiens
aaaucagaaucacaccuggggga

SEQ ID NO: 39067 - RNA, 23 nt, Homo sapiens
acacucuaaagagaagcgcuuug

SEQ ID NO: 39068 - RNA, 21 nt, Homo sapiens
agaaaguacuucccucuggag

SEQ ID NO: 39069 - RNA, 21 nt, Homo sapiens
agaaagugcaucccucuggag

SEQ ID NO: 39070 - RNA, 21 nt, Homo sapiens
acugaucuagagaacacaaga

SEQ ID NO: 39071 - RNA, 20 nt, Homo sapiens
guuugauaaacugacacaac

SEQ ID NO: 39072 - RNA, 21 nt, Homo sapiens
ggacuauagaacuuucccccu

SEQ ID NO: 39073 - RNA, 24 nt, Homo sapiens
acgcagagcccgaaagcccccagu

SEQ ID NO: 39074 - RNA, 24 nt, Homo sapiens
gaggugacucuauccuaugucuuu

SEQ ID NO: 39075 - RNA, 23 nt, Homo sapiens
cuccagccccuccagggcuuccu

SEQ ID NO: 39076 - RNA, 20 nt, Homo sapiens
uccccacagacccagagccg

SEQ ID NO: 39077 - RNA, 21 nt, Homo sapiens
acuccaaagggaagcgccuuc

SEQ ID NO: 39078 - RNA, 22 nt, Homo sapiens
aggucucacuuuguugcccaga

SEQ ID NO: 39079 - RNA, 24 nt, Homo sapiens
acugcuggucuucagucagggcca

SEQ ID NO: 39080 - RNA, 22 nt, Homo sapiens
gcacaaaucuccagaccaccca

SEQ ID NO: 39081 - RNA, 22 nt, Homo sapiens
uucacacugcaugcucugggua

SEQ ID NO: 39082 - RNA, 20 nt, Homo sapiens
cccgccgcgucgcccugggg

SEQ ID NO: 39083 - RNA, 22 nt, Homo sapiens
gaaccuaucuccccucuggacc

SEQ ID NO: 39084 - RNA, 21 nt, Homo sapiens
aagugucagacacgguggugg

SEQ ID NO: 39085 - RNA, 24 nt, Homo sapiens
acucacaccuagguuccaaggauu

SEQ ID NO: 39086 - RNA, 21 nt, Homo sapiens
ccuucugacuccaaguccagu

SEQ ID NO: 39087 - RNA, 22 nt, Homo sapiens
gccuucugacccuaaguccagu

SEQ ID NO: 39088 - RNA, 21 nt, Homo sapiens
gaccaagaaauagccuuucaa

SEQ ID NO: 39089 - RNA, 25 nt, Homo sapiens
aaggagcucagaagcccugcccagc

SEQ ID NO: 39090 - RNA, 24 nt, Homo sapiens
acgcgcaggccagagacccaggca

SEQ ID NO: 39091 - RNA, 22 nt, Homo sapiens
ccucaggcacggccgggccacc

SEQ ID NO: 39092 - RNA, 22 nt, Homo sapiens
cugggggcggcacaggggcuca

SEQ ID NO: 39093 - RNA, 22 nt, Homo sapiens
caaacaccauugucacacucca

SEQ ID NO: 39094 - RNA, 22 nt, Homo sapiens
ucaggaacugccuuucucucca

SEQ ID NO: 39095 - RNA, 21 nt, Homo sapiens
gaccaaucgccguccccgccg

SEQ ID NO: 39096 - RNA, 22 nt, Homo sapiens
cagaagugggccgggcacaggg

SEQ ID NO: 39097 - RNA, 22 nt, Homo sapiens
acugggacuuuguaggccaguu

SEQ ID NO: 39098 - RNA, 22 nt, Homo sapiens
agcgggacuuugagggccaguu

SEQ ID NO: 39099 - RNA, 22 nt, Homo sapiens
accagcuaacaauacacugcca

SEQ ID NO: 39100 - RNA, 22 nt, Homo sapiens
agccacaaucaccuucugaucu

SEQ ID NO: 39101 - RNA, 23 nt, Homo sapiens
ucaccaaaacauggaagcacuua

SEQ ID NO: 39102 - RNA, 22 nt, Homo sapiens
acggaagggcagagagggccag

SEQ ID NO: 39103 - RNA, 22 nt, Homo sapiens
aguccagauucugugcccacca

SEQ ID NO: 39104 - RNA, 19 nt, Homo sapiens
auuuugguacagcagcuca

SEQ ID NO: 39105 - RNA, 22 nt, Homo sapiens
gguucaguuguucaaccaguua

SEQ ID NO: 39106 - RNA, 25 nt, Homo sapiens
acggagcugucccaacaccaccccu

SEQ ID NO: 39107 - RNA, 22 nt, Homo sapiens
gcacauguucugcggcccacca

SEQ ID NO: 39108 - RNA, 22 nt, Homo sapiens
gcggucccgcggcgccccgccu

SEQ ID NO: 39109 - RNA, 22 nt, Homo sapiens
ugcuguuagcccuagccccgca

SEQ ID NO: 39110 - RNA, 20 nt, Homo sapiens
uccccacagacccagagccg

SEQ ID NO: 39111 - RNA, 21 nt, Homo sapiens
uuuagcauaaguaugucccaa

SEQ ID NO: 39112 - RNA, 22 nt, Homo sapiens
ucaggaacugccuuucucucca

SEQ ID NO: 39113 - RNA, 23 nt, Homo sapiens
aagaaucuugucccgcagguccu

SEQ ID NO: 39114 - RNA, 22 nt, Homo sapiens
gccaccuucaaaugggaagucu

SEQ ID NO: 39115 - RNA, 23 nt, Homo sapiens
cacaaauucgguucuacagggua

SEQ ID NO: 39116 - RNA, 21 nt, Homo sapiens
uggggauuacacuucaacagg

SEQ ID NO: 39117 - RNA, 23 nt, Homo sapiens
cuacgcguauucuuaagcaauaa

SEQ ID NO: 39118 - RNA, 27 nt, Homo sapiens
auugcguucgaagugucgaugaucaau

SEQ ID NO: 39119 - RNA, 23 nt, Homo sapiens
gcgcccaauuaaugucuguugau

SEQ ID NO: 39120 - RNA, 22 nt, Homo sapiens
acaccgaggagcccaucaugau

SEQ ID NO: 39121 - RNA, 21 nt, Homo sapiens
ucgacugccacucuuacuaga

SEQ ID NO: 39122 - RNA, 21 nt, Homo sapiens
acaaugguuguccgauauuaa

SEQ ID NO: 39123 - RNA, 20 nt, Homo sapiens
cuggggaaaaggguggcacg

SEQ ID NO: 39124 - RNA, 22 nt, Homo sapiens
agagcaagaccccgucucuaaa

SEQ ID NO: 39125 - RNA, 22 nt, Homo sapiens
acccuuaucaguucuccgucca

SEQ ID NO: 39126 - RNA, 20 nt, Homo sapiens
cccgccgcgucgcccugggg

SEQ ID NO: 39127 - RNA, 22 nt, Homo sapiens
gaaccuaucuccccucuggacc

SEQ ID NO: 39128 - RNA, 22 nt, Homo sapiens
uaaccaaugugcagacuacugu

SEQ ID NO: 39129 - RNA, 22 nt, Homo sapiens
uaaccaaugugcagacuacugu

SEQ ID NO: 39130 - RNA, 21 nt, Homo sapiens
acccaguagccagauguagcu

SEQ ID NO: 39131 - RNA, 24 nt, Homo sapiens
cagaaagugcuuucuuuuggagaa

SEQ ID NO: 39132 - RNA, 22 nt, Homo sapiens
aacacucuaaaaggaggcacuu

SEQ ID NO: 39133 - RNA, 22 nt, Homo sapiens
gcaaaaguaauugccaguuuug

SEQ ID NO: 39134 - RNA, 22 nt, Homo sapiens
ugcaaaaguagucucaguuuuu

SEQ ID NO: 39135 - RNA, 19 nt, Homo sapiens
aaaaguaauuacaguuuuu

SEQ ID NO: 39136 - RNA, 20 nt, Homo sapiens
ugggccaccgccgagcggac

SEQ ID NO: 39137 - RNA, 17 nt, Homo sapiens
ggguggcagcgguggga

SEQ ID NO: 39138 - RNA, 17 nt, Homo sapiens
gggagaggaggaggcga

SEQ ID NO: 39139 - RNA, 18 nt, Homo sapiens
aucacauucaccucccug

SEQ ID NO: 39140 - RNA, 22 nt, Homo sapiens
agaaaaugccccucaguuuuga

SEQ ID NO: 39141 - RNA, 23 nt, Homo sapiens
gggagugaagacacggagccaga

SEQ ID NO: 39142 - RNA, 22 nt, Homo sapiens
cacugguacaaggguugggaga

SEQ ID NO: 39143 - RNA, 22 nt, Homo sapiens
ucaggaacugccuuucucucca

SEQ ID NO: 39144 - RNA, 22 nt, Homo sapiens
ucagaccgagacaagugcaaug

SEQ ID NO: 39145 - RNA, 22 nt, Homo sapiens
ccucauggaaggguuccccacu

SEQ ID NO: 39146 - RNA, 22 nt, Homo sapiens
gcaaaaguaacugcaguuuugg

SEQ ID NO: 39147 - RNA, 22 nt, Homo sapiens
caagacacauuuggagagggac

SEQ ID NO: 39148 - RNA, 21 nt, Homo sapiens
caucaccuuccuucuccucca

SEQ ID NO: 39149 - RNA, 20 nt, Homo sapiens
uacugcuuccacagcucccc

SEQ ID NO: 39150 - RNA, 21 nt, Homo sapiens
cuagggaagaacagugagcaa

SEQ ID NO: 39151 - RNA, 22 nt, Homo sapiens
cuggagagacaaggggaagagg

SEQ ID NO: 39152 - RNA, 22 nt, Homo sapiens
aggucucacuuuguugcccaga

SEQ ID NO: 39153 - RNA, 20 nt, Homo sapiens
uaugaacaauuucuaggaau

SEQ ID NO: 39154 - RNA, 20 nt, Homo sapiens
cccugcgccaucuccucuac

SEQ ID NO: 39155 - RNA, 21 nt, Homo sapiens
cggggugcacgggcggagggc

SEQ ID NO: 39156 - RNA, 23 nt, Homo sapiens
gggagugaagacacggagccaga

SEQ ID NO: 39157 - RNA, 22 nt, Homo sapiens
cagaaagugcuucccucuagag

SEQ ID NO: 39158 - RNA, 22 nt, Homo sapiens
ucaggaacugccuuucucucca

SEQ ID NO: 39159 - RNA, 22 nt, Homo sapiens
agcugaguguaggauguuuaca

SEQ ID NO: 39160 - RNA, 23 nt, Homo sapiens
aaagucucgcucucugccccuca

SEQ ID NO: 39161 - RNA, 19 nt, Homo sapiens
auuuugguacagcagcuca

SEQ ID NO: 39162 - RNA, 25 nt, Homo sapiens
accaacggaccuacuucccuccgcc

SEQ ID NO: 39163 - RNA, 23 nt, Homo sapiens
cacugugggcccucuccgcacca

SEQ ID NO: 39164 - RNA, 23 nt, Homo sapiens
gucacaucccucccaagacccuc

SEQ ID NO: 39165 - RNA, 21 nt, Homo sapiens
aaagagaccgguucacuguga

SEQ ID NO: 39166 - RNA, 21 nt, Homo sapiens
ccgugguucuacccuguggua

SEQ ID NO: 39167 - RNA, 22 nt, Homo sapiens
uccacauggaguugcuguuaca

SEQ ID NO: 39168 - RNA, 22 nt, Homo sapiens
agccacaaucaccuucugaucu

SEQ ID NO: 39169 - RNA, 21 nt, Homo sapiens
agcuaugccagcaucuugccu

SEQ ID NO: 39170 - RNA, 21 nt, Homo sapiens
aagacgggaggagaggaguga

SEQ ID NO: 39171 - RNA, 21 nt, Homo sapiens
gaccaagaaauagccuuucaa

SEQ ID NO: 39172 - RNA, 21 nt, Homo sapiens
acaaaccacagugugcugcug

SEQ ID NO: 39173 - RNA, 18 nt, Homo sapiens
acccucugaaaggaagca

SEQ ID NO: 39174 - RNA, 22 nt, Homo sapiens
aaagugcuucuuaccuccagau

SEQ ID NO: 39175 - RNA, 21 nt, Homo sapiens
caguagagauuguuucaacac

SEQ ID NO: 39176 - RNA, 21 nt, Homo sapiens
cuacgcagaaaggacacagug

SEQ ID NO: 39177 - RNA, 22 nt, Homo sapiens
cacaaaccauuaugugcugcua

SEQ ID NO: 39178 - RNA, 22 nt, Homo sapiens
uguaaaccaugaugugcugcua

SEQ ID NO: 39179 - RNA, 22 nt, Homo sapiens
cgccaauauuuacgugcugcua

SEQ ID NO: 39180 - RNA, 21 nt, Homo sapiens
gccaauauuucugugcugcua

SEQ ID NO: 39181 - RNA, 22 nt, Homo sapiens
acggaagggcagagagggccag

SEQ ID NO: 39182 - RNA, 21 nt, Homo sapiens
uucuaggauaggcccaggggc

SEQ ID NO: 39183 - RNA, 22 nt, Homo sapiens
uucaaaacaugaauugcugcug

SEQ ID NO: 39184 - RNA, 21 nt, Homo sapiens
acaaaccacagugugcugcug

SEQ ID NO: 39185 - RNA, 19 nt, Homo sapiens
gccugcugacaccgugccu

SEQ ID NO: 39186 - RNA, 19 nt, Homo sapiens
gccucagaggcagcugcuu

SEQ ID NO: 39187 - RNA, 22 nt, Homo sapiens
ccucaggcacggccgggccacc

SEQ ID NO: 39188 - RNA, 20 nt, Homo sapiens
uacugcuuccacagcucccc

SEQ ID NO: 39189 - RNA, 17 nt, Homo sapiens
gggagaggaggaggcga

SEQ ID NO: 39190 - RNA, 18 nt, Homo sapiens
aucacauucaccucccug

SEQ ID NO: 39191 - RNA, 21 nt, Homo sapiens
acuagacugugagcuccucga

SEQ ID NO: 39192 - RNA, 21 nt, Homo sapiens
gaccaaucgccguccccgccg

SEQ ID NO: 39193 - RNA, 21 nt, Homo sapiens
acaggauugagggggggcccu

SEQ ID NO: 39194 - RNA, 23 nt, Homo sapiens
ccaccuggcaagaacaggcguuc

SEQ ID NO: 39195 - RNA, 22 nt, Homo sapiens
gcggucccgcggcgccccgccu

SEQ ID NO: 39196 - RNA, 21 nt, Homo sapiens
caucaccuuccuucuccucca

SEQ ID NO: 39197 - RNA, 21 nt, Homo sapiens
ccccucccagccucccugcca

SEQ ID NO: 39198 - RNA, 22 nt, Homo sapiens
cugggggcggcacaggggcuca

SEQ ID NO: 39199 - RNA, 23 nt, Homo sapiens
cuaucugcacuagaugcaccuua

SEQ ID NO: 39200 - RNA, 22 nt, Homo sapiens
cggugagcacccggccccugcg

SEQ ID NO: 39201 - RNA, 22 nt, Homo sapiens
uggcagcagcggagggggcaga

SEQ ID NO: 39202 - RNA, 21 nt, Homo sapiens
ggaaaucccuggcaaugugau

SEQ ID NO: 39203 - RNA, 21 nt, Homo sapiens
gguaaucccuggcaaugugau

SEQ ID NO: 39204 - RNA, 20 nt, Homo sapiens
ccagcagcaccuggggcagu

SEQ ID NO: 39205 - RNA, 21 nt, Homo sapiens
auccuguacugagcugccccg

SEQ ID NO: 39206 - RNA, 22 nt, Homo sapiens
acuucaaggaucuuaaacuuug

SEQ ID NO: 39207 - RNA, 22 nt, Homo sapiens
aagagggagacccaggcucgga

SEQ ID NO: 39208 - RNA, 22 nt, Homo sapiens
ugcuguuagcccuagccccgca

SEQ ID NO: 39209 - RNA, 23 nt, Homo sapiens
cuaccugcacuguaagcacuuuu

SEQ ID NO: 39210 - RNA, 21 nt, Homo sapiens
aucugcacugucagcacuuua

SEQ ID NO: 39211 - RNA, 21 nt, Homo sapiens
cugggggacggagcagaagga

SEQ ID NO: 39212 - RNA, 26 nt, Homo sapiens
uuucagaauuugcugccaucaucauc

SEQ ID NO: 39213 - RNA, 23 nt, Homo sapiens
cuaccugcacuguaagcacuuug

SEQ ID NO: 39214 - RNA, 23 nt, Homo sapiens
cuaccugcacuauaagcacuuua

SEQ ID NO: 39215 - RNA, 23 nt, Homo sapiens
cuaccugcacuaugagcacuuug

SEQ ID NO: 39216 - RNA, 21 nt, Homo sapiens
acguggauuuuccucuaugau

SEQ ID NO: 39217 - RNA, 22 nt, Homo sapiens
aacauggauuuuccucuaugau

SEQ ID NO: 39218 - RNA, 23 nt, Homo sapiens
gaaagugcccucaaggcugagug

SEQ ID NO: 39219 - RNA, 22 nt, Homo sapiens
acacucuaaaaggaugcacuuu

SEQ ID NO: 39220 - RNA, 22 nt, Homo sapiens
aaccucuaaaaggaugcacuuu

SEQ ID NO: 39221 - RNA, 22 nt, Homo sapiens
auccucuaaaaagaugcacuuu

SEQ ID NO: 39222 - RNA, 22 nt, Homo sapiens
cacucuaaagggaggcacuuug

SEQ ID NO: 39223 - RNA, 23 nt, Homo sapiens
acagaaagugcuucccucaagag

SEQ ID NO: 39224 - RNA, 21 nt, Homo sapiens
caaaaaccacaaauaccuuug

SEQ ID NO: 39225 - RNA, 23 nt, Homo sapiens
cuaccugcacgaacagcacuuug

SEQ ID NO: 39226 - RNA, 22 nt, Homo sapiens
ggcucccaagaaccucaccugu

SEQ ID NO: 39227 - RNA, 22 nt, Homo sapiens
aggucucacuuuguugcccaga

SEQ ID NO: 39228 - RNA, 23 nt, Homo sapiens
cagcugcuuuugggauuccguug

SEQ ID NO: 39229 - RNA, 21 nt, Homo sapiens
gcggaacuuagccacugugaa

SEQ ID NO: 39230 - RNA, 21 nt, Homo sapiens
acaggauugagggggggcccu

SEQ ID NO: 39231 - RNA, 22 nt, Homo sapiens
cacuuagcagguuguauuauau

SEQ ID NO: 39232 - RNA, 22 nt, Homo sapiens
aguccagauucugugcccacca

SEQ ID NO: 39233 - RNA, 22 nt, Homo sapiens
acaguggucaucgagugacaca

SEQ ID NO: 39234 - RNA, 25 nt, Homo sapiens
aaggagcucagaagcccugcccagc

SEQ ID NO: 39235 - RNA, 22 nt, Homo sapiens
gcacauguucugcggcccacca

SEQ ID NO: 39236 - RNA, 21 nt, Homo sapiens
cggcucggguggcggcgacgg

SEQ ID NO: 39237 - RNA, 23 nt, Homo sapiens
cccaacagacauggcgguacuca

SEQ ID NO: 39238 - RNA, 22 nt, Homo sapiens
uucacacugcaugcucugggua

SEQ ID NO: 39239 - RNA, 22 nt, Homo sapiens
acugccugucugugccugcugu

SEQ ID NO: 39240 - RNA, 21 nt, Homo sapiens
gcggaacuuagccacugugaa

SEQ ID NO: 39241 - RNA, 21 nt, Homo sapiens
gcagaacuuagccacugugaa

SEQ ID NO: 39242 - RNA, 22 nt, Homo sapiens
cuuccagucgaggauguuuaca

SEQ ID NO: 39243 - RNA, 22 nt, Homo sapiens
agcugaguguaggauguuuaca

SEQ ID NO: 39244 - RNA, 23 nt, Homo sapiens
gcugagaguguaggauguuuaca

SEQ ID NO: 39245 - RNA, 22 nt, Homo sapiens
cuuccagucggggauguuuaca

SEQ ID NO: 39246 - RNA, 22 nt, Homo sapiens
cuuccagucaaggauguuuaca

SEQ ID NO: 39247 - RNA, 22 nt, Homo sapiens
accagguuccaccccagcaggc

SEQ ID NO: 39248 - RNA, 25 nt, Homo sapiens
acggagcugucccaacaccaccccu

SEQ ID NO: 39249 - RNA, 17 nt, Homo sapiens
uggaggccccagcgaga

SEQ ID NO: 39250 - RNA, 20 nt, Homo sapiens
uacugcuuccacagcucccc

SEQ ID NO: 39251 - RNA, 23 nt, Homo sapiens
ucacauaggaauaaaaagccaua

SEQ ID NO: 39252 - RNA, 23 nt, Homo sapiens
ucacauaggaaugaaaagccaua

SEQ ID NO: 39253 - RNA, 22 nt, Homo sapiens
acaacuguaacuagacgguuuu

SEQ ID NO: 39254 - RNA, 24 nt, Homo sapiens
agugugaguucuaccauugccaaa

SEQ ID NO: 39255 - RNA, 20 nt, Homo sapiens
cugcgggaggacagggcuca

SEQ ID NO: 39256 - RNA, 20 nt, Homo sapiens
ggcauucaccgcgugccuua

SEQ ID NO: 39257 - RNA, 23 nt, Homo sapiens
aaaaugcagauuccuggacucca

SEQ ID NO: 39258 - RNA, 21 nt, Homo sapiens
auguaggccuuuagaucacuu

SEQ ID NO: 39259 - RNA, 18 nt, Homo sapiens
auucaaucuacugccuca

SEQ ID NO: 39260 - RNA, 20 nt, Homo sapiens
uucccaugcccuauaccucu

SEQ ID NO: 39261 - RNA, 21 nt, Homo sapiens
ucuacucagaagggugccuua

SEQ ID NO: 39262 - RNA, 22 nt, Homo sapiens
acacucuaaagggaugcacgau

SEQ ID NO: 39263 - RNA, 22 nt, Homo sapiens
acacucuaaaaggaugcacgau

SEQ ID NO: 39264 - RNA, 25 nt, Homo sapiens
accaacggaccuacuucccuccgcc

SEQ ID NO: 39265 - RNA, 22 nt, Homo sapiens
caccugauaaaacugagguaua

SEQ ID NO: 39266 - RNA, 22 nt, Homo sapiens
uauccacuacaccccgcugccu

SEQ ID NO: 39267 - RNA, 24 nt, Homo sapiens
ucagagcauguguuuaaucaggcu

SEQ ID NO: 39268 - RNA, 21 nt, Homo sapiens
gagcugcauccuggcuccggg

SEQ ID NO: 39269 - RNA, 17 nt, Homo sapiens
uggcgcccgaacaggga

SEQ ID NO: 39270 - RNA, 22 nt, Homo sapiens
ccagaacugaguccacagggca

SEQ ID NO: 39271 - RNA, 21 nt, Homo sapiens
ugcaaacccugcaugugggag

SEQ ID NO: 39272 - RNA, 21 nt, Homo sapiens
aucugcacugucagcacuuua

SEQ ID NO: 39273 - RNA, 23 nt, Homo sapiens
gcuuugacaauaucauugcacug

SEQ ID NO: 39274 - RNA, 19 nt, Homo sapiens
accagugcccugcacacuu

SEQ ID NO: 39275 - RNA, 22 nt, Homo sapiens
cuggagagacaaggggaagagg

SEQ ID NO: 39276 - RNA, 18 nt, Homo sapiens
aucacauucaccucccug

SEQ ID NO: 39277 - RNA, 20 nt, Homo sapiens
cccgccgcgucgcccugggg

SEQ ID NO: 39278 - RNA, 22 nt, Homo sapiens
ucagccgcugucacacgcacag

SEQ ID NO: 39279 - RNA, 22 nt, Homo sapiens
cuguuccugcugaacugagcca

SEQ ID NO: 39280 - RNA, 22 nt, Homo sapiens
aucgggaggggacugagccuga

SEQ ID NO: 39281 - RNA, 22 nt, Homo sapiens
gaauucaucacggccagccucu

SEQ ID NO: 39282 - RNA, 22 nt, Homo sapiens
caagacacauuuggagagggac

SEQ ID NO: 39283 - RNA, 20 nt, Homo sapiens
cccugcgccaucuccucuac

SEQ ID NO: 39284 - RNA, 22 nt, Homo sapiens
gggagaggucucccugcgcaca

SEQ ID NO: 39285 - RNA, 22 nt, Homo sapiens
gggagaggucucccugcgcaca

SEQ ID NO: 39286 - RNA, 21 nt, Homo sapiens
aucugcacugucagcacuuua

SEQ ID NO: 39287 - RNA, 18 nt, Homo sapiens
ugguggcagaggugggau

SEQ ID NO: 39288 - RNA, 17 nt, Homo sapiens
ggguggcagcgguggga

SEQ ID NO: 39289 - RNA, 20 nt, Homo sapiens
uacugcuuccacagcucccc

SEQ ID NO: 39290 - RNA, 23 nt, Homo sapiens
aggaacagcagcagcccgggccg

SEQ ID NO: 39291 - RNA, 21 nt, Homo sapiens
gggcaucugggacgcgcagga

SEQ ID NO: 39292 - RNA, 18 nt, Homo sapiens
ggagaggagggcacugga

SEQ ID NO: 39293 - RNA, 24 nt, Homo sapiens
ugggagaaccucccugcuucugcu

SEQ ID NO: 39294 - RNA, 21 nt, Homo sapiens
aucugcacugucagcacuuua

SEQ ID NO: 39295 - RNA, 23 nt, Homo sapiens
gcuuugacaauaucauugcacug

SEQ ID NO: 39296 - RNA, 21 nt, Homo sapiens
acuccaaagggaagcgccuuc

SEQ ID NO: 39297 - RNA, 22 nt, Homo sapiens
cgcucuaaagggaagcgccuuc

SEQ ID NO: 39298 - RNA, 22 nt, Homo sapiens
ugcaagccuugggugugggagg

SEQ ID NO: 39299 - RNA, 22 nt, Homo sapiens
aguccagauucugugcccacca

SEQ ID NO: 39300 - RNA, 19 nt, Homo sapiens
guccugaauuccgcagccu

SEQ ID NO: 39301 - RNA, 22 nt, Homo sapiens
gcacauguucugcggcccacca

SEQ ID NO: 39302 - RNA, 22 nt, Homo sapiens
gggagaggucucccugcgcaca

SEQ ID NO: 39303 - RNA, 23 nt, Homo sapiens
gcacaugugcacacagccgggug

SEQ ID NO: 39304 - RNA, 21 nt, Homo sapiens
cucccccacugcagcuggcac

SEQ ID NO: 39305 - RNA, 21 nt, Homo sapiens
cugaggagagaggaggugggg

SEQ ID NO: 39306 - RNA, 22 nt, Homo sapiens
agcuagugagaagucaaugccu

SEQ ID NO: 39307 - RNA, 22 nt, Homo sapiens
agcuagugagaagucaaugccu

SEQ ID NO: 39308 - RNA, 21 nt, Homo sapiens
ucaaucacagauagcaccccu

SEQ ID NO: 39309 - RNA, 23 nt, Homo sapiens
aaaucagaaucacaccuggggga

SEQ ID NO: 39310 - RNA, 22 nt, Homo sapiens
auaaggauuuuuaggggcauua

SEQ ID NO: 39311 - RNA, 22 nt, Homo sapiens
uauggaugcaaaaugaucccaa

SEQ ID NO: 39312 - RNA, 22 nt, Homo sapiens
uuucaguuaucaaucugucaca

SEQ ID NO: 39313 - RNA, 21 nt, Homo sapiens
caaaaaccacaaauaccuuug

SEQ ID NO: 39314 - RNA, 24 nt, Homo sapiens
acgcagagcccgaaagcccccagu

SEQ ID NO: 39315 - RNA, 24 nt, Homo sapiens
acgcgcaggccagagacccaggca

SEQ ID NO: 39316 - RNA, 20 nt, Homo sapiens
aggggccucagccuccuggu

SEQ ID NO: 39317 - RNA, 22 nt, Homo sapiens
gguuaguggaccaggucacaaa

SEQ ID NO: 39318 - RNA, 23 nt, Homo sapiens
aaccaagaccccggagaucccag

SEQ ID NO: 39319 - RNA, 20 nt, Homo sapiens
uacugcuuccacagcucccc

SEQ ID NO: 39320 - RNA, 20 nt, Homo sapiens
cuggggaaaaggguggcacg

SEQ ID NO: 39321 - RNA, 22 nt, Homo sapiens
augcccuuuuaacauugcacug

SEQ ID NO: 39322 - RNA, 18 nt, Homo sapiens
aucacauucaccucccug

SEQ ID NO: 39323 - RNA, 22 nt, Homo sapiens
ccccucuggucaaccagucaca

SEQ ID NO: 39324 - RNA, 23 nt, Homo sapiens
acucaccgacagcguugaauguu

SEQ ID NO: 39325 - RNA, 23 nt, Homo sapiens
acccaccgacagcaaugaauguu

SEQ ID NO: 39326 - RNA, 22 nt, Homo sapiens
acucaccgacagguugaauguu

SEQ ID NO: 39327 - RNA, 23 nt, Homo sapiens
acccaccgacaacaaugaauguu

SEQ ID NO: 39328 - RNA, 22 nt, Homo sapiens
ugagccacugugccuggccuga

SEQ ID NO: 39329 - RNA, 21 nt, Homo sapiens
ggaaaucccuggcaaugugau

SEQ ID NO: 39330 - RNA, 21 nt, Homo sapiens
gguaaucccuggcaaugugau

SEQ ID NO: 39331 - RNA, 22 nt, Homo sapiens
aagcgguuuaccaucccacaua

SEQ ID NO: 39332 - RNA, 23 nt, Homo sapiens
acccaacagccccugcaagggau

SEQ ID NO: 39333 - RNA, 21 nt, Homo sapiens
cuggaggacggcaacagucag

SEQ ID NO: 39334 - RNA, 22 nt, Homo sapiens
agcugaguguaggauguuuaca

SEQ ID NO: 39335 - RNA, 22 nt, Homo sapiens
aaucagucucauugcuuuauaa

SEQ ID NO: 39336 - RNA, 21 nt, Homo sapiens
ugcaugacggccugcaagaca

SEQ ID NO: 39337 - RNA, 23 nt, Homo sapiens
ucucgugacaugaugauccccga

SEQ ID NO: 39338 - RNA, 22 nt, Homo sapiens
aaagacguggagaaauuagaau

SEQ ID NO: 39339 - RNA, 21 nt, Homo sapiens
guucuaacccauuguggccaa

SEQ ID NO: 39340 - RNA, 23 nt, Homo sapiens
cacaaauucgguucuacagggua

SEQ ID NO: 39341 - RNA, 22 nt, Homo sapiens
aggucucacuuuguugcccaga

SEQ ID NO: 39342 - RNA, 18 nt, Homo sapiens
aucacauucaccucccug

SEQ ID NO: 39343 - RNA, 23 nt, Homo sapiens
gggagugaagacacggagccaga

SEQ ID NO: 39344 - RNA, 22 nt, Homo sapiens
ucaggaacugccuuucucucca

SEQ ID NO: 39345 - RNA, 22 nt, Homo sapiens
ucaggaacugccuuucucucca

SEQ ID NO: 39346 - RNA, 22 nt, Homo sapiens
uggcagcagcggagggggcaga

SEQ ID NO: 39347 - RNA, 20 nt, Homo sapiens
cccgccgcgucgcccugggg

SEQ ID NO: 39348 - RNA, 20 nt, Homo sapiens
ccagcagcaccuggggcagu

SEQ ID NO: 39349 - RNA, 21 nt, Homo sapiens
uucuaggauaggcccaggggc

SEQ ID NO: 39350 - RNA, 21 nt, Homo sapiens
auccuguacugagcugccccg

SEQ ID NO: 39351 - RNA, 25 nt, Homo sapiens
aaggagcucagaagcccugcccagc

SEQ ID NO: 39352 - RNA, 21 nt, Homo sapiens
ggacuauagaacuuucccccu

SEQ ID NO: 39353 - RNA, 24 nt, Homo sapiens
acgcgcaggccagagacccaggca

SEQ ID NO: 39354 - RNA, 22 nt, Homo sapiens
gcugaggcuguggggcuggagu

SEQ ID NO: 39355 - RNA, 20 nt, Homo sapiens
uacugcuuccacagcucccc

SEQ ID NO: 39356 - RNA, 24 nt, Homo sapiens
ucagagcauguguuuaaucaggcu

SEQ ID NO: 39357 - RNA, 22 nt, Homo sapiens
gugggguggguggucaggccga

SEQ ID NO: 39358 - RNA, 17 nt, Homo sapiens
gggagaggaggaggcga

SEQ ID NO: 39359 - RNA, 21 nt, Homo sapiens
gaccaaucgccguccccgccg

SEQ ID NO: 39360 - RNA, 22 nt, Homo sapiens
cgggacguccagacucaacucu

SEQ ID NO: 39361 - RNA, 21 nt, Homo sapiens
acccaguagccagauguagcu

SEQ ID NO: 39362 - RNA, 23 nt, Homo sapiens
acacuuacuggacaccuacuagg

SEQ ID NO: 39363 - RNA, 22 nt, Homo sapiens
aggaaaccagcaaguguugacg

SEQ ID NO: 39364 - RNA, 22 nt, Homo sapiens
cucagagcagacgugguucuca

SEQ ID NO: 39365 - RNA, 22 nt, Homo sapiens
gcggucccgcggcgccccgccu

SEQ ID NO: 39366 - RNA, 21 nt, Homo sapiens
ccccucccagccucccugcca

SEQ ID NO: 39367 - RNA, 25 nt, Homo sapiens
aagaaagagucuugcuuugucgccc

SEQ ID NO: 39368 - RNA, 24 nt, Homo sapiens
acugcuggucuucagucagggcca

SEQ ID NO: 39369 - RNA, 24 nt, Homo sapiens
acugcuggucuucagucagggcca

SEQ ID NO: 39370 - RNA, 21 nt, Homo sapiens
gaccaaucgccguccccgccg

SEQ ID NO: 39371 - RNA, 20 nt, Homo sapiens
cccgccgcgucgcccugggg

SEQ ID NO: 39372 - RNA, 23 nt, Homo sapiens
caugagugacgcccucuggagua

SEQ ID NO: 39373 - RNA, 22 nt, Homo sapiens
gcggucccgcggcgccccgccu

SEQ ID NO: 39374 - RNA, 20 nt, Homo sapiens
aggggccucagccuccuggu

SEQ ID NO: 39375 - RNA, 22 nt, Homo sapiens
ugcuguuagcccuagccccgca

SEQ ID NO: 39376 - RNA, 22 nt, Homo sapiens
auacauacuucuuuacauucca

SEQ ID NO: 39377 - RNA, 21 nt, Homo sapiens
agggcucaucuugguccugca

SEQ ID NO: 39378 - RNA, 23 nt, Homo sapiens
gggagugaagacacggagccaga

SEQ ID NO: 39379 - RNA, 21 nt, Homo sapiens
gggcaucugggacgcgcagga

SEQ ID NO: 39380 - RNA, 23 nt, Homo sapiens
cccaacagacauggcgguacuca

SEQ ID NO: 39381 - RNA, 25 nt, Homo sapiens
agcuagucaagcgcgguuguggggg

SEQ ID NO: 39382 - RNA, 22 nt, Homo sapiens
ccacacacuuccuuacauucca

SEQ ID NO: 39383 - RNA, 22 nt, Homo sapiens
aagcgguuuaccaucccacaua

SEQ ID NO: 39384 - RNA, 22 nt, Homo sapiens
auaaggauuuuuaggggcauua

SEQ ID NO: 39385 - RNA, 22 nt, Homo sapiens
ccucauggaaggguuccccacu

SEQ ID NO: 39386 - RNA, 22 nt, Homo sapiens
ccuggcacacaguagaccuuca

SEQ ID NO: 39387 - RNA, 20 nt, Homo sapiens
ggcaaagaaggaacauuccu

SEQ ID NO: 39388 - RNA, 22 nt, Homo sapiens
ugcuguuagcccuagccccgca

SEQ ID NO: 39389 - RNA, 22 nt, Homo sapiens
auccuucuacaaauucacccau

SEQ ID NO: 39390 - RNA, 22 nt, Homo sapiens
ucucucccauuagaguugaaaa

SEQ ID NO: 39391 - RNA, 21 nt, Homo sapiens
acuagacugugagcuccucga

SEQ ID NO: 39392 - RNA, 22 nt, Homo sapiens
uggcagcagcggagggggcaga

SEQ ID NO: 39393 - RNA, 22 nt, Homo sapiens
uccacauggaguugcuguuaca

SEQ ID NO: 39394 - RNA, 20 nt, Homo sapiens
ccagcagcaccuggggcagu

SEQ ID NO: 39395 - RNA, 23 nt, Homo sapiens
agaggcaggcaugcgggcagaca

SEQ ID NO: 39396 - RNA, 21 nt, Homo sapiens
auccuguacugagcugccccg

SEQ ID NO: 39397 - RNA, 23 nt, Homo sapiens
guagugggccgagccgagugaca

SEQ ID NO: 39398 - RNA, 21 nt, Homo sapiens
cugaggagagaggaggugggg

SEQ ID NO: 39399 - RNA, 18 nt, Homo sapiens
ugguggcagaggugggau

SEQ ID NO: 39400 - RNA, 17 nt, Homo sapiens
gggagaggaggaggcga

SEQ ID NO: 39401 - RNA, 24 nt, Homo sapiens
acugcuggucuucagucagggcca

(The sequence listing continues in the following parts.)

What is claimed is:

1. A method of increasing expression of a TROAP gene in a cell comprising contacting an endogenous miRNA complementary to a portion of a promoter of the TROAP gene with a single-stranded complementary oligonucleotide that hybridizes to the miRNA, thereby increasing expression of the TROAP gene.

2. The method of claim 1, wherein the miRNA targets a non-coding RNA (ncRNA) transcribed from the promoter.

3. The method of claim 1, wherein the single-stranded complementary oligonucleotide comprises at least one locked nucleic acid (LNA) base.

4. The method of claim 1, wherein the single-stranded complementary oligonucleotide comprises at least one 2'-O-methyl (2'-O-me) base.

5. The method of claim 1, wherein the miRNA is 80%, 85%, 90%, 95% or 100% complementary to the portion of the promoter.

6. The method of claim 1, wherein the single-stranded complementary oligonucleotide is the same length as the miRNA.

7. The method of claim 1, wherein the single-stranded complementary oligonucleotide is shorter than the miRNA.

8. The method of claim 1, wherein said cell is located in situ in a host, and the contacting step is effected by administering to the host an effective amount of the complementary oligonucleotide.

9. The method of claim 1, further comprising detecting a change in the expression of the TROAP gene.

10. The method of claim 9, wherein detecting comprises inferring a change in the expression of the TROAP gene from a physiologic change in the cell.

11. The method of claim 9, wherein the cell is located in situ in a host and detecting comprises inferring a change in the expression of the TROAP gene from a physiologic change in the host.

12. The method of claim 9, wherein detecting comprises one or more of Northern blot, PCR, immunohistochemistry, Western blot or ELISA.

13. The method of claim 1, wherein said portion lies between −200 and −1 relative to a transcriptional start site of the TROAP gene.

14. The method of claim 1, wherein said portion lies between −500 and −201 relative to a transcriptional start site of the TROAP gene.

15. The method of claim 1, wherein said portion lies between −2000 and −501 relative to a transcriptional start site of the TROAP gene.

16. The method of claim 1, further comprising the step of identifying the endogenous miRNA.

17. The method of claim 16, wherein identifying comprises identifying an miRNA seed region is the promoter.

18. The method of claim 17, wherein identifying comprises calculating a minimum free energy for said seed region.

19. A method for identifying an endogenous miRNA that modulates expression of a TROAP gene:
(a) identifying an endogenous miRNA exhibiting complementarity to a portion of a promoter of the TROAP gene; and
(b) assessing the ability of the complementary miRNA to modulate expression of the TROAP gene.

* * * * *